United States Patent 12,642,819 (COMPOSITIONS AND METHODS FOR TREATING INFLAMMATORY BOWEL DISEASE) - sequence listing, part 94

SEQ ID NO: 49 - DNA, 2944788 bp, Lactobacillus rhamnosus (residues 1-1,472,394 of 2,944,788)
  modified_base (670520)..(670616): a, c, t, g, unknown or other
  modified_base (1020827)..(1020924): a, c, t, g, unknown or other
  modified_base (1415060)..(1415158): a, c, t, g, unknown or other
  modified_base (2341581)..(2341679): a, c, t, g, unknown or other
  modified_base (2861685)..(2861783): a, c, t, g, unknown or other
  modified_base (2930296)..(2930523): a, c, t, g, unknown or other
tccaaacggagcttgccattaactatctgggcacgatccgttctaaaagttttacgtgagcgctttttcgacttccatttaggcttttcatgatttggcattttaggattgaagtagtttgcccacgccttacttaaatcattcacagcaagctgtaagacgcgtgctgatcgttcaaattgccaatctgctttgttcataaccagttcatcacgaacttttcgctcattaggccgtatcgacttatccatcatgactaaagaagcatcatacatgtcattccagacctcaagcccttggttccaaacgaagcgtcgataatcaaacagtttttctagttctttacgcatggttgcattgggatatagcttgatcttatgtgttttaatcaaaagtgttcacctcccttcaagttaactaaaggacttacttcaaagacggatcgtcttcaatctttttcttgtatttacgtaagccggataaccgacacgaaaataagtgaatgatactaattaagtcttcagttagctcttcttgaggtgatagattaggatgattcaatcccacaagctgcgggttgaatttttggggttaggcgctcaaaccaatcatagccaaaacatacgcaactggtcgatgtttctttgactcatcagcatgaccaatacaggctaggtgttgatcttctgtgtcataacatcgattagtcggtgctatgtgggctttgaactttctagacttatcccacttctgcagtgacaccgaggcgtttagccattttgtctggtttgagcatatgagcatcttccacttaattatcgtgctcataacataccatattacgctacattgttatatatatttatctgctgttaatcacctcctaatgaaagtgagcgtgagcaggagcgcttagcaatcggagtgtaagtggcctcaggcgtgatggccgggctttggccattgcgttcgaggtccttacacgcagactgctgcgctggggagcgcgtgatgataagcgcaaccaaatttcgttaacctgtctctctagcaaccaataaaaccatttcctaactgcaaacacagtgtaatttgtgtaacgcgttacaggtcaagtgctttcacactaaaattttcacttttttatatggaccgcgaaaaccggcgcgcttagggagcggagtgtcagcggccttgggcgtgatgatcgctctttgcccctcgtgaccaaggtccttacatgtagatccctgtgtcagtgaacgcgttaaggtcctgcaaacttacagtgtcttacaaaaaagtcagaatgagtgcggacgggtcgtgttttccatataatggatgggagtacaaacacggagggcgcaaaataatgaagagactttttcgaaaagtcggaacgttttttaaaaaacatctcacaacgttaaaggtgctatttgtgctggcagtccttgtgtttgtgattttcgaggttggccgtattagtcaagatctcagcggcgaacaaatgcgggcgagcctagccacgcaaagtcccggttcactgatcattttgctaatcgtgggcttgattgctgtgacgccgatgctgacgtatgattttgttattaccgaattactgccgggcgactatccacgccgatatgttattaagtccggttggattgttaatacatttacgaatattgccggttttggtggcttgctgggagccagtttgcgggccaatttctatcatgaaaaggcaacgcagaagcaggttttatttgctatttctaagatcgctatgttcctgttggcaggcttgtcgctgtggtcaatgattgggattgtgattatctttgttttcgggattggcgctgaattttccaattattggatttggctagttgggggcgcagcgtattttccattgttgatgttcatttcccatgtgcgcgacagtgagttcttcgcggatatgccattaaagcggcagttgcgcttaacattaggctcgtttctggagtggggtgggtgtgcagctttcttcctgctcattggttattttcttgaggtccggattccgttgatgtcagtgttgccgctatttatggtagccaatgtgatcggggttatttcaatggtgccaggtgggctgggttcatttgatgtgttcatgatctttgaactcggacagttgggactggatagcaatgttgctgttgtgtggctgttgttttatcgattgttttactatgtgattccatttctgattggtgccggtctgtttgctcaagatgcagggaaacgtctgaatgcctatcttgaaggcttgccggttcagctgattcgtaaagttgcgttcggttttttggttattttcctgtacttttccgggatcatgttgctgttgcgcggagtagcaccggacttggcgtttcggaatacgctttatcaacgactatatccgtatacattcctattcttggatcgggtgacgaatgtggttgtggcattcctgattctggggtttgggcgtggtattgccagtcgtgtcaaacgcgcttattggccgactgtcatcgtcttgatcgtcgccatgattgcgtcattgcgcgaggacaatcacctgcgttttatcgtctttttggtattggttgtcctggccttgattttgacgcggcgggaactgactcgtgaacggctggccttatcgtggggcaataagctgattgatggggcggtttttggcctgacattcatcttttatgcattcgccgcgttttataatgccccggcgattcaccatcgtcatgtgccggacgtcttcttattcccgtccgagcgcatgtttttcacgactttaatcggggtcatgctggcggcgttaacagtgtacttaatcttccgttacttgtcggcgccttccaaaccattggcggatccctatgatgaggagcgcttaaaggcagtggttgaaaaatatggcggcaatgaagtcagtcatttggctttgatgcgtgataagtcgctgcacttttaccaagtagacggtgaggatcgagttttcttcttattcaaaaagaaagctgacaaactgattatcatgggcgaaccgatcggggatgaaacccaaatggctgcggcaattggtgatttcatgaaaaaggccgataagcaggatctatcactggtgttttatgaaatcaatgaaagcctaacgatgaagctgcacgagtttggttttgattttatgaagtttggtgaagaaggttatgtggatgtcacgacctttaccttggcgggatcaaaacgcaaaggcgaacgcgcattaatgcataaattcgaacgggaagggtatacggttgaattactgcagccaccgtttgacgatgcgttaatgcaggaactcaaagcggtatccgattcgtggttggctgggcgcagcgaaaaaggatttagtctcggctttttcgatcgccattatcttaatcaggcaccgattgcggttgttcgcggcccggaaggtaagatcgttgcgtttgcttctgatatgccaagtggtaatcaggaagttaccagtattgacttgatgcgttcaagtgctgatgcgccgtcaggaattatggatgaggtgtttatcaacctgttccaattagccaagcagcgcggttttaagtatttcaatatgggcatggcgccacttgccaatgtgggaacgtctgactattctttcatcgaagaaaagattgcccatttggtttatgaatatggctatcgattctatggtttccaaggattacgctcatataaaaacaaatacgtaacagagtgggttcctaaatatgtcgcttatcgtaagcggacatccttactgttcacgttgttgcagattatgatggtggttaatcaaaaagtgaccattgcatcgcctgttaagtggtggcctaagcgtttggcttgggtaagccgtcttggccagggaattgacaaataagcagtcggtggtagatgcgggctagtgaggtacgcatgcttgcagacaaagtgtaaaatagtcgttaaagtaaatctaaacgcgattgtttgctcggatctacctgtgccgagttgcacgcatgctcatgttcaaggaggtttttatgcagcattattatacgaacgatcctgatcttgcccacgatgaacgcacttttgatttcgaacttggcggtcatcgtttgcgtttcaccacggacaacggcgttttttcaaagcataccgtggatttcggcagtcgcgtactgattgcagcggtcttggccgaaaccttgcctgatgggccgattcttgatgttggcgctggctatgggccaatcgggttggcactggcaaagcattttccgaaccggcaagtgacgatgagtgatgtcaatgaacgggcacttgccttggcaaagcaaaacgcggctgataatggcatcaccaatgtttcgatcatcgaaagttctatgtacgacagcattgatgatcagtttgcggtcgtcgtgaccaatccgccgattcgtgccggtaaagccattgtttccggcattctttccggagcagccgcgcatcttttgccaggcggccagctgtatgcggtcattcaaaaaaagcaaggtgcgccttctgcattaaagttaatgaaagccacttatgccaacgcggaagttattaagaaagagcacggttattacattctcaaagcgagtaaataacagttttaatacgtgacgtggtacactcatactaggatagaaaggagcagatttagatggcaaattcgaagtacctagcagcaggtgcggttgccgctgctgtcattgcaaccggcgcatttgtttgtgccaagaatttaacggaatattttgaacgcaggcatcagcggaaacaggttgaaggcttcgtcaagaagatttttggtgacaatgagcgggttcaaagcattttggacaaattaagcgatgatgacgtggccaatctgctccgggtcagtgataagttgcgcagcctcaaagacagcgccagtgagtatgccggatcagcacgcgaacaagggctggccgcatttgatcgcttgaaagcagcattgagtcgttgagcgtttgaaacagttttaaagaatcaagcatctaaaaagaaccggccatgggaaaatttccttgtgggcggttcttttaaatggttacaataagaagaaccggtatgaggcgagtttggcggtatatgaacccgctggaggcttgtgctgataatcacactaaaatggaggccgctttttcacgatggcaatgacggattcggaaatcaatcaatatatgatcgcggcactggtcgaagcaaaaaaagcagcggctatcggcgaggtgccaattggagccgtcgttgtgcatgaccagcaaatcataggtcgtgggtataacttgcgcgagacgacgcaggatgcaacccagcatgcggaaatattggcgattcaggcagcctgccgtcaacttggcacctggcgtttagaagattgcagtttgtttgtcacattagaaccttgtcctatgtgcgcaggggcaatgattaatgcaagaattgctacctgttattttggtgcgactgatccgaaagcaggggtagcgggtactttttataatttgctggaagatacccgattcaatcaccaagttgctgttgttcccgggattcaagccactgcaagtgctgccttattgcaagattttttccgtgcgatccgggcaaaacgaaaagcggccaaacaggctggtcaaacggatcaaaatcaggtataatggtttttgccgcaaggccttaaggcaatgatggctttccgaattgtgtcaggtccggaaggaagcagcactaaggtaggttcgtcatgtgccttttgttattgagaaattgaccggtcgctttgttataaagcggccgtttttgttgtcagaatacaaggcatcttctggcttggctatggtaaactagaacgaggctttatgctaaacgattgaaatgttaagccattcatgagggggcgaaaaggtgagttatcaagcgttgtatcgggtctggcgcccgcagcaatttaaggatgttattgggcaggatgcgattaccaagacgctgaagaatgcgttgatcaccggacaaacgagtcacgcctatctttttactggccccaggggaaccgggaaaacatcggtcgcaaaaattttggccaaagcgttaaattgtctacaccttgaagatggtgagccggacaatacttgtgaaatttgtcaggcgattaacgatggcagtctgaccgatgtgattgaaatcgatgctgcatccaataatggcgtcgatgaaattcgggacattcgcgacaaggccaagtatgcgccgacacgagcacgcgttaaggtgtatatcattgacgaagtacacatgttatcaaccggtgcgttcaatgcgttattaaaaacgttagaagaaccgccagcacatgtggttttcattctcgcaaccaccgagccgcataaaattccggcaacgattatttcgcggacgcagcggtttgattttcgccggattacgccagaagatattgtgaagcggatgcgctttatccttgatgacaagcagatcacctatgatgatgcagcactcaaggtcattgccaaagcagctgaaggcggcatgcgtgatgccttgtcaatcctggatcaagtgttgagttttggcgataatcacgtgacgactgaggatgcgcttgatgtcaccggtggcgtcaccacagccgttttaggcaaatatctggcggcggtgttggctaaggatcatgcgcaggctttgaaaatggtcgaggacttgctggcagccggtaaagatgccggtcgcctcattgaagacctgattgagtatctgcgtgatttattggtcaatcaacaagcacctgcgttattaggcgagttagaaaaaagcctgctagacgatcaattcaagattttgagtgaaaacttcaaaccggcgcagatttaccatatgattgacgtgttaaatacgacgcagcaacaattgcggatgaccaatcacccggaaatttatctggaagttgccacggttcggctaagcgagaccgctaaaccggttgtcgaagctgcgcctgagcccgccgtgacgccgcaacttgagcagctatcggccaaagtcaaacagttgagcgatcaacttaagcgggtagaagcaaatggtggtacgattgcaccgccaccgcgtacccgccgagtcaaaaaacaaaaagccaatcatgttaatcgtaaggcaatttatccgattctcggcgcggcaaccaagcaggatttaaccaatttaaaagatgtctggcctgaccttttgggaatgctgagtattaccaaacgtgcgatgatgaaagtcagtgagccggtagcagccagtccggatggcgtgattgtcagcttcgactatgatattttagttgaacgggccatgaacgatgcggccttaatgacagaactggaaaccggattgcagaagttgaccggcaagcagcccaagattgttttggtacaaagcgatgtctggccgaccattcgcaaggaatatattcaggaactcaaggcaccggcagctaaggcagaaacgaaagagactaagccacagacgcccccggttgtcagtaaactgactgaactttttggcaaagatgcacctaatgtgacaatcaaaaatgactagtaaaggatgatcaaatatgcgtggaatgggtaatatgcaaagtatgatgcggcagatgcagaaaatgcaaaaagagatgcaggccgcgcaaaaagaactatacgcgacagaattcgaaggtaaatctgcttctgacatggtgaccgttaaattcagcggtgagaaagtcatgaaagatattcagattaaaccggaagcaattgatccggatgatccggatatgttgcaggatctgatcattgaagcagtcaatcaggcaatggccgacattgacaagcaaacgcaggataaacttggcaagtatacacgcggacttccgatgtaacccaccatcaagcggattctgtaagcgaagacgccgcggttaatggcggttagtcgaatcatgtagatgataaagctgttcgtcatttagcacgatagcgatcacgattttagcaagaggggttactatgcaatatccggaaccgatcagtaagttaattgatagttatatgcgcttacccggcattggcgctaaaacagctactagactggctttttataccattgatatgaacaaagacgatgttacggcatttgctaaaagtctggtcgcggctaaagaagatctgcattattgttcgatctgcggcaatattaccgatgaagatccgtgtgcaatttgtcgtgacaaaaatcgcgatcaaagcaccatcttggtcgtcgaacagcccaaagacgtcatgagtattgatcgggctcaagactaccatggcctttatcatgtgttgcatggggtgctatcgccaatcgagggtcgcggcccggaagaccttaacattgaaagccttttgaagcggctgaaaaagaataccgccgtcaaggaagtcattattgcgaccaatgcaacgccagaaggggaagcaacagcccaataccttgcgcgccttatcaagccggctgggattaaagtgacgcgtttagctcatggcctttcggttggcagcgatattgagtatgccgatgaaatgaccttaatgaaggcggttgaaggaaggactgagctgtaatgttcggacgcaagcagatcaaggtcaaagaagaaaaagacgaagaactcatgatgcttgtttatcgagttcgtgatcagatggcggcacaacggaagctcgtggcaactttccgtgaggttgatgaccagacaaaatcacaagtcgcgctgcaagcagctttattcgattttctctatcgtgaggcgcgcacccgcaagatcaagggtgaaattgtagccaaagttgcggctgaacaaattgcggagttccgggatcagtaacagtcagctgctcgaaccggtttccttttggtcgggacaagtgcttcgcggtgatgttagaagcacgcgatatttcacattaacggtaaatggtgatgatctctttttcagatctaagcatttaccgtttttatgtcgctgtaagtcttggtgcatgacttttatgaaacggatttaaagataagtttttaattgtgaaacatttcaagtaaaatggacttaattccaaaaaaggagcggcatatcgtgacaggcacttttatcaccttcgaaggtcccgatggcgcagggaaaaccagcgtcttgaatacattaattcctaaattaaaggcgtgttcggttacttctgtgcatcttacccgtgaacccgggggcgcgaaaatttccgagatgattcgggatgtgattcttgatcccaagaatacggccatggatgcacgcacggaagcattgctatacgcagcgtcacggcgccagcacttggttgaagtgattcagccggcgcttgctcacggggacatcgttgtttgtgatcgattcgtcgacagttccgttgcttatcaaggtggcggccggcaaatcggtacgcaagcggtgttacaaatgaaccaatttgcgaccgcggggctggaaccggatttgaccgtttatttggatgtgcctgtacaggtgggcttggatcggatcatggctcatcaaggcgaacgtcaatatgatcgccttgatcaggaaagtctggcctttcacgagcgggttcatgctgcgtacatgaaactggttgccgataatcctaagcgaatcgtcaccgttgatgcgactcagccacttgcggcggttgtcactgcggcgtttatgacgattacagagcggttcccggagttatttgcgaagtaaggaatggaatgcgctaggtcgtgtgcgacaatgctaactagcgcagggaggatattatgaagctgattcttgcaattgttcaagacaaagatagtaacctgttaagcagccaatttattgatgctaatattcaagcgaccaagttatcgacgactggtggatttttaaaagccggcaacaccacttttattatcggtgtcgctgacgaacgggttgatgaagtgcttaagattattaaagagacttcccagacgcggcaacaatttatgacgccgccagttaatcttgatgcgacatcagatagttcgattgcgtatccggttgaggttcaagtcggtggggctaccgtcttcgtgctgccgattgaagcctttcatcgcttctaatggctgattttctgattaacacgctgcagcctaagcttgttgcccaatttgcccgcgtcattgatcggcaccaattggcccagtcctatttgtttgtggggccaaaaggagcagggaagttagcgctggctgagtggattgcgctgcgcctattttgccagcatgtccaagacggtgctccttgtggcgagtgtcctgagtgcgagcgcatcttaaaccataatcatccggatgtgatgatgctcaaaaccagtacgcaaagtatcaaggtggatgacattcgcaacttgaaacaggaaatgagcaaaaccggggttgaaggcaatcagcgcgtgtttattgtggaagatgctgataaaatgacggcaggagcggccaattcactgctaaaattttttgaagaaccggttccggggatgacggtgattttaacggcgacggctaagaatcagttattgccgacaattttatcgcgggcacaggtgattacttttcagagtccggatcgtaacgctgtgattaccaagctggaagaaggcggagccaattcgcagctggcgcgagtggcagggcgcttaaccggtaatgtcagtgaagcgcaggaactattggcgtctgatgattttcaggatcgggttaatcgggtttttcagttattagaccgattagctgatcatgatccggaaagtttcgtgcgcgtgcaaacccagttactgccggttgccaaagatgccgaggcacagcgacaagtcttggcattgatcggactggcttatgcggatgccttaaatcgtcattttcaagtgaatgccccgcagcagctggacattcctgcaattggcattttggctaagttatcaagccgccagttaaccgcttccttacaagctattttgacagcacaggtgcggttaacgcagaatgtgacgtttcaatcggcaacagaacagttaatgcttaaactcttagaagggtgatcttgtggaaaagaaagaactgtacgatggtttcctagtccttgagaaacacgcccagcagatgctcaaggaaattgcggcgatgaaagatgatatggcggagacgcttgaacgcaatgcggaacttgaaatcgagaataagcatctgcgtcaacacttggctgaactggaaaaagacgacaacaaaaccagtgacggcggcgttgaactatcaaagtcaaagcaaaacctagaaagcctctataatgaaggcttccatgtttgcccaatgttttatggccagcgccgggtcaatgacgagccatgtgcgttttgtcttgatattatttatggggagaattgatttggagcagcaacgaagctttggtacccatacaaccggtacgttatatttagtcccgacgccgattggcaatttagctgacatgacgattcgcgcagttgagcttttgaaaacggttgatcttattgcggctgaagatacccggcatacccagatgttgttgaaccattttgagattgctaccaaaacgatttcattccatgagcataatacccaaatgcgcattcccgaactgctcgcaaagctgcaaaacggtgtcaccattgcacaagtgagtgatgctggcatgccgtctatttcggaccccggtaaagaattggtacacgcggcgattgaagccggcataccggttgttccactgccgggtgctaatgcggccactaccgcattgattgcgtcagggttgccaccgcagccatttttattttacggctttttaccgcgcaaaacgggagaaaagcagcgcgtgttagaaaagctgtcaagcgaaccggcgaccttgctattctatgaaagtccccatcgagtaggcaaaacgcttgcggcgatggtagcggtgtttggcgatcggcaggcggctttggcgcgggagttgactaaaaagtttgaaacctttattcgcggatcgttaacggaattacaaacctatgcagctaacgaattaaaaggcgaatttgtcatcatggtagccggcgcgacggacaaaccggctgttaacagtcaattgccgcttaaagaacaggtggcagcgattgtggcaaccggtgccaagcccaatgctgcgatcaagctggttgccaagcaaaatggcgtggctaagcaagtggtttatgatgcttatcatgaattggataagtaaacgaatatatttttagaatctgaggactgagacaaaaccgagcttgaaagagaaggggttttcatgggagcagtttatgaagaagattatcgaattccgggttttctaggagatcgatttggtcgcgccggattggccaacatgatgaatgtcatgttggaagtgtcggaacgccaattggagcagttgcatgccggcattgatgcgatcagtgagtttcatgccgggtgggtgatcacccagtatcacatggatatccaccgtatgccaaagattgaagaacggttacgtgtcggcacggaagccaccacttacaataagtattttacttaccgcgattactggatcgatgatgcgcaaggcaatcggttggtttcagtgagcagcaattgggtgattatggatttgcgcacccgtaaaattgtcgatgtgatccctgaactggttgaacgtgtcggagccgtttcaaatcgtaaaatcaatcggttcccacggtttaaaaaggtgaccgatccggatggtgaagaagcttttcatgttcgttattttgacattgatagcaatggtcatgtgaataacgctcattatctggaatggatggaaaacagcctagggtatgacttcttgagcacgcatactttacggggcgcagatattcgatatgaacgtgaagtagcatatggcaccacgccaaccgcgcaatttcaacatgatcctgatgatccaatgcgcaccttgcatcgggttgtaaccaatgaccaggtgaatgccgaggcacagatgatctgggatgacttcagtgcttaaacatcgcagggaaaagtttttgtttgggaataaaaagcagttctaagcaattttcatcacttaggactgcttttttaattgcccaaacttaactcacagcattatccacaaagtcagccaatgcttggccgcgtttgccgtcgcttaggcccacttgcagcttaatgcgtgccttttgtccattgagaccttggcagaagatgatgcccatttttttaagctgaaccccgccgccttcgtaattgtaaacggcctgggcgacgccattgaaacaacgggaaactagcacaatcggaacgtgacggtctaacaggcgctgaatggctggcagtgttgtgggaggaagattaccggcaccaagcgcttcgatggcaaggccgttgatattatccggtaaggcatcaaataaagtgccgtccattccggcataagccttgattaagaaaacccgatcaacaagatgatcaatcgcacagacttcttgattgattaattcctggaagaagcgcacaccatctttagtcaccaatcccactggcccaaatgtcggggtgcggaaggtggcgacgttggtggtgtgggttttggtcacgaaacgggcggtgtggatctcatcgttcatgaccactaaagtccctttgttccgcgattcatcgctggcagctgttttaatcgcactttggaggttttccaggccatcactgccaatttcgttactcgatcgcatggcacctgtcacaacaacgggcattgccgaatcaagggtgagatcaaggaaataggctgtttcttccagtgtgtccgtaccgtgtgtgacaaccacaccatctgccccttccttttcggcgcggcggatacgcttaaccaaggtcagcatccgttcaggcgtcatatgcggtgaaggtaagttaaaaatttcttcatttgtcagttcaacaccggcaggaacaaagctgtcggcaccaagtaaggggttatgctgacttggcataatatcgccatctcgagtttcggtcatggagatggtgcccccagtatgtaaaacaagaatgtgtttggtcacgattggatcttcctttcacacgttatcgagattcattatacggctttttttccaggcgtgactgttaaaatggtcacgtgtcaaaaccactggtaagcggttttgaaatgctgctaaataagtctggacttttttccgtttggctgtaaatactgtggcgcagctgatgatgagcgatgccacgggtgtttgaaaagtgattaataaaataaaagattaaaaaaacacttcgatagtgaagtgttaagggaatccctacatgagggaatgagagcaaccagaaagatgtgattacgagtcaatattttagcaaaagagtctggcagcatcgttggtatcacgctagaaaataccgtgaaagttgtgagataaatttcaccacggcttttttgaacggcaatgcgaacatttaaggggttccctttagataattttcggtgtacgataagactcgttacaaaaatctaggagtaggaacctgcgcgttaagtgctgccggaacggaatgtgaacggcagacgaagacagatgtcgcggtgcaggttccgcattcgcctgatgtttaggcgtctccgcaaaaaaggagattgcagctaatgcaagttttatcgtttagtagtcccaagctttccactcgaaacattgtgtatctcgccatgatgatggctatgcagattgttttgagccgtttttcttttggcaccccgtggttgaagattagtcctgctttttttgccactatcttaatggggtattatttcggaccatggatggcagcagccgcagcagcattgaatgatcagctgtcgatcatgatctttaatcctggcgctaactttcctgggtttacgcttagtgcagcaattgcagccatgatttacgggatgttcttccacggtaagaaggtttcggttattcggacattgcttggggttggcttagtgttgttgattagtaatattattttgacgacactgtggctaaacatgatgggcacgccatggcaaggtattatctggccgcgcacgattaaaaacgtggtcatgttgccaattcaaacggcgctgtcctacgcaacgctaaaaagtgttgaacggattcggccacatctttaattgacattgttgattgttgaaaccggctaaaaacagcactgattttctggccatgattagatggcagaaggtcggtgcttttttgatgttgagcaggtggttgagcggttgactggtcagtggggccgttaattgttagaatagacaatcaaaggtttaggcgggggatttactcggcgcagaaagctgggtgtaaggaccttggtcgcaatggccaaagcccggccatcacgcctgaggccacaagtccgcctttacgcccataacgcgctccccggcgcagaaacctgcgtgtaaggacctgagtcgcaatggccaggagcgggccatcacgtctcaggccgcttacactccggtttctaaacgcgccggctcgcgctcagctcaccataacgcgttcgcagtcgcagcaatctgcgtgtaaggaccttggtcgcaatggccaaagttcggccatcacgcccaaggccgcttacactccgattgctaagcgctcctgctcacgctcaccatacagaaagggtgccggttatgtatcttttgttgataggtttgactgcactggctttggctggagtcggtttatgggccttgcagttggaacggcagattgtggcgatgcaattgacaacgcataaaatgatgtatccgaatcaggtgcgtagcgggcggaagacttatattcgtaacttgtatcgcgaagatgcgagtgcgcgtctggttcgccgagttgggttgattggtagttggatcagcgggctggcgtttgccgtggcacttggaaaccaattttataccgagttgcgccatttgccgtttattagccgtctttatgtgatggctacgaattatttgacgacgcgtgatctggcattgtgggtcgtgatgatcagtgttatagttgccggcttggcctggatttggttggcgaagtggttacacgatcgcttgttagcggagaatgaagccactggaattcaaagtgcaaccgacttgtattggactccagaaggcgtgattcatcaacgtctgtggcttaagatcttgttacaggtgctgcttattgtcggtggcgtgcttcttttgctggcggctttaaacggtgctttgcctgatcctggtcaagcgtggatttaatgttgatttaatctaaccctgctactctttcaaaaagtgatggttttgcggtcaattggttgctcaatcatagcactaaaagtacgcacctatattctaagctctgcatatacatgctcacgcttcgaggctatttgtgataaactattgccatgattgtatcgccggagggaggtttaaatatgcgattattagcacttgatacctcaaatgaggcgatgtcggttgcagtgttggataatgatcgattattggcgcaaacaacgattaatcacaagcgaacgcacagcgaacaattgctgccgaccattgacgaactggttgctgcaagtggcttacaacctgaagatttagataagattatcgttgctgatggtccgggatcctataccggtattcgaattgcggtcaccactgggaaaacactggcatataccctaaacattgcgttggttggtgtttccagcttggccgttttagcgtcaaacatcagtgccactaaagcgatgattgtgccgattatgaatgcgcgccggaataatgtgttcacgggggtttatcagtgggacaaaggtaaactgctgaatgtggtgacggatcgacatgttccattgacgctgctgctcacggagttatcgaccttgcaccagccagtcatttttgttggcgtagatgctggcatgtttcggagtcagattattgaggcacttggcggattggcacattttgccccggattggctgaatttgccccaagcattgcgactaggacagcttggcaaagacttgccaccggtttcggtttatgactttgtaccgcgctatttacgcttaacagaagccgaaaacaactggcttaaggcgcatcccggcaaaggacatgatgtttatgttgagaaagtttaggtcgtggtttgaacgcacgacgcctgatgaattgcaatttaaaccgcggacgatcaatgttcgcaataaagaatatctgttgcgccgaatgacggaagcggacgttgacgcagcgctggccatcgagcgtcgaatttatcatgatacgccgtgggatcgttatgctttcttctctgaactgcgcaaggtacggcattcgttgtacctcgccgttgaagatgccggtcagatggtggcgttaattggtacatggtttaccatgaacgaggcgcacgtgacgaatattgccgttgatccagcttaccagcatatggggctgggtcgctttttaatgcaattcatgattggccgtgcaattgattacggcagtcaaaagatcacactcgaggttagaaccaataacgagattgccaaacggttataccactcgttaggttttcaagatggaagaattaaaaaaggctattatgtcagcaaccatgatgatgcgctggatatgtatcgggaattgccgtaatttcggcgatcatcgtgattgtagaggagaataatgtggcagcaagagaattaattttagcattcgaaagcagctgcgatgaaaccagcgtggccgttgtcgaaaatgggaccaaaatcctatcgaacattatcgccacgcaaatcaagagtcatcagcggtttggcggcgttgtaccggaagttgccagtcgtcaccatgtggaacagattacgttggtgaccgatgcggcgttaaaagaagcaggtgtgacttatactgacctgaccgcagttgccgtgacgtatggacccggactggtaggtgccttgttgatcggggtaacggctgccaaaaccattgcgtatgcccatcacttaccgcttattccggtcaatcatatggcaggccatatttatgcagctagatttgttaagccattggtctatccattgttggcattagcggtttccggcgggcacacggaactggtctatatgcgcgctgccggtgaatttgaaatcatcggtgatacccgtgatgatgcggccggtgaagcgtatgacaaagtcggccggatattgggtatcccttaccccgccggaaaagaagtcgatcgcttggcccatcttggtcatgatacctttcattttccgcgagccatggataaagaagacaatctcgattttagcttcagtggtttgaagtcagctgtcattaatacggtgcatcatgccgatcaaattggggaaacactcagccgtgaagatctggctgcgagttttcaagcggcagtggtggacgtgttggttcacaaaacccaaaaagcgctgaccgaatatccggttaaacagctcgtgattgccgggggcgttgccgctaatcaagggctgaaagaagcgatgaatgagaccttggccgttcattttcccgatgtcgatgtcattgtgccgccattgcgcctgaccggtgacaatggtgccatgattggggctgcagctcatattgaactggcaaaacggcatctcgcttctgaagatttaaatgccgatcccggcctgagttttgcccatgcgtaagtaatcgtcacccgcgacagcaattttattgacgttgtctaactgttttggttagacttaacttattgataaggttgttaacgaaaggatgattcccatggctcaaaaaacgatcatgttagtttgctccgctggtatgtcaacctcaatgctggtacaacgaatgaaaaaagcggcggctgcagatggtattgacgtcgatgtttttgcaactgcagctgccgatgcggacaacaagctcgcctcagagccagtttcggtcctcatgctcggcccgcaagtccggtttatggaaagccagtttaaagccaaggctgacgagaaaaagattccaatggcggtaatcgacatgaaagcctatgggatgatggatggcgaaaaagttttacgccaggcattgggactactcgatcaaaaggtttaaacatcccaccaattagcgtgcaaaaaaagaactggttctaacagcagcatttgttgttggaaccagttcttttatattcttgtcatctgacagtcaacggcaaacttttatcaaaacgaaaagggttaggtagactcattttgcatcgtttcaagttgaatgcttttttcttcccatgcatcctcggtcgttttggtttcctgttgaaccgcatcaagtttggtttgcaatttttgcattttaacataatcggttaaaacatctggcgcggtcatttgcttttgaatggcggttgcttgttgttccaatgtttgcaatttggtttccagatccgcgacttcacgctgcaatttgcgtgctgctcgagcatcttctttggactgctgataagaagtggcaccggtcgtttccgatttggtcattggggactcagccgctgctgcttcggcctgggctttggtttcggccagcttttcctggtagtagtcccagttgccaagatacgtggtactgccggtaggggcgatggcgataacgttggttgctagttcattgatgaagtaacggtcatgggaaacaaacaagaccgtaccgttgaagtcttttaatgactgctcaagcacttctttgctgttaatatccaagtggttcgtcggttcatccagaacgagaaaattatcgtgtttcagcgctaacttggttaattccagccgcgctttttgcccgccggataacgcgctcactggtttttgaatatcatcggcaccgaataagaaggcagcaaggacagcgcgtacatccttttccggcatcatcggatgatcatcccagatctcgtcaatgacggtatttttgggattgagttgttgaatttcctgatcgtaataaccaacatcgacattggcgccaaacttggcagtgccggctaagaacggtatttttcccaagatgctcttaagtaaagttgatttgccgaccccattcggaccgataatggcgatgcgatcgtatttgttaacctgaaaatcgatgggacctgccattggatgatcggcttcataaccgactgttgcctgattaaccttgaggacctcattaccgcttggtcgattaggcgtgaaattaaaatggacggttttatcatcgccggtcggtttttccagcacgtccattttttccaattgttttcggcgtgcctgtgcctgtttggtggtgctggcgcggacaatgtttttatcgacaaaatcctgtagtttggcgatttcttcttgttgcttgttataggctttccacgcttgggcctggcgttcggctttttgcttgagatagccgctgtagttggttttgtaatgggttgcgtggtgatgatccagttcatagatttccgtgacaacgtggtcaagaaaatattgatcatgactgaccgttaagatcgcaccggggtatgttttgagataaccttcaagccagctcagcgtttcgatgtcgagatgattcgtaggctcgtcaaggataatcaagtcatgtttttccagcagcagtttggccaatgctagccgtgagcgttcaccaccggacaaagtacccacgggtttatcataggtgtcttcaccgaactgaaagccgtgtagaaccgaacggatttcggcctcgtagccataaccgttttgttcattaaagtcatgctgcagttgatcgtattgtttcatagtggccgcaaaagcagcttgatcggcaatcagtttaggatcgccaagtttggcctctaaatcatggatttgacgcgccatcgcttgaagcggagcaaagacggtcagcatttctttgaaaatcgttttgtcggaatcaagcccggagttttgagctaaatacccaattgatagattcttcatggtggtgacctgaccggcgtccgggggagcaataccggtcaggatttccagcagcgttgttttgccaatgccattgggaccaacaaggccgatgcgggcgccgtcttggatctccaggttcacgttggcaaataattcattgccgttgaagctgcggccaacttgttgtgcctgcaaaatgatcacaggaataccttctttcacaattaatcgttaagacctaatataacatagtttcgttcatgggcgcgcattccccgccgatacatttagctggcaaaatctgcttgtgaagatgtatccgcttgcgttcaggccataaaccagctaatataagcagaagatactatgttggacagttcacatgttctgcatgggaatacttctacaggaggcttgcttacatggcggaaacgatcatccccaaagcaacggcgaaacgcctacccgtgtactaccgatacttgaatttcttggctaattccgggacaaccaagatcagttcaactgaactgtcggacgcggtaaaggttgactcggcgacgattcgacgtgatttttcctatttcggtgcactcggcaaacgcggttatggttatgatgtgaaggatttgctcaatttcttcaaaaagattctgaatcaggatcgacttaccaatgtcggtttagtcggggtcggcaacctggggcatgcgttgttgaattataattttcgacaggcaaacaacatccggatcagcgccggttttgacattaatcctaagctcgctggaacgattcaaagcggcgttccgatttacccgatggatgaaatgattaaacagattaaagatcagcaaattgaaattgtgatcttgacggtgccaattgatgctgctcagcacattaccgatgatttggttaaagcaggtatcaaagggatcatgaattttaccccgattcggatttcggtaccgagttatgttcgcgtgcagaatgtggatttagccaccgagttgcaaacattgatttacttcctggaacattatgggccaacgctcaacgaaccagaagcctgaataagaccataatggcgtcgtttacctttagcaggcaagcggcgtttttatattgcactttttagtgtactgcgtataatagtacacataatacgaaaggaggcgcggtcatggcgactgagtcttatgctcacttggcttactatgaacgactggtgctccaaattaaagccagagtcgttcaaggcatcatgcagccaggtgacaaattaccgtccgtacgggaaatggcgaagcaagaacagctaaatcctaacacggtcgcgaaggcgtacaagcagcttgaagctgacggggttatctttgttgaaccgggacgtggctcgtttattgccgaaccgttgaaacatgccaacgcagcagcagtggcaacctttcgccctaaatttgatgcgttggtggttgaggcacagagtctcggtatcagtcttgccacgctgcatacctggctaaatgaaaaggaggaacctgcatgagtctcaccatcacgaatttgcaaaaaaagattgatcagcgaccggtgctagaagacgttacattttcgttagagcgcggccaggtcgtcggtctagtcggtcccaacggtattggcaaaaccaccatttttcgcaccatcacccatcagtatattgcggatggcggaacggtgaaggttgacgatcatgatttggcaaccgaaccggcccagcgagaagctattttttatttggatcaacagcatttgtttttccgcaaatattcactggttaaaattgccgccaactacgcattgctgtataccgactttgaccaagccgcgtttctgcacttgattgaaaagtttggcctaaatggaaccgcccgtttccagagcctatctaaaggttatcaggcactggtgatggtcgcgttggctttagcgagtcaggcaccttatgttttcttggatgaaccattcgatggcttggatgttttgattcgggaaaaaatcgtcaatctggttgtggatgcggttgcagatggccagcgtacgtttctgattgcctcacataatctgattgagttggacggcttatccgatcgggttttgtttgttaaaggtgggcgcatcagtcgcgatttgacccttgaagatgttcggcagcaagcggtgaagttacagttggtgtttaaaaccaataaaattccggcagtagtcaagcagtatggccgaatcctgaatattcgcgggcgggtgattgaggcggttttcccggatttcaatcaggagattcaagcaaagttggcagcagaacagccagtcctcaatgagaatttaccgttatcgctgtcagatttgttcaaagtcgaatttcgaccacatcattcgggggtgaaataatgtatgaccatcaattattgaagctggttcaatcacggcataaagttttgctgcgggtggtacttgtatttgttgttttactggcatttctcaatctcggcggaacgatacagggctaccaaaatcgtcaggagtacatgatgagtcctagagattttgcgattatgaaaaagcagtccgcaaagaatcacgatacaacgtttgccaagatgtcttatagccaatatcaagaagaacaaaagtatttaatcgctccgcaagataagcacaaactttactcgccttctttcattgcgtatagcatgacaattgtttcgtatgctattcctttgcttgtcggaatggcgatggcaggggttgatcaggccagtggtctcaatgcggcactgtttacgagccggtttcggcgccgacaaatgttttcggttcgctatggctatggccttgcgtatttattaggggcaacaacagtcggtattgggatcacgcttttaggcttttatgccgccgtacctgcgatgtatgtcggtctcagcggggctaatattgtgggtgcattattactcaatctcgccgtcaacagttttatgtttacagtcggcattggggttggcacgatctttgcctcgccattttggatgggcgtttttggcttgtttggtacgtggtttggcatgagcgcaatagaacggtttataaattcgattagattttacggcccagtcaaaaagagcttttggcacacgctgattcccagtggcaaccaacttttttgggtactatttatcggggcgatactggcgagtgtcggcggttatttcctgataaggtggttgtttgatcggatttccctagaacattcaggcgatgtcctattgttgccgaagctgcgatggttaattctcgcatacgcactcgtggtgattccgtatacgtttgatgattggatcttacaaaatcgcttaatatcatatgttgtctcaattggcatggtgattgggctaggcgtatggtggcagcggcgagaacatgtaggatcgcaaacatcattgaaaaccaaaacagtttgaagctagctttaagtcatgaagtttatgcaaacatacctttatggcgtaaaaaagtcggctccagcgctgcattttcatgcacgtcggagccgacttttttgtgggtcctgattgattttgatgattgtttggccagacagttaactagttaactgccattaacgatcataaggggtataaataatgtagttttgatccgttgtggcttcaaagtcaaattgcgagttcttcgcgttttgtttggtttcttcattgctaatcgtttcggtttgtaagccgagagctgtacggagtttatttgagactcgctgcatttccgcatcggaggcaatctgataggcgccgtccccgacccaggcattgacgccctgcaaatgatcggttgagatggtcttggcggcatcacgataattcaagaagatactttgcatatctgcgaaactcatattagtggcgatgttcttggaaaccgtgtccataagtttggtgaaattaccgagtgatcccactgatatggcttttttcaaaatagctttgatcacttgttgctggcgtttttggcgcccgtaatcgccttctgggtctgaatgacgcattcgggaataagcgagggccatattgccgtttaggtgcatgttgcctttagtgaatttctggttgccggtatacgggtcttggaatgaaaatgggacgttaacgtcaatcccgccgactgcattgactaccttttcaagtgcgcccatgttaatggttaagtagtaagaaatcgggacattgaccagcttggagacagtattgatggccatgtccgaaccgccgacgttataagcggcattgattttttgcatattgaattctttggtaccaatcagttcagcagcggtatcccgcggaatgctgaccatggtggtttttttagtcttgggattaatgacggcaacaatcatcgtatccgagttgcctttttcaatccgtccgtctgcccccgtgtcaacccccagtagcaaaacagcaaatggtttcttttgggcaatatccgtgctgacgtgtttggtggcatggtatgtattgtcaatcgcatattttgcctgactgtataagcgcaacgcataagctccgactgtaaacaggccgacgacaaggattaaaccgatgagtcttccccagtgaaatcggcggggtttttgacgctgacggtgatttgagcgggtctccataatttaactccttcgtaaaagcattattttccattataggagattgtggtgatgggtgcgattaatattcggttacgtttatagggcatgggcaatgtaataaagccaaaccatccataaggcaccgacatgggcgatgatcggtgtgctgatggcgccggtgtggcgataatcgtaagcaagtaccaacccgaccagagttgcactaagccagtggccaccgggttgggtcacggcaaataggaggctggcgatgagcgcgccgccaaagataccggtgacattgacgagattaccgaacagaactttacgaaaagccaactcttccaagatcggcaatgctaagccaatggtcaaaaagtaccaaggattagtcgtcatactggaaagctgttgatgaatttggctgctggtttgcggcattttgaataaaatggtttcaagccacgaaccaaccagttgcgctgccaaaacaccggcaatgcccattacgccccagaagacgcgttgctgcggggcaagaacgccaggtgcttcaatcgcgttggcaatcactaagttacgctcgctcaaaatcgcgataatgagtgcgaccatactgattaaggtaacaataccaaggctaaggcgcccaaccggcaatatctgaaaaataaggaggttagcgatgaaggcaaccaagtaggcgccaataatagaaaaagcatgtttttgaagtgacataaacgactccttttaaaaaatgtctgaaattagtataacattccggagtttgggggttgcattcacccgcaaaactcgttatagttacttttgtagttagcacttagacgcaacgagtgctaaatcaaaaaatgtaatgtggagggattgccttgttaaaaccattaggagatcgcgtgattgtcgaggtcgttgaagaagaggaacaaaccgttggcggcatcgttttagccaacaatgcaaaacagaaaccgcaaaccggcaaagttgttgctgtaggtgaaggcgctttgacaccggaaggcaagcgtctgccaatggccgttaaagttggcgatactgtattatacgacaaatacgccggctctgaagtgaagtatgaaggtcaagactacctcgtactgcacgaaaaagacattatggcaattgcgtaaaaaataatcgatcaattttgaggtgaataaaaacaatggcaaaagaaattaaattctctgaggatgcacgtgccgcaatgctgcgtggcgtggatcagttagcaaacacagttaagacaacgttaggaccaaaaggccgcaatgttgttttggacaagagctatggtgcaccggaaatcaccaatgatggtgtcacgatcgcaaagtcaattgacttggaagatcactatgaaaatatgggtgctaagttagtcgcagaagttgcttccaagactaatgatattgccggtgatggtacgaccaccgcaacggttttggcacaaagcattattcgtgaaggcatgaagaacgtcactgccggtgctaacccagtcggcattcggaccgggatcgaaaaggcaaccaaggctgcagttgacgaattgcacaagatcagccacaaggttaacggcaagaaggaaattgcccaagttgcttccgtttcctcttctaatgaagaagtcggcaacctgattgctgacgcgatggaaaaagttggccatgatggtgtgattaccattgaagaaagcaaagggattgatactgaactctctgttgttgaagggatgcagtttgatcgcggctatctgagccagtacatggttaccgacaacgacaagatggaagctgatctggatgatccatatatcctgattaccgacaagaagatctccaatattcaagatattctgccactcttgcaagaaatcgtgcaacaaggcaaggcactgttgatcattgctgacgatgttgccggtgaagcactgccgaccttggttctgaacaagattcgaggcaccttcaatgttgttgccgttaaagcacctggctttggcgatcggcgcaaggctcaacttgaagatattgcgaccttgacaggtggtactgtcatcagctccgatcttggcttggatttgaaggataccaagattgaacaattaggccgtgcaggcaaggttacggttaccaaggacgacaccaccattgttgatggcgctggttccaaggatgctattgctgaacgggttaacatcatcaagaagcagattgctgatacgaccagcgacttcgaccgtgaaaaactgcaagaacgcttggctaagttagctggcggggttgctgttgtcaaggttggtgccgcaacggaaaccgaactgaaagaacgtaagtatcggatcgaagacgctttgaacgcgacccgtgctgcggttgaagaaggctatgttgctggtggtggtactgccttggtagacgtattgcctgctgttgctgctttgaaagaagacggcgatgttcagaccgggatcaacattgttcaacgtgcactggaagaaccagttcgccagattgccgaaaacgccggcaaggaaggctctgtcattgttgaaaagctgaagaaagaaaagcaaggcatcggctataacgctgcaaccggcgaatgggaagacatggctaagtcaggtattatcgacccaaccaaggttacccgctctgcattgcaaaacgctgcctcagttgcagcactgttgctgacaacagaagcagttgtggctgacaagcctgaaccaaaagataacaacgctgccgctgccggcgcaaacccagcagctggcatgggcggtatgatgtaatttcgcctcggcgtttaaggctgcaacaaaacaccagtccccaaccgggctggtgttttgttgtacataaggaacagattcggttaattctgacgatcattgaggcgtgaaacaagatgaccatgattaacaaataaagatggcaactgagcggcattaagcgcaataataggcattgaccggctttccttggtaaaataaaataaataagtcatcttggttatcattttaaagttgccaggatagcgacagtcaagcaatgcgtggggtccgtttaatgaatttctcgcgctcacattagcaaagggagcggttgatatgaaactagttcaaaatccgattcgacttaacgccagcctgcataaaatgctaccgaataccatgcgttatctctatagtcgcaagccggttaaatactttgagctttacacacttggttcagtacatgtttattatgtcgaaggctttgaccagattgacattgtgctgacgcatgataaacggacaatcaaagataccgagattgattttgtcttggaaaagttattgccggatacgccaaaagatgaattgaaaatcgatcatgctgccaaaagcgagattgaacatgaagtccatcgcaagctaaaggttcatgatgttgtgatagtcgagaaggcttaattgccagcggttactttttcggtcagacgaaagagtgatcgcttttcttttggtttgcgcgagttcgtaaaatggcggtgttgttgccaatcaatataggttaagatgaaagagggtaggcgctgggcaatttttagcgtagactggtgcatgtttactttttaaaatttcaattaaggttaataggagtttaaaatgatgcatttgaagcggctgtttattggacggccattgaaatcttccgaagaaggcggacaacagctaaacatcttcaaagcgttggcgatgctgtcgtcagatgctttgtcaagtgtggcatatggtactgagcagattgtcttggttttgacaaccttgtcagctgcagcaatctggtattcattgccaattgcggcgtttgtgttgattctcctgatctcgctgacactttcttaccggcaaattatccatgcttatccaagtggcggcggagcttatgtcgttgcgagcgaaaatctgggcaagaatgccggtttgacggcgggcgcttcacttctgattgattacatgctgacggtttcggtttccgtttcggcgggggctgaggcgattaccagtgcgatcccagcgctttatggtcatcaagttgccatctcgcttgtcattatctttattttaatgggcatgaatcttcgcggaatgagtgaatccgctaatttcctgatgattccggtgtacctcttcgttttggttatgaccgcgatgattatctgggggttgtaccaagttgtgaccggggccattccttataaggcaacatcgatggtcggtgccgcaattcccggcgtttccatggcgttaatcttccgcgccttttccagtggttccagttcactgaccggggttgaagcgatcagcaatgcggtgccattttttaagttgccaaaagaaaaaaatgcggcgaaaacattggccattatggcggctattttgggcttcttctttgccggcatcacatttttaaactactggtatggtttggtgccaatggcgaaagtgacggtattgtcgcaggtggccaaagaaacatttggcggtactggaatcatgtactatgtcgttcagtttgcgacggcgctgattttggcggtcgctgcgaatacgggtttttctgcatttccagtgctggcctttaatttagccaaagataagttcatgccgcatatgtacctggatcgtggggatcgattgggttattccaatgggatcctgacactggcgctggggtcagcggcgttgatcacgattttccaagggtccacggagcgattaattccgttgtatgctgtcggggtgttcatcccgtttacgctgtcgcaaaccggcatgatcattcattggttccgcaatcgtggtaaaggctggataggcaagacggtcgccaacttctccggagccttaatttcctttgccattttagtcattctctttgcttatcgtttgtttgacatttggccgtttttcatcgtcatgccgcttgccatcttcttgttctacaagattcgtgatcactatgacaaagtagcggcgcagttacggttgccggccgacgttgaagagcatgactatgacggtagcaccgttatcgtccttgtcggcaatgtgacgcgggttacccgagcagcgttgaattatgcccagtcgattggcgattatgtcatcgcgatgcatgtgtcgatggatgagaatcctaacaaggaaaaggaaacccaaagcgagtttcgggcagactttccggatgttcggtttgtagacatccattcgtcatatcgctcgattgaagcgcctacgattcggtttgtggacatcgtagctcgcaatgcagctaagcgtaatttcacgaccacggtgctcattccacagtttgtcccgcgcaaaaagtggcagaatattctccacaaccaaaccaatttccgcttacgggctgcttttgctagccgggaaaatgtgattattgcgacgtacagttatcatttgaagaaataagtttcagtaagctgccggctggattgtgtaagtgtcaactttttcacggttctactctaattaagtgatttccgatactccgagctggctacgcggtggctgggctggaacgtggtgggcacgactttgaacccgcaaattgcgcggtttcaaagctcggccttggtctaaagcggagaagaccactccgcttaagaccaatttcaccactgagcccgccaccgctccgccagctcttgctttctatgctaatattcgtcacactgctgttggaatcgtctaaattgatgcggcctttgtttgacatacacatgcaccaagagagattttacactagctcctaaaaaccggccagattcaaacaatccagggctgtgggattgacggaactggtaaaatatgaataatagaacgtcagagaaagtcaaaggataaagggtgaattttgtgccgcaaaaaaccagcgatacgccgatgatgcaacaatataatgcgattaaagcgcagtatccggatgcatttttattttatcggattggtgatttctatgagctgtttaatgatgatgcgatcaagggggcgcagttacttgagctgaccttgacggcgcggaataaaagcgcggatgatccgattccaatggcaggggtgccgcatcatgccgtgcaaagctatgtcgatattttgatcgatcatggctataaggtagcaatctgtgagcagatggaagatccaaaaaaagcggtcggtatggttaagcgtgcggtcattcaattaatcacgcccggcacgaatgtcgatattaaggccggtgcggcgaagaccaataactatatcacagcagttttgccgcacgcagccgggtacgcatttgcttacggggatgtttccactggcgaactgaaagtcacggacctgaaaagtaagttcgccttacaaaatgaattaagcgcgctggccaccaaagagattgtagtgccagaagacctgaacgatgaagatgccgcgatgcttaaaaaaggggagcggctgttatcagtccagcaagacacgaagccgaccagtgaaggcagttatgtttcccaagatttaaccgatcctgccgaagctgcggtggtgcagatgctgatggcgtatttgttgaacacccaaaagcgcagtctggcacatattcaaaaggctgttgcctatcaaccgtccgcgtatttggaaatggatcaggatgcccgcagcaatcttgatatcctacaaaatagtcgtaccggacgcaaaggtgatacgctgttgtcattattggatgcgaccaaaaccgcaatgggcgggcgcttattgaagcagtggctggagcggccattgttggacattgatgccatcagtgtgcgccaaaatcaggtgcaggatttgctggaacacttttttgagcggagtgagctgcaagagcggttgacaaaggtgtatgatcttgagcggttagcaggacgggtggcctttggaaccgttaacgggcgcgatttgattcagttgcaaacctcgctggatcaagtcccggcgattcaggatgttttgagcaagcttgacgatggcagttttaaagaacttcgcggtaagatagacccggttagtgacgtggcaggactcattcggcggtcaatcgagccggagccaccgatttccgtgacagatggcggcttaattctgcgcggttacaatgaaaagctagatgcttaccgcgatgccatgaaaaattcgaagcagtggattgcggaacttgaagcttcagagcggaaagcgacgggcattcacaatcttagaatccgttacaataaggtcttcggctactttattgaagtgaccaagtcaaacctggataaggtgccagagggtcggtatgaacgcaaacaaacgctgactaacgccgagcgctttattacgccggaacttaaagaaaaagaaacgctgattttagaggcgcaggaaagttcaactgcgcttgagtatgaccttttccaggatattcgggaaaaagttaaggctcagattaaacggctgcagcatttagccgctcaaatttcggcgttagatgtgctgcaaagttttgcgaccgttgccgaaaataaccattatgtgcggccaacgatgcatgccgggacccatgacattaacgtcaaaggcggccgacatccggtagttgaacatgttttggggcaggacagttatattcctaacgatgtcatcatggatcgggatacggatatgctgctgatcacgggcccaaatatgtccgggaaaagcacctatatgcgacagctggcattgattgtcatcatggctcaagcaggatcgtttgtcccggctgacacggcagatttgcctatttttgatcaaatcttcacccgcattggcgctgccgatgacttagcaaatggcgaaagtacctttatggtcgagatgttggaagcaaatgcggccttgagtcatgcaaccgcatcgagtttgatcctgtttgacgaaatcggtcgcggcacggcaacgtatgatgggatggcattggctcaggcgattatcgaatatttgcacgatcatgtccatgccaagacacttttctcaacgcattatcacgaattgaccagtttatcggattcattggcaaagctgaaaaatgtccatgtcggggcagttgaagaacacggcaatctggtgtttctgcataagatgatgccgggtccggctgataaaagttacgggattcacgttgccaaattagccggtttgccagctgacttattgagccgtgcggatactattttgaaacaactcgaagcggcaactccggaaaaaaccgtcccggcagctaccagccaagtcgaggaccagcagttatcgttgtttgaggaacctaaacctgcacccaagaatagtccgattttagccaaacttgctaagttcgatttgatggatgcaacgccgatggatgcgatgaatttgatttttgacctgcaaaagcatttaaagaagaagtgattttatgccaaaaattcaccaactatctgccactttaagtaaccaaattgctgctggggaagttattgaacggccggccagcgtggtgaaagaattggtggaaaatagtattgacgcccaagccacccaaattgacgtgaaggtgtcagcggccggtttacaaaccattcatgttagcgacaacggaatcggcattgaccctgacgatgtggcgacagctttcttgcgccatgcgacgagtaaaattttgaccacgcgtgatctgtttaatgttcattcactgggatttcgcggggaggcgctggcaagtattgcggcggttgccgatgtgacgctaacgaccgctaccgatgccgggattggcgctaaaattcatgtcaaaggcggacaggtagaaagtcaaacgacagcggcgcatcgtcgcggaaccgatgtcgaagtgagcgatctgttttttaacactccagcacggctgaagtacatgaagtcgcaacagaccgaacttggcaagattgttgatattgtcagtcggctggcattagctaaccctaagattgcgtttacggtcagccatgacggcaatatgatggtgcggacagccggtcaaggtgatctacgccagacattggcgggcatttacggtttgccggttgctcggtcaatggtcgactttcaagccgaggatcttgattttaaggtgagtggtttgaccagtttgcctgaaaccacgcgggcgtcgcgtaattatctgagcttggtcgtcaatggccgctatatcaagaactttcagttgacgaaagccgtgattgccggttatggctccaaactcatggtcgggcgctatcctatgggcgtgatttcgattcagatggatgccgctttggtggatgtcaacgtgcacccaaccaaagccgaggtgcggttaagtaaagaagatcagctcagccacttgctcagtgaggccattcgtgcgcgcttagccaaggaaaacctgattcccgatgccatggataatttgcccaaacgcgagcgttatgatcttgatcaactggaactgacccttaataaaatcagtcctaagacgacagcagtgtcgcatcaaggtactgaagtgcgcgaaaacgccgacactaacactgaaaatacgccgacttctcaaccagcagcgcaggcagaagcagcagtcgatttaaccatcaacgacttagatgatcggccaatttttgatgagccacagcgcttggctgcttgggatcagcgttatcaaacgttagacgccaatgttgcgcctgccttggtggaggataccgcagcttcggatttgaagcgatcggagccgactgaacgttttcccgatttaacctaccttgcccaagttcacgggacatatctgctggcggaatctggggacggcttgtatattttggatcaacatgcggcccaagaacgggttaattatgagttttatcgccaggcaattggtgaagtcagcaacgatcagcaacatttactggttcccatcgtgctggattattccgcggctgatgcgatcaatatccgcacgcatcgggatgtgttggaagcggtcggcttgtatctagaggattttggccaaaatagtttcgtggtcgagcatcatccgacgtggttcaaagccggtcaggaagaagacacgatcaaagaaatggttgattgggttttacgtgacggcaagatctccgttgcggcttttcgggagaagacggcgatcatgatgagttgtaagcgcgccatcaaagccaatcatcatttagacgatcagcaggcacgggcgttattgcagaaactgccgcaatgcgaaaatccattcaattgtccgcatggtcggccggttctggtccacttttccaacaccgatctggagaaaatgttcaagcggattcaagacagtcatgaaagtggggagatgcaggcatgattattctggcgagttattcaccacggcgccaagcattactcaagcgtattattcctgcattcgaaagccatcctgcagcagttaacgaacgggcgttgccgattttgccaccaccggagtatgtccagagtctggccaaagccaaaggagaatcgttagtaccgagttatccgggggcaacaattattgcggccgatacgatggtggcttttcaaggaaaattactgggtaagccgcatagtcgtgcagaagccaagcaaatgactactgcactcggcggccaaacccatcaagtctatacgggcttgtgggtgcgtctggacaatggcacgattcggcagcaagtcgtggccacagatgtcactttttggccgcttgatgaagccgaagttgagtcgtatttacaagaagacgcctatcaagacaaggcgggtgcttatggcattcaagacgccggagctttactggttaaggcgatcaatggtgatttttacaacgtcatgggtttgccgatcagtacgttgtatcgaatgttgttggcgtaaggcgtttgcgcttttattcaaccgtatggaaattcagaggttataaaaagccgcccttagagaaatctagggacggctttttacggatatagatactttaaaaacttacaacctgccaattactcggtaaagtgaacgtgtaaatcttgccaatggttttgccttgttcaccggatccggcgaacataatagcggtgaaaatattggtgtactcgagtttctgcgcggtcacggcaacttgcggaatcgtaccgtgtgtcagtttggttttgacggtagtacttggcttaacagtatgaatcgttgcatcacccgaaatacgatattgataagccatgtgtttcttagccgtgccgatggggtggctttgaatttgtaactggtcattcatgggtgctagcggttgcaattcagtggtttcgtcaatcgtaaagccgatgtgatacaaatcattcaaactcaaaagtacaaccggtatcataattagcaaggcgctcacagcgattgccaagggtcgacgccggttgggcttcatcaataccatcgtccaaaagaaggcaacggcgccaataatcaacagcagaataatcatgatgggtgcctccgatccatggcatcgttattcaagaagaaactcagaactaaccctaaagcggccatgaccagcgaaactgcaaaagcagcacgatatccggcaagagttgcttgatgcatcgcgttggtgtagtcaatcggatccaggactttcccgctagccgagggcgtggcgccttttgtgacgacggataaaaccgaaaccaagatggcggtgccgattgaagccgcgacttgccgaatcgtattgttaaccgcagtgccgtggttgatgagatgggttggcagtgcattcataccggcagtggtgacgggcatcgttaccatggtgataccaaacatccgcaccgtataaatggccgtgatgtaaattagcggtgttgttgcggtgacagtcatcaatggcagcgtaccggcaactaagagaaataacccagctacggccaaacgcttagctccgattttgtcaaaaatccggccagtaatcggactcatgatccccatcataatggcgccggggaaaaggatcattccagagtgaaaagcactttcgccgcgaatcgtttgaatgtacatcggcagtaccatttccacgccaaccatggacatgaaagcaacagcggtcaaaatgacactcaaagtaaaggttttcgatttaaaaacccgtaactccaacagcggggttttgagatgcaactgccgccagcaaaaaagggccacaaaaacgatcccaatcgccagactgatgagtacctgcgaatctgtccagccagcgtcaccaaccgttgaaaagccatacaataatccaccaaaacctaacgttgaggcaataatggacggcacatcaattttgggatgcgaagtaggcagcacctgacgcatgctgtaaatcgccaaaagaacaacgccggcagcgatgggcataatgaccgcaaacaatgcacgccaggtgtgatgcagcagaatccaaccggaaagcgtcgggccaattgccggcgccaacccgatcacaatgccggccaaccccatggcactaccgcgtttttcaggcgggaaaatggtgaacatgacggtctggaaagttggcatcgacatcccaacgccgattgcctgaatgagtcgcccgagcagcaacatttgaaaatcattggcgagccaacaaagcagcgatcccaaaaagaaaatcgtcatggcggttaaataaagatgtttaacgttgaacttatccagcagccaagccgaaacaggaatcattatccccataatcagcatgaagccggtcgtcaaccattgaaccgcgctggcgctaatgtgaaaatccgccattaaggtcgggtaggcagtcgtcagaatcgtttgagtcaaaaaagtcgtaaaggtcccgatcagtagcgtaatgacaagcagcaaacgattgtaaggatgaccattaacatcagttgttgtcaacaatatcgtgtcctttctaaaaacattataatctagtctagcacgtaatctgacaattttgggtaaatggccttcacaaaatctttaaaaagcgatcaaagaaataccccactcaccttgttaggctaaaagtaagttagtcgaacgaaaggggcgtttaaaaacgtgaaagtccgatcatcgcatcagcgaattgaatggattgatgttgccaagggcctcggaatcattgcggttgtgctgggacatttctatccgcgcaacacaaccttttatgaaagtctgtattggtggcacatgccgttgtttttcatgattggcggtttttttgttaagccgacaacgctgccaaccttaaaagcttttctagcgcgacgtttttggccattattgaaacagtactttggttacggcgtcggtttaatcttgttgaactttatcattgaacagcgcaccccggcgtttaccgttgattatttgcgacggttaatttatggtgggaccgaattgaatggctacttgtcagttttctggtttgtgacggtatatgcgttcagcagcttgctgtttagcttattgcgcgggtatttgccaaaagtctggcacgaagcaattttaatggccggattgttctggttagggtttagttaccctaacgctgaaaatgttttgggatttccgattcccggcaatcttgatttagtattggttgcattgccttacatgtttgtgggctggtggttatttcattacgctcgccatattgtcacgcaaccatggtttatgctagttgcgcttggtgtttttgccggtttatttgttgcccagtcgcgcggtcaaatcgacttcttgctttacatgaagtcgcaccatctaacggatccattacttgctagctttgtgccggttattatctgcggcggtttatttgccggtgcgaaaacattaaccggaaccgtgcttggagactggctagatcgcattggtcgtagtacactacccataatgtatgggcacaaggcggtcggctatgtgctggaaaagttgggcgatccgaatttacttgttttagttgctgctggtgtgacgattcctcttttccttgcttacgcgggccgctatgtgcgcgaacgctggcaaggtggaggattatatgcgtttaattaaacgaatactgctagttgtggcggttctgatcattggcttggccccaagcggtcaattagtcgaagccgatacgacgccgactatatttgttcatggttatcgggggaccgcgttttccactaaccaacttatagaatcggcggaggctgccggggtggccaaacgaagcatggtcgtgaccgtcagtccaaatggccaattaaatgtgcaaggagacttgcatgccacagctgcacccattattcaggtgatttttcaaaacaatacggctggcgaagaagtcgatagtcagtggctggccaaaattctaactatgttgcatcagcgctatggcgttacccggctaaatgcggttggccatagtatgggcgcttatgccgtgattgccgccgcgatggcacaaacaccggtagaactggaaaaggtagttgtgattgccggcccatacgatggtttactgggatggaatgacaaaccccatgaactgcaattggcagctgatgggcggcccagtttaattcgacccgagtacgcgcgacttttgcaaagacgtgaacacttccgggctaaatcggttttgaatatttatggtaatgttcaagacggcagtgacacagatacggtcgtaagcgttaattcggctttgagtctaggctatttgttgcgagggctaacgaagtatcaaacgttagcagtgaccggaccgcatgcccaacacagtcgcttgcatgaacacaatgtcgccgttgaccgcgcgatgttgcagtttatctggggaaagtagcacaggatgaagcgttaggcagtggcgtggaagtagcaggcactgaaatcgttaaagttgacgctactaatacgaaagagtcaaaaagcgtaccatttcttgcaaaagtcgagaaatggtacgctattattttgaaacgatgaatgatgggccttgattgttttaataaggccgcatatttttgtcttgagctaaaaacttcaccaacaaaagcagatgacgtgacaacattagtcttgatgctggctcttggcttctttaacctcttcggcaacggtttgcttaaccggctttgggtcttcagtcacatcaaaccagttggcaaaaccgcgggagaaatcggcaaccgtaaagttaaagtgatcgattttgaccttgtcatgtaactttagatccggatgtgtttccatgatgaagccggctatggtaatgatttcggagtcggtgaacgctttaatgtcggtgtggaaatagcgctcaaagtcccaaagtgtggtcttgccgctgactcggaaaactttaggattgtcggttttgcgaatatattcatcagacacatcgtcaatttcatctttaacagtgccgaaaagttcttcataaatatctttatctgtcacaatgccgctggtgccgccgtattcatccacaacgacaacgatgggcgtttgcttcttgatcatctgggctaagatgttatgaatcggcgttacttccggtacattaatgatggagcgcaagagtttggaaactttgacggacggatccacctgaccttgtttaaccagatcatagatgtagacatagcctaaaattttgtccttatcgccatttgcaacgacggggaagcgactatagccttgggttaaataatcacgtaaggcttctttaacggtggtattaatatcaatcacaaacaggctggtgcgatcaaccatgatatctttggcggtcttgtcgtttaactcgaatgcccgctgcatgtagatgacatcgttttgttccatatcgcctgatgttacggcgtttttactaagactcaaaatttcggcttgcgaaaaagcctcgttaccttcatcagccggcttcatgcccatcattttgacaatgccggtcgcactgacattcagtaaccagacgaaggggaagaacaaaatgtggaaataatgcaaaggggtgacaactaacattaacgttttaattggatagtcaatcgaaatgttttttggcacgatttcggtaagcaccacttccaaataagttaaaataatgacccctaaaactgcacctaccgcatgtaaactaccattaggcaagcttaaatgcgtcaacccgaacaaatcgaccagcaggaattcaacggtggtttcaccaatccaccctaaaataatacctgccagcgaaacgccgacttgggttgtggacaaatattcattcaagttgtgcaccattcgcaaggcgcgctcgattttcgctttgcggcctgtgcctttgtcaatcatatcttccaaggcactcggacgactttgaaccaatgcaaattcacaggcgacaaaaaatgccgcgaagaaaaaggtgacgagcatcaccaataaattggggacgatttggccactttccatgtattccattcctcatttcatgttacttacaaacttaattttaacattgaattggccggatgaacgataattcatgagttgattgcttctatgttatgctgagatcggtcagaaattactttggggtagttgcggcggcttgattagatggcagcatttgatataaagcgtctgtcagcgtggttatctgcgcgtaagaatctgtgttgtcatgtcaaaccgtgagtggccacaccataaagcgcgtatacaccgagtgctgatcgcgtttgaccacgtttattttgaataggagcaagattaagatggaacaggttaagatgtattgggaaacgatgaaagtttttaaagcgaatccagaaatgccaaagacggaactgatcagccaaccattaccgcaaacgccggcacaaggttctactgcgccgcaaattgctattcggaatgtggatgttttccagcttatgagtgagttgacaggcaagattggggtgatgaattttgccagtccgattcatccaggcggtggtgtgatgtttggcgcccgagcccaagaggaatcgattgccaaaggaactttcctggtgcccgccttgaagcaacatatggccgattactatgatgtcaattgtcagcaggccaatcgcgggctctttagttccaaactgatttatgctgaacatgtgcgccaggtgtttgacgatcaaggccggcgattaccgaataaatatgttgatatcgtcacagtagctgctcctgatcgtcgggtagatccgcaattagatgacgaaaccgccatgcatgatattgcgtttaaggttctccaaacgttacgtgcttttaaaatgcatgcggttgatcagatcattttgggagcttttggtaccggcgtttttgggaatcccgtcaaaccggttgccaagatttttcgcgacacgttgttgatgcctgaattcgccggtgcttttaaacgggtttattttgctatttataatcccgggatgacgacaataaaggcgtttgccgcggtgctaaaaggtgaagatgaacaataaaggagagctgatgggcggatgaagcttacagtcatgcaacatgcaaatgccgaagatcttggggtgattaaagaatgggccgcagatcaggggattgaaacagtcacctatcgaccggaccaaggcgatccaattgcccagttaaatccagctgatattgatgggttgattgtgcttggcgggccgatgagtgtgaatgatgatctcgattggcttgctgctgaacggattttgattcgcagtctgaacaaacttaaccggcctgttttaggtatctgccttggagcacagcaaattaccaaagcgttcggcgccaatgtgtatcgcatgccgaaacctgaggaaggcatcgggacagtaaaaggaacggatgggacgttattgaatgttttccattggcacggcgaagcgatgagtcgattacccggcagtcagatactgtatgaaaatgagcacgcactgcaaggctttgcttatcatgagcggattgtgggcttgcaatttcatttggaagtcacgcctgcaatgattacagcgattggcgcggtagctgataaaccgcaagcgccggtcaacgaagcactgctagagccgggacatcaggttttgacggctattttagaacggctgtttaaatgatcgacaatgatgaagcatgtttccgagctgtaaacaaatacgaaaccaggtagctatgtagcggttaaatggtgacctgcttgcggattgaaggctggataccactgactaaatgagggtgattgtgccgactgttatgttaaagctgtaatctaatgtaatcttttgtcatagaacttaacctaaacgcaacacgccgaatacatgttcgtaatactcactgactatactaagcgacagttagttaagtcaccacacaaattcaggaggaactcgaacatgaaaaagctcttaagtacagtattattctcagccgttgctttatctgccgttgccttgtcaaaaccaggtcacgttaacgcggcaacgaaagatactgacaccaccgtcagcgcaccagccagtgataagactgaagctgatgtcacttataatggcggtgcaacaaccgtttggacctcaccgactgtgggacagcaagttaagcgttatgtagcaaccggtgaacatcttaaatttattaatagtaaaaaagtttacgcagaaatctggtacgaaacatctgaccatggttgggttccagaacgttatttgagcatcaacaccttgcagcaattatcatcattgaccaagaaggctgatgccactgctgtgccaactcagacaacctcgactgcggaacaggttgcgcaaacatccacagataataatcaggctgcatccgatgctgctgctcaaagtgctgcagcttctaatgcggctgcctcaagcgccgctgcatcaagcgctgcagcttccagcgttgcggcatccaacgctgctgcttccagcgcggctcaggctgcggctcaacagcaggcgcaacaacaagctcagcaacaggctgcggctcaacaacaggcacaacagcaagccgctgctcagcaacaagcacagcagcaggcagctgcatctcaggctgccgttcaacaacagcaagcaccagcaacccagacgacccaaacatcaactaataagggcacttttaaaattagtttctatgacccgtctgttttaggtagcaacatgggttacgaaggtgtggctgcaaacctgagcgtcttccctaaaggtactaagctgcgaatcaccatgtctaacggacaagtgttagaacgaaccgttaatgatactggctcatttgcatatagcaacccgcgccagcttgacgtcgcaatgcagggtaaggacattccatcagccggagtgctttctgcaaccgttgaagtgatcaactaagcatcggcaaactttaatcagttaaaatcagtttaaaaagcacgcgtcaattccctagcattaggaattgctaacgcgtgctttttacgtggttgattttagagagataagcttaatgtacccgtgaactcagtagtagataaagttgtgcggtttcagccagccgtttgtcggtaacctggtaccaacgattaatgatcaattgtgagctgatcagttcttcgaccgctaactgatcaccggttggttgttttggcggtgcaacggcagccactaactgtcctttggcattcagcagggcactaagaacctgagtgatcgcttttaattccgctggcgattggtcgaatgcgccaacaatcaaatcgtagggacccgtcagcaatttcaaccaccgatcgggcatgattcggtatcggagccgatcagaactcgcagctgcacgcgcattttgaatggcttcggtatcggtgtcaatcccaagaacagctgtcgcaccgtggttcaaagcataacggcaaaaccagccatcgccacaatgaatgacaaggacgcgcaagtcagtcaacggtggcattttcttgatgagtgcctgccaaatcggttgatgatcgcctgattcaactggcaggttggggttatcttgcatattaggatatggcgtttccataggttcacaacctttcacgttcattatagaggaaaaagatgaacgatgtgtgacgagatagcgggtaggagggatcacgatgctacctcaaaattcaaggcaagtacggcacctgtcagcaccttgtctaagaggaatctgaaaaaatgccggaaattcaaacaaaagtattgcattcctctaagaaacatgagaatatactatacatacttattgcccagtagttcagtggtagaatgcttgactgttaatcaaagggtcgctggttcgaatccagcctgggcaggccttaatcgcggatgacgataatatccgcgattttttatttgagcacgagccgacttctgcgccgggtaccgcgtcatgttgtgtttgcgctgacgcaattaagcgatggttcttgagtgagatggcacgatggttcgtcagtttaaattaaccagattaaaaagaacactaaagagacaggccatgaacgaattctttgatcaattgtaaacaaaacatggtatgcttaatgaaatacaaaagcaggaagggtggcgtcatgcatacaaagacgttgacacggatggggttattgttagctgtattaatcgggttggcatttgccccaccaattaccgttggattcttgggtgtaccaatcgttttacagaatatgggtgtcatgttggtcgccatgttattgccgacgcgtccggcaaccattacgatcggcatgttactggcgttggctgcgttaggattgccagtgttgactggaggacgcggtggcattgctgtctttatgggcccgacagccggctttatgtatggctggttgctgacgccgctagcgtacgcgggcatcacgcatttcctgaaacgggatttctggctcacaaaagcaatcggcatgacatttggcggcgttttgctgacagaacttttgggcgcattatggctaacggccacgaccagtatcggatttgtgcctgccattttaagcgttctgatttatattccaggcgacttgcttaaaatggcactgaccgtgttagttgttcagcaactgaccgctgttattccggcgttgcgccagaactgaatttggtcatcaatcaattaaacaattaaaaaataccgcaacctgatcggcgtttcatgtgatcggcttgcggtatttttagagttattcttgacaatgggcgaatgccaatcaaaacgggaagaatgactggtcgatatgacgtcattaatcgacaaacaaaagctcaaacgtatggtcttgggtattaatattgacggcaacgtggcggttaagatcgctgaccagatttcgggcaaatgccatcttggcctcaaaatctttcaatttagcggtaaaaggcaccgaattgaagtcaaaattctcaccaatgaaggcggcatctgtgacatatttaaggttgttttgatcgtgccgactacctggtttcaaaacagcgtctaagtaatgatagagttctgatggcgcgtaatgcagcggcttaactagatcggttgtgatcttgaagtctggcgcatcatcggccatttcttcattgacctgtacttgggtaagtccttgatataatttcaaaataggcacctctcatctttattttctattatagcatgctcaacgttgcgcgattcgctcaagtgctttttgaaattctgcctgcgccaaagcagtggtttcttttgcttgcgctttctccaggaatgttgtcaattcagcatttggggttgcggcaagctcgcttacagcccatgcggcagtcgcgcgaatcatggggcggggatcggtatcgatcacctcaagcaaatgagggacggcactgcgatcgtggagattgacaagagcaatgatcgcattacgttgcaagggcttttttccccgccaggcaccggcaagcttcccgaatcggtttttgaatcctttattgcttagcgtcagcatcgggatcaattccggcatgacagtatccgggtcaggctccatttcaggatgaacgtgaaaatctttgcctttgttgaacgggcacacttgctgacaaatatcacagccgtataaaacattgcgaatcattggccgaaattccgggtccataaacccttttgtctgtgtctggtaagataagcagcgttgtccgttcattcgaccgtcgccgagtaaagcatgcggtggacaaaagtcgatacagcgggtgcatgtgccgcattgacatgacatgggttcatcaggggcaaatttaatattggttatgatttcgcctaaatagacataggaaccgaactcgggtgtaattaataaaccatttttaccgataaaacccagccctgctcgttgggcaactgccacatcaattagttcgccggtatcgaccatgggtttaaagcggatatcagtctgtgacttggcggtttttttaataaagcgaatgagtgctgccattttccggtcgagaaccgtgtgataatcaattccccagctggcacgagcaaagcgcccacgtttgggaccggttcgtggtggtcggtcgtgaattttcgagggataagccagcgcaatggcgataatactttgcggttggtcgaaaattttatccggatagagccgctcgtccagattctggtgttcaaagccagttgtgtggccggcagctttttgtgccaaaaggcttggttttaatgcagcaaagttatcggctgtcgtaaacccgattttgtcaatacccagatctttggcgtgctgcttaatcgtagctttaagatccatgagcgccacccctaacaatggtgtttgccattattttagctaaatgacctgacgaacgcaaaaaatcgcaatgctgtaaattcctacgtcggtgaacgcattatgatacagtcattttaatagacaaaaagcgccatgcggctaggccgaacagcgcttttacattacgcacttccctgatttaacttcggaaagtgcaggataatgggcaggaggtgaatatcgcttttcacgacgatgttaaagtaccgctaaaatgtgaacagaatatgacgattttggcgctaattactgaagataaagttcgcgtaaatcacgcttttcggcgtcggttaattgcaaggcttccttcaggtaattgtgcatgttgccatattcagcatcaatggtggctaaggcgctatcaagaaatgcaccggagaccgtgccgagatcgcgaatgttggcaagcaaagcatcagttgcaccgcgtttgcgagcggcagcaagatttttctcgaccattggctgaataagatcgttggttgccagatagtcttggcgaatggtgtggccgtcaacgcctaatgctgacagcaaataaacggcgcccatgccggtgcgatctttaccagccgtgcaatgaaataaaacagcaccgtcattttcctgatgacttaaaaggatatcaaagaactgccgataagctttttgcgcggaaggcattttgacaatatcggcataagttttgaccatattttcaaagccagcgtggggatcgcgtgaaaaacttttttgtagagcatcggcttgttcgctgcttttggtttcatctgttgggaaaaccgggacgaaatgataagtcgtgttttcgggataacgatcaggttcggctgcttgttcttccggagaccgaaaatcgacatcggttgtcaggccatagtctgccagatattgcaagtcgtcatctgacagttcacttaatctggcagagcgaataattttacgtgatttaatcacttgacctgatttcgtcttgtacccaccaagatcgcgaaagttgaggccgtttttgatattaagaacaaatggttccaaatttaattcctccatcgtgaaaacgtttgactttagtatacgcgaaatggatggtgaccagcaacggctgaatagtttttcgtgacgatctcgcgtttatcggcgtagggatcggagtgtaaggaccttaagtgcaatggccaagaccgggccatcacgcttaaggccgcttacactccgacttctaagcgcgccggctcgcgcttactttccataacgcgctccccggcgcagggatctacgtgtaaggaccttggtcgcaatggccaaagcccggccatcacgcccaaggccacttacactccgatccctaagcgcgccggctcgcgctcactttccataacgcgctccccggcgcagaagtctgcgtgtaaggaccttagccgcaatggccaaagaccggccatcacggctaaggccgcttacactccgacttctaaccgcgccggctcgcgctcacaaaaaaagagccgttttcagacgactccttcatcacttcgaacaactattcaggctgtgaaataataagaccagcaatgaatgctgcgacgagtgacttggttcctgaagaaagcggcgagccgttgtaggtcaaaacggaattgtttccgatgagatcttcaatgcggatcgttgagccttctgcagctgctttttcctgttcttgctgtttcgcatacttatcagggtatgcaacaccgagcaattccagtgggtcggtttgatagtattctgcaagtttacgaatactgcgttcacttggaattgtttgatcattttcccacttggtaaagcttgccggggaagtatgggttgcctttgcaacttctacaattgattcgccacgacttttacggatttgtcgtaaaacactgccaacaccatttgtaatcattaatttcaccacgcttcttttcattttgaacgccaaatttttaaaaattaagaattcagcttactcactttaatatagcatcattacgcattaaatcaatcataaaaccgcaaaagtaaagcatattttaataaataatgatagccattctgcaagttgtatgttaatgcttcaaggatgttactggcatatattttacatggtgtgaagatagattaccatgtaaaagtgcaaatttatttcttgtattcgtttcctcaccgttctatgcttaagttaattagaaagttaggatgtgagcggaatggatcaagaatatgatcgcttgctggtacctgtagacggatcgaaggaagctgaattagctttcaacaaggcagttaaagttgcattggccaatcaagcacatttggatgtgttaaatgtgcttgataccaaacaatttatcggcagttacggcggcatgatctcaggtgatgcagtttatcagctgacacaggacgcacaggaatatttagagaacttgaaggatcaggcaaagcaaaccggcctgacagatgtggacatccatatccggtttgggaaccctaagacagttatcgcaaccgactttcctcacgaccatcacaacgacttgatcgtgatcggcgcaaccggtttgaatgcagttgagcgcgtattagtcggttcggtgacagaatacgttaaccgcacggctccgtgtgatgttctgattgtcaaaacaaaataagcgttttatcgatgaagagtcggcagcgaaggttgcggactcttttttggtaagcgcgagccggcgcgtttagaagtcggagtgtaagcggcctcaggcgtgatggccgggctttggccattgcgactgaggtccttacacgcagacttctgcgccggggagcgcgttatgggcgtaagccagaacataagggccatctagcctaaaatggccgggctttgcccatttaggttagaggtccttacacgcagattgctgcgactgcgagcgcgttatagataacagagaataacgccgccacttgccgaaaatagaattcctccaagccaccacagcctcaaacgcaacataaccatcttccgaagtacgttaactggcattctcgtaactgacggcgtaatgtatcgttaacaacgataaagacttggaggaatcctaaaatgacaaatgcacatgatcgcgctgagcaggtcaaaacagaggcggcattgcggaagtatcaggcgcgtaagcaatacacggactggttggccaaaatgtcaccggaattacgtgcttatcatgaccatgagtggggtgttccggttcatgatgaccaaaagctattcgagttactatcgttagaaatttttcaggctggtctgaactgggaattggtactgcataagcgagccgcttttaacgatgcgtttcatcagtttgatatcaaaaaagtggctgcgatggatgagccggacatcgatgccttattacaacgcaccgacattattcgcaaccggatgaaacttgaagcaacggtcacgaatgcacgggctattttgcgaattcaagcggcgtatggcagcttgaatgactatttatgggcatttgtggatggcaaaccacttgtcaatcgacctaaatctttggccgagatcccaaccagaagcgcattatcggtgaaaattgctaaggatttgaaaaagaacgggtttgccttcgttggcccggtaatcgtgtataattatttgcaaggcgcaggattaattgatgatcatgttgtgatgcaagactgatccaatcagcgcaaaaaggggcaagagcgttgaaacgcatccgcttatgggggatttttctggctatccttggttcaagtttatggggaatatccggtccagtgagtgaagctttatttgatgaaggcattaaagtttcctggctgattagctctaaaatgatcattgctggcgttgttttgatgacgttagctgtttggaaagatcgcgctgccattatgtcaccgtggcgcaatcggcgtgatgcgatacagctgattttgtttgtgttgtttggcatgatcgggatgcaatatatttactttaaagcagttgcagtggctaacgcagcgactgcgacaattttgcaatatctatcaccggttatcgttttggtttttttggcgttacgattacgtgaaaaaccacgccgaattgatttattcacaattgccatggcgatgcttggtaccatgctagtggtgacaaagggacggttaacacatttggctatttcgccgtctgcttttttctggggggtgatggccgctttagccgcagcagcgtatacattattgccggcgggattactgaagcggcattcgcctattgtcgtgacagcttgggctcaattactgggtggcttattagttgatattttcgatcctttctggaaacaaattccgcacttggatcaagcagggtgggccggttactggtttatcgtcatctttgggacgattgttgcttattcggtctatttggccagcttacagtttatttcgccgacagccgcgaccttgttagacgcgtttgagccgctgggggcaaccttggtgtcggtcatttttttgcatatgcatctaggtgtggctgagatactgggtgggatgatcattattttaaccgtggcgatgatggcactcatgaccccacgcggacctaagcttgaggatcgttccgactaagtggctaatgcgcaacctgtttttaggcaaaaaaagaaggacaaatgaacgaacccttgatagcgcttggctcgcaaaaaattcatttgtccttttctttgtttgtttctcaggtggaagcttgaacctatgctcgtcaaatcaaagcgtgtcgcaaattgcgaggcagcatgtcccaacaaaatcaagcttaacttgcgtgtttaacgagaaggttgggaagtgcttgttggtgctggttgcggcgtaatgcgagaatgtagccgtttttgacgcgcagacgataggtgacaaataactgcagttggattggacgccccaaatagtcaataatcggatatggtgtctgattcgtcggcatgatgctcatccccttaacatcattatagaaccaaaaagtgtcacaagtttataacaatcatgcacatcaaacccgatgtccatgctatactggcgtaagaatctgcgatgaatatggaggcacaacatggatcagtttagtatcagtaatttagcagactggcttgaggcccataatgatgagctcatggctaagaccacccagctggatcccacgaaggtttttgccattgtggattatttaaaggtacttaagaaaccggctgaaaaatacttgcacatgaaacaggctgattattacaccactgaatcggatcacaaactcaatctgcccgatgatcaggcaccgttaacggcggcacatgatcggattatggtgaatcacgttgatggttcgattaaagatgatcatttaaactttacatataaccatgaaccggtttttgacggtggttatgcacctcaacgcgatctcaacattgtgaagtatgggcttgaagtgatcggtgcggttgcaaccagcgggcacattaaaactgtcagtgccgcattgtcacctgatgcagttttgacgcttattttagctgccaatgcttttgccacgcatcaagcataaattttatactggcgatgctaaccagtcatgatcggtgagttcatgatattttttagaaaccggaacccaaagatgggcttttaggatagcgctgatgctctgccaaaaagcagggtcatcgcgctgtttttggttagtttgaatcgtgattgacgcgccggtttcagtgatggcggtgatattagggtaaacaatttgctgtaattgggttgcgatgaaatctgtctggttaatcaacataagaatcatcctttcatttgttgatagaaccagcatagcttgtccatgtggctttatcgcgaatcagtcgggatgaatttggggataaataatgataaacgtgtggttttttccctaagcaaaggttaaggacgttaagaaaaatgaagcctcgataacacttgcagctcgaaacgcaataatgctgatggagtgtggacttaagcgtgtgagtttacaggtaaggtgcgtaatcttgttttaagcgcatacgtaatgtttgcttggtggtttcggggatgaaagctgcattgacggcattgaggttaaaagttagaaagtcagcggcggtggtatcaaaatatgcttgataccgttcatactcgtgggtcagggtggtgttggagacagtacgattatccgtattaatcgtgatggcggccccggcttttttgagggcttgataaggaaattctgccagtgaccgtgcggctttggtttgcaagttgctggtgaggcagagttcgatcgttgtatgggttttcacgattgtctgaatcagttcaggtcggtcaaaacaagcggtggcgtggccgattcgcggaatacccaagcggatcgcctcggcaatattttgcgggcagtggcattcaccagcgtggaaagttaacgggacgccaagtcgttgcgcagtttcaatggcaggtgcacaaactttagtcggatagtcagcttcgttaccggcaaaatcgccgccaaccaaggtatcaccgactaaaggagcattggcggtaaacatggctgcattgtctgcgtttggcaattggcgcatgccgcaaactaagaccttggcaataatatcgaattgggccatagcctgatgtaagcccgtgataaccgcctcggtggcttgactcaatgttaaatcgccagcagtcgaaagtaccggggcaaatcggatttcgatatagcggacattttcgcgggcagcttgggcgacaacatcaaaggccgccatctgcagcgcctccttggtttgcaaaaggggtgcgataaagtcgaatgtttttaggtaatcagccagattttcagaattttccggagcctggaccagcttgcgtaaggcgttatcatcggcaggcaacggttgattgattttttgggctagttgacgaatgcaatttaaggacagagacccgtccagatggcaatgcagttccgttttacccagcgtatgtaaggtagcaaaatccatgatgttctcctttgaatgaatagattgatttgagtttaacataggtagcaagtagggcgttacaatagtcataacaaccgagtgaagggtgataaaaaatgcgcatggtcgacttgattacaaagaaacgcgatcacggggaattgaccgatgatgaattaacctggatgattcagcagtataccgcggaaaagatcccggattaccaaatgagtgcgtttttgatggcagtctattttaacggcatgagtgcggctgaacgcgatcactttgcgtttgcaatgctgcattccggtgacgtccttgatttaagcgatattcccggcatcaaggttgacaagcacagtactgggggcgtgggtgataaaatcagtattccgctggcacctttagtagcttctctgggtgttcccgtacccatgatttcaggccgtggccttggccataccggcggaacactggataagctagaaagtattccgggctttaatgttaacgaaactgaagcccaattcaaacaccaagtgcaaacactccatcaagccattgtgagtgccagtcgcgatgttgccccagcggatcggcgaatctatgcattgcgtgatgtgaccgggacagtggaatcgataccattaattgcgggctcgattatgagtaagaaactggcgagtgggaccgatgccttggttttcgatgtcaaagttggcaatggtgcgtttatgaagacttcagaagatgcgcgtgctttagctaaagccttggttagcatcagtcaggctgccggcgtcaaaagtgttgctttgctaactgatatgaatcaaccgctgggcattacaatcggtaacagcttggaaatcgccgaatcaatcgctattttaaaaaatcgcgggccacgggatgtccacgacttaacggttgcattagccgcacagatgttggtcttaggcaaaaaagcaccaagtctggaaattgccaccgggttagcagaagatgccttgcgtgatggccgagctttgaacgcgtttaaacagctcattcaagctcaaggcggtgatccggcggtggttgatgatccgcggaagttaccgcaagcagcatatcgaattccggttaaagccgagcaaagcggtattgtcactgcgattgatacgaatgccctaggcgtggcggcaatgcaactgggcggcggccgcgctcaaaaaggagacacgttggacttggcagtcggcttagttctacacaaaaaactgggaacgccggtgactaaaggcgatacgctggtcatgctgcacgctaacgatcaacatgtggatgcgattgtagagttggtgcgccaagcttaccatatcggcacaaccgctccaaaaaagttgccgttaattcatgaagtgattcgaccgtaaacgttttttcacaaatagatgcgattgttttctctactgtgaaaagataggaaatcgactttccggaaagcggttgcgattattgacgtcggagaatatcataacaatcttgtgaaatgaaatatcctaagaagcatgatttccatctggttttttgggtttttggtttttaaaaaataaatatcggggtatacttagattgtaatcaatctattaaaggaggagaaacatatgctaatggcaatggacgtattatcgctagctcgttttcagtttgcgatgacgaccgttttccatttctttttcgtaccgttttcaattggtatgggtcttgtggctgccatcatggaaacgatgtatgtacgcaaaaaggatgagacatataaaaaaatggccaagttctggggcaagattttcttgctgagctttgctgtcggggtcgttaccggtattattcaggaatttcaatttggcatgaattggtcgaattattcacgattcatgggggacattttcggagtgccactggcgattgaagccttgttggcattcttcatggaatcgactttcatcgggttgtggatgtttacctgggaccgcttcaagccagctgtacatgctatctttatttggatgacttggttgggcaccacgttatcagcaatttggattctttccgcaaatgctttcatgcaacatcccaccggttttgcgatcagtcaaacaactggtcgggtcaaattggttgactttggtgcggtgatcaccaatccgcaactgtgggttgaatttccacacgtcatctttggtgcctttaccacagccggttttgcggttgcgggcatggcagcttggcggttgcttaaaaaagatcatgttgatttttacaagaagtcgcttaaagtcggcttggttgtcgggaccattgcttctgcctgtgcgattggctttggtgacttgcagactcagttcatcattaaggatcaaccgatgaagtttgcggcaactgaagggatttacaaagacaccagtgatccggcaccttggacgttggttgagttaatcaacaccaaagatcacacaactagcggcaacattgaagtgccatatttactgagcttattgtcctatcataagatgaacggttcagttaaaggcatggagactgctaataaagagcttgaagccaagtatggcaaagataagaattattatgtaccggttaagaccctgttttggagctttcgggtcatggctggtggcggcgttttgctcttcttgctgggtgtcttaggcctgtggttcagtcgtaagaagaaggatacgttgctagatcagcggtggttattgtatattctcggctttgctctgtggctgccgtttatcattaataccgctggctggttcattaccgaattaggtcgttatccgtgggttgtttacggattgtacacgattgccgatgcggtttcgccaaccacgacggccggtcaattgctgttcaccaacatctgctacttcttgatctttaccttattaggtggcgtgatgatttactattcacatcgcgttttgaagaatggaccagatggcgatttgaacaccgattatggggtcaacagcgatccgtttgctaaggaggcgttcgcaaaatgagctggttacagattttatggttctttttattgttcgtcctgttcagtgggttcttcgtccttgaagggtttgactttggagtcgggatgtcaactaagctcctggcccacaatagcgatgaagaagatcagttggtagcaaccattggcccacactgggatggtaatgaagtgtggctcatcacggctggcggtgcgatgtttgcttcctatccgatgtggtatgcaagcctgttctccggcttttatatcatgttcttccttgttttgtttggtctgattgttcgcggggtttcctttgaatttgccgcacatgctgagaccaaaaccgggcgcaacatttggcgttgggcgttggcgtgtggcagtttgattccgccgtttattttgggcatgattttcaccgcgattattcaaccgctgccgattaccaaaaatggggatgtgtttccgacgttgggcaatcagattaatctattgacgattgtcggcggcgttgcagtgaccctgatgatgttgatgcatgggctgaacttcattcgcttgaagaccacaggcgacttgcggaagcgagcacgtgactggaatagcaagttgtattatctgctttatgccggcgaagttgttttcgctgtcttactattcttcatgaccgatttcttcaaggaacgcccgattagcacgttgctgattctggttatcatcgttggttcaacggtcgcagcccatatcggggttttaaaagataatgaagtcttgtcattcattggcagcgcccttggtttggtcggcgttgtcggcgtcatcttcaacggtttattcccgcgggtgatgattggtcaaaatgcggccatgtcgattctcgctaaggatgccagtgccagcccattgacgctgaccattatgaccattgtggcagttattcttttgccaattgccttggcctacttcatttggagctatgttgtcttccacaaacgcattcaagccaaaggggcggttagcgaatgatcgataagacgctgttgcgcctttcgggaatgcgaaaaacaatgacaatgcttgccgggtttgcactcgtgcaagcttttgttattttactccaaggaaaatatctcgctgaagggattgttcattcttggaatcgtcaaagtttagctggtttatggctgccgcttggcttttttgccgcggcttttacggtccgccagttgatcgtgtgggtacgaaaccgtatcgccgccaagtttgcgatgaaaagtgctgcctggctgcaagcgcagttgttgcgacatctttttgcgcttggtccggcagcggttgctaaagaaggtactggtaatttagtcacgatggcacttgacggcattcccgaagctgaaaattatatcgaacttattttaaataagatcttgaatatgagcattattccgtggattttggtggcttatatttggtatgaaaactggttgaccggattcacgttgctgattatgtttccaatcattatcttgttcatggtcatccttggcttggcggcgcgtgataagtcggaaagtcagtacgccggatttcaaaagatgagcaatcattttattgattcactgcgggggttaaaaacactgcaactgatgggtatcagtcgcgagtatgccaacaacgtctatgaagtctctgaagattatcgcaagcagacgatgggcgttttgcgaatcgccatgctttccacctttgcgttagatttttttaccactttatcaatcgcagtcgtggcggtttttctgggcattaagctaatggatggcacgattccgttgtaccccgcgatggtagcattgattttggcacctgaatattttatgccgattcgtgatttcggaacggattaccatgccactttgaacggtaagaatgccatgacggcgatctggaaggtgattgaccagccgctgccaacggatacgcatgtgctaccagcgtttaagggatggcagccgcaagatacactcagcatgcagcatcttgattttacttatgctgacaagcgagcgggcattcaggatgctaatttaacctttactggaccggaaaaagttgccattattggcgcgagtggatcaggaaaatcaacgttactgaatttaattggcggatttttacagccgcaagctgccgatatcacgttgcgcgggaccaaaattccccatatgacgcaaacggcctggcaggatcacctgagttatattccgcaagatccttatctgtttgcggatacgattgcggctaatattcggttttatcggccggatgcttctgatcaggcagtgcgggatgccgcagaatcggctggtttgacgacttggatcaattcgttgccagatggttatgcaacgcgaatcggtgaaggcggccgcggcatttccggtggtcaggcgcagcgaattgcccttgcccggactttaatcgacacaaatcgttctatttggcttttcgatgaaccgaccgcacatctggatattgaaaccgaagcggcgttaaaagaaaccttagttccactttttgctaatcgactggttatctttgccacgcaccggttgcactggttgaaccaaatggaccgggttatcgtggttgacgggggcaagattgttgcggaaggaaccccgactgaattagccgcccactctaagccgtatcaggcgttggtccatgaaatgcgaggtgaattcaatgcattggttgaaaaatgaacattgggtccggcctgatctcaagcgctatcggtggctgttgttttggtcattgattctgggcattatgacctttgtctttgccggtgcgctgatgttcacctccggatttctaattgataaaagtgcgaccaagccactgtttgctgcgatttacgtcacagtggtgctgacccgggcattcggggttggccggccagtctttcaatatgctgaacgcctgaccagtcataattgggtgttgcggatcaccagtcacatgcggcgaaaattatataaagtcctggaaaccgatgcggcatttgtctccgaacatcatcagacgggcgatattctcggcttattggcggacgatatcggacatatccaaaacctctatctgcgaatgatttttcccacagttgtcggagccggtctaacggtcattgcaacgctattattgggctggtttaactggggctttgccttgtggatattgctgctgttgctcttccagattttgattcttccatggtggggtttggtcgttgaacgttttcgtaaagcggagcagaaacagttgaatcatgatgcctatgtgtcgttaaccgattcggtgctgggcttgtctgattgggtgattacccaccgcgatcaagatttcatgaagcaaagtctggcagcacccaaaaaacttgctgtctctaccgctaagtccaagcgatttcagtgggggcgtgattttatcggccagcttttgtttgctttaatcgccgttagtatgttgatttggaccaatttggaatggaccggcaatcagtcaatggctaattgggttggcgcgtttgtcttggttgtcttcccgctagaccaggcgttttccggaatcgcccaaggggttggtgaatggccgacttatcgggatgccatccgtcacctcaatgatttacacccggttacgcgcgagttgccacaacaacagccagtaccgactacctttaataaaatcgaattaaatgatgtcagctttcggtatacaccgtctgatcctgaattgatcacaaacattgatttgacgatccaggcaggagaaaaaattgccattcttggccccagcgggatggggaaaaccacgctcttgcaattggtgctaggtgatttaaccccgacaaatggccacgtactcattgacggacaagatgtactcgactaccagaatcaccgcacgaatttgtttgcggtccttgatcaaagcccctttcttttcaatacatcgattgtgaataacgtgcgtttgggaaatgaagatgccagcgatgaaaccgttgcggcggcgttaaaagcggtcaaattggatcaactggttgctcagttgcccaacggtatgaacagcagtgttgaagaagcaggctttggcttttccggtggggagcggcagcgtctgtcactagcacggatattattgcaggatgccccgattgttttgctagacgagccgactgtcggattagatccgatcacagaacaagccttgttgaatactatgttcacggttttaaaaggtaaaacgattctatgggtaacccatcatctgcagggagttagccaaactgatcgtgtcattttcctggaagatggtcgattgacgatgaatgactcgccacaacatttggctgaacagaataaacggtatcaaaatctttatgcgttggatgcagggttgaggtagtgctggagttgtggcatgccacggtttgtgcatttgaaaagcagcttagacactatttttaggatagtggctaagttgttttttattggcttgttgaagacgatgcagaacctctccgcatgtttaattttaaaaatagcacacggtgtataagtacagtagcctaaaagacttttgcttcgaaatgtgtgtactaacacagccgccttgtgctaaaattcatcatataaatgtaagcgatttcatacaaggaggtacaacatggaaaaagttgcgatcatcggggcaacgcttttacttagtattgggttagtagcgtgtggcggtgggtctgggtccagttcaagtaagagcagcagtaccactagccaaaccagcaacgccaaagtcaagattaaaacgggtgcggatgcgaatgccaaagttccagctgctggtactttggtgatgcggcaattgtatgcggcaccgcatggtaagcagtcttttgcggcggtgaatgtcacgctgaatggtgataccatcgtgtccgctagaatcaatgagttccagtatgtcaaaaagagttcggattggactggggtgccaaattccaataaagactttggaaaaaattatccgtccggtcagattttgattgctaaggcggaaaatagcaaaccatactcagcgttgatgaaaaaggaagcaaaggcaactcacacgtgggaagaaaacgaaacggcgattacgaattttgttaagggtaagaagattagtgatctaaaagcggctgtggctgaagtgaagggtactaagaaggttagcgatgttgtttccggtgcgacttttgctgacacagccggttatctgcaagcgatttacgatgcggcaacgaccggaatggttgcggaaggaattcaaacgactgatccgaatctcacggaaggtcaggttctggcggcgccgcatgggactcagtcgtttggcatcgtgacagttgccatgcaaggcgataaaattgctaacgttttcttggatgagttccaatatatgccagccaaggacttcggtgcggttcctaattcgaataccgattttggtaagggcattaaggccggcacggttttggcttcgaagcgggcaaactctgatgcttattcggccattatgaagtcaaaaggcaaagcgacaaagacctggcaggaaaattcaacggctattgatgaatttgctaaagggaagaccgttgccgaacttgaaacagcagttagtgacttaaaaggtaagaagaaagccagtgacgttgtgtctggcgctactttcaccgacacggcaggttacttagcggcaattatcaaggcggcaaaggctgcaaaatagtcgtgttctgaaaatgattgtgccgtgagaataacgaagaaagctgcgaatggaagttcgtggctttttagttggcctgaataacttggctaatcctgatgggcggcgctgacaggcagtgggtcgtacttaggacttgataacgtgtaagataaatgttgaaggctttaaaccgaggtgaaaagaatgcgctggcttaaacgctatgtacgaccgctggattatgtcattgttgtcttgctatttatcgcctgttttattccggcggggattttttcgctgaccgaagccaatgtgaatacgagtcaaaaggtggcggtaatttcagttaatggtcaggtcaaacggcgaattaagctgggagcgcacacccgccatcagcagttcacgctttatccggcaaaaggtcagtacaatatcattgaagttgatggtgaacgtattcgggacaaagaagataattcgcctgaccagattgcggtgcatactggctggattagtcgcattggccagcagagtatttgcttgccgcataagttgctcatagagattaagccggctcagggaaatcatggttccaatggcgatgcaggcggactggttcatccataatacaaactggtggcggccgatcagtgtgcgctgaatcggcttttttgaaaatggatagactactgacagatcagttttgacggcttgcactaaaaattgctgcagtactgatgacttcccgtggtaaactgtaacaacaatctgtcattgtgctgagggccagcggtaggttgaaacgctgcatattcaaagtgagaaaagaggcaagcctttgtttggattactgaaatacggacgtgatcagcgttgggctggggtgattgaagcgctttttgattggttgccaaccttactaccgatcttgattgcgcttaatttgggtactgggcatcaggttacggcgctcgtgacaacactggtgttaatggcggtgtggttgggttacgtggtgggttatgaacggcaccaccgccacgcatgggccatgagtgcgaaacgggagctgcgggatcgctattttactgcgctttaccgacgcaatgatgccgttgcaaccactgctgcggatcatgcggtgattcagcgcgacttgggtggtctcaataatttagatatgttttacagcacgctatttccaaccattttgcaggcgggcatgacgtttttggttttaattgggctttcgttttggtaccgctcgtggttggcacttttaccatttggctgtgtgtttttaattgggctggccatgatgtttttaggcaagcggatgtcggcgcagaacaaggctcatctcagtgggtttttgaaaatgggcggccggttcatggatgatttacgcgggatgaccaccttagtgatgtatgatgccgcagatcgttatgcccagaagtttgccgatgatagcgagttttttcggcaggcaacaatgaatcttttgaaaacgcaattgcagaccttgtttgtgattaacggctttgtttatttgacggtttttgctggcggcttcatcacggcagttcagctggtggccggtcaattaccggtggcaggcgcgtttgccacttggtttacattggcgatgatgatggtaaatgctcggcaactcggttattttgtccatgtggtgaaatcaaatggcccatcattggcagccattttggccacgatcgccaaggctaaagcggcgccggacaccgtcaaaatcacggataatcgcccgcttagccaaattactttggatcaggttagcattggatatgccgcagatgcgccgctggtaacggggattaatgccaccctggttccgggtaagctttacggtttggctggcgaaaatggaaccggcaaaagtacgttaatccaagcgattttgggacgattgaaacctttatccggcgccattatggctgaccagactgcggtttcggctctaagcaatgtgcaacaagcggccgtgttcggctatgtcactgccaacgaatatcttttttccggcacgattcaggagaacttattgttaggcaatcgcttcggtgatcaatggcaagccagactcgcatcgttgggattgatgcagtttgtgccatcgctggaaaaaggttacgcgacccaagtaggcgaaaacggacggctgctttcacctgggcagcgacaacagttggcgtttgcccggatgttgctggcggacaagacggtttacttattagacgaaataacatcgagtattgatgaagccaatgcggcgattatccttcaggcggttaagaagttgagtcgccataagattgttttgttcatttcccatgatctcaaggcaatgacgcaggctgatgaagtctggttcattcatgaccatcagctgacggttgccaatcatcagaggctgtatcaaaaacagcctgcatatcggcaactggtagacaacccggagatgatggaaaacgaggtgaattccaatgattagaggcctgttacgctatacgcatcatctgaccggcgctatttttattagttttctaattggtatggtggctgaattagctaaagtcgtggtgttggttttagctgctatgatgctttttgatccgcaaaacgctggacaattgctgttacctggattgatcgccattattttattaggcttaggcagctttggcgagcagtattccggacattatgttgcgtttcacgtgttggcagacttacgtggagcggtttatcgccaattggtcaaactggcaccggctaaactagatacgcaagctagtggtaagttgcttaagctaattggcagtgatattgaagccatggaaattttttacgcgcataccttggttccggttgcgatcgggttggtatacgggctcttggtagttggcatttatagtcagctaaattggctggctgcaatcatcgcactgattagttatgttgctgtcgggatggtggtgccatatgcgcgtcatcggcaactgacagccaaaacccaggcagccgatcgtttgaaagctgccaatcagcaatatttactggaatcagtgcgcggcatggcggtagtgcggcaattagggatcgccaagcaacgcatgacaaaaggcaatgaaggttttgatcaggaagcagcggcttttcagcaggcgcagtttagccaattgttgaaaaatgtggcggcaacggtcgtcattgttggtggttggctactgatgatttggctcagtggctggcagcaacctactgccattcagcaagccttgctagcaatctttccacttacttttgggccgctgctggcgttaaacaatctgccgggctcgttgctaaatggtcttgcggctgcgcggaatttatttaacttattacaggaacaaccgctaaatgctgcatcgccaaacgcaaaccgcgttgtgactgccattaatcgaattcaagtggatcaggtcagctttagttatccaactcggccggaagcggtattaaaagacgtcacggtgactttgaatgccggtgaaatcgttggttttgttggcgcgagcggatcaggtaaaagtaccttggccaagctgatcatgggttggtatccggttagtcacgggcagattttgattgacggtaacgatttggcgaccatcaagccgactgcattacgcaatcaaatgaattatctgccgcagacgccggtattcttttccgagtcggtgcgggataatctcacactgcatgacccagccatcacggatcagcagatttggacagttctcgatcaggttaagctccgggcgcgactggagcaaatgagtcacggcttggataccgtggttgcggctagtcacgtgccattttcaagcggcgagcagcaacgactcgagttggcgcgggcgttgttgcacccaagcagtgtgttggttctcgatgagccgacaagcaacttggacaccgaaaatgaacggttgattttagagacgattaaaacttactatcatggcattgtgattctaatctcgcaccggcctgaatcagcagcgtttgcggatcgggtttatcggttttccgagcatcaggtggtcttagtaactgaatagttagccttctgaaaaaaagtgcggtgaaaattgaagccaagtcgtttacgttgtcattttctcgaaaaattgttagcctgaatctggatgcggattgaaccgtgatctgaccgccttgggggagggctagctatgatcattgatgcgattcttaataacaatgccgttgtcgtgcggcgtgataagcgcgatatcattgtcgtcgaacgcggtattgggtttcatgctaaaaaaggtgaccagttaacgctgcaggattcgatgaaaatttatgtgcctgaagatcacgccaaactaaagattgcgatggcgacgattgccagcttgcccgatgaatatttaacgattgccgcgcggattattcaggaagctgaagttcagttacacacaaaattcaacagttatttgttaatcgagttagccgatcatatacattttgccgtgacgcgcttgcatgaacagcttattctgcataacaaattactgtgggagatccagattgcctatgagccggcttttcgcatgggtgaatgggcgttgacggaaattgctaatcagatcggggaacagcttcctgaagatgaggcgggttttattgcgttgaaatttgtcagcaacgatttgagccagcaacatcccgttaactcggtggcgttcacgcaaatgctggctaacattaccaaaattattttctatcaactcggactgaacatgaacgctaagacgccagagtatcaacgcttggtcattcatctaaagttctttcttcaacgcgtttatgcaacttcaacggcgaaaacaccggtatcacccgaaccatatgatcaggccttgctggcacatctgcaacaagactatacgcaggcataccggtgcatggaagatgtggttaagtttatgcagcaaaaattacccggaccgatttcaaaaaacgaacaaatttatctaaccctccacatcgcccgtttagccaagagtcaggggcaaagtttaaaaagtagttgacgaacgctaatccatcagataagatgatgatgttgaaagcgaatacattttaattgggcttgtaactattgaattaggcaaaaccagaaagatacgacttgtgtgcaccacaagtcatgtctttctggcttttttttatgtgagcgcgagccagcgcggttaggggccggagtgtaagcggcctcagacgtgatggtcggtctttggccattgcgactgaggtccttacacgcagacttctgcgccggggagcgcgttaaagccggcgtcagcagcgggtgcaactgcaggtgctgagcgtaaactaaaggaggcagtttgaaatgggcgaaacagcattagccaaacagttgttgaaactggttggcggtaagcaaaatatcaatcaggtctggcattgtgccacccgtttgcgttttacgttaaaggatcaagacaaggtacccaaagaaaaagttgaagccttagacggcgttatcaccgtcgtggaggctagtggacagtttcaggtggtcattggcaacaatgtcagtgatgtttatcaggaagttgtaaaactggaaccatcgttgagtgatggcacagaaggaccagcaaccgtgacccatgaaaaaatgacctttaagcgcgctttcaacggcttgctaacctttatttccggcgtttttaccccattcttgggtgcaatggccggtgctgggatcctgaagggcctgttatcgctagcggtggtgcttggttggctgacgacgaaaagcggggcctatcagatttggtgggccgcggcggatggcattttctattttctgccgttagccttggcatttacggctgccaaacagttgaaagtcaatcaatttgttgcgatggcgattgcggcggcgatggtttatcccaacatcgtggcgttggttggcaagccgagtatcgactttttcggcattccggtggtggctgccaactatacggcaaccgtgctgccaattttgctggtggtcgtggtgcagaagtttttggagccatttttcaacaggatctggcatgaatctgtgcggaacattttggcgccgctgtgtctgttagtcgtgattgttccgttaaccatgctggtggtcggtccggttagttcgattctcagtaatggcttggcaactgcgattgtgtcactgaataagagtgtgccggtcttggcagggatgattcttggcggattctggcaggtgtttgtgattttcggcgttcattgggctttggttccggtgatgatgaacaacattgcgctgtatggcaccgatccgatgatgccgattcttctacctgctgtgttggcacaagcgggagcagcgtttgccgtgttcctcaaggcgcgggatgccaagatgaaaagtctggcgggctccagtacgatcaccgcacttttcgggatcacggagccgacgatttatgggatcacgttaaaactgaaaaagccattctactgtgcctgtgttgctggtgcagttggcggcattatcgtcgccatgtccggtgctggcgctaatgtggcctcactggcaagcattttgtcattaccgacttatttaggcaaagggtttggcgtttcggtgattggcgatgtagttgcctttgtgctgggcgttggcttgacgctcgcatttggcggcattaatgcaccggctaaaaatcaagctgcggctgaggtggttgctgatcacgccgaaactttggccgcgccggtaaaaggaacattggtcaccctcagtgacgttcctgatgaagtgtttgcttcgggtaccatgggtcaagggattgcgattgaaccagaagaaaatgtcgtcaagtccccggttgccggtaccgtgagcctagtttatccaacagggcacgcaatcggcatcacatctgacaaaggggccgagattctgatccatattgggattgacacggtgaacttaaaaggcaagcacttcaaagctttaattgaacaaggccaaaaagttaccgttgggacgccactggttgaatttgactaccaagcgattcaagcggccggatatgcgccgactgtgatgatgattgtgacgaattctgatcagtatcaagttgagacccgatcagatggtgcgaccgacgacgatgcattaatgacactggcatagaaaaggtggtatttgacgatgaataacttgaaatttccaaaacagtttatgtggggtggggcaaccgcggccaatcagctagaaggtgcttatcacgaggatggcaagggtttatcaattgccgacgtgttgcctcaaggaaaagaccggtttgcgattgtgaaccaaccggactttgactggacgattgatgaaagcaagtatcgctatccgaatcatttgggcattgatcattaccaccattttaaagaagatattaagctatttagtgagatgggcttcaaatgttaccgcttttccattgcctggtcgcggatttttccagaaggtgatgagcagcaaccaaaccaagccggcttagctttttacgatgcgttgattgcggagtgcttaaagtatggcatcgaaccgatcgtgacgatttctcattatgagatgccgcttcacttggtaaccaagtatggcgggtggaaaaataaagcgttgatcactttctacaagcggtttgcggagactgtgttgacgcgatattttaaacaggttaagtattggatgacctttaacgaaattaatagtgcgttttcttttcctgtcatgagtcaaggcttggtcgccagtaacggggctgatgataaacgcaacattttccaagcgtggcataatcagtttgtcgccagtgcttggacagttaaaattggtcatgaattggatccgcagctgcaaatcgggtgcatgttgctgtatgcgaccacgtatagctatgatgccaatcctgtcaaccaacttgcaactttgcaacagaatcaggcgtttaactttttctgcggcgatgtgcaagtgcgcggtgaatatccggcatacactgatgccatgatggatgagtacggcgttaagttccaggatcttgaattttccgcagctgaattggcgctgttgaagcattacccggttgattatatcgggtttagctactacatgtcagcggtgattgaaactacgcaggagcatcatgcagaagttggcggtaatttgctgagtggtctgaaaaatccgttcctgaaggcgagtgaatggggctggcaaattgatccaatcggtctgcgtattgccttaaaccaactttacgatcgttatcgcaagccactgttcattgttgaaaatggtttaggcgccattgatcggcctgatgaaaagggtgaagttcaggatgattaccggattgattacttgcggcagcacatcgagcaaatgggtgcggcgattcatgatggcgttgatttgatgggttacacaccatggggctgcatcgacttggtgagtgcctcgtcgggacagatgtcaaaacgctatggcttcatttacgttgatcttgatgatgatggggaagggacgttggcgcgcagtaagaaaaagtcatttgattggtatcggcgcgtcattgcttcaaatggcgcggatctggcttaaatcttggcgcgcatggattagctagttgaaattcacacgaaaaaggacaccactcgaatccatccgaatattcggtggaatcaagtggtgtttttggatgcatgaaggtggtggcgactgagcttgacgttggttgtgtcatttgggtgatgcaaaatcgccattcacatctactttttgtttctggcgcaaaattttaaaaagtaagtgatcgaagccgcttggtttgtgacgaatttaggaagaatttgttatgcttgatgagtcaggatcaatgccattaacgtgtcgcgataaactggttcctaataagtcgtgattaaatgtggcaaatggtgcacatttttccggttgaagcagcggcgccgtggtataagattcggtaaggttagagcaaagcggttgtgtgaagtgtgaatccagcaagctgaattcctggattgatgaaaggaagacggatatgtatcgagatctgaatggtaaggttgcagtcgtgaccggtggctccaaaggtattggcgcgggcattgcagaacggtttggcaaagagcatatggccgttgtgattaattatttaggtgatcacgaaggcgcgcgaaaaacagccgatacagtgatcaaaaatggcggtcaggcagtcagtattcatgcggatgtttcgacagaagcggggatagcgagtttggttaaaactgccgagtctgaatttggccgccttgatgtctgggtcaataatgcaggtatggaaattaaagcaccgacgcatgaagtgtccctggatgactggaataaagttattgcgattaatcaaaccggggtctttttaggcgcccgggctgctttgaattattttctcgaccatcaccagccaggcaatattattaacatctcatcggtccatgaacagattccctggccaacgtttgccagctatactgcagctaaaggggcggttaagcttttcacggagacgattgcgatggaatacgctaaccgcggaattcgggtcaacgctatcggtcccggtgccattgagacgccgattaatgcggaaaagtttgctgataaggcgcagtatgaccaaacagtcgctatgattccccaaggacgactaggtaaaccggaagatgttgccgccggagcagcctggctggcatcgacagagtcaagttacgtcactggcacgaccctatttattgacggtgggatgacattatatcctgcgtttaaagacggacagggctgatcaatgttgcgaagatgcaaaaaagtcgccatctcgattatgaaatggcgactttttgtttacgggttagaattcgcgttttttatacagcacggtgcttaaccaccaagagaagatgaaagctgaaataaagattgccacaattactccgaaccaaggcttgagggcatctaagtctacttggaagcttctttcaagaaagacggcaattaagagaatggcaagtggaaaataagcagcaagaggcgcgcgcttaaaccccaagccaatcatgagtggaaacgataagataatttgaaagagcatgagcgcagtaccaaaacaaagcatccacccgaaagcttgtgaatcacggattggattaacgcgagccatccaacccagaccaatgataagcatgctgcacgcgtcaattaagcccactgtcatcaaaccgaacagataatggccggcgacaatggtagtacggcggaccggtaacatggtgtaaagattctccattccttggcgatcaacaccgacaaaaggcatcatcaataagccaatgctaagacccgtaatgccgcctgcaagcggggttgctaagtcaccgttcaagaaagggagaagcaacaaaacgatactgatcaaagtaccaaaccaaaaatacttcttactattagtatgaaatacagccaggtccaagccaacaagtttgaccaaatcacgcatgtgcacgcctccccttgccaaaagcaatcatcaaggtttccaaatcaactgtttcctgaacaatactgtcaggcagttgatcggcttgatcggcaggccaaataccggagaatccgacgcggctttgttgcaatccgataatcgttgcttgaatgcccggggttaactcatttgggccacctttaatcataatataccgatcaagcaggtcacttaatggcccagtgaaggttactttccctgttagcaagtaagtgacataatcggccactttagccaattcgataatactgtgggttgaaatcaaaacgctatgttgatcgtcgctgataaaatcctgcaaaatggcaatgagttcgtcacgggcaatcggatccaagccagacgtgggttcatctaagattaagagctgcggatgatgggctaaagccgcggccagttgcaacttgattttggtacccattgataaatcacgatatttggttttttcaggaatcgcaaaatcgtgacataactgtttaaaataaaccgcatcccaactagggaaaaaaggaccgacaaaccgattcaccgcggttgattgccatgagtctggataaaccattccatccagaacaacaccaagctgatcccgaacctgttttcgagctgcaacggtggtttgacccagtaaactgatatcaccactgtcaggttgaagcatgtcgagaatcgctttgatcgttgttgttttgcctgcgccatttggaccgatgaaacccataatataaccggcaggcaggtgaaaactgacgtcagccaagtgaaaatcctcatagtgtttgttgaggtgcgaaactgtgagtaaatcagttgtcatgatcggcttctccttctgcttgcagtaatgtatctaacatagtgtgcaactcggcgggggtgattttggccattttagccgtgtcgattgcttgattcagggacgcttcaatgtcgcgcagtgcgttttcccggaccaaagagctatcttggccgagaacataggcgcctttaccctgaacgttggtaatgaatccggctgcttcaagttcgtgataggcgcgggtcgttgtgatcacgctgatacgtaaatctttagcaagactgcggatagacggcagttgttcattcgcctttaactgaccggcgaggatcgcggttttcacctggtcttcgatttgttcataaatcggtttgcccgattgatttgagatgacgatccgcatggttaacctcatttcgtgtcatgatttgaccggatgacgcttgcgggcggtacgttgtaattgtaacgaacgcttgaacgctttgaaaataccgccatcagaatagcttaacacattcgtctgataaagcttgaccgttagccaggtgaacgcgattaaaaagatcacattaatgccgaatgctgaccagccggccgcagcactgacttggcctgctcccagtcgtacgggcatcatcatggttgataaaaatggcacataactggcgatattaagaataggcgaggcgccattggcaacaatgatagcgccaaagtagccaaccattcccagcatcacaatcggtgtggtagcctggccgatctgttcctgattcgcaaccagcgaaccagttaaggcggccaaaacggtataggtcaaggtgccgacaaagaagaacgcaatactaaacagaatcatgtttggactcacactactcaggtcaagatggccgataagcgttgacaggggattttgcggtagctggcgtaaggcgacgagactggctaatccgaccacgccataaataatgatttgtgttgccatcaacgccagaatgccaagcagtttgccaaagaactgagcttgcggcgtaatcgcagttaaaatcgattcttctatccgtgaccctttttctgtcccaatttcctgcgccatcattgaagcataaccgatgacaaaggtgtaaatcaaaatatcgacgatgaaacccgcaaccgatccggacgcttgggatttggcagaacgggtgacaagcttgccatcatctactttgacactggtagtggccaaggcgggagtcgcaaaaagttgctgcagttgggtggtcgatagctgtagttgactggcaacttttttggtgtgggcttgagccagcacaccttgtagttgggtgcgattgatgctttgcccatctgttcgctgaatgagacttgcctgttgggtcggctgaccggtgactgtcaaaactgcatcaagtttttcggccgccaatgctcgtttagctgcagccgtggtggcgtaatgcgtataatgctgatcgttgtcgctgctgcttttaaacgtttgaaccaatgccgggctgtccgaaaccacgccgattcgggttgtttggttggtttgattcatcaaccagaaaaccgcgccaaaaatagcggctaatactaacggacccaggacaatccataaccaggttttacttttaagattcttgatgaagacttggcgaaaaatgacatccattttttccatgattaggcctctactttcatgcggaagatttcgtctaaggatggtgcttgttgactaaactcgggaatgtagccttggtgtgtggcagcggcgaaaatatcatggccaacttgcggatcggtcagtttgactaagaagccgcgggaacgtggcgtcaccgtgatcacgccggggaaagcctgtagctcctgttgggttaagggggattgaacgtagagtcgggtttgaccaaactgttcgcgaatttcgtcaagcttgccggataagacaacggcaccgttttttagcatgaccaaccgatcggaaatggcttcaacgttgcgcatgtcgtggctcgaatagataattgcgctgccttgatcacgcaaccggcgaatcccgacttctagcagatgggcattaaccggatccagaccggaaaagggttcatccaaaataataaattggggtgtatgaatcatcgcggcaatcagttgaactttttgctgattaccttttgacagatctttgacgagatcagtgggcttgcctttgacttgaaattggtcaagccattgatcaaggactgccatgaccgctggacgtttcataccgtgaagttcagcgaagaaacaaatttgatccgcgatggtcattttaggatacaaaccgcgttcttcaggtaaatacccgattgtctcgcgactcagtttggccaatggttgctggttccaagtaaccgtgccttgatccggttgcagcaagttcagtaacatgcggaaggtcgtggtctttccggcaccattttgaccgataagtccgagaatttctccgggtcgaaccgcaaaagaaacatcgtgaacggcggtggtatttccaaaacgcttggtaaggttggtgacgttgagcatagcgaacatctcctttgtgtgtttatactgtatatgtaatatatgcacagtataaacagcgactattggaattgcaagcagcattttggaaatttgatgacgatttgtcagctgcggcgatttacgtgggttgagcggctatcatttgtgtgaatataaggcaacttttttgaacccaaaaacgccagaagtcaggcagcatttgctgtaatgacttctggcgcattcaaaaagcagtgattcaaatgttaaggcaggttgaagatcaaaatcggattcattccgcttgttgggcaacttggcttaatgacataacatcccggacaatcattaattcctcgtttgtcgggataacgagggtcttgacacgtgcatcggctgccgtaatatcgccggcgttatcgtgaatctgtaaattgcgctcaggatcaatccgggcgcccagatagccaagcgattgcatgatgcgggcgcgaatattactactgtgctcgccgatgccggctgtgaagacaagcacgtcaacgccattcattaaggccgcgtaagcaccgatatatttgatgattcggttgacgaaaatatccagcgctagttttgcgcgcggatgcgtcggggcggcggcttcaagatcacgaacatcgtggctgatgccggagatcccgcgcaatccggattcggtgtttaaaatgtcaatcatttgatcaacatcggttatgtctaacttcttcatgaggtaggcaatcaatgaaacgtccacatcaccggcgcgggttcccattgtcacgccggatacaggggtgaaccccattgacgtatccacggatttaccattttggatcgccgtgatgctggagccggcgccaagatgcatgacaatcatacgcatggattcaagcggtttgcctagcattttggctgcgtgagcactgacataccgaacgctggtgccatgtgcgccatatttacgaacgccatatttttgataatattcataaggaatgctgtaaagataattgaccggtttcatagtctgatgaaaggcagtatcaaaaaccgccacttcaagcgcccaaggcatcatcttacggaaaatgtcgatgcaatcggcttcgacgggattgtgcagtggcgcgtaatcccgcagcgctcgaatttgtgccaacacccgattgtcaatgacgataggtgcggaaaatagttctccacctgcaacaacgcgatgaccgatgccggtaatttcatcgaggcggttcaccagacctaaagattgcaagtgactgagcaaattgctgacagcttcccgataattgcgaatcggagtggtactttcataaacctgatcagtaccatacttgattttaaccgtcgactgacgcaggatatcagttgcgccttctgctacttgtctttcgctgggcatgtcaaacaacttccatttaagtgaggagctgccggcattgatagagaggatttttaccatgtttgatcactctttcactattgctatatctgtatcataccacttaaaaagcacaatgtttgtgaaacattgtgctaattgttaatttttaaaaattaaatgaattattattttggcatgatttcttgaaatatgcaatgttggcggcgattctttaacaatttttgcactgacagacaaccaaaattgaagctgggatcgctaaagaaatcacaaattagttaatgcgttcgctgcaagagctgctgcgtgagcttggtcaaggctgctttggtaggcgatgaaggcagtgggttcaaagctgcaattgctcggtgtgtataggtgaaagcaagctgatgtgcctgtggaagaccgtgtttacgaacaatcgcagcgatttcatcagcattggcggcgatttgttcggctgttttcgttaaaggcgtcaactggtcaggcacagtttgataggcgtagatgagcggcaaggtgacaatgccattatttaaatcctcaagcgccggtttattcaatgttttggcagtttgggtataatcaagtaaatcatcaatcatttgaaaggccatgccgagctgccggccaaatcggtaagcggcctttttctgggtggcagaaaggtgaccgatcgttgcgcctgtataagtcgccagcgcaaacaaagcggctgttttaccgctgatggcacttaaataagcattgacggttggaatgagcggtgcgctggggccgttttgatccacttcacccataaagatgcgcttcatgatgcgggcgttggttcttaaatcaacggtttcgggatcctgttcgctaagcaactgaaaatagatggcaaacaggaaatcaccggcatagatggcttcacgatttccggactcggcagaaaccgtggtcatgccgcgacgaatatcggcatgatccagcacatcatcgtgaaccagtgtggctaggtgtagtgcttcaatcgcagcaccagccgtcacaagctcagcgttgtcaggttcgccaaaacgcgctagcataagcataagcccgcttcgtaacatcttgccgcctgcattgatttgttgctgaatcaacgtatgcacttgtggttcgcgtaaagtcgcgacctgttccagccgctgctgaatctgttcgagttggtgatagaccatggggaatcggtgccacaggggatgaatcatgcattttctctctttcctaaagacatatttactctactgtacctgattcttaaaagtcaattgttggaggttgttatgtcaatatctgtatttcttgaattagttgaggttaaggcgaaaacagcatcggttttcccctttttgttggggacgttgtttgcctggtaccattatcatacgttacatattccggaattgttggttttctttgttgccatgcttttgtttaacatggcggttgatgcgaatgacaactatcaagattatcgccgttcggaaaagacagaagctctacattttcgcgaaaagaccaatatcatcggcgtcaatcatctgaatccaagtatgattggctggatggtggtggcaatgatggtcaccagcgcagtgcttggcttgtggatggtaagccgtaccggatggccattgttggtcatgggactgtttagctttgcggtaggctatggctatgcaggtggtccgcggccgatttctgccacaccgtatggagaattcttctcgggatttacgatggggtttgtcatttttctgatcgcggtttatgtcaacgtctttaacgtggtcgacttttcgtggtcattaattgcgtcggtttatctggcaagtgggttggcacaatgcgcaatttcggcgttgttactggccaacaacattgctgatcaggatgaagatgagacgcttaaacggcgcacgattgtccattatctcggacgtcagcgcagcattgttttcttttatagtctgtatacggcaggattcttgatgctgattgtttcggtattactcggcctgttgccaaaattgacgctgctgacattgatcaccgtgccgctggtcgtcaaaaatgcgcgtgggtttgctgctaatccggttaaaaagctgacgtttccgaacgccatcaaaaatctattcgtcaccactttagcgcaggtagtctttttggcgcttggggtgtggctcaatttctaagcggtaaagcgtacgtgtgaggaggttaagcaggccatgacaattcggccttttgttaaaaaagatttgggccattttattgatgcggtgacaccattattgtcgccttcagccttgaatttcgccttgattaccgatactcatgacaaagccaaattctcatcgacttattatggcccgactggattttggcatgtccgtgagcagcagtggttgagtacccggatgccacttgacttgcgggttcatcttggcgacttggttgatggctcggaattgccatggctaaccaaaatgcgcttgcgcaatatcatggttgattatcggcggggtgcggtgccatttctggttactaaaggcaatcacgatgacaatgataaattcgccgaaaagcggcccggtcacaaaggcagcttcttgccggatgttaatcgtcagctgatatttgcgacagatgccgcgcagcctgatattgcggtttcgcatgaaggcttattggtacgggactatccgggattacgcgtgatcgtattaaatacggctgatgtaccgttacatgccggacataaaatttacgatgtcaagaagactttagcggtttcgtttgcgcagttacgcgactttgctttagcgttaaaaggcgcgttgaatcgtgatgtgttaatcatgagtcacgcgccggcaatgaatcaaaaaggccaaccagccttaaggtttaacggtcgggccgtccatgagttgttgcgggcttttaatttgcatgccagtggggtgttgaatacaggtaaaacgcctgaatttggcggacagttaaggtttgatttcacccaaaacacgggccggatcattgcgtatctcgccggacactatcacttggaagcggactatcaggtgaatggtattcattacagcctacaaaataccagtgcactgatgggtcgccatcacggattgacgactaaatttaatcgccggtttgatcgacattttggtactcctagcgaatatgccggatatgttgtcagtgttgacattgatcgtcggcgtttaagtctctatggctatggcgcagcaagtcgggttcgacggtttgctttttgacggtttaaaaatttttttgtaaaaaagcaggtcatagggcttgccaagatagcgcttacatgatacactttatttgaagttaaggaagaacatcaaggtcgatgcaggaaccaagaatcacgatccttcgttcagtaacaagcaaacgaactggctcgaaagtgtgtgtcgcaaagcacgagtaaaacgaatagagcgttggtgcagtaagtatctgcgccacctatcgtcagattcatgttccatgagatctaaagatgaacacacatggaggtatgaggctaataacaagactcagtaatccaagcgggacaatgagcttcccatagatgttcaatcgggtgtgtcatagaaccaccaaacaacgccaagttatctggcaacatcatttcaacactcgtcgttccgtacaagtgaataagatttttgtagaggtgtcgcagtattaggtttattgaagagggttttacaattagtaccagtcaatgtaacaatatgactgcatcggtcaaatccttaacttaggagatccaagttcgactgtaggaacttggatctctatttttttgccgtttttgggggattttagtggtgggattcggtgatggtgccgactttgaggggggcagtgtgagtgtggtcgggctgcggctgaaacgcgttcactggcgcaggagtcggttcacgctctgttctgaaacgcgttcgccagcccagaaacctgcacataaggaccttgagcgcaatggccaagcccgggccatcacgctcaaggacacttatgctccggtttctaaccgggctggctcacgctctgttctgaaacgcgttcactggcgcagcgatctgcgtgtaaggacctcaaccctaaatggccaaagcccagccatttagggttgaggccacttacactccgatcgctaaccgcgccagttcacgctctttgattgacttgcgttgtcaaatctttatactgaaacaagtaatgatcgtcattcacgcgaaaaggggttaactgtatgtgcggaatcatcgcgtttgcggacaagacaattttgaacaagaaaccagttattaataacatgatggatatgattaaacaccgggggccgaattcgagtggcgaatatatcaatgatgatgttgcgcttggatttcgtcggttgtcgatcattgatttaaagggtggttcgcagccgattctgaacgaagacggtactgttgcgattatctttaatggggaaatctataattttcaaagtattcgcaaagatttgattgctgccggacatgtgtttaagacccattccgacaccgaggtgctgcttcatggttacgaagagtatggcattgaagaactgttgaaaaagattcgcggcatgtttgctttcctgatttgggatgacaacaagaaagaaatgtttggtgcccgcgacttctttgggattaagccgatgtattattaccacgatggcgatacgttcatcgttggtagtgaaatcaaggcctttttgaagcatcctaagtttaagaaacaactgaataaagaagcgctcaaaccgtatttgactttccagtactccgcgttggacgaaactttcttcaaaggcgtttatcgcattccggaaggtcattacttcacgttgaaggataatgaactcacgattaagaagtattgggatatggatttcaaggctaataatctgagttttgaagatacggttgctgccattgacaagagtgtgtccgaatcagttgatgcccaccgaatttccgatgttgaagtcggatcgctgctttcttcaggggtggattcatcttacattaccgcgctgttgcggccagagcacaccttctccatcggttttgacaacaagaagtatcatgaaggggtcgccgcgaaggaactcagcgataaattgggcttagataacaccagtgatatcgtgacggaaaaagaggcgttggataacttcccgttgattcaatatcatttggacgaaccggattccaacccttcctgcgtgccgttatacttcctgacaagactggctcacaaagatgtgacggttattttgtctggtgaaggggccgacgaactttttgccgggtatgctaactatggttttcacacccgcagccatgcgattcgggtcttcgcggacggcttgcgcaagttaccgcgcggcgtgaagtaccgcattgcccatgggttgaagaagatgccgaacttccacggacggctgcatctgtatgaatccacggccccggcggaagagttcttcattggtgaggccttagttttccatgaaggccaggccgatgagattttgcagccggaattccgccagagtaagagtgttcgtgatatcgtaacggaatcgtacaaaaaggtgcgccattacgatgatgaagtcaagaagatgcagtaccttgatattcaccagttcatgcctaaggatattttgctgaaggccgacaagctgtcgatggccaactccatggagctgcgggtgccgtttttggataaggaagttgccaaagtggcggctggtattccaaccaaatatctgatcaactcacacaattctaagtacgccttgcgtgaagctgccaaccgtcacctgccagaagaatgggcgagtcgcgaaaaactcggcttcccggttccggtcaaacagtggcttgaagatgagcctttttataaaaaggttcgcgaaacatttgagcaagactgggttaaagagttctttgatcaagacgcgattttggatattctcgataagacttaccgcaaagagcgcaatgatcgccgcaaagtttggacgatttataccttcttagtttggtataaggtttatttcattgatgatgagattccgcattatgtggcggattcaaacaaagaaaagctcgaagcctaatcgattttgaacctaaacaagcacaagctgcagccagaactcattctgtctgtggcttgtgctttttaagtgttagtcacttctctgcgctggcaagtgtggtgggagctcatcatctagacatatttttgggtaagttgggtttgacctgaatgcaacagtacagcactggaaagtcactttggaggacttgctcggcacttttgcagatgcggtaggatttggcgaggctatcaccggctgggagcacgatttcggcttcgacaataatattgctgccagcataccgaccatcaacgaagctgaccgcgagtatcccactaacagtttgcagcttgtccacaagttgggtgcggagggcaggattgaacccgttggagagcttttcagcgctggtgctgagaattcggctgccgttccagatcaagaatagcccgatcaaaacagctgccagtggatcaatccagtggatgtgccaataggaagcaccgagaatggcgatcatggtgccagttgaagtcaaagcgtcgccgagaaaatctttggccgatgccgcgagtgaactgctttgtgtatgttggccaatgaggtggttgaaccaacaaaggattaacattgacaccgctgaaatggcagccataatagcggcttggcctttgagtggcgcagcggcgtgtccggatagtaaggccaaagttgcgcccagtccttcccagatggtgatcaggccgataagaaacatacccaagccggcaagaaaaacggcaagattctcaaattgccagtgaccttcaagatgaaatgtatcagaagggcgggtggcaaacgatagtccgacaatcaaagcagagacggtgacaatgccagtcaaattattttgaccatcggcggttaaagcaacggcatgatccttcgcgccgaaccatagctcaatggcggcaatcacagtgtagacgatgagattcacaaccagcatacgccgggcctgacgaatcttctcatgaccgtgttgttcaattaaggctgagatactgagcgaattgttgctttttaacatcgcaaacaccttctttagtgagcgtgagccagcccggttagaaatcggagtgtaagtggccttgggcgtgatggccgggctttggccattgcgcccaaggcccttacacgcagatttctgggctggcgaacgcgttatggtaagcgcgagccagcgtggttagagaccggagtgtaagtggccttgggcgtgatggcccggttttggccattgcgttcgaggtccttacacgcaggcctttgcgccggggagcgcgttaagcatcttcagtagcatcaatttcgatgaagctttgatgcaagccgatctgaaaacggaagagcataagaagattgaatagaccgattaagccgatcatgatcgccatgtcggtgccaatcgcttgatgagttgcaattaagcttcttaaagcgtcaatgagataggtcatcggcagccattcattgatcgcttttgcaaagccattgaccaaataagtagggtataacccacctgagccagctagctgaaggaccaagacgattgaaaccagccatgttccgaaaccgccaagcagcaggcggagacagaaaatcaaggacaggaacaaccaagatccgagaagaatggcaatgaagaacagaccatgatcgctgacgtgcaaatgattaccagctaataaggaaatatcaagcaatcctgcctgtaataagccaactgtgccaatcaccgaagctttgctggcccaccaacttagtgcgtaccgtggtttacgatgcggtaggaagccttcgtacatggtgcccagcgcgattccgccgacatagaggccgatagcgatggcaaaaggcgccatgccggttccgttgttggggatcttggcgacatccgacgtgacttcacgcacaggcgcggctaaagcagcagcgttattcgccccagtttggatacttgccagcttctgactgccgattgtcaattggttggctaaagtttggctgccgttttgtaactgttgcgagccagctgcgagtgcggtggcggcagttgttaattgggtgacgccggtattgagggaagccactgcttgattcgtctgtccctgacttttggttgcttgctgaagcccggttgcgaggcggtttagtccagtgctaagttgtgcggtgccggttgtgagttgttgagcgccggtggtcaacgtttggccgccggtagccgccttggtcatgccggtatcggcctgatgtagtgccgttagcacaatgccagcatataatttggtaacttgactcgccacttttgatttgatggcagtcgcagcgcctgtggtcattttagagacaatgaagttctgaccggaattgaaccgaaagtaaagcggcatggtttctggggtggtcgttagtagggtggttgcctttttggaaaagttacgcgggatggtcaacaccatgtaataggtgccccggtgcagccggttggtcgcagtggaagcagaaacatgatgaaaatccagcgcggttgatttggtcaaattggcggttaactgctggccaatcgcaatcttttttccgtggtaagtaacaggccgatcatgatcaacgatggcgaccggtaactgatccatcttgccataggtatcccacatggacgaaagatagataaaacaatagatggctgggatgagcgcaattgccaccaggacaacgaccatcattttgtgctgcatgagataacgccattcacttcttagcatggtaagaccgcctttcaaattgacactctgttcattcacgatcatagtggccttaaggcggtcagacaagaaacaatctgagccatctgttcagtctctgaacgcacttttaaccggcagcatgcgggaaaagtgctgatgatcgccgcttaaacgggtgaacagtttggcacgatttgtcaattgcttcggggtaaaatttgttgttcaatgagaatggtaattaacagtatgttcatggaggttgacgcgatggctagtagtacgaaaatgcttgaaacagaaatgaaaattcagcaggcgtttatgacgctgatgcatcaggaagggtttggcaagttaagcgtgcaacaattagccaagttggccggcatcagtcgtggcaccttttatctgcactatttcgataagtatgatttattggcgcattatgaagatgaaatgatcggacatgtgaaaagcatttttgcccattttcccaaaccgcttcaagctaaacgcgcagcaaacccgttacccgagcgtgatgctttctttcagttgttcaagtatttgtatcgccaacgggatctggccgttttactgttgaatgaaaatcaaacgcaactaaccgcgaaagtgaagcaattggttgttgagttgttgcggcaaggcggtagtgagttagttgctgatgatcgtgatgtgcccagcgattatgctcaggagattgtcagtcaaggggttgtggatttaattgtttactggctcaatcaaacgccggttcgctcaccggaatcggtttacagcatctttcgcaccacacgccacctaacgcctgaacagttaacagctcggatataaagaggacgcaaaaaaccgccgcaaaatagcgacggttaatcaagcgtagcggtttggcactatttgtgtagaaactgatgaaacgcggtcatgacagcctcaggcgcatcgatcatcagattatgaccggcgtttgggattacggttgtggtcatgtgtgcgcctttatgggcaaagaccacttgatcctgatagccaacttcattgtcattttcacctaacacaagcgtaactggtgacttaatcaggctgcttaagcgtgattcaatcgacagacgataagcatggcggttcttcatggcaacccagaaatcgcggttaaaagttttaagccctagcaggataagttcctgatattgtcgccaggttgaaggattgataacaacattcatgtgtagatagtcggtaaaatccggtgactgactggttactgacgcactaataagatgctttagtggcgcaaccgtacgtgctgttttctccgcgagtacaaccggagcggttaaaaaagcaccggaaaactcgttaggaaatcgcgcaagcaggcctaatgctagatagccaccgtaagaatggccgacaagataacatggcccttcgctggtcgcctgaatgaaagcatgaacctgtgccaacacatcatcagcagattgcaatgctgacgtggccggtgaatttcccattcccggtaaatccggatagaggcgggcaaaatgccgctcttcgctggtaaaacgtggctcataaaaagctgccatgctgtgtccgtctaaccccatgccatgtaaaaagtagatggttttcccaaccccaattttgttgtagtgaaggcctattttagttggcatcgtatagagctccttagtgatcagttatcattgctggggatgaatggttgaatcaaattagccagtgcctcgatgttccgagtctggatatagacggtcccggaaccagtgaaccgattgactaaaccttcaccggtagtaaaaccgatgacaccactagccggctggatgctgtaatccagctggctgtcccaagcgacaacatgactgttatccacgacatattcatggctgccatcaagttcgatcggaatgatgtcaccataagccgaaaccagcatggtgccagtgcccgctgtttccatgatgaagaatccgccagtgccgccaaataaagcaccaccgactttttgactggccatgtgataactaacggaagtgtccattgccaaaaacgcaccggtattcaggcgatattgatgattggcatcgagcgtcaattctttgataacgccggggttgccgggcgcaatcgccaattcagcgttagccgccttaccagttgccgttgtgataaaaaagctctcgccactggttatggagcgtccaatcgcactcattaggccgccgagtccgcgtttgccattgctattcatgtggccgcttagttcaaccaagccattgtgatagatcatggagccagattcgatctggatcgtttcatcttgttgtagcgcaatctgcacaaccggaaacgtattgttggccgagatggtatagttcatcattaaagcccctttcttgattgtcttcattgtagcgtattccattgccaaaatgcgttcattttcctctgaaaaagtgagttagtaacttgccggtgacgtgatggcgacccattgtagtgaacctaaatggcaaattcgtcccgcaaaaaaatcagttcagttccggttgacaaaccgtccgttaaccagtagtctttaactaatctatttcttaggaggttctcatcatgatgacaaagctgactcaaggtagccaatcattttatttctggtttttcagacgcgatctgtgagaccagttacctttgagtgagcggtcacacagatcaagcaattgactgtgtggctggaatcaggagaatcattcccatttcgtgccccgcggtcaatcgatgactgcggggcttttattttagtttcaacttactggatgtaaaaagatggagggatttacatggcattagtcgatcgtatgaatcacgaggttcggcaactcaaaccgagcgatattttacaattcaatgcagaaattagcggtattgaagggattgttaagctgacattaggtgaaccggattttccgacgccggagcatgtcaaggcggcgggcatccaatcaatcgaaaatgatgagagccattatacccagagcaaaggcttgccgggattacgagctgcggcaagccattatctggcaacgaaatataaaacctcctatgatccggagacgcagattttgatcacagctggggccactggcggtatttattcgagtttaacggctatgttgaacaaaggcgataccgtgattatcccaactccgatttttcctttatacatcccaatcgtgttattaaacggagcaaaaccaatatttatcgacacttcggcggatgggttcattcttaagccagagaaattacaacaggcgattgaagccaatcgggacacggttaaagcggtgattcttaactacccgactaatccaactggggtgacttataatcgcgcggatctgagcgcattagccaacgtcatcaagcagtatgaaatttttgtcttaagcgatgagatttactcagaattgacctacagtgggacgcatgtttcgatgggcgagatactccctgatcaagcaattgtccttaacggggtttcaaaatcccacgcaatgaccggctggcgcgttgggatcacagcaggtccggctgcgattattcaacaaatcggcaaggttagcgagtttacgattaccagcgtcaccaccaatgcccagcgcgcggctgaagaggcgttaaaaaatggtatggaagatagtcagccgatgaagcaagcctatcgaaaacggcgtgattttctgatgaaggccttaccggaagccggcttggaagttcctcatccggatggcgcattttatatttttgctaagttgccagaccggttccatgacagctggaagtttgtttatgcgttggcacgtgaagcaaaggttgccgtgattcccggtgccagttttgggccaggcggtgaaggttatgtgcggatttcgtatgcggcctcgatggcggatttgaaactggcggctgagcgcattaagcagtttatggcaacgcattaggtaggcaggtttgcagttggacgataacgcgctcaaaggagaatgatgatgaagaaaattttaatgtatagtgttcgaccagacgaacaaccagcgattgatgactgggttgctgctaatgatattcaagttgataccaataccgttgccttcaatgctgatacggttgatctggctaagggctacgatggggttgtcattcaacagcatggcgccattccagaaccgcttgtttatcagaagttgaagtcattcgggatgaagcagttgactttgcggattaccggctatgacattgttaatctcgatgctgcggctgccaatggattggccgtgaccaatgtgcccgcatactcgccgcgatcggttgcggaactggttttggctcatgccatgcgattgattcgccatttgggtgaggctacggcgcgcgaagccaaagatgattatagctggggtggtctggaagcgcaggaagttcatcaattaacgattggcatcattggcgctggcaaaatcggcagtaccgtcgcccgcatttttcgcgccttaggatctaccgtcatcgtggctgatccggtaacgcgacctgaattggcggatacggttcgttatgtcgatcttgacaccttgctggccactgccgatatcgtcaccgtgcacacaccgctggacgacatcaccacccatatgcttgatgctgccgccttcaaaaagatgaaaaagacggcttacttgatcaatgcagcccgcggaccgattgtcgatacggctgctttgattgaggcgctgcaacgtggtgagattgccggcgctgctttggacacaattgaaggtgaagccggtatttttggggttgatcgcagccaatccggcgtggacaataccaatcttgaaactttaaaggctttgccgaacgttgagatttctccgcatatcggtttttatacggatgcagccgtgaaaaacatgatcgatatttcattggatgacgtcaaaactattttagccggtgggcattcaccgcaccaagttaattaaacggaggaagacgatgaaacaagatgtaaaaaccgtgacgatgaacattttaaacggtttatcagtggggattattgttgccttggttcctggagcgatcttaaatgcgctcgtcaagttgcttttacctagctttccacagttggccgttgtcacgtatatgacgaccgccgcgatgaccttgttaccggcgttatcggctgtgtgcgtggggatgctggcgaagtttacgccgattcaaacaagttcgctggcactggctgccattattggtgccggtaattatcatctgaccaaaaccggcttgagtgttgccggaaccggggatgtgattaatttggcgatcaccctcgccattggctatttagtcattctattgttgggcaatgcgctcaaggcgtacacgattcttctgattccatcgttagtattgctgattgcaggtggggtggggatgctcactctcaagccggtttccggaatcacgaagtatattggcgttgttgtccatgatattaccgaattgcagccgattgcgatgggcgttttgatggggatcatctttgccattttgattgtgacgccgatcagtacagtggggattgcgacggctattatgttgaacggcatcggtgccggatctgctaaccttggcattgtcggggcaagttttgcgctggcggcttatggctggaaagcgaatccgcttgggacctcgctggcacattttctgggctcgccgaagatgcaaatggccaacattttgtctaaaccgaaactcttcttacccatggcgcttaatgccggcattcttggtggtatcggtgctgcattgcacattcaaggaacgcctgccagtgccggatttggcttttctggtttagtcgggccactcgctgcactcgatgcaatgaaggcggtgacggtgggaaatgtgcttgaattgacgatcattttcttcatcttgccgattggactggcttatcttagcaatttgctatttaccaaaacactgcactatcaggtgtcggaagactatgccttgcattacgactaatggcaggtcgaaaagcattcacgcaatatacgtgatttttgaagctttagtcggtggcaaacaaagagtaacttcttcatgccaccgggactacatagagacggggtgttggccccgcagtcaacatgcaaagcaccactaaatatttttcttattggtataggcgtataaccgtttacatgataaaatgaggaagattttagtccctttgaaagcgaggcgagtgtcgtgttggcatggtgggcacagcaagaactgtggttacaggtgatcgtcggagtggtggcgctattggtcattggcggtcttttatggatgttgttatcactggtattgttaccattattggcgttattgcaacggctactgtcgccggttgagaacaccacatcaatgagcgatcgggattacttactcggtacgctgacgttagatgtggcgcatcatcacactggcgaagtcatggtaaccggtggtggacgcgcccgccagacatatccggccaagttgtggtcggataaaagccagccgctagatcagggcacaaaagtcgtgatcattgaactcaaacaaggtattgcctatgttgatgccttggctactcacaaccctaaggagggaactgatggaaattttaactgattatatgccgtggattattgcggccgttttattgatcttgctctttatttttctggccacccatcgtaagaccgctttgcctaacgaagtgctgattatttccggtgccttgatttccggcaagcacagttttcgcgatgtcaatggcaatcgtgtcaaattgattaccaacggcgggtcttttattttaccgattttgcagcgctgggacgttttaagtctaaatacgcggaccattgaagtcgcaacgcctgaagtctacacgcaacaaggggttccgattatcgtcaacgggacggttattttaaaaataggctccagtcaggaagaagtcgcaaccgctgcggaacaatttttaggcaaaaatgacgagcagattaattcggaagccaccgaaattctggaaggccatttacgggcaattttgggcacattaacggttgaggatacctatcagaatcgtgatgcctttgccgaaaaggtccaggatgtggcgagttccgatttagccaaaatgggtttacagattatttcgttcacgatcaaagatattgccgacaagaacggctatctggactcactgggtaagaagcagattgcggaagttaagaagaacgccgctgtagccgaagcagccgccaatcgtgacacccgaattcaacaggcgcaagcagatcaggaagcaaagcagcaggaaatcgaacgtcagacccaaattgctgacgccgaacgggaacagcaggtcaagatggctgacttcaaaaagcagcaagaaattgctcaggcgcaagctgatcaggccgcgattgttgaacagatgaaggccaagcaggttcaaaaagaaaaagacattgaattagcccaaaagaacgccgaattgcaggaacaggaactgaatgcaaccgtgcgtaaacaagcggatgcggacttgtataaagcccagcgtgccgccgaagcccaaaaagcaacccagattgcggccgctgaagcatcggcaaaagaggttgaattggatgccgaagccaaagcaaatgcaaccaaggcgattggggaagcagaagctggcaagaccaaggcgatcgggcttgcacaagcggaagcgattgctaaacaagcggaagcagcacggcaacttgatgaatccggccgcttcaagatgacgattgaagcaatgccgaagattattgaggctgctatgagtccgtatgcaaatgttgattcgatcaagctttatggcgatggcgacctgacgaatcaaaccagcggcagtttggtcaagcaactagacatgttgcaagaagttgccggcatcgacattcgcgggatgttaaatggcgcactgatgcatcaggctggcaatcaaccggttgtcgatgcgatcaagcaccacgagcaaccatcagccaaggcacctgacaccaagcaaccagcaccggcgccaaatagtgatcaaccggccactaccgagcaagcggcatcaagtacaccatcgcgcatggccgagaagcaaaagtagtcatgagtgaaattcagaatgattgcttttaattaaaaaagtggctccgtttgcgattgttctaaaatcgcaacggagccactttttggttgatgtctaaagaaattaatacacggcgggatacactaagcaatgccttcaatgtatggcgccgggcggtgaaaattttgatgaatactactataaatcacgcggatggctttgtcgtagtctttatcatttacgccaattaacaaattgatatcgtcattggtctggctgacaagctggacattgagcaggttgtcgtctagataggcgaggaccttgccggcaattgccggtcgttgccgtaactttcgggaaaccatcgcaatgagtgcaacattctcggtgacctcaagtttatcaggctgacacgctgctttaattgctgccgtgagttcgtgaacggaaacctgatggcgtggttcgcgaattaacagactaaaactgtcaatgccagtggggagataatcaacgaccaaatgatgatcagcaatgacgtccagtgcatgctgaatgatatcgagatgtaatgccagttgatattgccgaatcgtcaccaccagataatgcttgcgaccggcaatcccggtaatgatccgcatatcatttgccgggtcatcatcttggataatcaatgtgcccggatcttccggggcattcgtattaagaatgcgagttggaatgccactttctcgcactggctggacagcctcttcctgaaaaacactgaagcccatataggtcaattcgcgcaattcatcataactcatcacatcaatactatcggcatcttgaataattcgcggatcggccattttgattccggaaacatcggtccaattttcgtaaagatcggcttgagccagccgcgccaaccacgcaccggaaatgtcagacccgccgcgcgccatgagttgtacgtgaccggcagcattttgcccgtagaatccgggaacaactatcccatgatgacgcggtagccgccgataagccgctaatgttttggcttcatcgattgccccattttgatcaaaaaagaggagatcagcagcatcaacgaaggtatagcccaaataggcagccatcaggtgggcggttaaaaactcaccacgcgaaaccagataatcgcgcgagtaatgagtggcgatgtgatgacgaatcgtattcatgagttttatgagtggcacatgcaaatgtagagcctgattgatagcttccagtcgggctgtcacttgagcaaaaagcggggtgacatcacgaccggcttcgagtccatccgcaatcagataaagggtatcggtcaacttgcgggttgcatcgccatatttaccggctgcactgatgacaacgatttggcgctgcgggtcttggttgataatggctttgactttttgaaactgcccggcgtcggcaaccgaactgccgccgaatttaacgactttcattcgattaccccctgatcaacttgttctttgacgttacgggtggtcagttcactatcgccaatggctgccatgaaggcatgagcatcaattgccaaaacgccacgcatgagccgatgcatttcaccagtcgggatttgtttgattaaaagatgatcctgaacgacttcggtgtccttatcgttaaacatggcaaacgtgagcggatcggcgcgcagcaagtaatcagcagtattcagatctgcatcgaattgtaagttctgattaaagtgccgcgtcagatgcggggcattttccagaatgtcgaatagatcctgaacaatggcattagcagtcggatatttaccggcgccttgaccataaaactgcaaatcgccaatggtctggccgtgcagtcggatcaggttgaagttttcaaacgtgttggccgccaaagcagtcgccggataaagacgcggttcaacgaccatactataatggttaccaactcgtctgctcttgccaattaggcgtaaaacctggtgacgactggcgaaaaagtcaatatcggctttggtgacattacgaatgccaaatttaggaacatcacgcggcggaaccatatcgtaagccagtgcggcggaaattttcagcttgttaaccacatcgtcaccatcaatatccgcactgggatcggcttcggcatagcccatgtctttagctgccaacaaaaccgggtcaaaatcgagatgcgcccgttgcatttgatccaaaatataattactcgtaccattaaagatgccttcgatggtatcgatttggtcaatgcgagcagcgcgttccaaattgcgaatccagggaatgccaccaccagtagtggcttcaaaataaaagcgaacgtgatgctgagccgccgttgtgatgaattcaggcaggtgttgcgcaacgacagctttattggcggtcaccacatgtttgccgtgctgcagtgcacgtaggatataatcataagcaggatgcaagccgccaatagcctcaacgacaacatcgatagtcgggtcggcaaggatagcatcgaaatttgttgtcatctcaggcatcgtagctgggtgggttgggcgaatgaaaatagcagtgacccgcattcggcgatcaccattttcaacgatgtcataaacgccgctaccgacagtaccaaaacctaagatggcaatattcattttcttcagctccttgtatataaaatatagacacttgtttttctaatgcgaacagattatcatatccttattgcaaaaacaagtcggatcagataggagtcgttcacatgcgatacacaagtacacgggatcagcgcgttagcaagactggacaacaagcgatcaagcaaggcatctccgaagaaggcgggttatttgttttaccgcatttgacggattaccgcttgaatcttcaaaatttattaggtaaagattatgaaacgattgctcagaatgttctcacgaccctgttgcctgattttaacactgctgcgctgaaaaaggcgatccaatttgcatatcataaaaatttttctgatcgccggctgacgcctgttcggtctgtgggtgattttcatgttttagagctatttcatggcccaaccagcgcctttaaagacttggggttgcaactactaccccaattgatgcgcctggcactggatccggaagatcgcatcatgatcttagccgcaaccagtggcgataccgggactgcagcgttgcagggcttcaaaaatgtcgcccaaaccgggattaccgtcttttatcctgatcatggggttagtccgattcaggagcggcaaatgttaacgacaaccggcaataacacacgggttttcccaattggcggtaattttgatcaagcgcagagtgccgttaaagatctctttaccgacaccggttttgcggcgcgtttgcaggcggaacaagtaacgctttcggccgccaattcgattaatatcgggcgcttgattccccaggtggtttattatttttccgcctacttgcaactggttgaatcaggtgccattgagctgggtcaaaaggttaacttcaccgttccgactggcaactttggggatgtcctagctggtttctacgcgaagttattgggtttgccgattcatcaattaattgccgcggccaacgccaaccatgaactggcggactttcttgaaaccggtatttatgatcgcaatcgcccgttcctaaagacggttgcgccaagtatggatattcagatttccagtaacttggaacggctactctactataagagtggtgaagatagcagatatgtggctaagttaatggaagaattggccacaaccggccgctatcaggtacggcccgatgttttggcagcgattcaggctgattttgctggcggttttgccgcagatgcgcagattgcagcttcaattgctgcggtttggaagcaaaacggctatttgttggatcctcacacggctgtcggctaccatgtgatgcagcaatatcgggagacaaccggcgatccgacgcctaatgtgttactcgcaacggctagtccatacaaatttccacgtgcagttgctcaagcccttgacttgccggtgacaggtgacgactttgccgtgatgacccagttacaacaaatgagtggtgttccgattcctgctaatttagcgcgcttggcaactttgactgcccaacctaaacacgtggtggcgccggacaaaatgggtcaggcgatcattgcagccgcaaaggaggtttttaacgatgatcagcgtgtccgttccggcaacaagcgctaatttaggcgttggttatgacgttttaggattagcccttgatctcaaagctcggttcaccttcgaagcgagcacccaaaagcttgagattgttggggatgatcctgactttgccaatgaacagaacttgatttatcaagcgtttgcgacatttgccaaggcggttgatcaaccagtgccaaatttaaggattacggtcgattcgaatattcctagttctcggggcttggggagttcggctacgtgtgttgttggcggaattgctgcggcgaatgagtggtttcatgccggctgggatcggactcagcttttgaagcttgcagcgaaaatggagggacatccggacaatgctgcccctgcaatttttggtcagctgtgtgcaactattttggcagatacagagcccattgtgcgccagtatccggtcagctcacagttgcagttagtgacattcattcccgactatgctgtgagcacggcagaagcacgaaaaatccttcctacaacgatgacttacgcagatgctgcttatcagatggggcggtgcgttttaatgacgcgcgcgttggccgatggtgatttgccgcttttacatcaagtggcccatgatcggatgcaggaaccttatcgtgccacattgattccggactatcaggctgtccgtcaattggtaaccgcagccaatggcgttctgttgatctcgggttcaggatcgaccctgcttgcaattgtggaaggagcaacggctgctcgccagctgcaagcagccgccagccaacaatggccggcatggcgcgtgcaggtcgtccagccgagtatagaaggggtgcgggtttcagaaagctgaacaatatcaaaaaacgccaagccctgacacttggcgtttttgcatctaaatcttgaaaaactgttatcctattagtatcttcatgaatgcagattgccagtatggtataattctggggcgacgagctgaaggcaatattcattttgaccaaccgctcagggaaagttattagtgcagtttggacccgctgagacaacttgccactgcactttcaatgaaaatttcatggtacccggcattcttttgcccgcacctaatcgaacgaggagattatcattcagatgaaagatacacccagttttacccccatcctgcttggcagtgatatgaacgtgtatggtatggcgcgttcgttccacgagatgatcggcggggcgattgatgtctatgcgcgtgaacagctggcaccgacacgcttttcacgaatcgtaaatgtccatctgattaagcaatttgattctgacccgacttttatcgaaaaaatgcgtgaagttgcgcatctgcacgcggcgtcggctgggcgtctgctgctaattgcatgcggtgatacatacgcacaattggtgtccaaacataaagatgaattaagtcagtggtttatctgcccatatgtcgactatgatcttttaaaacgccttaacagtaaggaaagcttttaccaggtttgtgaagaataccatcttccttacccagccactaagatcgtgaccaagtcgatgtatgaaagcaacgccacaattacggcgccatttgaatttcctgtggcgctgaaaccgaccgattcggtggaatggttgaatatccactttgaagggcgtaagaaggccttcacgattcactcccaagtcgaattgaccaacaccattgccaagatttatgacaatgggtatacatctgacttaattcttcaagactttgtaccgggtgatgacagcaatatgcggacgttgaattgttatgtcgaccagtatcatcatgtcaaaatgatgtgtcttgggcatccgctacttgaagatcccactccagcgtctatcgggaattatgtggcgattatgccagcttttgatcatacattgtatgatcaaatcaaagaatttctcgaagccatcaagtttaccggttttgctaactttgatatgaagtacgatcaccgcgacaacacgtttaagttatttgagattaatattcgtcagggacgcagcagctttttcgtgaccctgaatggctataatcttgccagctggcctgtgcgcgattatatcaccggtgatctcaaagatgctccgactgtttatggcaattccgatcgcagcaagtacaaattatggcttggggtgcctgaacgggtcttcaagcaatactctgccgacaacgaggccaagcgggaagcgttgaagttgatcaaagaaaagcgttatgggacgactgtcttttacaaacccgatatgacgcttaaacgctggctattattgaaatatatgtttcataattatgttggccgctttaagcagtattttgcggaaaacaaaggcgatgtgtgataaaataaacatgttagggacacctaaacttgcaagggggcatttcttttggttactgaaaatgatttaacgattgaatccgtgcattataatcggctgttattggcggttgatgatgatgatgacgactcctcgcgcaaggcattgaactacgcctgcacggttgccaagatttatgatattccgctggggattgtatcggtacttgaaaccggcgatctgaatattttccagtcattgacacctgatgatgttgaagcagcacgggaaaaaatggcgaagaacctgaatacttatgttgaaaaagcccgtgcgttcggcgtacagaaggcccagccgattattgctgaaggtcgcccggcagcagcactgcttgacgaggttattccagcgttcaagccggacttggttatcatgggttcacacgtacgtcgtggccgtctgcgactgggccacgttgcaagcgaagtagcccgcgatgcagcggtatccgttattattgtccgctaattgtcagtgctatgattcaaataagcagccgtgagatttgataaagtctacggctgctatttttgtgtaagcgcgagccggcgcggttagaagtcggagtgtaagtggccttaagcgtgatggcccgggcttggccattgcgcttaaggtccttacacgcagacttctgcgccggggagcgcgttatgggcgtaaaccagaacataagtggccattgcaaccaaggtccttacacgcaaatccctgcgccagcaaacacgttatgagcataagtcagcgcggttaataagcactatgctacctgttcaagcaaaatcgaaatgaggagcgtttatgcagtatcaaaatgtcagtgtcgggcaactgatccggcgcgtgagtcggtttacggttgaaattgcgattgatggcgtgacgacatcggtacatatgaacaacactggccggaataaggaaattctagtgccaggttcgcttgccagtgtccggtatgtggatcatcccaaccggaagacgcactatgatctgcttgcggtaaagcggcagaatcgttggattaatatagacagcttagcccccaaccacgttgccagagaatgcttggaggctggcaccatgaaattgcccggattatccttgccttatgcggttcgtcccgagaccacctggcgcgattcccggcttgattttgcgggaactgcggctgatggcaaaaaatggtttgttgaaactaaaggcgtcacattagccaaccaaacattggcggcgtttcccgatgcacccaccacacgagcgctgaagcatgtgcacacgctgacaatggcacaagcggaaggctatcaggcatttttggtttttattgtgcagttacccaatattcagcaaatgacgatttatcgtgaacggtttccagagcttgtcaccgcaatcacaattgccaagcaaaacggtgtgcgcgtcttggcttatgacacgatgacgggtccggattttattactttgggccagccgatcctgtttgacgagcatctgccatttacggaaatgaacttggcgagtttgtgaaatatgagaattcggtcatgatattttcatattgacttgacaacgattacgatgcacgattagcgggtcatcaatcgtccctagccctcaatcccatgccgatgagggcttttttgttatggttaaaattttcagcaagtgaaaacaccagcgaggcttgaaaatgaaaatgagattccgtgatttgaatcacacacaaatgactcgtacaatggttagcattgtttcaattcgatgacaactgtttctgaaacagagcaaaatcgctacatcaggtcatgagcgattttaaaaagtaccgggcaccaaaacgagatcttaattcgttaaagtgcctgagaggagtgagcaaatgcaacacaagattgaaaatgatgctgaaacaaaaatcgaagtgagtggtttaaccaagatttttggcaaacgaatcaatcgcgccaaagaaatgttaaagcaagggaaaaccaaggctgagattctaaaagctacgggcgcaaccgtgggtgttgatcaagctgatttcactattaaaaaaggggaaatcttcgttatcatggggctttctggttcgggtaaatcaaccacactgcgaatgctgaatcggttaattgaaccgactgccggacaagttctgattgatggtgatgatattgccaagttggacaagcaacacctgcgtgaagtgcggcggcaaaagctgagcatggtatttcaaggcttcgcgctattgcctaaccgaactgttttacaaaacgcagcgtttggcttggaaattcaggggatggataaatccgaacgtgaagctaaagccaacaaagcgcttgatttagtgggattagacgggtttgccgatcaatttcctgatcaattatctggcgggatgcaacaacgtgtcggcttggcgcgcgcgttggccagtgatgccgagattctcttaatggacgaggccttttctgcgcttgatccgttaaatcggcgtgatatgcaagacgaattgttggatctgcaagaagaaatgcacaagacgattgttttcatttcccatgatctgaatgaagcgttgcggattggcgatcacatcatgattatgaaagacggcgagatcgttcaaatcgggacaccagaagagattctgagtcaaccagcagatgattacgttgagaagttcattgaaggtgtggatcgaagtcaggtttataccgcagctaatgttatgattcgcgctaacaccgtgaatatcgacaaggatggtccgcgtttggcagcacggcggatgcgtgacaacgagatttccagcttgtatgttgtcaacaccaagcgacaattagtaggaatcttggatgccgatgatgttcgtgcggccattgatagcgggaaaaaggacttaaccacgattgttaagaccgacgtaccgacaacaaaaatggatacgccgttagctgacctgctggatgctgtgtcgactacttcagttccgtatgctgtcatcgatgatcagaaacgactttgcgggattattattcgtggtgccgttcttggcgcactttcaggacaggaggtcaatgtcaatgtttaatcttttagtcaccatcccaacgttaccattagcacattggattgattccttcgtggactggctcactcaatttgccgggttcttcggtgtgctgacgaactttatcggaacgattgtcaatgcctttcaagcgatctttgatttcattccgatttggctgtttatcattttgattatggcgctgacctggtaccttaagcgagggcagaagtatcgcagtttgctgatttttgaattagtggggctgttgttaatctggaacctgggattttggcgcgatatgacgcagacgctgaccttggttctgaccgcaagcttgttggcaattgtcatcggcattccattgggtatctgggctgctgaaagtaaaaccgtttcggcgattgttaagccgttgatggactttatgcagaccatgccagcctttgtttatttgattcccgccgtggcattctttggcatcgggatggtacctggcgttgttgcgtcagtcattttcgcgatgccgccgactgttcggatgacgcaattgggaattgaacaggtaccagccgacttgaatgaggcagccgttgcatttggtgctacgagttggcagcagctgatcaaagtgcagctgccctttgctcgcggcaccattatggctggcattaaccaaagtatgatgttggctttatccatggtcgtaattgcatccatgattggggcaatgggcctaggtaccaaggtttactttgctgtgggtcgtaacgacgctggcggcgggtttgttgccggtttggcgattgttattctggcaatcattctggatcggattacccaaagtctcaatcgcacgcgctaggaggtggctgtttgactttttataaaaaaatcattgcggcactggcgatggtagccacggttggctttttgaccgcatgcagcagtacccaacctaagtacgatgccaaaaagcctttagggccgcaaattaactacacgattaccggaatcgatgcaggtgccggcatcatgagcagtaccgacaaggccttaaaagcatacggattggaacaaaaaaattggcagttgcaaccaagctcaaccgcggcgatgaccagtacgctgcaaaaggcgattgccgataagcggcccattgtggtgaccggctggacgcctcactggatgttcaccaagtttccgttgaaatttttgaaggatcctaagaatgtctatggtaaagccgaacagattcatacgattgtgcgtaaagggcttaagcaagatgctccgcaagcctaccaggtgcttgatcaatttcactggacgcccaaagaaatttctagtgtgatgttggcggtgaacaatggccaggatcctgctgcagctgcaaaagcatacgtgaagaaacatccggagcaaattgctcaatggactaagggtgttagtcatgttagcggtagtcctaaattaaccctgacctatattgcctgggattcggaaattgcctccacaaacgttgtggcgaccgttttgcggcaagtgggttataaagtgacgattcgcgcgatggaaccgcagccggtttgggcatcagttgcgactaaagcagcagatgcacaggtatcggcgtggttgccaaatactgctgctaagttatacgccgattataagaaccaggttgttgatcttggtgtgaatatggatggcgctcgggtcggtttggccgttccaaagtatatgaagaatattaatagcattgaagatttgaagtaaccattgtcaaaacgctgagggtacggttcgtcatgaagacggatcatatccttggcgtttttacataggcagatgatttgctttctcatcttttcgtgcctagtataaccgcggaagcagctttaataacacgccaaaactggcaggttcagattgccggtttttaaataaaagggggacttatgatggctgagacgattaaagccggggttgcagcgctacaaactttggagagttggggcgtcacgcacatttacggcatccccggtggtacatttaataacatgatgtacgcgttggatgaggaaaagtcacgcatcaagtatattcatgtacgccatgaagaagtcggggctttggcagcggtcgccgatggaaaattgacaggtcgtattggggtggcattcgggtcagccggtcccggagcaacacatcttttccaaggggcttatgatgccaaaatggataaagtgcctactttgttcttagtgggccaagtggaacaacggtttatgaatgctgatttctttcaggaattagatgaagatccaatgtttcaggatgcggctgtctatgcacgtaccgtcaccacagcgcagagtttaccgcatgtcattgatgaagcgattcggcgggcatatgctgctcatggtgcggcgattgtggtgattcctaacgacttggctgccgagttgattccggcgaatgggtattacagtgccgcggcgacccatgccaccccgattttagcggctggcaccgatgaacaggtggatcaggcattaagattgattcgtaccgcgtctcgtccggtgatgtatgtcggtcaaggcgttcgcggggcagcagatacggtgatgacgctagccaaaaagttacaaatgccggtgattaccacagcgctgggcaagccgattattccgtacgcctttgaagcactcttgggttcggctgcacgagtcgcatcgaaaccggccaatgaagcattgcgggtggccgatttgatcatgtttgtcggctcgaattatccatttgcggaagtcatgttttcgcctaaagccaagtttattcaaatcgaagctgatcccaaaaccttaggcaagcggcatcacacagatgtggcaatcttagcggatgcacccgcaactttgaagaaaatgattgcccgcagtgatgaggctcctagcagcggctggtatcaggctaatgtcgataacgtcaaaaattggcaccaatataatgacgccatgatgcaacgaaccactggtgatatgcgctttgagccggtattcggccagatcaaccgcattgcgaccgatgatgcaatttttgcgattgatgtcggggatgtcacccaaaatgctgtgcgcttgctgaaagtgaatggtcggcaagcgtggacaaccagcggactgttcgccacgatgggagcaggattgccggcagccttagccggacagttgagttttcctcagcgccaagtgttcaatcttgctggtgatggtgccgcggcgatggtcatgcaggatctggatacagaagtgcggtaccacctgccgattatcaatgttgtcttttccaataatgcattgggttatattgaagatgagcaagaggatgacggacacgaatggtttggcgtcgatatgccagcgattgattttgcaacggttgctaagggtatgggcatgaccggtttgaccgtcaccaaggtttcggaactcgcggctgcgtttgatgaagccgaagccaatcgcattgctggcaagccaacactgattgatgccaaaattacgaatgagcggccaatcccggtcgagcatctgcagttagatccggatcgtttcgatgccgctacaattactgccttcaagaaacgttattatgctgataatttggtgccgtttagttcgtttctagcggcgcatcatgtttcggtgggttgaatttggttgatgaaaacgcaaacgtgccccaaaagcggtttttacttttggggcacgttttagttaacaatctagaactcgataagcatagctaccgtttgcggacaaagatcagttttgagaacaggtagttagcgacgacaatgataatttgatccagaattttgaccaggatctcgttgccgtgaagccagtccacgccgacaatcataatgaagttatccagcaacagtgaaacgccacggaggattagaaaactggttagctcgaaccagaacttctttttgcttgaatagtcactgtggaagacgacacttttgttggcgaagaatgcaaaaatgacactgacaatgttagcggtcgtgttggttaagaccaagccaatatcaaaatagcgcatcacaaaaaaggtgacgaaattgatcaaggtggtcagcccgccgataaataagtagttgatgatcatttcgtagcgtttatatagatgaatcagcgttttcaaaggttaaatctctcctagcttcgagtttgatgcaatgcagttcttggttgtgagcgaatgatgtcagtataccatgcaagctgagtggtagtgagatgctttttataaggttcatgcgagagtgacattaacgataaccccttgtcagtgtgcagctaaaaaagcgactgagctgttgacttgcgtttatccgcctaattgacttacaatttgttagcgaaaggctgagacttgggtatcatgggcctgcttgaatctcagtgggtttcaaggtatgctctttgcaaggaggataacgatgacgaaatcaggtaaacaacagtccccacgtaagcatcgctggctatggcggacgatttttgcgctcggtgtccttctgggcttagcgctggttttcaacgaaccgattaagctgtttgtcgttgatcatttaagccaatggacgatggggcagattgatcgcaatacagttgataagaacgaaaaaagaagtgccacgtttgattttaaaggtgttaaagcgcttgatatcaacacggtcgggaatgccgcgttgacccgtaatctgcatccgattggtaagattgccattaccagcgttcatctgaagttgccgattctcaaggggctgtcaaatgataacctgagcgccggcgccgggacgatgaaggctgatcagaagatgggcgaaggcaattatgcgttagccggccactacatgaccaaccaagggattcttttttcgcctttgaaaaatgtccaaactggcgatacagtcgcgattacgaatatgaagaaagtttacacttacaaagtgaccacgaaacagattgttaacgaaactcaggtgcaatggatcgatgatgtggcaggcaaaaaactgattaccttagtcacatgtgcgtcaccgacagaaggcgaagtggatcggatcattgttcaaggagaacttcagtcggtcaagaaagcaaatcaaaagaacctgaaaattttcttataatttgaacaagtgctggcgaatgcttgcactttttttctttttgcggcacgctaagatttaactagcgaaaaatggatggtggggaagacgatgtcagcgtacgaaaaatttatcaacaatgtgccagtccgacgtacagtggttttattctcggtttttttggttttgtggtttgcccgtagcattatgagcgacattttgttgacctttatttttgcgtttctagtcagtcgcttagtgcacgcggttcaacgccacgttcatgttcggccgtttgtgatcgttgtacctgtttacatattggtgattttagggttgatctatgcagcggtccattatgttccagccattattcaccaaacgatcacgctgtttaattcggtacaggatttttataacagcgatgcctttgccaacaatcaggtgatgcagtgggttttgcagagtaccaagagcctgaacctcaccgaacaacttaagactggcctgtcaacggttcttgaatatgccggtaacattggtgcgatgggcttgacgttggtgttgtcgtttattttgagtttcttctttaccatcgagttggatagcttaccggcatttgggcaactgtttttggattcaccgtttggctggtattttaaagacctgcgttattttgccttgaaattcatcaatacgttcggggttgttatggaagcccagatctttatcgcggtggttaacacggtgattacgacgattacgctgttgtttatgaaaatgccgaatattccgagtctggcgattatggtttttctgttatcactcattccggttgccggggcgattatttcactcattccgttgacgatcatcgggtatacggttggcggctggcaagatgtcatcaccattttgatcatgattgcggcgattcatgtgttggaagcatatgtcttgaatcctaagttcatgagcagccgcacgcaattgcctgtcttcttcacctttgtcgtgttgctggtggcagagcggctctttgggacttggggcttgatcgttggcattccgatcttcacctttttcctggatgttttaggggtcaaaaagattgccggaaccaaagcacatcattcgacttatgacactgtcccgcagccaaaggagcatcatgaaaatgacgcgtaaacgccggtggctgatcattttggcggtgttaggtgttttggtcgtcgttggtggcgtgacgatgcgctggatccagcatcagcgtcaagtcagtaagattacggcacgacctgttcctcaagcacagttgcggcggcatgttcgtaaactgattgatgcgaccgactttagaggcagtgttgccttgatcaaaaagggccggattgtttatacaggcggtgtcggtgaagcagatcatacgcgcaaattagcgaataatgggacgacgatgtttccgctggcctcggtagaaaagtatttaacggcgctcgtcattgggcgactgattgccgatcaccggctgtcattgactactaagctagccaagttttatcccgacattgatcatagtcgcgacattaccattcggcagctgctggatcatcgctcaggcattcagatggatgaacttacaccggagcaaatactgacatcagaaaaaaccgcgctcgactggaatttgaatcaactaggatccaccggcgaccatagctttatttatactaatgccaattatgcgttattagcggggattattcgcaaagtcacaaagaagcctttcgctgcggcactagaccaaacgattttggcaccgttaaaactcacacacacccgtaacttcgatgcgttatcggcgaaaatgccagtggcgcaaggttatctgagcgaagatgatcaatcgtaccagccggatgatttaagccaggcgcttttgtcgagtttacttggcagtgggagtgtctacatgagcgtgaccgacttggccaaggtgatcattgcagcggaaaccgggaagattattcctaaaaaagtctatcgtcagttaattgcggcacattatgcagatggtaatcagtatgccagcggggtagcgtggttggacgatcagcgtttattgcaaggcatgtacaacgacaatccggaaagtttcagtacccttgcttattttcgtgctaatgcgaccagtggcgttgtgttgtttggtaatcatacgatgacaaccgacacggtgacgctggcgcagaacttagaagcattggtggaataaccaggcaggaacatgaaaaccggtcttaatgacagaagataaatgtcattaggaccggttttgtgttgaacggcaattgcttgttttttagcgcgagtgccttatgcgcctgactgatggcacaagcattccaagtggctaatacgcgattgatccagctgtattagtaattaaacgagcggccaaaatcgttgagtccttgataaaggctgcccatgatgctggcaagaccaaacatggtaatcaccatgaagacaatggctagtagcacactgacgatgagaagggcgtaaatcttgtcgaaatgattagttgactgagccgtaaatagcatataaggcccggctaagaaaaagaggctaagactgatggtcaataataacgaaattaacattgccgaaccaacgttgatgagacccaatatctgcattaacagggtaaagacggagaagaacaccatccaattacagtggaacgcataatctgtcgtaaagtcgagaaaacgccgccgccgatcacctaatatgccgcgaacgcccagataataaatggcaatcacgccaatcgccagaatcgcaactaagaccagcaacttcaaaaatgtactcatgacagaactggcaaggctgccgggtaaggatgaaaaagccgagccggcgcgcaaagcaatcgtcaaggccagactaacgatggtaatcgccagactggtcagtccaaaataactatgataagtgcgctcaatgctggccggatgcttaatactatcgactaaataccgccagtaactgcccgcatactgcttggtagcctcaacggttggattaggctgtggcgttggctgaggggcctgactggttggagcatcggtagcagtgttgtcggtagtcggcgcagtttgcgttgcggccgctgagctttccgaactttgggcagcttgtgaatcggcggccgtatcagcttgggtggtgtgagtggaaatcggtttagcggtttccggtgctgctccagattttgcgtctgccgttggtgcggttgctacgggtgattggctagtcgcactaacggtatcggcttttccatcggttgtgtcaggagttgcgggagcttgcggctgtgtggcggccacccccgccagatttgcaccgcattttgtacagaagttagcagtgggtgcgttatgtgccccacaatttggacataatttaaacatgatattccctccaaagttaaacccagttccattttcaaaaacaatcgtcacttaatcataacaaaagacagacacaatactgactaaaatgacgggaaatttcttaccgccgatgaaataaacgataaagacctcctgcaactaaggcaaacgtaccgccaagtaagatcagatccatgatgccatgaaccaacgataaaaagccgttttcatttactgccagttgcatcgccggtaagttgatataaatcaaaaaataaatgacactgatcaaccatataccaccaattgtgagccaaatttttttcacgagaacctccaaattactgagcataaaagtcataagggacgtcaatccgaatcgcatcggtaccctgtactgacaagcgtgcgtgtcgatcacatcgtaccgtgtgtcgtaactggtgcaccagttacaaacgttgttaaaccttttctttttgctatgtttccaatataccagagaaagcgggtgcgaacttactgaaaatggtgtaacatgagattctgtaaacaggcagaagactgtcaaatcataaaagcgaggtattctctgatatggcgaaattagtattgatccgtcacggacaaagtgaatggaacctgtccaaccagttcactggctgggtagatgttgatctgagtgaaaagggtgtcgaagaagcaaagcatgccggtgaattaattaagcaggctggtcttgaattcgaccaagcttacacctcagttttgacccgtgcgatcaagaccctgcactacgtcttggaagaatccggccaattgtggattccagaaatgaaaacctggcgcctaaacgaacgtcactatggcgcattgcaaggtttgaacaagaaggaaacggctgacaaatacggtgccgatcaagttcacatctggcgccgttcgtacgacgttttgccaccattgttgaaggcaactgacgaaggctctgctgctaaggatcgtcgttatgccgaccttgatccgcggatcattcctggcggcgaaaacctgaaagtgacgctggaacgggttatcccattctgggaagaccacatcgcaccagatctgttggacggcaagaatgttgttattgccgcacatggtaactctctgcgtgctttgaccaagtacatcgaaaacatttccgatgctgacatcatgaacttggaaatggcaactggcgaaccggttgtttatgactttgatgaaaagttgaacgttaacagcaagaccaagttggactaatgattcgctaactcatttgcataattgaaaagacgaccatcccttgagcgttgataagacgcttgagggtgatggtcgtttttgtatggtgttgcttagaattttttatagaaaatcgggtcagcttttggctccagcaactgtgtgcgaaattttgatctgggtgatgagtcgcttgcacttgccaagcatctattgaataatcaatgtaatgaagtcaagaaaagaggcagccaagtggcaaattatataaaagacatccgcagcaaggtcgggcatatgccgatttttctaaatgcagttgcgggtgctgtcgtcaatgaccaaagacaaatattactgcaacagcgcactgatgcaggcaattggagtttacccggtggcatgatggagtatggcgagacgtttgtcgagacgctgaaacgggaaatgaaggaagatgcaggcttgctggttgagcctatcaagccgttacacacttttgagcagggctttaccacgtatccaaatggcgatcaggcccagattatctgccgactatatctggtaaagccggtgggtggcggtttggagcaagctgatccgaatgagacattggctttgaagtattttgacttcgatcagttgccaccattattcaatatgcaatcgcgcgacatgattgcgtgcgttcgcgcttatttggatggggaacagcaacattaaaaagctagcaattcgataaagtaaagtccgcccagggatgataggggcgggctttttgctagcacttggaatcgggacggcaatgaagagcattaccacattgggttggaacttgtggtcgacagtctcaggggttgttttgaggcgggcactcaaaacacttgatgattttatgttagttttaattgacgctaactaaataagtgattatactaatgtaagttagttgaacgtaaacaaaactaactttcaaaaatctcgtattcaaaaggagcaaaaaagtatgacacaaacttcagaagcattattaaaagtattcgggcaattactccaaaagcggccatttatgggggccatcgccagcagcctgcgttttggtgatcagcagcggcaacctaatcaattgcgtttgttgcgcttactcgatcagcgcggtgagctaacgaactcggatttagttgaagctttagacattcgccctagctcggtttcggctttggtgcagaaactagaagaactgggcctgattaaccgccatgaatcggaaaccgataaacgggttcaactcattgctttgactgacgatgggcgcaaattcattgaaaccaccggaaagctgaaaaccgatttaccggatcaaatttttagcggtttgactgacgatgaacaagccgagttgttgaagttaattgaaaaattaacggcggatttggctaatcgcgatgatctcagctggccagaaggaaaacagtttgacgatatgcgggcgtgggcggagcgctttcatcacgggcatcatggtccccgccgcggctaccctggcagctttggggcaggtggtccccatggcttcgaccgccatttttaagcggttgtcgtgaagatggcgcttccgcttgaaaagcttaaaagtagcggatgcactgacttaatctagaataagcgagcaacttaaaaggaattgtccggtgggcgattcctttttgtttcggaacgatcataagtaagtgagggtggaagcaaccaatgttcattttcacaaaaattcagcggcaagatgactgctgactatgccattcatggtttgcaaaatcgcttgcttttcgttaaaaagttggcagaaactttactattttggcggaagcaggcaagatggatttaaacaacaaaaatgggagggaaaccgatttggctggaaagatgcggtactgtccaaattgcggttttaaaataccggcaggcgttaagtactgtccaaattgcggcacggatttggtgcgttttgatgcccaaattgcggcacaaacagcggcacaatccacgcaaagccgaccgactaaacaagcggagccgcaagattcgattgctgaccaggagccaacagttggtgagcgctctcggcgacgtcaaagtcagacgccggccggtaagaaaagcctagacttaactgacgacagctttcagcattttcttgattggctggctgttcacattgtgtatacgttaattggcgtcatggtgttattttgtgtctttagcttttcggtcttgatcggttgggtgcttgcagttgccagtgcggtggcggtttatgtcgtggcgaaccggcgaccggtggcacgttaccagccgcggaatcgtagcgatcagtccgatgatgatgatatttggacgatgccttcatctggacaggctagtcaggtgcctccgtattcgacgcctattcgtcagccaaacttttcacctaattcccaaagtggcggttcgtcgcgttggtggctgcaatttgctggaaaatcgcatcggcgcggtagcttgatctggctggtttatttagcggccgcgtttcttgccctaattgccgcttatgcttggccttttggagcgagcggggttggtacgacaacggtgggcggcagtttgtatgacttggttcgcagtgccagtacattggccgaaacgacggctgctaccactgggacagtgggtgcggcaaaggttaatctgccttatgtagcgctagcgttggcaggtgtggggccagctttaggattagtgtttgggcttttccgggcgcgcggcatgatgcgacttggcgggatgttaggattattagggtatgcggctttatatgttgcctatgcaccattaatgagtagcggaacaaatcaaattcaagggttgctcaatcctggcattggctatgttgtggggatagttgctgcattagtgatggtcgtcacggcacggcttttgcggcgtgattgacgcgtttcgcaactgaacgtttgttgcgataaaataaaatatgttctgtattggtgctgagtgttgtacgataaagaagtccttcacaagaggcagttatggggtaagggtttgaaaccgaaacaaaggaacgtattggcttgggttaaggtgcacgactatgcaacggcgtaagcgaatctctggtattttaatcactgctttgatgatcgcggtcgtatttttgatctggtgggttccatctttggcaccttcaaaatcgggtcaatcttcaacgtcagcgccacgacaggtgacatcggcgtctgcttcaaaaattgttaaccgcagcactatcagcacatcaacttcatctgagtcgagtgtcacgtcaccacaagcggctagcagtctcaacgagtcaagtttcttttcgccgacgctgaatcgttcttggcgctattttacgtatcttccggctggctatacctcatcgcgccagtatccgcttatcttgatgctgcacgggatggatggtgatgcaaccaatctggtgaaattggttgattcaaaaaccatgttagatcaagcggtgacagccactaagcatcccgcagtcgtggttttcattgatggtggcaatagtttttacgttgattcgccagcagaaaagatgcagacagcgatcgttcaggatttgctgccgcatttgcagcaacaagttgccgtattgccccaggcggatgcccatgcggttggtggcgtgtcgatgggcggttatggcgcactgcatctggcgctagcggttccgacagcatttcgcacggttgcagcattgtcaccggctgtctggcaacaagttcctgaagctgcgcggccacggatgccagcatttttgcgtgccggacaatggaatcaggcacagtgggaagcagatgcgccggctaaaatgttaacaggtgaccgcactgtcgggttgcacgtttttcttgcttccggtcaggcggatacaacggtgccatttcaggatgttagccggtttgccgatcaactcacgactgccggggtaaatccgaccacgcactggagcgctgctggggcgcacggctttacttattggcaacagatcctacctgaagcttatcaatggatgttgcgacagctgccggttcctgaaaaataagtgagtagcgtatacagcttgcgatcgtcagtgctagcttggcgttcaattgttggtatgacagggtagtaagataccaaatatcaaaaacggaggaagtagaaatggaattttgtccacattgcggcgttcaggttagcgctgacgaagcatattgtcacaattgcggtttcaatcttaaggcatatcgattagaaaatcagaatgctgcgttagcccatcagcaggaaaatgttggcggtcagacgagtccggcatcggcgtcaggaccacaatcaggcagcgtgccaccggtgacccgtcgccgccaaaccagtggcggatcccccaaccacccgaaacgaccatggctaattgtgacgctggtattactcgctgcggttgtcattgtgggcggtgtcttatattttcagaaccgcagtcagcagacgcaagaagccgcctcgagttcggccagtgcgtcagcagcaagcgcctcctcagtttcgatcgcctcagcctcggcatccgaatcgcaggcagcagcatctagctcactggcagcgtctcaagaagccgccagtgaatcactcgctaatgccagcgagtcacgtgcagaaaaagaagagaccaacagcagtagcagcgatctaagtaaccgcgatgttgccaaaatggccgccgatctggacgattttgatctcgacgattaccgcgtggaagtcacatcgccggcagttaacatgaaagaagtcgatgtttacgacaaagatagtggcgaactgtacaataaataccgctacgatgagattcatgaccaaatgagcaaatacgatgatgattcaggcaaatgggagcttattaaagacagcgatgattaattgcgccaagaagacaagggcgtctgcatacaatgaaattatggcaggcgtctttttgaatgtccttcaattgtaacgcggtttgctactgggattcagagaaaagacgctaacgaaactgttgtgtttgcaagtcaaacgtgtatgctaatgggtatggaggttcgacatgcaaaccgaaacaaacatttccggcttgatttatcagctggctaaattacagaaatattttctcaatcaacatctcggcacgctcaacttaaatagcgatcaggctaaggtattgacttttgtcgctgcacatcctggtacgaatcagcgccagattagcgtggatctaagtcgtggtccggcgagtgtttctaacctgatcaagcggctaattcaacaaggtctgctagaaaaacggatggcaccgcacagtgaccgcgagcggcaactttttttgacggctgatggacaagcggcggctgcggaagtccatgagttgtttcaggtgttggagaaagctttcgccaccaatgttaaagatcctgaagcacttaccgccaccttggaacgattgttaaccgctttgcaatgaacttgatggtccgtgcaaaccccagcttattcgtctttacatacagaggtaagggttctgaaaaattctgtgttcaacccaatttcatgacgggcggatggctaaagtaacatttagattaaaataacgaaaacattcaagattctcttggcgcctgagaagaaacatgctacactatgcacaaattacagcaagcagaaaggtgtcccttatcattgattggcgcaacgaacgaagcgttgttcgctttactatttccaaaagattttccaaccctgttagtcgctaaacaggcccgacgcatgctatgtatccgcgccagccatggcaaccaagaggcagcacgtctactgcgagtccgctcaaccccgattcgcgttgtttatgccgtcaaagttagtcattagtttcagagcagcatcctaagcccgatgatgattatcgggcttttttggtgtgaacgcgagccggcgcggttggcaatcggagtgtacgagggctttgcagctgaggtctttacacgccaacttctgcgccgatgaacgcgttatagaacgcaagaaaaattaccaaatcgcccaaaacaaaaaacgcaagaaaaaaccgcaagcagctaatcttcttgaactaggaccagatttaatgacaactgaagaacatttccaaagtaccggcgttttaaaaaacgctcgttgtttaaagcggtacattccgttaaacttaagaagaagtgttattaagcagccaatattctttgttgagaatatttttagatcggagttatcatgtatcgttactttattcaaccgcaacttaataaagccaatcaaagtctcattggatatgaacttttgatgaagcaacatacgtctcgtggttggcagccacctgtgtctttttcagcactgccggcaccggtgattgctgatacactgcggcaaacagcgcaaaaattggttttgaaaatcggatcggtttccgtcaatctgaatcggatgcagatgctcaatcaccagattcaaacggccttgattgatgtgcaaaatgagttgcgtccggtgcgtctggttgtggaactaacggaagagccggaggaagccccgattgcctgggcgcaacttgagccgatgatccagcggtttgtcgaacgcgggattgaaatcagccttgatgatgtggctaccggcgaaaataaattgtcgcatatccgaccacttttgccttatgcgagtgagatgaagttcgctttacaaaatgatgccaagttgacgttgagcgatgcacgtatgcagcaacgtgtacggttttggcgtgatcttgcggctgagtaccacatgcgcttcattcttgaggggattgaaagtgctgctgatgatcggcttgttgatgcactggggattgatttgcggcagggctatttttatgggaagccgcaacttttgaagttacaggcttctgatccaacaaattgaggagatctgacagcgttgagtaaatgggggggattttgacgctatgaaaattgttttggttggctgtacgcatgcaggagttgccgctgcaatgcagattttaaaagaacatccagaaagcgatgttgtcatttatgaacgtgaagacaatgtctcatttctttcatgcgggattgcactttatcttgctgggacggtcaagcggcttgaggatatgttttatgcgactccggcaagtttgcgcaaagcaggggcaacggtacatattcagcatgatgtcttaaaaattgacgttcatgcgaaacaattgaccattcagaatctgctgactaacgaggtgttcaaggatacctacgacaaattgttggtcacgaccggttcctatgtcgtcgttccgccggtttacggggttagtgaagagcgggtgttgatgtgcaagaattaccagcaggcgcaggcaatttacgcaaccgcaagtcaacatgcacacattgcgattgtcggtggtggctatattggggtggaactagccgaaagttacacgaacacaggtcatcaggtgacgttgctacaaggtaatgatcaattgcttaatcactatattgatccggcgatgtccaaacgagtggtcagactgcttgaggcacacgggactaaagtgttgctaaacgaacgggttcaggcttttcatagcggtgcttccactgcggatccgatcacgattgaaacagcgatgaacacttatcaagtagatttagcgattgtttgtaccggatttatggctaatacagaactgttacgcgggcaaattgagatggatcggcatggcgcgattatgaccaatgattacttgcagacttctgatcctgatgtttacgcggcaggcgatgcatgtaccgtgaagtttaatccgactggagaacaggtttatattccgttagcgacgaatgcggttcggcaagggatgatcgcgggtcgcaacctttttgggaacttgcaacgttatccggggacgcaagggacaactgcgatgccgctatttaatcaccacttggcctcaaccggcttgacgcttaaaaacgccttggaaaaagggatcaccgccgcggcagttacttacgaggacacgtatcggcctaaattcatgcccacagctgatcgggtcatgatcagactcgtgtatgcgcgtgatacgcgacgcattcttggcgcgcaattattaagtcgctacgatatcacccagtcagccaataccgtatcggttgccattgcaaatcggaatacgatcgatgacttggcgtttgtcgatatgttctttcagccaaactatgaccagccttttcattatctgaatttggtcgcgcaacaggcaattgaacaagaagcaaccgcggatcaagcatcaaacaataggtgaatggaatgaacgttgaaacacttttgccgattttggcgtcaactttgcgtgatatttttgttattctcggcgtcattttgatctttcagatgattgtcctggcttatttaaaacgccatcatctccacggcggtaaggtgatctataccaagggacggttgaatcagctgggaacggtttactttggcgtgttactggttttctttcaaatagagttactgaccggcaaacctacctggattattgtgaatgaacgattaatgttgtttttttatgtcatggcttatttgggggctcgcagtttggtggtcactgccggtgccggtggcttgacacagttggttttgatcggatttaacacgacaatctggcaggacttgagcgtaataagcattgaagcagtcgttgcttatgcctttgtagtgttggggcgacgcatgcaattgtcttttatgcaggccagtttcgcgctaacagtttgcgttgggctgtgttggcaggttgtagtgtttctcaatgcagccttattggcaaatggcacgggcgcaatggctttggtctatgctggcgactttttgatcacaaataccgtgctaagttatgttctggatttttttgaccgcaataatgatgacacaacgcgcattcagtacgcggcaagtacggatcggctaacgcaagtggagaactatgccagttttgagcggcagttggcgaaagcatttaaggattttcgttttcaacaaacacctgttgccatgattgcttttgatattgatcatttcaaacagatgaatgatacgtatggccatttggcaggaaatgaaattttggcgcaagttggtcggctattgttggacgagaccagaaagacgccggatgttcaatgttttcgcgtgggtggtgaagaatttaatttgctgttgcggcatcaaagcttcgagcgggccgtggcttttgccaatagcttgcaagcgaggatccaccactatcccttcatggttgcgggcaacgtcttacacatcacagtatcgatgggattggcgcaattgaaggcggctgatctcaatccggatgccttttatgatcgcacggatcagatgctttattactcgaaatttcaaggccgcgcaaagttgaccacagagcaggatgaagccctcgtgaatctttcggcagaggatagttattcgcattaaatgacagccaatgcctggtgaaacaaggcattcattttttctgatgttgttattagaaatattagttgttttgtaagccgaaatcagtataataatatattagttggtctataccgtcaggggtttagcatgtctaagcagggcaataaagcatgataaaaaagacggttagttgatcagaacaaatcgagtggggaaaagtaaaattgtttgcaaaaatgtcagtttggggatggcaacggttgctggcggttttggcagccggcctttttttggctgggtgtcagcaagtgcaacctgaaaaaacaacaaaacaagtggcaccggtcactagatcggtgcctattcgtgcgcctaaaaataaagcgtttgaggcgcaatataccgcgctgcttcgattcttaaagaaagaaatggtccaaaaagacggggtctatacgaattatcgtaacgaccagcaaaccggaactaaggcgtctggccatgcttatttaagcgaatcttccggactatggctgcagcatctagcgttaacccggcaaaatgcggcgttttcggctttttatcatcgtacgaagcgtcttttttggcagggacaccagtttagctatcgttaccaaccaacgacgcgaaccttgtatccggtaaatgccccggttgatgacttccggattatgcgcagcttgttgcagatgccgcagtccaagtggcaacaaactgcccgcgggctttacgccaagtttcaagtgaccaatttacgcgcaaaccagttaaccgattatgttgacgcgtccacgggtaagcgcgcgaaaaccctgactttgtgctatgtggatttggcaacgcttaagcagttaggcagcaaagcagtttatcagaaagccttgctgcaggtacaaaatggacatctgtcaagtgctgccttaccgttatttgccacacgcctaaacttgactgatcaaagttacaccaaaagtgcaaccatcaatattgtcgaaagtttactaacggcattgcatcttagtgaagttcaggcgttatcggatgctacttggcagtgggtgcgccaacaggtgagagcgggtcagttgatgaatcgttacacggcgaccggacaagcagctagcgaggatcaatctgctgctgcttacgctttggcggccttgttggcgatgcaacagcacgatcaggcaaccgccaaaaacgcactgcagcatgcgttggcgtttcagatgcagactgactcaccgttaaatggcgggctgggtgatgcggcgagtcaaacggtgtattcatttgacaacttaatgacattggttgccttggatacctattgcgaaggacaggtgacatcatgaagcggcgtttgcaagcggcaggcgctgtttttagccgtcactgctctccggcgcttttggcagtcattctactgatagctgtctgcggctggtacttgtttgggccgatcttgcacgggtatgccgataacggtgaatttgctagggtgctctctcataaccaattgttgccgcgattgggcgcatctcatcatggagcgcgttatttagatgttacctatagcatccggcaattttacaacgatacccgtttgccggcatggtcgagtcaaaacttgctcattcaagttgcgctttggatcgatcaacttttaatcagtcgaaccgtttttcatttacgggttttgggaatgctggcgtttggcttgtacttaggtggtgtgtatttggttgttgccggattgactcggcaacaacgaaaaggccgccattatctcattgcgatactggcagtttggctattgggtgataccagcctgacgctgtacttcaattctttttattcacaatccgtgatgctgattgctgtcacttatttgtttggcagtttgctgctattggccagaaaaccagcgcatgcgtggcgttatttgctgattgttgcaagcgctggggccattttgatcacagccgatatgcagactgcttggttagtgggaccggtattgttagctaccgtggggttatggtggcaccgtactcgggcatttaaatggtgtttgctgctcgtgagttttgcgttggtacttttgagtggcttgacaatccggcagacgccagccgagctaaaggcggtcagtttgtatcaaagcatgacccgcggtgtgttgctaaacgccactgatccgggcaaaacgttggccagtgtcggtcttgaaccgcaatacgcattgttggcgggcactcagttttaccaggataagttgccagttaacacgcgtcatcgcgttgtacagcgtgagtttgtgcgccagttgcgatatagcaaggtactgcggctctatgccggttatcccgatcagctcgttcggatgctccagcttgcgagcggggatgtgtacctgacacagatggcggccgtgggcgactttcctgttacgacgaaagggctaccgaaacagcaaagtcggtattttacgagttgcagtttggtcatgcgggcatttttccccaaacagtttcagttctttctattacttgccagcattctaattggcctttacggttatcgggtttatcaaggcgggcgccggggtattcgggcatggattgtttgcggctggctcgtgatcggatttgaagggcttgtggtaatcgcaatgctcgtggctgttattttgaatggtgatgctgatttggcccgtcatttggtcttaaccgccgttagtcagaatctggtcttgcttttagggcttagcgacttcatgacgcgccatgaggaccaagcggtggatgcgctggctagtgccaaggaggtgtcgccatgaagcgtttgttcagctgtttgttgatcatcattggcttggtagccggcaatcatgtctgtcaggagcaacctgttgctgctgccacccgaccggcagtgctattggtctatgacagccaacactcagaaaccgcacaagatcaacctgttgctgatatgaccagattattgcttggtttaggacagtcggtgacccaagttgcgcttagccagtaccatgccggtgagctcaataggaaatacacagcggtgatgagaatggtgaattggcaagcaagtccgcaaaatagtgctgcatttgaccatgattgggcgcagtttacggggaaaaagatccatatcggcgcgcgattaccgcaggattttatacggacattcggtgctggtgagcaagtgacgcatttgcagttgcaattgcaggatgagacaaccaacgtcaggcaattactgccgtttaccgcgacaacttggactttgtatccggcagttgctgatgcagtgggtcgtctgcaagtgcaaggaacatcgcagacatacggctatggtttgatgaccgaagacaaagcttatttacctttctttgatcagaacggtttgaccggtttgttagcccagcggttgttagctcggtttttaacggggcaggcacaaaaattggcaccggcacttctgataaccggagtgacgccgacaacgagtcctaaacagttacggcaggtgacgacgtttttacgccaacaagggatttcctttgcgcttagtgccacattaaccgcgaaacatgtacgtttaccggagcatgctgcttacttggcagctttagccaatagcatgcaagctggcggtcagttaatctggcagtggccacagctcagccagacgatacctgctgatgctaaagctgtgcagcgattgtatctggcacaagtgaaacaggcaatacaaaacgggctttaccccagtggcatcagtggtgacatccgtactgcactgacgcctaaattacaggcgctttatcgtcaaacgaacacccagtggttactgccgagtatgcccaccgctgatgcatcggcgcataccgtaccgcaaactgcgaatacgactgaacgtgctttttgggtgatgccgctgcggcgttggcaaacgattgaaggggcgaatgatagtggcatcacatctgcagcaccgctagcactgcagatggcactaccaacgacagcaaaagcgttggcgcaattcaaacaggatctccgtgcttatcacggcacttggtttgactttagttcggatgcattcaccaatcggcttgtagcaggcaacgtgacggtaaccagtcaattcggccaatattggcgaaacggcaaacccgtcacggtcgctagcggggacaacccccaccagaaacggccacaggcaaagcgtatcagtacccgtctgaacggattcttcaattggcaagaacggtttttgctgattttcatgctgatcatgttggtgatccttgccgtgttgctgagaaaaggcagtaagctttatcgcgataaatttcgacgttaggtagagcgattgaaggaattcgtcataaaaactgaaggaggctgcaattgagtgctttagattggatcatgctatttgccatcggggcgatttggctgatcctcatggtgaacgtcattttggttgtcgcgggctattttgagtatatgaagatgacgcaacaaccagaaccgtctttgccgcccacaccgccaatggtttccgttatggtgccagcgcacaatgaaggcgtggtgattgtcaaaaccgttgaatccttgttgcgatttgattatccccaggatcgttatgaaatcattgtgattaatgataattcttctgataattccgcggcgttacttcgcgatttgcaacatcggtatccagatcggcagttgcatgtgatcaacacagatgccgtgacaggcggtaagggaaagtctaacgcgttgaatattgggctgaccaaggcacaggggtcggtgttagccatttatgatgccgataacacgccagaattcggtgctttgcgaattttggtgagtgaactgatggcggacgatggattaggcgcggtgattggtaagtttcgtacgcgcaacaagcaggcgacatggttaactcgtttcatcaacattgagaccttgtcgtttcagtggatggctcaggctggtcggcaacatttgtttggcttatgcacgatccccggcaccaattatgtcgttcgccgcagcctgattgacaaaatcggcggttgggatgtcaaggcactagccgaggacacggagatcagttttcatgtctatatgaacggcgcccggatcaaatttcaacccaaagccgtgacctgggaacaggaaccacagacactcgatgtgtggtttcatcagcggacacggtgggtcaaaggtaatatttacgttattttaaaaaatagcgccttactttttcaaaaacgcggtcgaccgatccggtttgacctcatttactttctctcgatttattttctgctcatgacgtcgcttgttctgtccgatgcggtttttattctgtcaactgccggctgggcgcatgttggactgaagggtttctccaccggtctgtggctgctggcgatcttgttattcatcgttagtaccttcattacgatctccacagaaaaaggcgaaatgacagtcggtaatgtcgggatcatcgggttaatgtatatcacttacagtcagttatggctggcagtcgcactttatggaatggtggcgtatattcgtgaacaactttttcatcaacaggctcactggtataagacaaaacggtatcaataaatggttcttatacttgctagccgtcctgtgttttttctttgtcaagccgttgccggtgcaagcagcaacgcaaacttttaccgaaccgtttcaaaatgtcgcgactagtcagtctggtcaaggcattcgaacggacatgtattttgtcaaaatgggatattggcaagtcgaaacagccaaacttaatctgaactttcaggtgagtcagttggcagatcggaccctatctgatttgacggtggccattaatggggttaaatttgcctcttttcgaccggataacacgagtgggttacaaactcacagtattgatgttccggtgaatttaattcaaggcagtaatcaactaaccgtccaaggccaagtgctaacgacggatcaggggacagtcgaaaagacccagacgcctgctaactggttaacggtttatccacaaagtaatttgaattttacctatacgctagatgagcctgagccggcgattaagtcgttttatcagcattttagtggtcaagatactatagccaaaggacaggcgggcattgccgttccgaaagcgccgagcaactcggaattagctgccgctacatacgctttggcgggttatgcacgggttttgagcaatgcggaagaagcaattgcgattgccccaagtgatagtgagaccttagctaatcgtccttaccaaatggtggtagctcgttacgaccatttgccaagcgcagttaagcagcagatccaaactcgtgatctgaatcgcggggctgtcctgcagacagtttatacaaacggtcgctaccaattgatagttactgccaaaacggacacgttacttgtgaaagcggcacgatttgtggccaatcaggaactgatgcaggaaactaaagcaacgaaaaaaatcatcacggcaaaaacccagactttttctagttcgcttcaggatttcgggaaccattacgcgctgagcccaacggatacaacccttactggtagcggacatcagcaggcagtctttttcgtgaagctgccaatggatcgcaccaatgctgatggcagccaaattaaattgaatttgcggtatgccaagaatctcgatttttcccggtcattagtgacggcttctgtggacgatcgacctattgggagttggcgattgacgcaagcgggtgctaatggcaaaacaattacgttaaccgtgcccaagaacatgccgcttgcaaatgcggtgacaatccgcatcgccgtcgatttggcgttaccgggcacgaccacgacgaccaatgaccagacgccatgggctacgattggtgaagcctcggaatttcgggttaagtcaaagccacaaaccagtcagctttttcgaaactacccgacgatgttcctcaagcaaggggcgttcgatcatgtagcggtggttcgcccggcccaaatgacgaacacagattttaaaacgttgacgaatattgtgaacttgcttggcagttttgctaaacggaatactggcaccatcacctattatgatcaagcgccaagtgaagcagtcttagctgccaacaatgtcattgcttttggcagtcccaaagccacgcgattggttcaaacgttaaaccccaagctttattttcgctacaatggtaattttacgcggctagtggccaacgaaaagctcagtattgaaagtgcttatggcaaaacgctaggtacggcgcaattgctgcgctcgccgtataatgctgccaaaaccatgctagttgtgactggagccacggctgacgccacctttttagggtcgacgcaaatggtaacccagccacaaattaaggcatatcgtggtgacttgattgcagtggatccggataatcagcattacgactatcgctttaaaaaacaagcgataaccagtaccggatcatccgttaccaaacagttgcttcagaaacggacgctggtcattttcttaacggttgctgcggtgatgctggtattgttgctggcagcactgattttcttgttacgaaagtatggcacacgggcacaggagaaggggataacgaatgaaaagcaaaaccgctgagcttggtctgcggaccgatttgaacttgctagcattcctgtttctgacagcagttactgcggtgttcatggcattgacatctgatcaggtcttgcttaacactgtctatcttggtatcagtatttttcttttattggcaacctacttttggggattgacggcggggctagtattgaatctactgttcatttttgcacagggcacatggatggtgtataccgaccttttagccggacacccagcaccgctagcgttgattttttggttgatcatgccggttttgttcagtgtctccttttacggtctggttcaaaaaacactgacgttgcaacatcggaatcaggagttgatcaatcgggttcagcaattcggcagttttgacgaacgaactcggttgcgaacgttggtggcttatcaacaagatggcgccgtctacatggatacttcccgccgttatcacttaccggttagcaccattgccttaaaattgcgctacgaaggtgagttgcgccggctaatgacaacagcgcagtttaatgagctgattcaaattgtttcacaggcgcttacagcttcaacgcggacgaatgacatggtttatttgattgatcggacccatccgacttgggctgtgttgctatacactgatcgcgcaggggccaccattgcggctaagcgtattcgcagccagtttgccaaatcgctggccgcgcaacccggtatgccggatgtggctgttacgttgcaactcggcattgccgatatgcgcgatgatgggatcaagacgccggcagatctgattcatcaagcagaaaaagcaacggaatatgatgtttgatctgtcattgatagcttatggatattaacgccggttataacagggagttttttgcctgcacttttttcacaagtattagttgtgaagaaggtgctttttttggtgggctcgagcctgtgcggttagcaatcggagtgtaagcggcctgccgaggtttggccactgcgcttaaggtctttaagcgcagattgctgggctgacgaacacgttataggaagtaagatcaaacttgcaaatcgtccagagtagaaagtcgtattctgtgttcacaactcataactgatataaataccctgtctttgcgtcacgactacgcattttcaaagtcatcattgaataacagttgtataaacccatttttcgataaaacattgcttgacacgcgtgagaatgagttacatactcatgttgttagctggctaacaatatgaggaggatggcttttgaattttgactttactgatcgcccggatgaacatcggcttgacctaatgcgcaaagtttatcccgatgttgacactcaatcagtcttgacttttctgaattttcgcacttgcttcagagcggttgccaatgactatcaacaggttctagatcaatttgggttgtcggaatcacgctttttgatcttaatgttcctgtaccatcaacaaccgcaagctttaagtattactgtcttagctgaaaagctcggggcaactaaagcaaccacgagtaaattagttcgaggcatggtcgcaagtggcttggttgagaagacgacgaccgcagctgataaacgcgcttctttaattcggatgacaacagaaggggcgacgttacttgaccggtttttaccggtgaattatcaaacggttaatcggctctttgccaacctaacccatgatgaacaaatacaactcaaccgattactcgataaattactgctcgggaccaagtaccccatataccctcagaaaggggcacatcatgatggaacaagctaaaattgattttttaagaacctacttaagtctttacattgatcacttcacagttcttcatgcgttacaggctggtgaccaaacatatgaagttctggatgttcgtaatgcaccgacgcaagccaaaaaggtacaaatcaaaggtgcccgcgccatgccggcaaaagatcttgtcactaaattggaccaactcgaccagcaaaaaacctatgtggtgtatgactggactagcggcactactttgggcaaacaagccttgttgatcttgctttcgcatgggtttaaggcatttgagttggcaggtgcgttggaaggatggcaagggatgaacctaccagttgaaccagcacattaagaatgactcagtggcaatattaacggcgtaacagtcatcggactttgttgcaccattgaatcaagtacggcaaggggaggtgtcactcattccttttgccgtatttttggatttcgaacaacataagaatgcaaaaatcggcatttcgattacaaatcagggtcattgtttctttgcagtatggttcgcatgaatttggcttggtgtattggctatcttgaaattaagccgaggacagtatgccatgttcggcccgaatccggtttcttttttaatgccaacaacggtacaattaagttgacattatatgataggagatggcactgtgaaaaatttccgatttcaaaacgccaccgatattcgctttggtaccggccggcttgatactgagttacatgatgccgtgagtcgctttggttcacgtgttcttttcgtttatggcggtcattccatcaaaaagtccggcttgtatgataccgttaaggggcttttagcagacttagacgttaccgaactggctggtattgagcccaaccctaaaattgcctcgattcgtgaaggtcaacagttggcaaagcaacacgatattgacgtggtgcttgcagttggcggcggttcggtgattgacgctgctaaagtcattgccagtgccaaattctatgacggtgacccgtgggacttggtgaaggatcgcgggataacgcggcacaagttgcagcaggtaccggttgttgatattttaacgttggcggcaacaggtagtgaaatgaacagcggctccgtgatttctaatccggcaacccatgaaaagttgggtaccactggcccgaatacccccgccatttcgtttcttgacccgagcttgacctatactgtcccagtacggcaaacggcggctggttcaatggacatccttagtcatttgatcgaacaatattttgatcgttcgaaaaataatgacgccagcaaagggatgatggaaggtctaatgcgtactgttattaagtgggcacctatcgccgttaaagagccgcataatccggatgcccgcgccaacttgatgtggagtgcgaccatggcattgaatggtcttgtgagcgtggccaacgaaaatggttggacggttcacagtttggagcatgagctatcagcctactatgacattacgcatggcgttggcctcggcattttaacaccgcgctggatggagtttattttgaccaaagatccgaccaccgcggaaatgtttgcgcgattcggacggcatgtttgggaccttgaaggagacgaaacatacgcggttgcccaagcagcaatcgacgcaacgtttgactggattcagcatttaggcttcccgatgaccttaccggaagtcggaattgccgatgaagcgcattttgacgcgatggcaacagcggctgtggccaatgccagtctggaaacccgcgcgtatgtgccattatctgaagaagacgtcaaagcgatttatcaagcgtccatgacgaatggcctgacagcttagttaagtcgctaattgagggataggattaaaaaggaggaattgattggtgacgcaacccattcttgaacatgattcggttgcttttcaggcggcgcgtaatgcggagaatcaactttggcttgattttcacttaaaaccgaaaacgcgatggcttaaaatcgcacccacggagtcagcagaagcaaatttgcgtgtccgcgtcttagaatttggtcacggggatccggtactcatgatccctggcaataccggcgatccgtatgaattagcgccattgttgccgcaattagctggttatcatctatttgtgctcgcactaccaggcagtgggttaagtgacggctttgattacgaacaggtcaaggtgcatgactttgcggttgaattgatcggccaagtcatggatcagcttgatttgaaaacagtgccgatcattgcccactcgctggccgcacactgggcaacctggtttgcactgccttatccggaacgagtggatcagctcattttgctaggcaatccgggccggatgctgatgaccagtacaccggcaccgttaaaaccggccttaaatccggtcttgagtcgctggtttatgaaacgccagatcccgaaatcagccaagcgcgcctggggaccgcttcatcgcatggggacagatccggccgccgtgagcgcactgccgcaaagctttgctgattgtgttcatgcgtttacacatttaccgcattatcaattaaccagcttgtcgttattacgcagcatgtatcggtcaaaagaatccaacgtcttgccggaacggtatttacggcagctaacggtacccatgagtttaatctggggaaccaacgacccatttgccaaccctgaattgggtcaggagatcgccgctgtcgtccagcatggtgaattaacaacgatcaacggtgcgggccatgaaccgtggatagatgacccggaaaaagtcggaaccattgtgcggctgaaactaaaagacagtgaactacgcgctgccgtcagccgccattagcggtaaaaagacttaaccgaacttaaatcgaaaaagcggctatcccaaggcggatggccgtttttatgtgagcgcgagccagcgcggttagaagtcggagtgtaagcggccttaagcgcgatggcccggtctttggccattgcgcttaaggtccttacacgcagacttctgcgctggggagcgcgttatagaaagtgagcaaaaacggcgcagttagaaatccacgtatcaggtagtgttttccaaacgactaccatcgttccaacaacacagcaccagatattatcatcttcaagttgaaaccgatttgccgtcatgatcagccaactgtcattcaccaaattagttgtgggtggctcgtcaatcgatcgttcgcagataaaatttaataaataaattttctgcatattttatcagtttatggcaacccttaaatcccttaacaatattatctgagaccgcattcattcaggaatatcaatattctcacaaatgaataatgacgaaaaaggtttgacaatcaaaacagttctgcatatgctttgaacatccaattaatctggttggacaaaaaccggcaaccagtgatgacggttcaacgcgaaaatatcgcacaactgcttttagacattttcgcgactgtcaccatctgaggccgcggttaaagaggaggcgaggctatgacaactttggatacctcaaccatccaaacgctaatcccaaatcgttacccgctcttttacattgatcgggtgaccgaattagtaccggatgaatcgattgtcgcagagaaatacgtgagcgtggcagaagatcatctggttgcgtatctacccggtgagttaaccatgccgccaacgctgattattgaaacgctagcgcaggcagcatcgattttgattctgaagtcaccgaagtttgccggcaaaactgcttatctggcaagtatcggcaaaacagaattccttaaacccgttccaactggcagtgtgctgacactggcagtcaagatgggtaaggttcgggcgaatatgggggtggtcacaacgaccgccagtatcggtgaagagcttgtctgccacgcagaattgcattttgtggtagaagcaaatgcttagtccacttgacaggctttttttttcaactgatactttgagtatcaaatcagttgtacacggaggcacaccaatgtcccaaaagccaagcgtcaagcggataaacgataagctcattcgcgtttattcggatattttacgaatggaagaagaggaactacgtaaaagtcagttccgggatttaggcattaaagaaatgcataccattgatgcgattggtattcatgcgacccctagctctagtgatgttgccaagaagctgcatgtgacccaaggcactttaagcttcgccattaacaatctggcgcgcaaaggctatgttgaacggttgcatctagagtcggataaacgggttgtgaacctgcgactcagccgcaagggacgactcatgtatcgggcgcatcttgcttttcaccaaaaaatggttgccagttttgttaagggatttaccgaaccgcaaatcgagctaatcgaacgcgcgctagataatctcaatgaatttattgacgaatatcgtcattagaaagaaggccccgtcttggagattctggccagtgcttactcggtgccagccacgcgcattgaaaacgagcagttacgagaatttatggacacatcggatgaatggatcagagaacgcacggggattcaaacccggcatgtggtcactgaccagcgtaactttgatttagcctatgatgtcgcccaacaattgttagaaaaatcgacggtcaccgccgatcagctcgatttcatcatcgtggcgaccatgagcccggactacgccaccccggccgaggctaatcgcctgcaagcagctttaaatgcgaatcacgcatttgcgtttaatctcaatgttgcttgcgccggttttgaatatgcgctgcatgtcgctgatcggctgatgaccagtcccaccgttcatcaaggactggtgatcgggagtgaagtcctttcccggttagttgattggcatgatcggcgcacagcagttttgttcgctgatggagctggcggcgttttggttagtgatcaaggcgccccggttcaagcagttgatttaaagagtttcggtgataccgagatggtgttgttggctggggagcaagcaaatcaaagcccctttgccgatgcacaagcgcaaccgtcgccatatttcaaaatgaatgggcgcgcggtttaccagtttgccattagcgaagtacctcgctcgatcaatcgggctttggaacaagctaatctgacaacagatgacattgactggtttttgcttcatcaagcgaatgcgcgcattgttcaatcagtgaataaaaagttgaaagtcgcggaagcaaaatttccgatcaatattgatgagtatggtaacaccagcgcagccagcgtcccgattctgttggcacagttggcagaaagcggtcagttaaaacgcggccagaaaatagtgcttagcggttttggcggcggcttgtctgttggctcacttatcatgacttactaactaacggttacaattgacagaccaatgaaacggtcaaaacttaacactcaaaggagaacatataaacatgactaacgaagaagtattgcctaaggtacaaagtattattgctgaccaattggacaagaagccggaagaagtaaccttgacgacgaacttcaagaacgatctggatgcagatagcttggatattttcgaaatcatcaacgaaatcgaagacgaattcgacgttaagatcgatactgacgaaagcattgaaacggtttcagatctggttacgtttatcactgaaaaggctgaagcttaagacactggagaggagtgggccaatgagtccattaatggaacgtttaggcgttaaatatccgctttttcaaggcggcatggcgtgggtcgctgacggcaaattagctgcgtcggtttctgaagctggcggtcttggtatcattggctccggtcatgcacctgcttcatgggttaaggaacagatcgaagttgcaaaatcaatgaccgacaaggcattcggtgtcaacgtgatgttactatcaccgtttgtcgaacaggtcattgatgtgattgtcgatgccaaagttgccttggtaacaaccggcgccggcgatcctagccgctatctggaacggctccagcaaaacggcaccgtggtcatgccggttgtgccgtcagttgcgatggctaagcgcatggctcgtgacggcgttgatggtgtgatcgctgaaggcatggaatccggtggtcatatcggtagtatcaccacgatggccctagtgccgcaagtggttgatgccgttgatattccggtcgttgcagctggcggtattggcgatggtcgcggtgttgcggctgcgcttagtttaggtgcagttggtgtccaaatggggacccgctttttaacctcaacctcaagccgcattcatcaaaactacaaagacgctgtgattaaagcaaaagacgttgatacccttgttaccggtatgtatgtcggtcatgcagcccgcgtcttgaagaacccgatgagccgcaattatctcaaactggaaaaagaaattgcgctttctggcaccactgattttacagcggtggaagaattaggtaatggtagtttgcgtaaagccgttctagaaggcgatcgcgaccatggatcctttatggcaggcgaaattgccggattagtgaaacgcgaagaaagcagcaaggatattgttgaagaagtcatgcagcaggcaaaagaaattgtcgccggctcgaaaatggcggctttgctcactagtcaggttgacgtgcaagcgtaacccaaacgcaggcaaggaggtaccactttttgcaatttgcttatgtgtttaacggccaaggtgccgaggtccccggaatggggattgatttttaccagaatactttgatattcaaagagattattgatcgtgccgatgccgttttggactttgacttgccagagtttttggctaacggtgattttgcggcccatccggattacctacagccggccttagttgcttatagtgtggccatgcatgaggttgcctcagcagagttgccgccggaagctgctttagccggcttgagtctgggcgaatatagcgcattaatcgcaggtggcgggttgagcttagaatcaggacttgagctcgttgcagcccgtggtaaagcgatggccgccgcgtgtcaagaacaaccaggcggcatgctggcggtgatgagcggcgatgagtccatcatcaaaacagcttgtcagcaggcagaacatgtttggccagctaattacaatggtccgaagcaaacggttttggcagggacacatgatgacttggcaacggttgaaaagtggctgacagaccaaggtgtccgcgccattcctttgcaagttgccgggggctttcatagtccgttaatggcaagtgcacaaccaccattacaagcagcactggcagcggctcatgtctttgaaccagtgattccggtcattagtacgacggcacttaagccattttcggctagcaacatccgaccggtattagcggcgcaagtagccgaaccgacgaagtttgctaccgtgatcgcacaactgaaagcacaaggcgttgatacgattgttgaattaggtccgaaaccggtgcttagtaaaatgattaaacgcattgaccgcaagatgacaacctacctgattcgtgatgcagcaagtctcaatgaggtagccgatttgaataacggagtgaaggcagattgaaactaactgataaaaccgcgatcatcaccggtgcctcacgaggtatcggtgaagcgattgccagaaattttgctcaagcaggggccaacttggtcttgaatgcgcggcatgaatttccggaaactttgatcaaagaattagaagactatggccacggtgttgtgaccgtgctgggcagtgtggatgatcccacaaccggtgatcaattggtcgccgctgccttggaccagtttggcagcgtggatgtgttggttaataatgccggcattaccgacgatatgttggcgatgcgcatgaaacccgattcttttgccaaggtcgttcaggttaacttggatggaaccttttatgttacccaaccggccttcaagaaaatgctaaaggcgcgcgctggcgtcatcatcaatctggccagtgtggtcggtttgaccggtaatatcggccaagccaattatgcggcaagtaaagcaggcatcatcgggctaactaagacgctggctcgtgaaggggctatgcgtggcgtgcgcgttaatgccattgccccagggatgatcgccaccgatatgaccgccgctttgagccaatccagtcaggaccagattctagcggagattccgttgaagcggttcggacaacctgaagaaattgcccacacggcccgttttctggtcgaaaatgcctacataaccggtcagacagtgactgtcgccggcggattaggttaagtacatgaacggaggaatgacattgcaacgagtagtcgtaaccggaatgggtactgtgaatccgctgggccattcagtcgccgaaactgtggcgacgatggacgctggcaaggtcggcatccagccaatcaccaagtttgatgctgaaaaaaccggaatcacagtcgctggtgaagtcaaagatttcaaacccgaagaacggatgagcaaacgcctaagtaaacggatggatctgtttacccaatatggtctctatagcgccattgaagcatatgaacaatccggtctaactgaagatgcggtcgattcagatcgagtgggcgttattttcggttccgggattggtggtttgacaaccattcaggaacaagtgacgaagatgtatgtaaaaggcccggatcgcgtgagtccgctgttcgtgccggaagccatcagtaacatggttgcagggacaatttcccattactttggtacgcatggtcccagctatgttgtcgtaacggcatgtgcttcagctacgaatgcgattggcgaagcagcgatgcggattcaagccggtaaagccgatgttgtgattacaggcggcgccgaagcttcagttaacgaaatcggaattgccggttttgctgcgctttccgcattgtccaaaaataccgatccaaccaaggccagcctgccatttgcggctgaccggaatggtttcgttttgggcgaaggcggcggtgcattgattctcgaaagcctagagcatgcacaaaaacgcggcgccaagattttaggtgaagtggttggctatggtgctaccagtgatgcctatcatatgacggcgcctgatccaagtggctctcaggcggcacgtgcgatgcagttggccgttgaagaagccggcattaagccaagtgaagtcggctacattaatgcccatgggacagcaaccaaagccaatgacgcgatggaaagtaaagccatccatgatcttttcggcgacgatgtgttggttagctcaaccaaggcactgacaggacatctgctaggtgctgctggggccatcgaagcgatcatgacgctaagtgccttacaaagcggccggttgccaatgaatgtggtggatgcggctcaagacgaggattgcccggtcacgctggttaatcgcgacaatcgtgatacatcagtcgattatgcattgagtaactcctttggctttggcggtcataatgccgttttggccttcaaaaggtggtgagtgtcatggacaccaaaatgatcgaagttttgatcaaacagttggagcaaagttcgctgcacgagctggaactgacacttggtaacgactcgctacatttggtcaaagcaagccctgctgccgcgtctgcacctgtgaccccggctccggaaaatacggcagcgacacctgtcacgccggtaccggacaagccacaagcggatgaaggcacagcggtcaaagcgccactggtcggaatcgtttatctggctcctaaaccaggcgctgatccgtactttcaagtcggcgatcacgtaaaaaaaggtgacgttgtctgcatcatcgaatccatgaaaatgatgaatgagattaaaagtactgttagcggcacggttaaggcggttaaagtcgataacgaaagcttagttgaatacgaccagccgttgctcatcgtacaagaagacaaagcgtaaaccgagtcgcattccggctccataaacacgttttaggaggatagcattcatgctcgaaaccaaaaagacacttgaagcacaagaaattcaggcgattttgccacatcggtatcccatgttgatgattgaccgggtactggatctcaaacccggcgaatctgtggttgcacaaaagaacgtttctatcaatgaacagatttttcaagggcattttcccggtaacccgattttcccgggcgttttgcagatcgaagcgatggcgcaagcaggggcaattgctttgctttcgatgccggactttaaaggtaaaacagcttatctcggcggcattaagaaagccaagttccgtcacatggtacgccccggcgatgttttgcgcatcgaagtcactttagagaaattgatcgacaatgccggcttaggaaaaggcaaggtttacgtcggcgaagatatggcttgcagtgccgaacttgtctttgcaattggctaaatcgacccgattcagactcgtgtaaggaagtggaactgtgttcaaaaaagtactcgttgccaaccgtggcgagattgcggtccgcatcattcaaacgttgcgggaaatgggcatcacctcggtggcggtgttttcgaacgccgatcgccacagcctacatgtcttgctggcggatgaagcgatttgtatcggtggtccgcgggcaaccgattcttatctgaatatgcgcaatgtcgtgagtgccgccattttaagcggtgcggaggcggtgcacccgggttttggtttcttgtccgaaaatgccgaatttgccaagttggtgactgatgccgggttagccttcatcgggcccaagccgactgccattgagcaaatgggtgataaagccgttgcccgtcaaacgatgattgatattggtgtgccggtgatccctggcagccggccgcttcaggatgtcgatacagcattggcggctgcacaggcgattggctatccgctgatgcttaaagccagtgctggcggtggcggtaaaggtattcgtaaattggcgactgccgatgacctgacagccgaatttgccggggcgcaggcagaagcccaagccgcattcggtgatcccacgatgtacctggaaaaggtgattgtcccggctaagcacgttgaggttcaggtgttgcgcgatcagcaaggacacgtgagcgtttttcccgagcgtgattgcagcctgcaacgtcacagtcagaaaatgatcgaagaaagtccctgcccggtgttaacgtcaccggagcgggctaagctgttgcatttagccgaaacaattgctgacggcgttgattacctcaatgccggaacgattgaattcctaatggatcagcagcatcatttttatttcatggagatgaatacgcggattcaggttgaacatccgatcacggaaatggtgaccggcgtggatttggttcaggcacaattgcgcattgcggcaggcgaagacgtggaactgaccacgccggaaccatccggcgttgccattgaatgccgactcaatgccgaagatccggatcatcagtttatgcccgatgtcgggacgctggaacaattacgctttccgactggcggactgggtttgcgcgtcgataccggcgtggcgccaggcgataaaatcagcccgtactatgatgcgatgattgccaagattatcgttcatggccaaacgcgtcagtcggccttggctaaaatgcaccgagccctgacagagttagacgttcaaggggtcaaaaccaaccgcgactttgcactggcacttttccaggcacccaaggtattggctggagaagctgatacggcttatctcaaccgtgactttttgccacaatggcaggatgaaaggaaggatgctgcatgttccaaccacaactaacccaagaagcacttgctcgtgaggcggctttgcctgaaaacttatggattcaatgtccatactgcaagcaaggcagttatcgtgaaagtctcggcgatgctcaggtttgtccgcattgccattatggattccgcatcacggccaaaaaacggttagcactggtagcgacagatgcaacggaatgggatgcggatttaaccacgaccgacccgctggattttccgggttatgagaagaaactagccgcgggacatcaggcgtctggtttaaaagacagcgtttggaccggtcaggcgaaaatcggcggacaggtatgcggtctcggtattatggatcctaagtttatgatgggttcactcggaaccgtgactggtgaacggatcacacgtttgtttgaaaaagcaaccgaagcaaatctgccagtcgttctatactgcgcaagcgggggtgcacggatgcaagaaggcattcattcactgatgcaaatggctaaggtcagtgcggctgtgaagaatcacagcaatgccggcttattgttcatcagcgtgctcaccgatccaaccatgggcggcgtcacagccagctttgccatgcaaggcgatatcacactagcagaaccccacagcctcatcggattcgccggccgccgcgtcatcgaacaaaccatcaaccaaaagctcccgcaaaacttccaacgcgccgaaaccgtcctccaaagcggcttcatcgacgccatcgtgaagagaagcgaacaagcggattatatcggggaactgttacaaatgcacagagcgtgaacaggcccgcttagaaaccggagcgtaagtggccctgagccctaaatggccggtctttggccatttaggctcagggtcctcacgtgcaggtttctgggcctgtgaacgcgtttcagcatcggagaatgtccccaaccgaaacaaaagtgactttcccgagccagccggtctttggccatttaggctagaggcccatacacgcagatttctgtaactgtgaacgcatttcagcatcggaaaacatccccaccagcaccaacacgaagcaaggaggtaccctggcatgcccaaaaaagaaacatccgcctacgccaccgttcaagcggcgcgcgccccacgtccctataccacccgcgaactcatcaacggcttagtcaccaattttcatgaattacatggtgatcggtccagtcatgatgatccggctgtcattggcggcatcggttggttggatgaccaagcggtaactgtgattgcgaccgataaaggcaatgacttgacagaacggttgcagacccattttggcagtccggagccttggggttatcgcaaggcgttgcggcttatgaaacaggcggcgaagtttcatcgtccgattgtcacgctgattaatacccctggtgcctatccaggtaaagaagcagaggcaaatgggcaaggggcagcgattgcagacttgctcgtcacgtgcgccgatttgccaacgccgattttagcgatattggttggcgaaggcggatcaggcggggcactggcgctggcgtttggtgatgaagtctggatgacagataaaagcatgtacagcatcttgtcaccagaaggctttgcggcgattttgtggaaagattccagccgcgccaaagaagcggctgaagtcatgcaactgaccccgcgggatttgttggctaaaaaagtctgtgatcggataattacggataccggtaccgacttccccagcgcactcaaagccgaggttaagccaaagttggcgacccttatggcattggatccgcagacactggttacccagcgtcaagcccgcttccgaaaattttaatgaaagcggcaacacaccgtccatttcattggcggtgttttttctttggtcaaaaagctttataattacggttgtaacttttcaaaacggaggtcatcatgctcgaaaaaaagttttatcataccatgttcagtcactctttcaatattccggtccgtgttgagtattgggaccacacggaagaaacatatggaacaggcgagccgacgatcacgattaaaatgaaaaaagcgatcccagtgcgtttgctgctaaagaatgcttcgcttgcattaggtgaggcctacatgcgtggtgacattgaggttcttggtggtaagcggccgttgcagcaattaattgcggcggcctatgccaacgcggacagttttatgcgtaacaacaaactcatgcgcgtgttgcctaagcaaagccacaccgagcgcaagtccaagcaggatattcattcacactatgacttgggtaatgacttttacaagctatggctggatccaacgctgacgtattcctgtgcttattttgagaactgggatgacgatctggaaacggcacaattaaataaaatcgatcacattttacgcaaactgaatccgcagccgggtcggacgttattggatatcggctgtgggtgggggacgcttatgttacgggcggccaagacctaccatttgcatgtggttggtatcaccttaagtaaggaacagtttaagctggtttctgaccggattgaagcggaacacctgaatgacgtggcggaaattctatatatggattaccgcgaattagatcgcgaaccgtttgactacattacctctgtcggtatgtttgaacatgtcggtaaggaaaatctagaagagtactttaaagatgttgccaagctgctaaaagatgatggtgtggcgttgattcatgggattacacggcagcaaggcggggccgtgaatgcctggattaataagtacattttcccggatggctatgtgcctgggatggcggaaaatctgacccatattattgatgccggtatgcagttggacgacttggagccattacgccgccattatcagcggacgcttgaaatttgggatacgaatttcaataatcaccgtaatccgattcagcaaaagttcggttatgaatttacgcgcatgtgggatgtttacctgcaagccgccgctgcgagttttgaggccggtaacattgatgtcatgcagtatctgattagtaagggtccgtctggtaaggacttgccagctacccgtgattatatgtacgaatagtgccggaaatttagttaacggtttatgacacgacagctttgaaaaggtaccttcaggggtgcttttcttttatggaggagtattcaacttgacgaatatattagtgatcggagcgaccggcaatattggactgccgctgattcaagctttaaccaaacgtgcagacgtgcaactttttgctgctgtacattcgccggctcatgcgcgtgcaactttacgggacttgccggttcaattacgcaaatttgattttcttgacgccgcaacttttgacccggcattggcggccattgacaaggtcttcttcgtgcgcccgccgcaattagcaaaacccaaaacggacatgtatccatttcttgatgccttggtgcgccatgggattaagcaggtggttttcgtctcgttactgggcgttgaacacaatccaatgaccccgcatcataagattgaaaaacgcattgaagcacttgggttgccatacacatttattcggccaagctttttcatgcaaaatctcaataccacgcatcgccatgacattgtggcccaccatgatctatttgtgccggctggacgcgctcggacgagtttcattgatacgcgcgacatcggtgccgtggcagcaactgtcctgtgtgatccgcaatatattggccaaaagctggcgatcaccggcgatcaggcgctcacgtatgccgaggtcgctaaaatcatgacggcagtgttaggcgtccagataacgtatagtcggccaagtctactgcgttttcgccacaccatgattgcgcgcggcttgccgaagaattatgtgaatgtgatggtcatgctgtatctgatcacgcaaatggggaatgccaaagaagtgaccacaacgttgccaaaagtgcttgggcgaccggcaatcacgttttcgcaatatgtccacgattatcggcgcgactttttaccggaaaagtaatcttggctgccaaacgcaaggtcatgagacacggcggaaaaccttgttaacacaaagagcgatttgccgtcacagaatgttcaaagttcgtcggtagtattaacaacatagaaatgagccacccactcattcctaaaccccaacccaactttttcatttctactcctccaaaataatgattgccaattggtaccctccgattggtaaaactgagacccgcagctgatggccgcgggttttgtgttggattttaagctgaataaagttggacagctcacttttaaactgggcgaatttaaaaagcggtgcggttcatggtgatttttaatcgtacccgtggcataatgggtcgttcgtgcgtaatcaatgattaagcagcccggatcatcggattgtttgcgcttccattgacaatgccgcgaactcagataagataagggtattatttcaaacacaaggtggtaagtacatgacggactcaattgagaatatggctaagcggtatcagccttattcgacgtggacaccagagtatgtggcgagcttgaaagctgaggttgctgcaagtcagtggcgaactaagacgcatattcaaccggacacgggcttgatcaatgatccctgcagtctgaatttctttaatggcaagtggcacctatattaccagcagtttccatttggtccggttcatggtttaaagtcgtgggcgcatgtcgtatccaaagacttatttaactggcggcgggtcccgggtgatttattgccggataacgaacttgatgcgcaaggtgcttacaccggttcggcattagtgacgcatggtacgttgcgaatcatgtacaccggtaatgtgcgggatgagcagtggcatcgacagtccacgcaattaggggcggttctgggcgcagatagtcgtttatataaagatccgaagccattgattgctaatccgcctgctggctacacccaagagttccgggatccatttctatttaattatcaagataaaacctatgtcttaatcggtggtcagcgggccgatcacaccggcgccatcctactatatgaaaagcagccggataagacctggcgctttgtggccccgttaagtatcccggacgagttttgcggttacatggtggaatgtccaaacattgcctttattaatggcaaagtcgtcttagtgtactgcccacaaggcttggatcaagactttttcgaatacgaaaatgtttatcctaatattgcacttgtggccgacagctttgatccggagactggcacactgacccatcagcgcctgcaaaatatcgataaagggtttgacttttacgcaacccggcttgccaataccgaaaaagatggcactttagcaatttcctggctaggcttacccgacacgaattacccaacggatgcagacgggtgggaaggcgtcttgagttacgtgcgccagctggatttacgcgatggtcatgtttgcctaaagccgcatcccaacatagaacagcttcgggaaactgctgctgaggccttaccagttgtcagccacaatacggatcaatggtcagtcaaagcgttgagcggtgcgttcgaactgagcatgacgttagctgccggccaaaaagccaccgtccatgttccggatggcgatcacgatcaactgttgatcaatcttgactcagatagtggacaagggatggttcagcgcgagaaccgtaataatggcggcagcttgcgtcaatttggtttcccagcaggcaaaacggtcacgattcggttatttgtggacgtctccgttttcgagttattcattgacggtggttatcgggtggtttccgggcgcttctttggagacacatgccccactgccgcacgtgtgaatccacctgctgcggttagcaacgtgcaggcgtggaatctgcggaaggataatggcgggctataggcggcttttgaaactgaatgaagcgatgttagtagaaagcacatctgatatcaaccatgtcgccaccatttaaacaacttatttgcgccaataaataaaaaagcatcagccaaatgtcattcgtgcagacattggctgatgcttttttgccaatcaactgcagtcatctgtgcaccgaggcatttcatttgcagaagtaatcgaattttttcaactgtgccttgacaatttttgaaagcgctgtatactcacagtatgaaatcgattccataaacaggaggtgcgccattcatggcaacgattagcgaaattgctgcggcagccggcgtgggtgtgacgacggtatcgcggtacttgaatcatcatccgtatatttccgctgataagaaggcgcggatcgaagctgcgatcaagacgctgggttatacgcctagcgcagccgctacctccttgcgcgcccaggcaaccggaaatattggcgttttggtctcgcgagtcacgaacccgttttttgccggtttgtttgatgccattgagcgaacactgcacgcccacggttaccaagtcatgatttcgcaaacttacgatgatccggatgccgaggggcggtttttgaaccagctgaaaagtcgcgaactcgatggtgtcatcttagcgtcagttgaagcaccggcgcgggtggcggcagtggctaaagcctttcctgggcgagtggtcgtggtcaatgcggatgtgcagattcccaatgctaagtccttggtgttaccgcactatcaggcaacccgcgatgcattggattacctatttgcgcaaggtcatcggcattttgcttatatgaccggtggcgcgatcaaaagtgcccgccacggtcaaagtcgaacccaagctttctttgattttatgcaagcgcgcgggttgccagtcgaacctgcctggctgtttgagcaggtgcattctgcaacagaaggccaaacgctcggacgccaaatcgccgcgctggctccggcaaagcgtccggatgctatttttacgaactcagatgaagtggcagttggcgtcgtggacagtttagtcgccgctaacattgccgttccagatgacatggcggtgatgggttatgacgaccagccatttgcaccgtttgcccgcgtgccgctgacgaccgtccatcagcctgttgccgaaatggcgcaggtggcaacggacttactattagccggacttggccgcggtgaaccggctgcgaccttagaaccgttaaccttgacgttaaaaatcaggcaaagcgcctgagttttatttttggcaaatatggaatcgataccacatttcagaaaagggagttacgcatgcttaacgaaaccagccgcacatggtggcaacaagaaattttctatcaaatttatccggcatcctttaaagatagcaacaatgacggcattggcgacttgccagggattaccagtgagttgccgaagctcaaggccttaggagtgacggcgatttggttgtcaccggtttatcgaagcccgatggtggataatggctatgacatctccgactatcaggcaattgacccgcgctttggcaccatggctgattttgacgcgttgatggccgctgctaaagaactagggattaaagtggtgatggatctggtggtgaaccacacttcggatcagcatccgtggtttcaagccgcgttgaaagatccgacttcaccctatcgccagtattatattttccgcaaaggtcatgacggacagccgccgaataactggcgctctaatttcggtgctggctcggcgtggacggcggttcccggtgaagccgacatgtattacctgcacgtcttttccccgcagcagccggatttgaactgggagaatcccaagctgcggcaggcgatttaccagatgattaactggtggttggcaaaaggcttggcgggcttccgggttgatgcgatcactttcatcaaaaaggatcaggattttgcagcgattacgccagatggcaacgatggtctaggaaaagtgaagcggaaggcagagaatcggcccggcctggcgcgcttccttaaagaactgaacgctgctacctttaaacctgccaatgccgtaacaatcggtgaggcttccggggttgcctatgatgaactaggcgacttcatcggtccaaacggctacttttccatgatctttgatttccattatgccgatattgatgtagcttccggttcggagtggttcaagcagacgcagtggacgccgaaaatgctgggcgatgcgattgcaaaaagtcagctggccattcaacgcgtcggctggggggctaattttcttgaaaatcacgatcagccgcggagtttgagtaagtacattcgcgaaccggcgtaccgcaatgccaccggcgccaaagcattggcattattgtatttctgcttgcgcgggtgcccgtttatctatcaaggtcaggagttgggaatggtaaatgcggttcgcagcagcattgatcaatttaacgatttgtcggcgcatgataattatcggcgggcgttagcggaaggttattcggaagcggacgccttggcatgtgtcaatcgccgctcgcgtgataatgcccgcacaccgtatccctggaacgacgaggcaaacggcgggttcagcgatcaccagccgtggctaccggtggcccaacaagcacccggcgtcaactggcaggatgaacaggccgatcccgactcggtctggcacttttaccaaaagctgtgccagttgcgtaatgattcgccgttgcggtcggatctgattgacggtgattttgcgccgcttacggtggcagacgaacacgtcatcgcgtacgcccgcgggaaacatttgcggatctatgtcaatctcagtgctacaccggcgactatcgacttaccggatggccaaatctggctgaacaattatccggatgcagcaccaacgttgaaaccctaccaagcgattctcattgaggtgaattaagatggcaaaaaattatgaacaagaagcaaaagcaattttgaagttggttggcgtcaataatgttgattccgtgacccattgccaaacccggctgcgttttgttgtgaaggatcgcaaggcgattgacgataaggcgttggagcagctgccagaagtcaaaggtgttttctatggttccggtcagtatcaggtgattattggtaccggcgttgtcaatgatgtgtacgcggcaattgccaagctggggaccgtgaatgcgatttatggcaaggacgatgcggacaccaccgcagcggcaggcgacgaacataagacttgggtgcagcgcttaatggccatgctgtccggcattttcattccgatcatccccgtcattgcggctaccggactgttcttaggattgaaaagtgcggcgaccaacgctcaggtgttaaagctttttggcgctgtgcctagtgacattcccgccagtctcacctcggtcatttcagtgctgaccgacaccgtgtttgcctttttgccggcgttgattgtgtggtcgacatttcgctactttaaagggacgccgattatcggcattgtgattggcctcatgttagtttcgccgattttgcctaatgcctactcagttgcagacggcagtgccaaggcaatcatgctgttcggctggttgccagtggttggcagtcagggttcagtattaacggctttggtcgctgggtttatcggcgccaaactggagctgttcttccgccgtcacatgccgaatgttttggagcaaatcctgacgccatttctaacgatgctagtcacgtttgccattatgattttaggcgtcggcccgcttgtccatgcgattgaaaatggaatgctagttggcgtgcaggcggtgattcacttaccatttggcattggcggctttctgatcggggcagcttatccgctgatggtgctcatcgggatccatcaaaccatgattgccatcgaaacttcgctgctggcgtccaccggcttgaatccgttgattacgttagaagcgatgtatggctttgcaaacttaggtgtggcgttggcaattttcctccgcgcgcgttccggtaaagctaaggcaacttcaatgggggcattcacctcacaactctttggggtttcagagccaactttatttggggttttgattcgctataattttcggccattgattgtcaccgtgttaacttccggacttggcgcggcggtcttgagcattctcaatgtttccgccaactcttatgggcttgccgtggttccgtcatatctaatgtatatttacaacggccacgccttgctgtggtacaccatcgtttcactggggacgattgtcgttgcgtttgttgccaccaacgcttttgccattcctaaagaagtcttggcgcccgatcgtgatgtggagacggcaaatgcggtgatttcgtcaaccgtgagtgacaacaaggtctatgcaccggtcagcggcgaaacgcttgctttgaataaggtaagcgatccggtatttgcttccggcatgatgggcgacggcttagcgattaagccagaaaatgccggcgtcaacaaaatctacgcgccacaatccggcaccttatcggttgttgccgacacgggtcatgcatacggcttgaccagcgatgacggtatggaaattctggtgcacttagggattgataccgttaatttacacggtgcgccgttcacggttgccgtcaaggccggtcaacacgtcaaaaaaggcgacttgctgggaaccatggatcgcgcagccattgaaaaggctggccttgatccgacaacgatggtgctaatcaccaacagcaaagcctacgcccggatcgaaccggttgccgacaccacggttgaagccggcgccgatctgttggcagtgcagcgtgaagacgttaaagtcgaatcggtttcaccggcgtccttgtaaaagatgctgaaataagccttaatcctatcgccctagttattgtgactggggatgggattaaggcttttttgatcccgttagtttaggagtgccgaaaaaacgtgaaagcgtgtaggatgaaggacgtacaaatccaaagcttcatcccgacactttctgctttttgtccaattgcgtgaccaaacacctgtgatataatcagaaaatatctcaatctaggactcggaggacgttatgcgtaacattggcaaattagtggcgctggactggaaacgaattttcaaaagtcctttagccttcttactcatcgcagcgctggtcgtcattcccagcctttactgctggttcaatgtctgggcgctgtgggatccttacagcaacacgcaggatttaaaagtagccgtgtattcggcggatcaacccgccacttttcgcaaccagaaagtggcagtcggcgatgagctgacggatcaactgaaagataataaacaactcggctggcgctttgtcgactccaaacaagccgtccaaaaaggcgttagaagcggtaagtactacgccggggtggtggtgccaaagcatttttcaaaagacttgctgagcttcgttgatggcaaaattcacaaaccgaaactcgattattacgtcaacgaaaaaatcaacgcggtggcgcctaaaatcaccagcaccggcgcgaccacgctgcaaaacaaaatttcggatgaatttatctcaacggcagccaagacattggtgaaagccttcaataaagcgggcatcaagctagatcaaaacctgccgatgattcgccgcttcaccagcttggttaccaatacaaacgatcagctgccaacgatcgaaaagtatttggcggaagtcgaccagttacaggctaaaatgccagcgattcgcgctaaactgcaaaccgctaacgaaatggcagggtatctgcccgagatcaatcaaatggctcaaaagctgacgggggcaaatggctatctgcccatggtccaagatgccggtgagctcgccacgaatgttaagggcaagctacccgaagttcggcaggcaggggcccagctgaatacggtggtcaccaatttcgatcagctcgaatccggtgtcaccaaagcggttcaggtaacggatcaaggcatcacggtggttaaccaagtcgatggcacgctgccggctttaactgattttggcaaaaatgcccaagcggcggtggcaacgaccaaagatgacgtgattcccaaaatcaatacggccttgggtgtggtgcaaaatgcaaccgacgccggcttaacactgattgcggctgccaacaccagcttgagcgctgacttaacaacgttgcaacaacaactgcaacaattagacagcagcaaagacaccgcggcactgaagcaagcgatggcgcaacggctgacagcattggccaatcgtcaaggtaaggttgccgccaatgccaccagcttggcagacacgttgacccgggtgcagacaactcttaatcagttaaccggcaaggatgatcatgtgcttgacggggccattgctaagctcaaagaagttgccgcgacagccactgcggttcaacgcgacgccgaagctttggctaaggatgtacctaacctaagtacgagtgaattgcagcagcggctcggcgttttagcaaacaccgccaatcaattcgccgacgcggccaatacgctcaaagccctcgatctcggcaccagcgtcaagcaggttttgaatgattttaaggcggctctcaacgatgccaacaccacgctggatacgattaaccagcagatcctgccatccataccgtcactgctcagcggcacgaaggatctgttgacgcaggctcacaactttttggtcaaagcgaaaaagcagctgccggcactcaaacaggaacttaccgatgccaacacgctgcttaacggtcacatggatctcatcaccagcggcatcacaaccgtcgcggacttgtaccaaaatgatttccccagcctcaaaaccaagctgacaaaagccaccgacttcatcaatcaagatctccctggcgtcgaatccgacctcaccaacaccttggccttggcgaacgaaaaaatgccgcaactccaaagcggtttggatgacgcccagaaattcgtgaaagacgactggccgacgctaaaagaagcaattcaaaaaggcgccgcggccattaaaaaaggcgaaaagtccgtcgatttatcccagttaatcaaactgttacgccgcgacgccaccaaagaggctggcttcttagccaaaccggttgaactcaaacaacaaagcttctatcacattccgacatacggttcgcaaagtgcgccattttacctggcactctgtatctgggtcggggcactgctgctgggcgcaatcctgattaccgagtatcgactgccgccaacgctcagcgacgccaccgtcaaacaaatgtacacggcgcgttggctgacgtttgccgtcctggggatgctgcaaggtctcatcgctgcactcggcaacttattcttgatcggcacgtacgtcgtcaacaagccgctttacctgctatttgccatgatgctcagtctggtcttcgtctccattctctacgctttaatctcgctattcggcaatatcggcaaaggcatcggcatcatcatcttagtcctttccatctccggtgcaggcgggaacttccctgtcgtcttatccggcaagttcttccagatgatcaacccatggctgccatttacctacgccgtcaacctcctgcgtgaaacagtcggcggcatctactggccaaatctctgggtcgatgtcgcggcactcctcgcattcggcatcatcttcttcctgctaggactctttctgaaagcgccaattcacccgtggattgagcggatgaatgagaagacgcgcgagtcgaaaatcatcgagtagttcgtgcgggtggcaaaagtaaagattgttcaattgaaacaggcaatgttgctggtgatcagccagtagcattgtctgtttgcgtgtggaaaaagatattgaagggcgcagtgttcaaaaatagacaggcagtaggcgcgggcatggcagcaagagcgctatactttgatattgattggtgtgaagttaggttcatgaaagggctggcgatcgatcgaagggaaaccacgcgtgcagcagcgatgagccctacacgctgatgatgttcagatttaaggggacaagcaacacatagcgttcagatttttaggcaaaaaaagtgacgcccctttgtgagtacgccacttttcgattcagtcgctgattattctgctttttccttcttcgtggtcaccgtcacaacgaaggtagactcatctttttgatacaggcgatgaatgttctgtagtagcaacatgatccacgacatggcgagggcaaaggcaatcatctcaaacgccgtcagcgaaaggtagtggacaaattggaacaagatcgcggcgaaaatgatgatgccgccgatgatgtaactggtgctgagaaattcgcgtgagacccccggcagcagccaacgcacggcgataatcatcccgatgaggaaataattcagaaaccacgcgctttgagtgtgaaggacatgccagatgccgcggttattcggaaacagcccaacgcccagtaacgctacggccgccacggttaacataatccgcatcgtaatcagtcgccaatccgttttccgatgcgccatcaacggcacaaacaaatagtccaccagcgcaatccacagcaacgccgacaccgcaatcgtcaagttaaactgccacgcattcagcgccttgctcgtgcccaagaagctgacattatgctgccaccactgccgcgaactgttcgtcacaatcgccccgacaacgccaccaacgaatgtcgacaaaaacaaagtcgtaatgaaagacgtcgaaatcgacaatgccgaataaatcattaggtagttcacaatactgataaacagcaaaaacaaccccgtcgccgtataaatatcaaaactgacaccttcaaacatgtagccaatcgcccaaaagaacaccgacgccacaaacgctagaataatcgcaaacgccagcaacagcgtcggaaaaatccgccaataccgccgccgatgatcacggccatgaatccgccgatgattctgaacatacgttaccgcaaacgtccccatgccacttaattcacccagcacaatcaccatctgcgcaatcgaattcttccccgtcatcggcacctgcaaaatctgaaaataaataaagtaagccagaaaaaacagccccgccaaaaccgttggaatcaggaaaaatcgcaacgaaatcgtctgcgtccccgtatccgtccgcttcggccgaatcactgcctctttatccttcaacgtcacctcaacctgctcgccatctttaatatcaagatcttccataatggcatccggaatgacgacttgatgtgcttctttagtcaatttcttctacacgctccaacttgtttgatgtgttttgttcagaaacttactgtagcacattttggggtggggtgtgatggggagatgtcggcgggatgacagggtatgtgatttttttgaaggatggccagtcagcgtttagttgactcgaccatcttttttctgtttgagctgttagttaaattacttgttgtgctaggtgacgtcaacgaagattatgctgaaatcgttttgattgttgcacgaaagcgacattatgacagataatagatgaagataatattaacgctggaatgaagcgataaaggtttgctagttgtgtactgttaataaagtatgcagctgtggaggaagacatggggatagaaagaaacgagcttgcgtttgaaagtaagctcattgatcatttgcagcatattggcggaactaagcagtggcagtatttaccagatataaaagatggagaagatctgtggcagaatttcaaagtaattcttgagcggaataacgctgaccagttacaaaagccgctgtcggttgcagaatttaatcaggtccaggctaaaattagaaacttacgctctccgtatgaagcaggacaatttctatacggtctaaacgggacttcgcagattgaagttgatcgcgatgatggtaaacacgttttcttaaccgtctttgatcaagctgaagttggcgctggtaatacggtttatcaaattgttaatcagattcggcgcccacctgttcaagcaggtcgaccagctcgccggtttgacgttacccttttgattaacggtttaccgattattcagattgaagaaaaggctgacagtcatgaccccaaagaagccttaaatcaaatgcatcagtatatccatgaacgacagtacacggatatctttagtacgctccagatattggtctccatgacgccgcatgatattcggtacatggccaacacaacagatgatatgtttaaccttgattttgcctttcgttggcagagagagtctgataataggccaattcgtgattggcgcgagttttccaatcttatgttgtctattccgatggcacaccagatggcgactaattatattatcctcgatggcactaaaaatcggaaaatgatcaaggttatgcgtccatatcaggtctatgccaccattcgcgttattaacaaaatcagacggcaacaattcggacttgatcctaaggaagtcggctatatttggcataccactggatcgggaaagacaataagttcatttaaggcggcgtggctcgcttcacgtctaccaaatgttgacaaggttgtctttttggttgatcgaattgcattgaccaaccagactgtcgacgaatatcgtgcctatgatcctgatagcgatcccgatggcaaaaatggggtcgtagcagatacggccaataagaccgttttgaagcaaaaattgaagacaaaacggtctggcatcattgtgacttctattcagaaattggatggattagcacgaaataactttaaatttgataaaaatgttgttttcattgtggatgaggcgcatcggtcaacagccggcgaaatgattcagcacattaaagccgcatttcctaaatcggcgtgggtcggctatacgggcacgcctaattttgatgcaacaaaaggcccaacaacttacgaaatttttggagaagtcttgcatgcatatacgattcgagatgcaattgcagaccacaatgttcttggatttaaagttgactttgaaaccacattgaccgattcagctctgagagaatcgtatttgccgaaatactttgcttggcgatatcctgagtggccaaaagaaaaaattgaaaatagaattaacaacatgacggcagatgatatggatgatgccgttctaccatctgtttacgatggcaaccaagatcatatccgcttagtcgtgaaagacgtgctagataattggcagaaacgttctaacaattatgcttacaacgcgctatttactacccacgttggcggtcaacaatcatcaattaaaaatgctgtgagtttttacgaagagttcaagcgacagaatgctaaacgaaagcgtccattacgaattggcattacttttagcatggacacaacgaatagtagtacccagcaaggaactaatgacggtttacttgaagcgattaatgattataatgctgcttttggcgagcactttgatctaacaaacgtaagagggtactcagaggctgttgtgacacgtttaaataaaacggtagatgataaacgttactttgatttggtcattgtcgttgatcagcttctaactgggtttaacgccccagaactaaattgtctatatgtcgatcgtactctcaaaggggcgaatctgatccaagcttattcccggactaaccgcgtgcagaattttcagacaaaaccgtttggccggatcgtgaactaccgctggccaaatcagtcagaaaagttgatgaaggaagctattcaggtatatgccaatcgtgattctgcaaacgtgcagctcacagtgggcccggatgatacatctggcgtgattgaaaaaagttacaacgatctcaaagatgaaatgaaaaagattgtcaaagaggcggccagtttaactggaaactttacaatgacaccgccgagtgaaagcgcccaagagcatttatataatctgctgcatgattacaatctcaccatggcaaaacttaagcaggatgacaaatatgacattgatcaccctgaaacacttttaagtcaaattggactgacacccgatcaagaaattcaactgacaactgttattgctggtgacttgaaagctaatattgccgaaaaacgaaatattgatatcagtgatctaacgctgcaaatggaacacgtgaaggatattcgcgttacgtatgattatatttccgaactgctggctgaacttgcaaataaagtgcatgacaatgatcaagaaggtagtactgccacgcgaacacaaattcaacaggctaccgagcagatggatgatgaacgctatgcaacaaacattcgtagcctagcagatgccttggtcaacggggaaaccaaggcggaacaatatccagtcaaagctaatgatgtgaagagcatgattaccaaccatattaaccagacaaagcggttgataattcgtgactttaagcaatggtggggtgtttctgatattccgtcagaccgcttgattaatcaaattgtggaagaacatacactcggcgaagatgatttaaatgccaccggagccttgaactcgattctcaaagagggtcaagcaacgtataagactgatgcaaaagatgaaaaagtgcgtcaattgtcgccgataaaatttagaaacaaattccgtcaagcctttgcagaatttgctgatcaatacaagaaacagttttagagaggaatataactcatggcagaaaagaatattgcacaggaaatcacttcccagttgtgggcaatggctaacgaactccgaggcaacatggatgcaagcgaattccggaactacatcctaggattcatgttttatcgttatttaagtgagcatcaagaacgttatttgcaggaaacaaacctatttgaacctgaagcgggtcagacttggaacgatgcttttcgcgaagtagctagtgatccggaatcacgaaaagaataccttgaagacatctcaagcgaattaggttatgcgattgcacctgagcagacatgggcgtcacttgttcaaaaggtgaatgacgacaaaatcgttccatccgattaccaagatctatttgatgactttaataagaacgctgcgctcaatccgaattctgaagcggacttccgcggaatcttcgctgatattaatctcggtgattcgcgtctcggcagttcaaccacagcgcgagcaaaggctttaaacggggttgtccgcttagttgaccaatttgaatataacgataagcaaggtcgagatatccttggcgatgtgtatgaatacttaatcgcccaatttgctgggaactctggtaagaaggctggcgaattctatacgccgcatcaggtttctaaagtgttggccaaattagttgcgctgggtgttcaaaaagatcaggaaatctttaccgtctatgaccctacgatgggctctggatctttgttgctgacggtgagagatgaactgcccgcaactgtaaaagctgttatgttccatggacaagaattaaatacgaccacttttaacttagcccgaatgaacctaatgatgcataacgtgccatatacaaacatgagcctcagaaatgccgatacattggaggatgattggcctgacggtgttgtgggaggggtcgactcgccccgcagctttgatgcagtagttgcaaacccaccatattccattcattgggataatagcgaaaacaagttgaaggacccccgatttaagccttttggcgcgctggcaccgaaaagtaaggctgactttgcttttgttgagcatggactttaccatttgaatgatactggcaccatggccattgtccttcctcatggtgttttgtttaggggtgcagctgagggaaagattcgcaaggccattattgagaagaactatttagatgctgtgattggtatgcctgcagggctctttttctcaacagggatcccaactgttgttttggtcttcaaaaagaaccgaaccaaccgagatatctttttcattgatgctagcaacaactttgaaaaaggtaaaaaccagaacatcttgcgcgatagtgatattgacaagatcattgaggcgtattccaaacgtgaagatgttgacaaatatgcgcacaaagctgagctcgatgagattgtagagaacgaatataatctcaatatccctcgctatgtagatacaaccgaacctgagaaaccaatagatgttgttcaggtagtagcggatatcaaggagactgacaagaagatcgccaagttatctagtgaattagctaaggacattgatgatttggtggcaaataatgatgaagcagcgaaacagcttgctgctttgaaggagctgtttaaaaatgagtaagggtaccagaaacgttcctgcattaaggtttaaggggttttcggacgcttgggaaaagcgtaagttgattgatcaattgtccttgctaaaagatggaactcatggcacacataaagacggtaactttgcgtttctattaagtgcgaaaaacgtaattcaggattctatagttttcgatgattctgacagaaagatttctgaagatgattttaatgatatttatgccaattatcatataaagaaaaatgatgttcttcttacaattgtcgggacaataggcagagtcgcgcttttcccgaggctgactgttccggtggctttccagcgcagtgtggctattttgcgaacaaagccgacactttttccatactttcttgctttggagttacaaacgccaacaattcaatctaaaatcaaggccagagctaatatgtcagcgcaagcaggaatatacttgggtgatttaaagaaagttgttatatctattccaaaatcagaagaacaaattgaaatagccatgtccttaaaccgattaacaaaccttatcgctgcaactcaagataagcttgaaaaattaagcatacttcaacgaggctttctacaacatttttttgctcaaacttggagattttctggatactcgcatgtatgggagaatcatagactgggtgatgtagccacacgtgttcgtggaaatgacggtagaatgaatctgcctatattgacgatttctgcgggtaaaggatggctaactcaagaacagcgattctctcaaaatattgcaggaaatgagctaaaaaaatatacgctgctgtctaaaggagaattgtcgtacaatcacggcaattcaaagcttgccgaatatggagctgtctttgtgttaaaacaatttaaagaagctctcgtcccacgtgtctaccatagctttaatgtttcagggaaagcggatcctgattttattgaatacttatttgaatccggagtgccaaaccacgaactaagaaaattaatttcttctggagcaagaatggacggccttttaaatattaattacgactcttttatgaatatatcagtacttttaccgtcaattgaagaacaaaataaaatcgcgcgagttcttgaaaaattgaagaaacttactgatgagactaggttgagactttttaatttgcaacaggcaaagaaatccttgttaaggatgctctttccatagagctactttcgctgactttctttcattcatgtggtaaacgtttaatagtctttaattataaagactattaatctcaggaggtgcggaatgaagcaacgcacgcagaagttccacatgtatttcaagcaatggatcgagctttacaaggagggagcagttcgacccgttacttatcaaaagtatcaaatgtcacataaacacttggtgacccttgcgccagatctgcatatggatgagctgaagaggcgaacctatcaagaactaattaatgagtttgctgccaatcatgaaaagcagacaacgctggattttcaccatcatcttaaagctgccattctagatgcattggatgaaggattgctcgaacaagatcccacgcgtaaagtcgtgattaaaggaacagtttcaagaatgcacaaggtcaagttcctaaaccagcatgagcttacaaagctgctggcgctattagaccttgatggcgggctaggatgggattattttctattgttgatagcaaagactgggctgcgatttggcgaggcgcttggcgtaacaccggcagattttgatatggccaagttaacgttaactatcaacaaaacgtgggactacaaaagtgcaactggcagctttgccgaaaccaaaaacacagcatccgttcgcaaagtacctcttgactggcaagttgcaatgcagttcgccactttgatcaagaatcttccgcaagacagaccgatttttgttaccgagggtcagcgcgtgtataacgaaacagcaaatgacattttagaacgtaaatgcaagcgcgccagcattccagtcattagcattcacggccttcgccacacacatgcatcgttgcttctgtatgcaggtgtgtcggtcggctcagtagcaagacggcttgggcatgccaatatgagcacgactcagaagacctacctccatatcatccaagaattagaaaaccaagacaacgataagattatgcgctatctcacctcattgatgtaacagaaaaagatcacctaacgcagctttaccgcgttaggcgacccttttcaaatgaaaagtccttgtaatagggctttttttaatgtttcgaggcttgaaagtttggattgagttgcagcgataaggtcatcaactctagaaagactcttaccaataagtttctgttcgttgatactcggaacacgaatattttgttttagtaagtctgggacaaccagttcattcatcattgttcctaactttgtagaacgaattagaataggccgcaaaattggttcataatgaatatactgtttccaaaattggataatttgtcgatgaattggtcttaagcaggtaaaacgaggcgacataatcccgtctgccacatcgttaagaacgaaacgaccaaaggcaaactttttactcgtgtggccttcaaatgctatgtcgcctatacgaataaccttatattttaaaagcgacgttttggcggcaccattaccctttctattaactgtcattgttgcgatcgacaatgtattttcacttgaaaattctgcgctctcatttctctctttattcggtttgtagagttctccaaacttacgcttttcccacgggtcagagtaacctctgaacctcattgattggtcaaagagatgctttaatagcgcccttttgatcttctcaaggttatcaagtttaccttgagttgcagcgataaggctgtctagtctttcaagaaagttcccaatgttttcttgttctttgaaactcggggtacagagtgtttgtcgaagaaagtcatgagaactcaagttagtcatcatcgtagccttaatcgttgattttcgcagaatattcctcataacaaactcgttgtgaatgaagtacttccagtaagagattatcggggacactttggggcgaaaaacgacaaaaacgtgggagacaatgccgtctcctatatcattctccacaaatcgaccaaatgaaaatttcttacttttgttcccttcaaaggcaatatctccctttcttagaacattatatgtggccagatagtcttcactagatatacgcacatttgtcttccaagacattgttgcaactgaaatgatcttgtccggtccaaaactgccatcattcttttcagaagttttactgtataaatctccaaacttacgcttttcccaagcgtttatcggataaaaaataggggtcatcaatcttttaaaagacggatatgagctatcctcttgtaccaacgtgaatcacgattaaatgttggtgtttatctaactcaatttcaggtaaaattgaagcacattcacacggcaaccccacgccaacaacctgaaaggagcattcaatgtccctaatcgacaccatcaatcgcgtgatcaacatgatttcgctggtcatcctgcttttctacattgtcaaagtctaccgccaagtccgctcattagactttctggactattttgtcatgtatctgaagcatcggcggacgatttatgccgagatgcagcggaatccccagttgcggcagaaacagttgttatcattgtttgtcagtttaatgattcttactttttgggtgattggcagtctggagaaattgttgacggcttggaatcttggcaattttattaatgcgttgatgacgctgtggttgtttgcctttttcatttaccagacttggcagacaaaatatctgaacgaacagaatcgctatttgagccttggtaatcgatatcagcgtaagcattttgatgatgtgatggcgatttttcaccggaaactggtagcgtgggtgccggtgaatgatgaggatgcgcgggaattggcgcggtttcgaaggctgtacgcgcgggtcgaggagcaagcgcggcgggatcaaaaggcggcgatgttgagcgatgacgtgtacgcgttgtttgacgatcagttgttgcttcgtgatgatggtgagccgctgactaatcgtgagaagcggctgttgagttattatgtgggttattgggatgccgagccttataatgactatagtttgagcatgattgaggatatggatgagcgcgagcggcgtataacgtctaaggtgcttaatgttgtcatgaccgtcacggcggcggggttggtgcttttggcgattcggcaaatagtgggatgagacctaggacgtgtgcagctatttgaatgggtaaaatagtttggttgtctgacttcagagactggaccgttcaaagttttgaaattagcgaataaatgttgtagttgggatagaactgtctgctggtgcaagtgtgccgagtagatggttcttttttggtagggccagataaaactgaaaactttttggcacgagttactggcgaattggcgaacataaaccgaagacacgggatttaatagtagtgtcgccagttaactggttgtcttgaatgatgcgtgaatattctcaaaaaggaattttataaaaataaaatgaaaccattgacttttaatctcataattttataatcaaaccattacattccggtcgagttagatccttaaccatcgaattcggccaaaatgtctgcaattattaaaaaaatatgtgaggtgcccagtatggaagaaaacaaacgtgatcaaacatggttcggcttagcaatgattttatgtggtgccttggtgtccattcctagcttgattttaggcgggagtttggtttccgggatgtcgcttccggctgcaattttgacgggattggcgggatacggctttattgtcttgatgatgatttctcaagggatgcagagtgtggatcaaggtaagcctgcagtagtggttgcccagcaggtatttggtaaggttgggtcgtcgaaggtgatttcgattatcatcgcgattgcggcattgggctggtttggtattcaggcgaacgttggcggtttggccgtggcgaatttgctgaagtatgttggcttgcccattccggcgtggttggcttcattgctgacggggttgctgatggtcgtgactgcgatgtatggcgtgaagttgattcggttgttggcgtatgttgctgtcccgtatctggtgattgtcattttatatggtttgtggttcgcatttgccaagcaggacgcggcggcaacgattgcggcttatcatcccagtggcagcttgtcgtttgtgaatggcttttcttccacagtcgggtcatttgcgatggctggcgtcattgtcggtgattatgcgcagttttccaaaaagcgcagtgatgtggttaaagccgctattttcggcgtcattcctgctggtgtcctgatgattgcggttggggcgatcttgacgattgcgttcaagtcgacggatattagtagtttatttatgaaaatcggttcgccggttgttggtggtctggcgcttattctcggtacatggaaagtgaacgttgtgaatgcttattctggcgggattgcagtggcaaacattttcaacatcccggagaagtatcgcaagttgacgctgttcttggtgggcgtcggcggcacgattttgtcgattctggggattttaaattattttgagccggtcatgacgattttttcagcgatgattccaccagttgccggagcgatggcagcgtcttattgggtgattcatcgtggcgagttgcacagctggcagccggttgccggagtgaactggctcggcttgaccgcgtgggcgttgggcgcggtggttggtgtactgcccgtgctgtggccggcgatcccaaacattccggtgctgggaattattcttgcgtttgtcctgtattatgcaggcgcaaagatacatccagaatgggacaaagcatcagagttgaattagcagcctaacagtggccacggtgatgtcaaaagaatgtacttgcggctgtttcacccagtgtggtgcgtgactcgtatgccttagcggactgaagataagtttaaaaggagaacaatatgcgacttttagatcaggaatccattgaaaatatagcgaccggcgcggcttttttcggcgctggcggtggcggtaatccgttcttgggtaaattgatggcccttgatgcgattaaaaagcacggaccggtgaagttgcttgatgtttcagaaattaacgatgacgattatttttgcccagcagcgattatgggtgcgcccgcggtcatgatggagaagattcctaagggtgatgagtttgagcgggtttttaagatgttaagccagtacaccggtcatgagtttgtagggacttttcccatggaagccggcggggtgaattcgatggtgccgattgcgctagccgcatcgttaggaattccactggtggattgcgacgggatgggccgtgcgtttccggagttgcagatggtgacgttttacttaggcggcgtggcagcaacgccgatggtcattacggatgaaaaaggtaatgctggcgtgattaaaacgatcagtgccaagtgggctgagcgattggcccgtgtacaaaccgtagaaatgggtggtagcgcaacggtagcgttgtatccttcgaacggcaagcagattaagcaaaatggtattcgcggcattgtcaccttgtgcgaacaagtaggcttgcgaattcgcgatgcccacctgaatcctgcgaaagccttggcggaaattcttgaagtgacgaatggccatctgatttttgaaggcaaagtcattgatgtggttcgccggactgaacgtggttttaacgttggtgatatcaaaattgatggcttcaacgattttcaggatcaacatctcagcgttttaattcaaaatgaaaacctgctggcgttgcgtaatgatcagccgattgtgatgacaccggatttgattgaaattgtggatgccgatacgcttttgccggtgacgactgaagtgattaagtatggcaagcgggtcaaagtcctagccacccctgccgatgcgcgctggcggaccaaagctggtattcaaacggcagggccgcggtattttggctttgattatgattatcagccagtagaagacttggtggccaaggcggactgaggttttgatgagcggcggataagtaccttcttccgcactgacttgaacactcacaaatagggggatttccatgtatcgattaggaattgacgtcggcggcaccaataccgatgccatcattttggatgatcagcagcatgtcatcaattcagttaaacggcacacaactaaggatattcaaaccggcattacgaacgcgattcaagcggttttggcggatcagcagctagacttggatcaaattaataaagccatgttggggacgactcaaattaccaacgccatcgtggaacgcaagcacattgcgcgcgttggggtgttgcggctggcgtatcccgcaacggaagccattccgccgtacactgcatggccggaagatttagttgccaagttgtctggaaaatatgccattgtcaagggtggctatgaatatgatgggcagatcttaaacgaattggaccctgacgaaatcaacgccgtattggcaaaatggcgtggtgaggttgacgccattgcgattatcggtgtctttgcggcgttgcgggttgaccaggaacaacaagcggcggatttggtgcatgcggcttatggtgatacttttccggttaccatgtcgcatgaagtcggctccttgggcttaatcgaacgcgaaaatgccgcaattttaaatgccggcttgtttcgcgtgattgaaaataccgttgatgggttcgagcgggcgttggctgaatctggcattaaacatgcatccctgtacttaacccaaaatgacggaactttgatgacagcaagctatgcgcggcattttccaattctaactattggctcgggtccaaccaacagcattcgcggtgctgcctatctctcgcatcttaaaaacgcgatcgtggtagatatcggcggaacaacaacggatctcggggtgttgcaagctggctttccgcgtgagtcttcgattgccgtgaccgtgggcggtgtggcgacaaactttcggatgcctgacatcatgtcgattgggttaggcggtggttcgattgtccggcagcagcgcgatggcagtgtcacagtcggtccggattcagtcggctatcaaattaccgaaaaagcgctgactttcggcggtaatatcgtgaccgcgacagatgtggctgtgcggctcggtctgtccgatgtcggcaatcccgaactggtcaaacaaattccgctaaaatttgctcaggcagcgatgaccaccattggccagatgatcgcggttgccattgacaaaatgaaaaccagccccgagccagcgactgttgtgctagtcggcggcggtgcgatcattgccccacatcatctggaaggcgttggcaaactggtacgtgatcccctcggcggcgtggccaatgcgatcggtgcctccattagtcaagtttccggtgaatatggccgcatctatccttacaaccaaatcccacgtgaccaagcaatggcagacgccaagaaaaaagcgattgaagcggcgattgaatccggtgctgatgaaaatacaattgaagttgttgaagtcgatgaggtcccgttggcttatcatccggagaatgccaatcgagtgaagattaaggttgtgggtaacttggctaaatgaagattgagcgataaaaaaaaactctccaaaatttcgatggagatgctgcgatctatcctatactcctagagcttttaaataataaaggaagtgagaatgaatgcttggaaatatattaacttcaatcgtatctcttcttattgggtatagtttgaaccactttgggggagatgatcggttttctgtattgaacagggacaaatatcaattggaaagtacagggacgttttttgctttcatagtgatgggaatagtgtgtttggctggaagtatggccgttgtttttgccatttggatcattatattttcaaatgagtcagatgaagtaaagactaatatgtatacggttgctttattatacctatttatagcaatcttgggaggctttagagcatataaagaagctaaatcttataaccccttctttacatttatttactatgggaatactttttacaagctattatcattgacggatgctggatacctggtgagttttgttgatattaatgatgataaggttattatttccgatattgcgaaatgcctgcctattgatgcacctacagacccgttaagcaaaatggttccttttaggaaaaaggattttgataagattaattccaaaaaatttcttgcaaagtttaagttatgaaaacaggagagctcaaagttattgcacgtagaacagcttttaggtcagacgagagagtaattgtaaagttctataacttttgacagttttagtttaatttaaagagcggcaaaaaattttagcggttgacaaagcctgctggaattatttgtcgctttttcgctgatatcaggtcggcatagtacgagccgcagctatttacacaaccaatacccaaccttttcaaaaccaccacaacccctttacatcctttaggtataaatgaattgatatacaacgataacaatcatattttacgcgtaggaggatgacggatggttaggaaaagatggacggtgattggtagcctgctgttgatggcggctttgatgggtggcgaagttgcggcgccggtggttgcggtgacggcgacggatacgccggtggtttcgagcgctgccgcgacggcctcgcaaaagcctgcttctgcctcgtcaacggcggcatctagttcggtagcattgagtccggcgagttcgacaggggctaacaactcaacgagcgccagtcaagcgtccgctaacacagcgaagaatgccgctaacagcacgactgctactgccagcaaaacgacttccccgaccaccagtgcgcaggcgcctgccgccaatccggtaatcaagtccatcattgatcagcatgaggcaactttaacaccaggcgtgacggaacaacgccttacatatattagccaaagcggagcacaaaataaatattattccgttgcacttaatccgaagaaccccaatacccaattattagccggaacaccaggggatggcgcgacttccggcgtacaaacggtgagcgatcaggcatccgcagcaattaagcatggtcaccaagttgtggcggcggttaacggggatcttttcaaaattgccagtggcgtgccgacggggaatgttatcaaggatggcgttgagttgcaggctgcgacaagccctagggaatcttttttcggtgttaaaaaggatgggaccccaattattggtgatgagcagacttatcaacaggtgaaaggtgatcttcagcaggcattgggtggcagaaatattttggttgctgacggcaaggtgaatgagacgaaggcgattggcactgatagcgaaccgcggacggctgttgggattaaagccgatggaacagttttctttgtggtggttgatggccgccaagccccaacttctaacggtctttcaatggtggatttggctaacttgatgattcaacgaggtgccgtgacggcgttgaatttagatggtggcgggtcttcaacctatgtagcgcgcgaacctggggaaacgcaattgtcactgcaaaatcaaccttctgatggcaaggagcggacagttgcaaatgcttggttgattgcttcaaaaaccacatcggatcatcaactggcttcggcgcaattgacgcccgatgatgctgtgtacacacctaacagcaccattacattcaaggcaaaaggtgtcgatgcagcaggaagttcagcttcgttacctgctgaaggtttaaactggcagctgacgaacactaaaatgggaacgattgatgctaagacgggcgtttttcattctaacggtacgcagggaaaggtaacagtccaattgacccttaacggccgccttttaggatccgcaacgataacaattgcgatgccagataagcttgccttttcacaacctgagctaagcgttaaaagaggtgcaactcaggcattgaccttgcatgcgacttatcagggacgagcggtgaccttgaaaagtagcgacttgcagtggcaggttcctgctaagctcggtattttgacgacgggtgatcaattacaggcgggccagcaagtggcaagtgacacaattgaagctaagttgaagaataccgacttgcatgcaagcattaaggtcgatgtcggcagattgcctgaggtgcttgatgattttgaatctggaattagcaactggggttcgttgacggcggatcgcggtgagcaggcaaatatcggtttgagttcagcagcagatggacaagtgcgttttggcaagcacgccttaagactagactatgacttttccagcgggactaagagtgccacgctcggtgtttatgctggtccgcaaacaagccaaaagatgccaggaatgccgactggtgtgggaatgtggatttatgcaacacctgaggcaaaaggctattggctgcgaatgtatgttactgatgcgactggtgccgcaaagccgattgacttgacgacacaagacactggtattgactggaccgggtggaaatatgtggaggcaacgattcctgctgactatcaaggaccgttcagtatttcacctgagcaagcgctttgcatgatctcactgaaggcgggtcaaagtgatggcggaccgatgacaagaggcagcctatacattgacaacatccgtgccatgtatggaaccaatccagatgattcaaaagcaccgctcattagccacatcaatgttgcggggcaaacttatacaacgccgcaagttgccattacgacaacggccacggatgatactcgtgatcctaatgctagtggcattgattggaccaaaacacgcatttgggttgatggcaatgagtacacgaacgcgaaggaacacttgacggtgaacaccaaggatcatacgttcacgttggctggctaccagtggcagaatggtacgcatcatgtcaaagtcagcgtgcaggataaatttggtaatgaaaccgaacaggaagctgattttaatgtaaacgttggcgctgcgacaagtggggagacatcaagtagcagtgtatcgtctgtagctagcaaaaagaattctgatcaacttcctgcaaccggtgaaaataactgggcaactggcatcttaggactgcttctcgtggttgctagtgccgcaacctatctgttaagtggctatcggcgaacacggtaaatggacgactgcgttagttagacagaggccaagcaatcatcatcgttgccaattaaagaggaacggtatttccaagaaagcgggggtatcgttccttttttatacaagcttgaacgaataggactgaagcaaaaaggttattgtaaaatttctctcggagcatgtggatgtcaaacacgagcgcatcggtttaggtgattacagcagtgcgatgggtcaccttgttcgaatattaagatggaaagcaagagctggcggagcggtggcgggctcagtggtgaaattggtcttaagcggagtgggcttctccgctttagaccaaggtcgagcttcgaaaccgcggtctttgcgggttcgaagtcgtgcccaccacgttccagcccagccacctcggagccacctcggagccagctcggagtatcgggaatcacataattagagtagaaccgagaaaaagttgacacttacagcaaaaagagtactaggttctctattgcccacctgtggtaaacttaaattggttactgtcatcggtatagttatgactgacactcctgacaaagcttcatgatggaaagaaggaacggcacttgaaaatcatcgcgatcggagacaatgttgttgacctttatccggctgacaagaaaatgtttcttggcggccatgctgcgaatactgcggcttttgcgaccatgatgggcttggatgcagcttatcttgggacgtttggcaatgacgcgcgcggtgattttgcgcggcggacattgattgagcttggcgttgaccttagccattcgttacagtatgacggtcctaacgcttttaccacgatgaagatcaccacaggcaagcggcatcaaaccgttggcgagccggttcaggaacttcaactgagtcgcgacgatattgcttacattaatacgtttgatctcgtttaccttaataatgaaagtggcgcggatgcctttttatccgcaatcacggcaccgacaatttacgatttttcaacgattgacgatgatcgtattttcaaaaagattgccccacagattgacttggcgtatttgtcggggaaggccaagtcggatgatgatgtggaggcgttgtgtcggcgcgtggccgcggctggttgtcagcgggtcgtttgctcgcgcgggcttcgcgggtcagcggccttggtggcggacatgatgtcttggcagcaggcgctaggcgttaaggcagtggatgctttgggcgcaggggatgcgtatatcacgtgctttgccgccacactttattcgtcgcaaaagccaacgctagacgcgaaagtttccgagtcgttaagccacgccgccaaatttgcctcggcacaagttcagctgccggggtcgtttggccatggtgcagcgttgattgcgtgagcgtcaaaaaagttagaaaaaaaccgccgacttgttatcggcggtttctttgacacttgacgcgactagcctatgatcgtttccgatttgatcgttaatcggctatgtgcgtctcaggcgtgcgcaaaccaagctctgttgacgacagtacgatcagacatgtcgcaacttggctgtcacggatgatggcgataggtcgcctttaagctacatcattaactttattcttagccaacatgcagctccccaaagctgatattgttgactaggaacgtggtggaaatttacccgatacttgtactatcagatcggctggtttaggtcttgcaggcagctggtcggatgtgatcagaatccgccaacgcttgagacagttcgttgtgttcactgcgattgccggcgatcacctcctttctgtcccggtttgatcatcgggggtgatgtggtgtcgcaatctaaggttaattattttcccgtgctaagacggatttgggttggcagtcgcagcttgagccggctgacccggtgtgagcgtgaaggtaatgacgccgctgtaacttccggctttaacggtattatcttgcggtactgctaatgtggtcttgttgagatcatagctgctaataccagcgccatccaaagtggtcgtggttgcaaagagttgttggtcggtggtggttaatgcgactggtttcgtccaatccggtgacacgctattcgtggtggttgttgcatcagggacgagtttaatgaccgcacccttcaactccgcaccactactggtcgcaatcggtgaagctttggcagtgacgctataaccgctgccagtgccacgaaaatcgctgacggtcaaaatggaactatccgaagcattgacgttttcgttcagatcgcctttgacaatggattcaacactgagacttggaaacgtcaaactattcggcgccgaaagtccaatggaacccggcgtgacggtcacagatgtattcgttgacccactatccgcatcagctgccaaaaccagtgaaccagctgaaaaactcccaacaagcagtccggcaaaagccacactgccgatccagtatttctttgacataaaaagtccccccagacttaaagtgagcgtgagccagcccgcttacacacaggcttctgggctggcaagcgcgttatggtaagcgtgagtcggcaaaacttgcagctaaaagcccttatgtcgacaagcgctttatgccaagtacgaaacaattttggaacacctttaattgtagccagataatttgggaaacaaagaaaattgatttggcaaattcacaaacgagcagaaaaggttgatttgtaaacctttttggtaaattaatctttacgagcaatttgcgagctcattcaaaaagagctttttgtctcagttttaggaaaaaaactgtcaaattttgagactttcattgttagactaggcagtggcgcgattatatgaaaatactaatcaattctggcctagccgaacaaagtcttagactacctgataataagccgagctgtttgatgttaactcgttatcttaggtcctttaaaggtggcgcacaagcagatttactgcaattaattgtttttaaatagagattggaattaaaaagcgataagtttttcacaagctgtgagtgacagccttctcggcaatagacacaaccgttttgagggcggtttgcagtcactgcttgcaccgggtaagcttacgattagaagtgaggcatataatggaaaccaatcatacaaattcacagccggctgctgctgagcgccaaccggagattcgcttaccaaacggcactaccacgaaaggcgtcttgctccaccgcggcatggctaacttacagcacgatgctgaccatgctgattttgagccgcaaacaaaggtctatttggcgtggatgaatgatttaaatggcaaccggttcggccttaagattacggatgcaaacgatcagttgttgttgcggcagaccgaatttttggatgacgcgatcaaggaactggcgtatgcagatgccccggcaaatgcagaactcacgcctgatgattacaaaccggcgcaaaaattctatgtaccatctgcgggcctcatcgcgctggtggcgggtttgcaatgggctgcgcgtcacaagcggggagatgtggttgtgtacagtacgcaccgttgcgacttgacgttttatcagccgcggcatcagccaacgttcatccaacaatgggcgcagcagcaactccagagcttgccagcggattttcggtttcgcattgccaccaagcttgatcgggctgccacccatgagacgacaaaattacggatacaattgtgaccgataacgcgaaatatattagagaggaggttggtgcacggtgccacagactcaggtttatgaaaatgttgacttgcagattattaagttattgttcaacagtgataccagcgattataaagtttacgcggtgcggattttaaacccgaatccggcgctcaaaatgacgctcacgcaagaagccacggtgaccggcgatatgggctattacaatcagcgtgccattatcactgctgatttggtttatgatgatgccgattcactgcgctatcggaaaccgtcttataaagtggcgcggctgcattttgggttaccgaaagaaccccgccgccagtggcaattgcttgaaaccttgctcgtacaccagccaacggttttacgccgcttgcatgaagcgtttgccgatgacgagccgattttggcgactttttcaaaagccacgattaaggatgcacggattccggggatcgggtcggcaacgatccaaaaaattgccatggccattcgcggcaagcttgaggttgcagtgttggctaaccactggggtaaagcactcagttcgatgacgtatgagaaaatctggctggcgtataaagatgctgagctggccatgcaccatattgatgccaatccttatttactgatgcaagtggcgcagtttgatttcaaaaaggcggatgcgtttgctaaaagtcgtggggttgcggccaatgatccgcatcggctcgctgccgggttgcagtacattttccggacggcggttttgacgcaagggttgacctacattacgatcacgtggttcaagcagcaagcagccacgttattaggcgtgcgcgccgaagacctgacgatgtttgctgaccctaagcaggcgttggcgtatggctttttgttaaatgaacagtatgacttggtgaccagctgcgatatgtttgccacggaaggctcagtggccaaaatcatgacggtggcgcaaaaaaccgcagagccactgatcaagccggaagaactggatgataaactggatcaatttttggatcgccatcaactcgtcatcaacgaccagcagcgcgccgcttttcagaatgtgaatcggcatgggctaagtgtgctgaatggcagtgcgggcaccggtaagacttggttgaccaatttgctggttcactttttcaatgcccaggcgaaggggaaaagtgtgttgctggcaccaaccgggcgggccgcgaaggtgttggcgaagtatacgcacgaacctgccgccacgattcacgcgtacttgcacttgctgccaggcgaggaggttgagcggttcaatgctgagtctgattgggagacgtttggtgatgcgcggttgatcattgtcgatgaaagctcgatgttaaccacacccttggcccataccgtgttgaaacacgtgaatttcaaaaaggcgcacgtgttgtttgtcggcgatgtctttcagctgccgccaattggtccggggaactttttgaaggactgtttagccgattcgcaggtggcggccacaactttgacgcgcgtttatcgtcaggatgcgcaatcaggggtgctggcgctggccaatcgaattcgggatcgactgccactgccattcgggccggatgatgatcgctatgtcagcggcaatgtggcactttacaatcagcgcgatgccggccgcgttttcgatgccggaatcaaggcgtatcaagacgcgctagccaaaaatggccatgagctggactcgcaacttttaattgtgaataaaaatgtgggcgctactggtcgactgcgatttaatgccgaactgcaggccttggtcaatccgactaggccaggggaggaagaatacgtcagcagttatgtcgatccggtgaccaagcaaaagcaccatttgcgaatgcgtgatcgggtcatgattttaaaaaatgacaagcatgtggcgctggttgatcctaagacctgggagcggcgcgcagttttaggcgaaaacgggttgcagcaaaccgacgaattcgggacaaaacgttggcgggagacgattatggccaatggtgataccggtgtgattgcccatattgataccaagcggcggtttctggttgtccaagttggccagctgttattacagtttcggtagcgtgccgcgggcgttgacgttggcgtatgcgatcaccgtccacaaagcgcaaggcggtcaggcggacacggtgattgcgattgttaacggggccgatcatatgttaaatgcccagagcttttataccgcgttgacgcgaacgcaagcacgctttatcttttttggcgactttcgggtgttgctggcgcggacgcagatttatcccatggacactcgccacgacttactcggtagcctgctatcgggacaattgacggtggataacttcagccgcttcacatttgaacagatactggcgtggttggatcatcagcaacaccaaggaaaccaaccgcgcgcggcactggaggcggaaaagcccgatgccaccagccagccatttttggtgcgttatgctgagcagctggatattttgaatcaagttgttgagacagtggccaagataccggttcgtaaatcgtctgctgaacattgatatatgtaaaaagtcacgctcattgttggcgtgacttttttgcatccgttaataccagttaaaacttcctacgtgcttagcgtgccggtccgttagcattcacccaataagtacggccgtctgcggtgcgatcaaggaagccgtattcgatcagattacggcgaacggtgacgtaatccgatacgtgacgctgcaatatttcgttgacggcggtctcggaatagtttttctgggggtcgaagtctttgaaaatctcggacaaaatgatcagtttacgtttttccttggcgggccaatttgtcacccggccatcaggagtgaggaaggcttttaaagtcttttcccgttcttgtggggtaatcgcataccggtcatcaatcatggtggcgccatcatgcggcatgatcagggcatccggcaaggcgagcaaggccattgcggcgagaaaatgctgcgcttgctgctgtttttctcgaaacttgaagcgatagttgcggatggtggaagccgaaacttttaagcgctgggcaatcaccgtgtcgcttaatccttgggcaaacaggcgcagaacttgttgctgactggcagatataccgagttgattggctggctgctgcagtaaggcggccaatgcaccgttgtggacatgttgaatgtggcgtttgatcatcgcttcagcagtgaagtaacggccgttttgtggataaacttcatcttcggcgaaactagtgtcgcaatagtggcagtgaaggtagccggattctaggtagtagccttgctgcaattcggatattttataaacgaaaatgttatttgtcattctataaacaagcctttcttgatattgtttatatattaactcgcagacagtcgttttgtcacttaaaaaggtcctaacaacaaaaaaatgacctacaaccaagcccaaagtaaagctggacttggttgtaggccattcttagaagtcaacttgtcctattttgcaataaaaacaagctcatccgcggtcgaaagtggcgcatcaaaccgataagtcggcgagtcaaagtgcgtcagttccgccactgttgtaacccgatgtgtggcagcataccgcaccatttccccgcgtgccattttagcataagtcgcacgggttttgagtttgccgttgacgttatgggcaaagcggacggtgataaactgatcagccggctgcaggtaaggacggatagttttggcatattcatcagaggcgaggttgatgatcgggccggggatggtcgccagtgcctgatacagccgatcgccccaaaaattatataagctatgattcggcaccgcagccagacgggtttgcatttccaaccgatatggaacaatgccgtcaaacggtcgcaagataccgtatagaccagacaaaatccgtaaatgttgctgaatataggctaagccggcatcatccaacaggtcaggcgccatgtactgatactgaatcccgacatagctgaaaatcgcaggtgattggtgcgccgtcacgtcactggtttgcagctgtgcgtacgccgcaccggtgagtttttcgctggtatgccacagtgtctgggcttctgcgcgggtgagctgctgcatgtgacgtagcagccacgccgcctgatcacgaaactgcggctgactttgaacgggaaaatcgtcctgagcgaccaccattttcttagccggtgcgatgataaacttcatgtggaaaccaaactttctatataagataaactacttaagaaacttttgctgacttcgttaaaatcgcaactcaccgatgtcgccaccaggcagtgccgtggtttgtggcaggtgactcaccacgcgcaacgtcattaaggtagcggaaaaatcaccatgcgccagcggtaaagtgatcccggcataattgagttcagcaccggtggccgtggccttgtcattaatctggtaggatacttccgggttgaggtaatgcaacagcacatgttggtagtgcggaatcggcgaaaccacgccagctgacgttaagacgagcgccttggttttggcttcgttggtgatcagccagcatacctgatcctgattcggatgactgggatgcagccgataaagactgccattttgcaattccgtacgattagctttgtaaaaggcaaagctggctttaaccgccgcggcttcagcgtcactcaactggcttggcggacactcgatcccggtaacgcccaccagactaagcagcgcccgcgtttgcaaaggcgtgactcgcgagtcctgcaaatttggtgacatcgtgaaatgcgagacgaaggttttaagcgggaagaataaggagaagccgttcataattttcatccggtaaacaggatcggtaaaatcactggtccaggtttgatccgtatacgccagcatcccgccatccaaccggccaccgcctgacgagcaattttcgataagcagatcgggaaaagtgtcgcgcaatgttttcaaaacccgatacaagccgcgggtgtatcgatagccgacttcgccttgttgatcaggtggcagtaccggacttccgggctggctgaaatgacggttgtaatcccatttcaaataatcaatatgattggtccggaccaaatcagttagcaccttaatcagatgatcctgaacaattcgctggctaagatccagaattaactgattgcgcgaacgtaacggcttttggccaacgtattgcatcgcccaatccggatgttcggcatataactcactattttcagtgatcatttccggttcgacccataaaccgaatgctagtccgcgctcgtgcaaggcatcggcaatcgggcgcaacccacggggaaatttgaccggatcaggcacccaatcgccgagctggccggcatcattcggccgattcttgaaccagccatcatcaatcacaatcaattcgactccgagcgcctcggccttaggaatttcggcgcgcaccttggcttcactgacatcaaagtacgtagactcccaagtgttatattcgatcagatttttccgcggcaatggcatgacgtgatcggcaaaaaagcggtggaaaatatgactgagatcattcaagccattggtcgtgtaagccaccgccgcttccggggtcacaaacggttcaccaggcttcagctgccaggaaaagagctccggattcaggcccatcaccagccgactgttgccaaactgatcgacttgcgcggtgtagctaaagttgccactccacaacagcgccataccaagcgcctcacctgcaaagtcatccgttgccggtgccgccagaatcgttgccggaacgccttgtggaccactggcaccataattgctggcgatggactttttacccggtgtgagcggttgccgggtgacgctggcttcgctgagatgggcgcccgtcaaagtaatgagatcgtaagcatgatcatcaaagtccagttgtaagctcgcagcatgggtaatcgtaagggtgtcgtcactcagattgtggtaagccacttgtttaagcaggacaggcagatcaccaacgatggtgtacttgagattcaccgccagcgtatcggtttcgtcatgcatcgtgatcaccagtgtctgcccatgcggagtgcgcgcggtcggcaaagtgtcattgaagtttttatttcccgccagaatctgaaaatcatgaaacttcagattcccgatcaattgcccatgcccattgcgaacggcatagccaggcgtccgataatccccgcccatcagcgtactatattcaagcggcaaggtcgtgagcgaaaacggcgccgcatcattttgaatgttaaacgcatgactgaaatcttccagcttggcagtaccggaaaaacgttcaagcgccggtccgcaataccgcttgaccaaatagccgcgaatcacctgaatgatatagctaaacgtatctttatgcaggtggaaaagctgcttttgcgggtcgtattctatgtttgccatgttagtctgtcctcctgtgagctgagcgcgagccggcgcggttagaagccgaagcataagtggccttgggtgtgatggccgggctttggccattgcgccaaggtccttatgtgcaggcttctgcgccggggagcgcgttatgattgagcgcgagccagcgcggttagggatcggagtgtaagtggcctcaggcgtgatggcccggtcttggccattgcgcctgaggtccttacacgcagatccttgcgctggggagcgcgttatggcgtgtggttgcgctaaaaacatccaactttaatccattataagcaatagaggttatatttgctcgtaagcgagatttatgtaagtatcaacgccctgcagagaagcaatctttaaactcggcaaagtataagatgcattcgttcaaacacgataccgatacgcgtccttgtgaaagcgcttaacaaagctgaaaaagtcaaactttttgcttataaaaattataaataataactactataatctttgacccgccgatctgcactcccgtagaattttaattgtagttaagtattaatgcgacattatttaaaattctgaagggagtacagtgatatgaatgcatttataggatggttgaatcgacatgttgtgccggttgcagccaagatcggctccattcgttggttagtggcgttgcgtgacgcgtttattgcgatcatgccggcgatgatggccggggcggtttccactgttttgaacgttttgattcgcgatattccgacccaatttaagtggatggggatagtcgactccatgcagtggctgatcggtatcaacgccatggtctggaccggcacactggcaattttaggcttgctattcgcctttacttttggctatcagctggcagttcaataccaagttgagccggtgaccggggggattgtggtgttaggcacgtttattatgagcctgccgcaaaacttcatgttgccgctaaaaggcacgctgagtaaaggtgctgccaagttaatcaccgatgccggtggggtagtcgatggcaagaacgtgagcatgtggggctttttcaactttggtaagttcttcggttcctatggcttcttcaccgtcatgatcatgggcgccttggcgatgacgctttacatctggttaatgaaaaagaacgtgacgatccggatgccagaagcagtaccgccagcgattgccaaagcttttaccggtattattccagcaactgcggccttatatctggctggcgttgtgaattatctgttcagcttaaacaagaccacggtcatcgaattcattgcgaccatcgtgcaggaaccactgctaaatatgtcgcaaggcttctgggccgtgttactcatgacgttgctggtacaaattttctggttcttcgggcttcacggcaccaacgttttggggccggttctggattccatctggctcaccgcccaaattgccaatatgaatgcgttcatgaaaggtgaagcactgccgtttgtctggacccgaaacgcctttgacttgtatgcgtggatcggtggcgccggtagtaccttattacttttgattgcgattctgatgttctccaaacgtgacgatcaacgcaccgtggccaaattgtcgatcgcaccgggctgttttaacgtgaacgagccggtgatgttcggactgccgattgtccttgacccaatctacttcattccatttattgtcgcgccggttgtcatggtatccatcgcgtacggcgcccacatgctcggctgggtgtcaccggttaagaaccaaattgtctggtccatgccgccgtttgtgaactcgatcattgcgaccatggattggcgcgccccgattctgcaagccgtcaacatggtcattggcttcctgatttacgtaccgtttgtcaaagcggccaacaaactcgatcctgaattaactgtccctgaaccaccaatgaaaaaagccaaaactgttgccgatgatcgcaatggtgatcgcaatttagaaggtgatgcgatttgaagcctagcacgacaccattgatcttgcttaacctcagcatgaccgtgattgtcttcagtgccattttaccggcaccttggcgaatcattagctgtctattcggggtgatcgcaactgctatttgcacacgctggtatctcggtctggcaaaagaagagtagatcgcagcgcaacgtttgctgaagcatattgctgcaaccatgcgttcagtccgcagtttgtccaaaaggaggtcaaaatgaaaattgtcatgaatctacccgttgaagccagtgtctttttcaaccaattgcaacaatccgccatggccgatattcgccagcacaccggtcgtgagccgctacctaagagtttgcagggctttagctacgagaaaaattggccgaatgggcgaaaagcgcggttgacgattaccgagtttacgccaaattcagtctacgcatatgaactggcgacaccgaatgatgacttcaccgtgcgataccacttgtcgccgttgtctgccggaaaaagtcgactggtttatgaagaagcactcgtcgcccgtaccgctcgcggtgcagcgaacaaccggactagcggatttcttttaggttggttgcgtaaacggcgcttcaagaaaatggcgcggcaaatgtgtgcgatttaaagaaccggttgcaaaacagcttggatgaacgtggcttgagcgacacagccacaccatcattaaaaaatataggagattgacatgggaaaaatcggaatcagtctttatcccgaacaaataaccgttgatcaggcaactgattatttaaccatggtccgtcagtttggttatcggcgcctttttacctcattactgcaactatccggtcatcaaggccgcgatcaactggctattttcaaggcggtggttgccaaggcgaatcagttgggttttcaaacgattgtcgacattgcgccgccgttgttcaaggaactaggcattgattatcaagaccttagtttcttccatgaattaggcgtatggggattgcggcttgacgagggcttcaccggtcaagaagaagccttgatgacccataatcagtatggcttgaaaattgagctgaatatgagtgccggtacgaatgccattgatgcgatcatggcgtttggaccgcgactggataacttgttgggttgccataatttttatccgcagcaatatactggtttaggcgatgaccgctttttggcctattcgcaaaagtttcggcggcatggcgttcggacggcagcctttgtgacggcgccaagtgcggatcatggtccgtggccggtgagtgaaggtttgccaactttggaaagtgatcgccatcgcagtattgccagtcaggttcaccatttgcgcctaacagaggtgattgatgatgttctcatcggtaatgcacttgcaaacgaagcagatttaaaagccgcggccttggcattcttttgcccatatccggcattgcgggtgatcacggaccacgcaccatcagcgttagaagccaaaattgcctttagcgaagcccatctttatcgcggtgatgcgtctgattatctgattcgcgatacccaaccacgcgtgcgttatgccgggcagcctttgccagtgcatgatgcgagcggtcacttgcagcgcggggatgtagttgtcgtgaacgaaacgtatacgcggtacgccggtgaactacaaattgtcttgcgggaattgccgaatgacggccgccgcaacaaaatcggccgcctgacagatgaagatctgaccttgttgccactgcttaagccatggcgaacatttatgttaaaacaggtgtcccactaataatgacagataggagtgactccatgagcaacgccaacgaacaaacgattatgggcttgattatggcagggggcaacgctaaaagtgaagcctttgaagccattcaagcagccaagaacagtgactttgatgctgcaaccagccatttaaaagcagcggatgaggctctggtcacggcgcacaatgtccaaaccgatttattgaccgccgaagccaacggagcgcacgcagatgtttcattactactagtccacgctcaggatcatctgatgaacgccattacttttcgcgacttggctggcgaagtggtcgcgatttatcaacgcttggctgcaaatacgaccgttgcaaatgaaacgctttaagccattgcgtgatagccagttgcgccgtgaatgaattttatatgtaaaacacgcggttattgcgaagataaccaaaaggctgggacgaagcatctctggaaagatgagatgcttcgtaccagtctttttattagattagcagtatcgcaactatcagcccatgaccttgtacaacttacccactgcaattggcaaagtgagataaggctttttttcgtctaaatcactcgccacggtctttggtaacaagacgtcgctttgaaccccgttgacgtaaaccacggtattgtccaggttgaacacgtcatggccataatgtttcgccagttgttggcgaagttgggatacgacaacccgctgctggtaaatatagaacccgttgtcatcggcttcagggtatttgccacccaccaacttcaacttatcgggtgcattattgagagggacaaagactttgccggaaacttgctcggcttcttcctcatcgatgaccccatcatgattctgatcctgagcacttgtagctggcgtgaccggcgcatcggaaccggagctttccaagactgccatgtgattcatgtccgccggcgtattgaacatttcaatgcgaatctgcagagcatcatcatcggtaacttcaaaatttgcaaagccatgtgcctgccgaccaatgcaatctgagttaagtgcccgcaatgttgctctatattgcttccgcataaacccgcctcctgtttgatttgagttatttaggtacccctaactcaccttcaacgatagtccttttaagaaaaaaatcaaggctgtgaaaccgtgaggaacagcggtatatcaatgaaaagacactgctttacgctggtgaaaagaacgagctctcggcgtgtcgggtagtggccaatataaataaattgatattgattatggttctataagtggtatacattggagctatccagaccggttatgctcctaaaacagggttacccatctgccaacaaaagcgcgaagaaaatggcacgcttagcatggcggaaaaagaggcgccagtaaaaataacatttaacattttgaaaccgttttcggtgtctaatccgttgtcacaggtgtatagttaaattggaatgattgtaatatgggaggtgcattatgaaagtagttattttctccacctgcatcgtggatcttttcttccccaatgtcggagcggcgatggtcgaggtgttggaacggtttgggtgtgaaaccttcatgccggtcaaacagatttgttgcggtcaaccgacttataactccgggtatgtgaaggaaagtcaaaaggtgtttcgcaacgaaattgacgcgctgctttcggttgacgccgattatattgtcgggccagccggttcttgcgtgaacatgttgcgcgaatatcgggtgctattgaaagacgatccggaatacgcccaaaaggctaaagaagtggcagacaagacgtatgaattttcccaatttctgtatcgcgtcttgaatgtcattgacgccggggctgaattagatgccaaagccacttaccatcgctcctgccacatgacccggttgctaggcgaacgcacggcaccgtttgtcttgctggatcacgtgaaggacttaaagatggaaccgctaccacatattgaaaattgctgcggttttggcggcatgttttctgccaaagagccggaaatttccaagcaaatggttgatgaaaaagtcaacgatgtgctcagtaccggcgcacatgttctgatttcagccgatcccgcgtgcctgatgaacatcgccggccgtttttcccgccgtaacgaaaagattaagattatgcacattgccgaagtattgaaccacaatgtgaatccggagcggatcaagtttcatgagccgctcggggttgaacaggaggtgcgcccatgagcatttcaaccagtgacaagccgttcttggagcgggttaaagaatcggaacaggataagttcatgcaagccagcgttgccaagtcgcaggatgcgcagtgggacaagcgcgaggcctcgcgtaaagagctgggtaattggccgcaatggcgggacttaggcgagcagattcgtcaacatgtcattaaatacttaccggattatttagaagaattcagcgataatatcgaaaaacgcggcggtcatgtttactttgccaagaccgacaaagaagccgcagcctacattaccaaccttgccaagcaaaagcaggcgcataaaatcgttaaatccaaatccatggtgacaacagaaatcaacctggacaaggagctactgaaacttccgggcacccagctgatggaaaccgatttggcggaatttattttgcaagaagacgactgggctgaaccgacgcatattgtgttcccggcgttggccaagaatcgggatcaagttaagacgatttttgataagctcggctacaaaggggataacgatccggaacatttggcgcggtttgcgcgggaatatttgcgccgctatttcttgcaagccgacttcgggattaccgggtgtaattttgccattgccgattccggcttgattaacttggtcaccaatgaaggcaatgcggatctgaccatggccattcctaagacgcaggtagttgtgatggggatggaacggattgtgccgagtctcaaggaagccgagacgctagacaacatgctttcgcgctcggcggtgggacagaagctgaccagttactgttccttctccggtaaaaaagttgccggtgaagcagacggcccggaagacttccacgtggtcattgtcgacaacggccgcagcaatgctttaggaacgccatttgagccggtcttgcagtgtattcgttgcggggcctgcctgaatgtttgcccggtataccggcacatcggcggtcacggttacggttcgatttatcccggaccaattggcgcggtgctttcaccagtgctggatggctatgagaaattcggcgacctgccatttgcttccagtctatgcgcggcctgcaccgaaacctgccctgtccgcatcccgctgcaccatctgttaatcaagcaccgggaagtaatgatggacaagctgaaaaccgatcacagttttagcgataaaattatgaaaatggtcggcgtcggcaccagtgcgccggttctgttcaacatggcgcttgatatggatcacgcaatgatgggcgttttggcaaccaaagatcaaggcagtgttgaaaatgaatacaacagcggccggatcaaacaaaccggcatgatgccgaagctggctcgcggttggaccgatgtgcgtgacctgccgcggccaccgaagaaaaacgaaaacttccgtcattggttcaaacaacacaaagcagcattggaggcgcaaaagcatgattgatcacagtaatcgcgaggactttttaaatgccattgccgaaaaagccggccgcccgcggcaccagcttaaggatcatccgtttgtgcctttaaacgacttgccggaaataactctgtccggccactcccaagacgagttggaagccatcgccaagcaaaacagtgaagcggtgcatgtcacgtttgaaaccactacgaaagcagagttggcagacgcactcaatgcttacattgaacacgatgcacccaagacgctcatcttgccgacgacggaacagtatcatgattatggcttggatgagtggaagcaaaccgtcacgcccaagccaatgtactggacccccggaaaaggccgtgacttcaacttgaagcaagctgcggctgcggatgtggccattggcttcgcggattatctattagcagaatctgggaccatcaccgttgcaaccacgcccggacaaggtcgcggcttccattttctgccgacgcattatttggcaatcgtcaagaaaagcagcatcctgccacgttcacgccaagccatggatcactatgatgcggcaatgaaggccgggcagctggaaaccagcaacatcaacttcatcaccggaccttccaactccggcgacatcgaaatgaccttggtcgtcggtgtccatggaccgctagacatgacgtatttggtggttgaggatctgtagcgactgttttagctgatgagttgcgggaaaagtcgggcctagcgagcgtatctgcgctagggtcggctttttgggttggataaattatacttatcggattaattggaacgtactcttcaacgaaggatacgttgagtctcgttgtttgagtgcagggatagaaagcaagagctggcggagcggtggcgggctcagtggtgaaattggtcttaagcggagtgggcttctccgctttagaccaaggccgagcttcgaaaccgcggtctttgcgggttcgaagtcgcgcccaccacgttccagcccagccaccgcggagccagctcggagtatcggaaatcacttaattagagtagaaccaaggaaagggttgacacttacacctcatccctagttggcgccggctcccacacaaggttatggtatactaaatcctgagacgtgcgataacggcacaatgcaaataaaggggatagcgacatgacggaagcaatcgatttgaaggccggaatggtttttgttaaggatggcaaactgatcaaggttttggaatcaaatcatcataagccaggcaaaggaaacaccgtgatgcagatgaaactgtatgacgttcgttccggcgccaatgtcacgacgaccatgcggccgagtgaaaaaatcgaaatcgccatcatggatcggaaaaaagcaacgtatctgtatacgcaagatgatactgcttatttcatggacagtgatagctatgaacagtatgaattaccgacttcaagtattgagcacgagttgaagtttatgctgccaaatattccggtcgaaattgagttttacggtgatgaagtgatcgggcttgagcttcccggaacggttgaactcaaggtgaccgacacccagccgtctgtcaaaggcggaacggttgcgggcggcggcaagccagccacgcttgaaacggggcttgtggtgacggtgcctgattttgtcaaagcaggcgaaaacattttggttaccacggacacaggcgcttataaagggcgggcgcagaaataaaagataagcgaattagcgaaaggtgacgcaatgatgcgttgccttttttgttaagcgcgagcccggggaacgcgttatggccagatgaggagatccttcgcgtatcaacgcccataattaaaattatccccacacttcattcacgacagggcggaataattgtagcgcatggctaacgagcatagaatacatgcgaaagggtgtggggaccatgacgatggcgcgggcgcaacgcattaaaatcttgatcgttttagggatgatgtcattattaacggctttgtccggctctagcacgaacttagcaatgccaaagatctccgaagacttgatgatctctagcagtgcggcaacgtggattgtatcaattggcctcattacaacggcagtcttgctcgtgatgtttggccatatcggtgatttagtctccaaaaatctcgtgtttctgctgggcgaggttgtgttcatcgttggctcgctactgaccggtattgcgccaacttatttcaccatcatggccgggcgcgtggtccaggcagttggctcggcgatgattatggctaattcgatggggattatcagtgaatattttcccgatgcgacccgtgctgaggcattggcggtcatttcgatgtttatatcaatcggctcaatttccggtccggcatttggcggcatcctgattacctgggcgagttggcggtggatttacttatttaatgtgccagtcgggatcttcattgtccttgcaggtatgcgcgtgttgccgttacgtcgccccgaacccggtgaaattaaacgcgtgtggcagcaggcaaactggaccggtcagaatctgtttaccgggggcatgatcttgatgtttgccagtggctactggttgcagcagccaacgcaattttggctcggtacaggggtgttggcaggcggcattttcttgacggtcctggcgtttgtgcaagatcagcaggcccggtctccttggattgcaccggtgattatgcataacgccgactatctgatttctgttagcgtcttgcttatcgtgatgctggttaattcagtatcaaacattcttttgccattttatcttcaaagctatggcggaatctcagcattttcaagcgggttactgatgatgctacaaagtgtcacgatgttggtgatcacgccatttgccggctggttggccgatcattggaatcggtactatttaacgattttaggcttattagtgttaatcatctcgcaagtcggatatgccaattatccagtcagaatcactatggcaccgattatctggccgattgtggctaacggagcagggatggcactgttcctttcgccgaacaatgcgctaacgatgggagccgtcgatgacaaactctcaggagtagccggttcgttgaattcactggcacgcaccgttggcttaactatcggtatcagcttcggcgccacgttactatttgcccaattgcccggtgtgacccgcatctcagctcaatcgggcgccccttttctacacgcactggcaacagttttctggttagccactttagtatcggtggtgggcttaatcattgtcattatccgcagtctgcgaaaacgacaagcgaacgcggtactgacaaaaaataagcatgtactttgaaaacgattagcattaactgagcggcgacaatgtttttcatttctggtttgacagaagtgaaaattatgtctgaaagaatggcggtcagggaaaaacaagccaattttagggacataaattgatgttatttaatattcgcggatttctgtaaaagtttagcggtttccccaaaggatcatctaaagtaaacagtttagtaccttgtaaatccccgttttaacgggagatttaaaaatatgcatagttgatgcacaagatgttgtcccaataagttccgcttcttttcctgtgatgttttatgacatacaagtttttttattcgaaattgaggattcgcttatttacattaatgagattctaatgtaaggtaagttcaatcattttaggagggaacaggatgaaatttagaaaaacaatggttgcgggcacagcaattgcgctcgctggggtgctggcagcctgtggttctaatgcttccagcagcaaaggtacatcaatcactcggatggaaagtgatgttatctccacaatggatccgtcaacaaatacggacgcgattgcggggcaggcattgattgataccatggatggtttgtatcggtattccggcagtgacttgaagccagcgatcgcaaaaagcgagccaaaagtgacggacggcggcaagacttatacctttaagctacggaacgctaaatggagcaatggcgatgccgttactgcacaggattttgtttttgcttggcggcgaacggttgatcctaagaccaagtctcagtatgcttatctgtattccggcgtgaagaacgcggacgatatcacagccggtaagaaggcagctagtaccttaggcgttacagcggttaacaagaccacgctgaaagtgaccttggatcacgccattccttactttaagaccatgttagtcaatccggcattcttcccgcagaatgagaagtttgttgaaaaggctggcaagaagtatggcacgacttctaagtaccttctctccaatggcccatatgaattaaaggactggaacgggactggtaattcatggaaggaaaagaaaaacaaaacctactggaatgctaagaatgtccacatcgatacgatcaatgggcaagtggttaaggatccgcaaactgctttgaacctgtatcaatcgaataagttggatattgctcagttgtctggtgaacaggcggcacaagctaagacaatgtctggatacacaccgcttaagcaaagcgcaacattttatcttgagttgaatgagaagaaagatcctatcttcaagaataccaagattcgtcaggcagtctcgatggcaatcaatcgtcaagaatacatcaagaaagttttgaatgattcatcaattgctgcgaacaatgtgacgcctcaaggtttatttgctaagaatggacaggacttctcaaaggcagcgactaaagcagaatcttctacagttaagtatgatcctgccaaggctaaacaactctggacagaaggcttgaaagagaccggtcagacgaacccaaccttggaactgttgaccgatgataccacgaatgccaagcgctcggctgaatacattcaaagcaccttacaacagaatctgccaggcttgaaggtaacaattgcaacagtgccattcaaaacccgtctttcccgttctcaaaatggtcagtttgacatggttatctccgcttggagtgctgacttcccggatgccattaccttccttgatctgtttacgtccgataacagttataacgatggaaaatgggcaaacagcgaatacgatgctttgatcaaacagtccaagacgaccgatgcaaccaatgccaccgctcgttggaacaccttgttgaaagcacaggaactgctcaccaaggaacaaggcgttgtacctttgtatcaacgggttcaaacaaccttgcaacgtaagaccattaccggtttgaaatataacccgactaactcttacgattttgtaaatgccaaggttaagtaataaaagcgtgacctgtcttagcagctgttagacggatcaacgcgtttaggaatcttacagggtttcctaaatcggaacttgtttccaataagtagttctcacaagcggcgttgtcacgtgttttgcggcggacaacgccgtttgcttattagggccaatgcccaaaaaacaggagtgaatcatggtcaaatatattttaaaacggatcggcttcctgctcctgacactgtttcttgttgcgtcaatcaccttctttttaatgaaggcattgccagggacgccatttaataaccccaagattccggctgatcagctggaaattctgaagagacagtatggactggataagccggtttggatccaatatctcacgtatatggttggtatcacgcacggtgacttcgggatgtcttatcaatttccgggccaaacggtttccaatctgattgtttcccggctcggtccttcgctacagatcggtgcgcaggcgatggtgcttggaacacttatcgggattgtgcttggtgccattgcggcaattcgaaagaatacggccgttgatgccgaagctacaattttcgctattctgggacgttcaatccctaactttgtgtttgctgcgctattgcagttgtttgcttacaagacaggggcattcccggtagcgttatggggtgggttttcatatagtattttgccgaccattgccttggcgatcgccccgttggcacagacagcgcggtttatgcgaaccgagatggtggacgtgctgagctcggattatatcgagctagctcggtctaaaggtgaatcgcgctggcaggttgtggcaaaacatgctttgcgtaattccatgattccgattgtaacgattattgggccaatggcagttgacttgatggttggatcactggttgtcgaaaacatttttgccattcccggaatcggggaacaatttgtcaagtccatcacaacgaacgattatccggtcatcatgggcttaacgattctttacagtgcgatgttaacggttgtgatccttgtcgtcgatattctatacggcttcattgatccacgaattcgactgagcggggaggcaaactaatggcaacaacaaaattaagtccagaggcattcaagcgtgtcaaagtgaatgcggctgaacaagagcgtattgccacgcctgcgttgacattcacgcaagatgcgattcgccgcttaaagaaaaacaaggccgcggtcatttcactttgggtactgatcatcattggtgtgatctctatcgtgtcaatttggctatcaccagccaatccgaataaacagagtcttaattattctaatttaccgccaaagtggccaggcattgatttgccgggactaaacggctatatgaatggccaaaacaaatatgccggtatgggtaaaaacgtctatttcctgcttgggacggactaccttggccgtgatttgctgtctcggattatggtcggcacgcgcgtttcccttttcatcgggattgttgcaacattctttgatttaaccattggcgttttctacggcatcatctccggttggcgcggtggtttgaccgatacgttaatgcaacgtgtcattgaaatcatctctagtgtgccaaacttggttgttgttattctgatgctgctggtattcaaaccagggatgacttccattatcttagcgattgctttgactggctgggtcacgatggcacgactcattcgtgcgcagaccctgcagttaaaagatcaggagtttgtgctggctgccagaacgttaggtgagtcgagtattaagattgcctttaaacatctgatcccgaacctaagctcgatcatcattattcaaaccatgttcacgattccaacagcgattttctttgaagccttcctgagttacatcgggattggtttgccagcaccgactgctagtttagggacgctgttgtcagatgggcaaaagaacctgcaagtgctgccgtatcagttgttatacccagcgattgtcatcgttattctgatgctggcctttaacttgctggctgatggtttgcgcgatgcctttgatccgcgcagtgaacattaggaggtggcaaaatgagtaagattctcgaagtaaaagatttacaaatcgactttgccacctatgccggaccggtccacgcgattcgcaatgtcagctttgacttgaacaaaggcgagacgttggcgattgttggcgaatctggctctggtaaatcggtaaccgtgcgcacagtcatgggcttattggcacccaacgccaagattaccaatggtgaagttttgtttgatggcggtgacattctcaaaaagtcggaaaagcaattgaatgccatgcgcggaaatgatgttgccatgatttttcaggatccgatgacgtcattggatccgacgatgacgattggtaagcaagttgccgaaccgctgctgctgcataacaaaatgagcaaggccgatgcattgaaggaagctgaacgggtgcttgaactagtgggtatcaaaggcgccggttcacgattgaaagattatccacatcagttctctggcggccaacgtcaacggattgtcattgcgattgcgattattaaccatccgcaaattctgcttgcagatgaaccgaccacggcgctggatgtgactattcaagcgcaaattattcacatgctgaaggaaatccagtctaagattgatacctccattatctttatcacccacgatctcggcgttgttgccgggattgccgatcgggtggcagtcatgtacgcgggtaagattgtcgaatacggcaccgttgacgaaatcttttacaacgcgcagcatccatatacttggggactgctggaggcaatgccgaccttagagaccaaaacggatcgtctgtatgccattccggggacaccgccggatttgctggatccgccaaagggtgacgcatttgccccgcgcaatccgtatgccatggcaattgatcttgaagaagaaccaccattcttcaagatttcaccaacccacgctgcggctacttggttgttagcacaaggcgcacccaaagtcgagttaccgccagaaatcgcgcggcggcatgcattatgggcaagtaaacatccagacgaaaaggcggtgaactaacgtggcggacaatcaaaagaaaaaagtgttggtttcggtcaaacacctggttcaaacctttaatgccggaaagaaagacgaagtaaaggccattcaggatatttcgtttgatatctatgaaggcgaaacgctaggtctggttggtgaatccggttccgggaaaaccaccaccggccgggctatcattcgcttgtatgatccaaccagtggcgaaattctctataacggtcaagacattgccaaattgaaaaatggctccaaacaaatgttggattttcggcgtaatacgcagatgatttttcaggatccgtatgcttcattaaatccacggatgaaagtcaaagacattattgcagaaggtattgatattcatcatttggctaaagatcgcgccgaccgtgatcatcaagtcgaagctttattggatgaggttggtttaaatgcggatcatgccacgcgttacccgcatgaattctccggtggccagcgtcaaagaatcgggattgcccgggcactggcagttcagccgaagttcattattgccgatgaaccgatcagtgcgctggatgtttcgattcaggcacaggtcgtcaacttgctaaaagacattcaggatcggcaaggtctgacgtatctgttcatcgcccatgacttatctatggtcaagtatatttctgatcggattgccgttatgcattacgggcggcttgtcgaattggccagtgcggaagaagtatacacgcatcccctccatccatacaccaagagtctcttgtctgcaatcccggttccggatccagacatcgaacgccagcgtgtaccgataccttatgatgcaagcaaggtcgaaggcgataataagcaacgtaaaatggtcgaagtctatcctgatcactttatctttgcagctgacgatgaagtggcagcgtataaagctgaagcacaagaggatcataaggccccggcaggcacggcagcagaataacgcggtcaaacatgataacattctgttaaggcaactctttaaaaatgatccttacagcaaaaagccgaaaacactgaaaatgtgtcttcggctttttgtcatatccgcagtattgacgcaagaaaacggttcgaatagctaattctgatctttaagcttgtttaaactaggctgcgtttttatggtgaggtaacgttttcagcgaatcttctgctacactggttttaaaggagtgtgtggaaggatgaccaagttttattttgtgcgccatgggcagacggagaccaatttggcgcggcggttcaatggcgggcggacggatacgccgctgactccggctggccgggcaggcgcggaggcagttggacggtattttgctacgaccggttttgccggtatttacgccagtccgatgccgcgggcgcaaaccaccgctgaattgatcgtggcgcaaagcaaggtagcccagccggcgatcgtgacggtacgggatttacgggaagtcgatttaggcgattgggacgggcagccacttgcttccgtgcaagacgatccgcaaattgataattactatcaccatcttgctgagtttgattataagcggattggcgctgaatccttcgctgaggccttaaatcgtgggcgccgtgctattgccggcatttatcagcaacatccggatggtaaggtgctcgtggtggcccatggattgttgggcatgctgctaatgagcacttatctaggcgccgagttggacgatgcgcgtgatgagatgaccatgccgcctaacaacagcatcagtgaattggatacagacgacggggaacaatttacccgcggcacgctgtgggcttttgtaccaagtgaatatcaaaccaagtaacaatgccacccacccggcattgttttttattaaaaaaattatcaagccaatatttggcactttcgcaaggcgagcgcttacaatgatactgagaagtgaaatggttagttaatgtggggtcttgcaccggcgttgtgtgacaataggccgtctttggattattaaataatattataaaatcttttgatggtcggacgtttcatttaatgttaaagcataacgccgcacattagaggtggggaacatgatgttagataatatcggcaaattagtgcaccaacaacgccgcagtatgaacttaaccattgaaaaactggccgaacgctctggggtttcagtcagtctcatatcccgcatggagcgtggtgatgtcaacaatatcagcgtcaagaagctgactgacattgcgcgggcactcgacatgcaggtgggtgatttctttatcgccccggaaatgagcgatatcaatacgttggcgttggttaagtatttaacgcggttgccggaaaacgaacgcgcacacgtctccgaggtactcatgcaggtgattaatctctgagcgtgtcgtaggcgaacttgcggcggttgccaataagtgcaaaaacggttctagagacactttgtctttagagccgttttaatgttttcggaaaagttatacttgcggccaattagcggaatccggcgcgaattttgaaaatctgcatgtggttaagactgttcgcaggcagaaaaatcgcgtatactaagtgcgctgaattaaccgcaacgatgacacaggccttcgcgagtaacactgtgaacatgctgggtcatcttataaaggaggaaaagtgacaatgacatttgaagccgttttgccagcgctaaaagaaggcaaaaaagccgttcgtactggctgggaaggtaccgagttgtatgttcaactggttccggagggtaagttcgaaggcgacaccctgaatccttattttctgatcaaaaccgctgatgaggccttcagcttgtggtccccgaccgactgtgacattctggccgaagattggcagctcgtggacgtatgaaccggtttgattttagcggccagactgtggtcgtaaccggggcggcatcaggaattggggctgcgcaggcggcggcttttaaagcggccagcgcccaggtgattggtgtcgacttgcaaccaatgactagcgtgaccgtcgcaattcaggccgatgtgagcgatccagagacaggaaggaagcttgccgctgattatacgccggacattgtctgcaacacagcaggcattttggatggctataaaaccgttgccgaaaccgatttggctacatggcagcatattctcaacgtcgacctcaccagccaattcctgatgattaaggcactgctgccgggaatgctggcacgtggtcacggcgtcttcgtcaacatgagttccattgccggtttcgttagcggtggcggcggcgtagcgtatactgccgccaagcacgcggtcatcggcctaaccaagcaactggatctagactacgctgcccaaggtatccgcgccaacgcccttgcacccggcgccatcaacacgcccatgaacgcagcagatttcgccggtgatggtaaaatggccgcctgggtcgcaaaagaaacgccagccaaacgttgggccaagccggaagaagtcgcccaactcacacttttcctagccagtgacgcggccgactacatccacggcaccgtgattcctattgacggcggttggttggaaaagtaaactggaaacattgtaagaactattaactgaatcggaaccgccccgcgcgcttccacgacgatacttatttcctttgatcgtcgttattactggcaaagccacaaaggagaaacaatatgcaaacaacatctatgacccatcgttcaatcgtcagtctcgccaaaaccgccattgtcgccgccatctatgtggtgatgaccctcatgcttagtccattaagctttgggatcgttcaagtccggttctccgagatgctcaactacacggcgctcttcaatcgtcggtacgtctgggcggttacgttgggtgtttttttggccaatttagcctcaccaaccgccattctcgacgtccccatcggcacaatcggcaccttggccttcatcctgctcagtcgctggctcgctaagttcgtccaccaaaaatgggctaaatttgccatcatgggcgtcttatttgccctctcaatgtttaccgtcgccggtgagctggtcgtgctcagcaaggtaccattttggccaacatacggcaccattgcactaggcgaagctatttcaatggcggtcggtggcgctgtgatgatggtgctgacacggtttgtggacttggataagtgatttgtaagttaaattgcgaaagtctagtttttagactttcggatctgtgagcgtctcctcgatggtttgggggcgcttttttgatacgcttggttgcagctgatctatcgaaacgcaatgttgacaatagcgattggaggagatcgaaaaaagggatgatcgattaaccgcgaaagtctagtttttagactatcggattggacaagcgggttttcgactcttcgaagcatgcaaataaacaccgagtcagtgacctatgtaaaagaagccatcaaatcggtttttttttaacttggctggagcttttggtaccactgtagctttcaagtgatcctaacgcccaaaaacctacttcttatcaagtgtcttcatgacatccttggcaatcagcgtgtaataatgcacgcgtcctgcgtcattagggtgcacaccatcatcggcaaaccaatcatcgttaccgcccgccagataataccaatccaccacatgcagatttgcatgcgtcttagcagcggcgtgaatcaacttgttaaccggatcaatccaagccttcccaggggcataagctgtcacccagaaaacctggcgattactccccaactgatccaaaatgccattaatgtcagcttccgtcatcggtccattcgtccccagactaatgacaacggtatccttcaacttcccactcgacttcaactgatcaataatcgccggagccgcctgtacttgccggccaacctcagcatcaatcgacatctgcgggaaaagcaccttcaaataagccgaactccccaacatcaccgaatcaccaatggcagtcactggtaacgtcttggcggcactgatttcgctgtcggtcaggccataaaggcgatactgattcaaaaccttttctttcttaaccttagccttggaatctttcttaatcttctgacgcgtttgctgattaactgcgatcgcctgctcggattggaaatggcggaagtagaaataacctccaacaccggcaatgacgaggcccaaggcgatgcatagtatgatatcacgcaagcgtaagccgcttttattcttcatttctgacaaacctccaaaaattacatacccttattctaaactaaaattagtaaaaagctgattacaaattaaggtcattcaggcaggacttcatctggccggatttaaaattaaggtgcaccgccgttttggctagatcaattcaatgatacctttttaataaagtcggccatgaatacctattcttgaggcatcgaaacaacaagaaagatgataccatcatgacctaagaccggtttaacgacactgagcatgacacatcgactcactggcgaaagcgaagaagatattgcgacctttcatcacttcaattacgtacacgtttaggaagcacagacagttctccctgaatatctttgtagaagcgtgagaccggaactccgctgaggtctatccatggccccagagaggaggctgaagttttaaatcataaggtcgaaatcttagtttttaacaccggtaaactgttccttcttgattggtgttcattgttacacttcatttggcgagtggaagtacccaaaattgtaaagataatgtaataaaagttttacaaactgtaggtatggcttcatcaaggaagatggcaaggaaataagctgtcaccaagttaaggatgaattgcttaaagctaaaaagacgggtagacttgaaagcacaaactagggtattatgcttgggagtggaattttcaaagctctttttacatgaatgcagtagtattttgttgagaagttttgactagcttcacatgagtaggatgaattatataagatgggattaggtgggaagaattaatgaacgagcaaattgaccttgcacgactttggaacgtttttaagcacagttttattgtaatgattttactcgggctattggggatgtttattgcatatttcggtgcgaaaacatttattgccccaaaatattcggcttcaacctcaatgttggttaaccgaaagcaagacaacaatccaaatatgcagctaaatgctcaacaggctgacattcaaattattaatacatataaggacatcattacgcgaccggtaatattgagagaagttgctgatgatctcacgagcccaaggcgtgtcaaagtgaaaaaagcacaaaaagccgtctatggtacacgatataatgctgctaccggcgttcgtgaacgttatgtagttaaagaagagcaaccggcaaaatacaaattaaaaccagcaaagtacgcaaatatcagtgaagacgatctcgacaagatgatatctgtctccaacgctcagaattctcaagtttttaccgtgaatgttcgtgataccgatcctgtacgagcaaaggatgtcgccaacgagattgcaaaagtcttcaaagcaaaaattgcttcgattatgagcgtttcgaatgtttctattgtctcccgggcaacggcagatccgacccctgtcactcctaacctaaagatcgcttctttaattggtttaattttaggtatggttctagcatttactgtcggtctgattcgagaattaacagatcaaacaattaagagtattgattttataactaatgatctaggacttgtaaatctcggactggttaattatgtgcaacggatgaatgatatggatgaagctattgcacggtcaaagaataagattattgattctgaagccgaaccagaaacgacgggctttccgcaacgaagccggagacgcgtttaagtattgaggagaaaaaacatgaatttttcattagagaaaattttgcatagacataaagaagatcaagagactcaaaaaaatggtgttatgttggtgacatttgcagagcctaaacatgttgtatctgaacaatttcggactgtgcgaaccaacattgagtttgccggagcagcacttgatcaatgtcaagtcgtaatgtttacctcttcggcaatgtctgaaggtaaatctacagtttctgcgaacgttgcagttacatgggctcaggctgggaaaaaggtgttgctgatcgatgctgatttgcgtcggccaacggtacatgcgacatttagaactttaaatcttgatggtgtcacaacggtattaactggaaaagaaaagccggatgatgtagttgaagaaacgtttgtagacaacatgagcatcataacatctggaccggtaccaccgaatccttcagagttgcttaattcgaagcggatggctggtttgttagagtgggcgcgagaaaagtatgacattattgtactagatgctccgcctgttttggcagtttcggatgtgcaggtattggtacctaaaactgatggcgttgtagttgttgccaatatgggcaaaacgttaaagggagacttaaaacgtacggttgaagttctgaagttagccaacgcaaaaattctcggatcagtagagcgggtaaaggccaaacacggggacagaggatacggttacggttatggttatggatacgggaacgaatctaataaatagcatgcgcttctaactgtcaaaagtgattataagacctttttagatattggtgaaagcatatgttgctaactgataacattgtgtcaaccgaatggtgataagtacgaccataacagcgtgctactaaatattttgtttttggggaaagcatggcacgttgcaaaatatgctttcagtcgacttcacaagacagatttgataaagatataaccagagaagcttacaggaagtggttgcgaaggttaaaagccgatgctcctgctaataatttgctgctttttgatcaatgcagaaacagcagaagatagagagaattgggctgtattggagttcaatattggaaaaagtttagaaagatttaaaggggagcttctttaatggcaacacaaaagactaaaaagttgctggggaattcggctattttcgcggtgggaaatttaggtagtaaactcattactttcttaatggttccgcttttcacgaattacctttctactgagcaatttgggacagtcgatcttgctacgactactgtaaatatgttgtcaccaattgtcgctctgagcattgcggatgcggtttttagatttttgatggatgacgaatcagacgatcaagccatttttacaaccggattgacttttacaattacggtaagtctagttttattgtttctgtatccagtagttcgttttttccatattgctaatggtggctatatccttgtatacctcacacttgtaattctacaggcattgcttcagaattttatccgtgctatagaatatgtgaagttatttgcgtttaacggcattttttcgacattgataatggctgtgacgggatattatttaatagctgttttgaagcagggagtaaccgggtacttttgcgctttgatcttttcggcgttaagttccatttgcttaaccttttttggatcaagagggtggcgattcttttcagtaaagaagtttgatacctctatacttaggtctttattgaaatatagcattcctttgatacctaatgcgttcatgtggtttttcacaaatgatgctagccgtttttttatcgttgctattgtcgggctctctgcgaacgggctctatgcagttgctaataaaattccaacgattataaatgttctctacaatgtctttacacaggcgtggcaaatttcagcagtcgaagaataccaagaaaatcctagaagtagttttttttcggagatattgaatgcaaatatcgcattgtcaatgatatccttatcgggcattctgtttattctaaagcctttgatgcgtgtttttgtagctcctgacttttatgaatcatggaaactggtcccacttctgttgattgcagcagtgtttgcaaacttctcaagttttataggcactttatatttggcgacaaagagaactcgtgcaataatgagctcgacagtttttggtatgatttccaatgttctcttcaactcattactaataccgagttttggagttcaaggggctggcttgggagctatgctgggctttttattagttgctgcgattcgatataaagacatacaacgttatatttcgctaaaagcaaattttaatcagttattactttcattaataggaatcgtgttgatgattgatgtcaattatttcttgcagtggggagttacaagcgttgctcttttaagtttaatcactattatagaagtggtcgtaaacgttaaggcgttaaaggcgttaggaaaaggaaaaacaagatgagggttgtaatttctgttgtgctttatcgcacagaactgaagacaattgaaagaatcgtacgagaattcgaatatttggctcaccattcgacaaatgagttgacgcttttgttattggataatgggtctaaaattgcgtttactgattcttttctaaaaagaattgttagtgagaaaagtcatgttaaagttttaatttctgaagataatatgggctttgggggaggacataactttaattttcgggaagtagagtcagagtactttgttgtaatgaatcctgatataaagaatatcaacactcaggatttcgatgcagctattcaattcttaaacctgaatcctaaaattggacttttggtacctaaattaattaatccagacggtagtgtccagttaacaaataaactacaatctacagtttttgatcaagcaataaggcttttgggaaaaggagttttcaagcaacgccaactgaagtttgtacaggccagtactggatatagtcagattatgcctacttgtaatgcccatggtgcatttatggtttttagatcttcaatttttaagaaggtcggaggattcgatgaacgctattttctctacatggaggatactgacattacaatggcggtcaatacaattagcgagtcgatttactatccacgtttaacagttgaacatgaatggcaacaggcaaaccgaaagatttcgggaattcgtgaaatgataaaaagcatgtttaagtattacaacaagtggggatggaagttgttctaaagggggagtgtcaagatgcattatgtcatcgtcgattttgtagtaaggcaaaattctggagggatattatcaatattacaagatgtcaataaatttgcgcttgaacatacagaagaccgttttacgtttatagttgggacagatggtctgatcactacttcgccaaacataaaggttattttgcgccctgatttgcagcgtaactacataaaaagaatttttttcgatttctggagaggtgctggtgtcattaattctttaaaaccggatgtggttatttctctacagaataccgccgttcttggagttaatgctcctgaaatgttatatgtgcaccaacctctcccgttcgaaacaaattataaatttagcttctttaaaagctcggagaggaaaatggctttttaccaaagtttagtgggcagtgttatcaaattgaacttaaggagttttcataagggggcaatcacggtacaaactcactggatgttggaagaagtacagaagtacgctaaaacaccaatttttgtaacgcgaccatctattgataaaaatgatttcaaaggtcagattttaggaagtaaaggaagcaatttcttttttccgagtactgcaatggtttataagaaccatcgaaatctagttgacgcctatgaaatgctttctgacgaagtaaggcgtgaacatcacttaatatttacgatctctagaaaggaatacggtcgtttgtacgggcaagtacctgatgattcgaatattaagtttctaggaaggattcctcgggctaaggtaatcgaaattttaaatcatagtatattagtctttccttcaaaaattgaaactctcgggttaccgcttattgaagcaatgatattgcaaagacagattgttgctgcaaatatcagcccggtcactgaagtaactagtgagtacgattcgattagttactttgatcctgatgatgtgaagtctatttacaactctctattggccggaataagaatgaatccttctaggagaagctttaaagagacaaatgacaatggttggcaggcattcttttctaatgtagaggcattgaatcatgcaaaataggaatggcgcggtttgtgttgtatataagcccaatgtgtcccaacttataaagacaatcaaacattacgactcattctttgacgagctagttattgtagacaattctggtgggaataatattgaacttactgagcaagtgaagttgattagaaatgtaacatatataccgctgcatgcgaataaaggtataggtaaggcacaaaatatcggattagcggctttgtctgatcagattgcaacggtgtgttttttcgatcaggattcatgggcatccgagaaggatttacaaacattgttcacgctattttcggtaaaggctaaagaaaactatggtatgctagccttgtctgttcatcaaagctcggagaaggaagtaaaagtcgatgacgttgatgaggttattagttctggatcggcagttttaaaatctgtctttgacaagttgggtggatttgacgagaacctgtttattgattttgtagactatgagttttgctggcgaatgcgctcctcaggataccggataggagttattgaagggacacacttgcatcatcaaattgattccgagacaatacacaatcacactcggtctgcccccttccgtaactattatgtttttagaaatgcaattttactgttgaagcaaaaccgcgtatttactcgcaaaggatatattctgggactgatggcaaaaagagtagctttcgagcttctttttaacaataaccgaatgaaaagagtccgctttattgtaaaaggaataaacgatggcctaaagggaaagaatggtgagatgcttggataagcaagtctgtcgggtagctgtattaatgtctacttacaatggtgagaagtacgttgaatctcaggttcgcagtattgcacaccaggtagttcctagtaatgttcaggttagagtatatattcgtgatgatggttctacggatagaactttagagatcgttaaatcacttaaaaggcaattcaaggatctgattaccattatcaatgaaccggaggggaacgttggagtcaaagcatcctttttttctttattagtgtcacattcaataaatgctgattactactttttgagcgatcaagatgatatctgggatgaaaataagattgggatctttctttctaaattcgataaattgtcagataagaagccaattggagtttattcagacttatggatcgcggataaagatgcaaattcgactggcaaaaaaatgagccaagtctctcattggaaaaaaggagccattgattttaaattcttatcatttgattatcgagtagttggctgtgctttcgcgattaataatgccgctagagaactttttaagaacaacgttactgtaaacgtaattaaaagtgttaatatgcatgattcttttcttgcactgttgatcgccgcgtctggccagctttatcttatcgacaagccaaccgtcttttatagacagcacgaaggtaatgtgataggtgccattaaaaagaaggaaacgttggtccaaaaagttaacaaggcagttgcagtgccgggacaattagtgcatgataatgtttgtgtcggcgaaatcatcaaaaatgaaaagataacggttaacgatggcgtaatgccaattgtttctttgtataggaaatattatgatgcgggagctttccatgaacgcctgagttcggccatcaaggtatacaagttaatgcatcacagaagacgttggctgcacttaattcttatgatttttattcatactacagaatacactacgcaaccgtggataggaagtaaataatgttttttattattgcaaccatattattggctctttccttcttgaccaataaacttcagaaaacaatatcaattctggcactggctgttgatgcgtttttagtagcatatcctgctgttcgtcataatgctgattacaatctatataagttgagttacagccagcagttagacaactttgaaaagggttatacattcttggcaaagcttttctttaattggggagcttcgtatgagacttttcgagtgtatattgcatgcgcaactttcataattttcggaatagccatttttcgtctttcaaagaatccaagtctagttgtattagcttttaacgtgggattatttgctattgaagccattcaaattaggaatatgattatgttggcgcttgctttacttggattttcgatgctgaagcaagggcaattcgctaacatagttttgggctttctagtgcttgttattgctacatcttttcatactttggggtatttctttttattgggcggtattttattctttattccttgggataagttgattaagggattgaaagttgttgcaattgttagctttccagtttcgattttatttttaatttttggtgttcagtccattcaaagtgcattcggaacctttttatctattactggagcaagatctgatttctcatttgatcttgtttctgtgtataacaatggtattggttttaatgcctggctattaacagtctttattgtggccattttgctatttccgttttttcttaatagtccatcagtcaggaattttttgaacgatccaaaatcaaagaacgttttagttcctgcgtttttaagtgtgttttcggttgttttgactcttctttcttcagactatgtcagattagtccgtgacgcatctgtgttttcatacatagcttattcacaacttgtcgaaaagctaagttacaaacgtttcatcattttaatctatgtatttgttatagcctgttttgtcttctggcttcagaattttattatttatcctgaatctggcaggtacattgggtacactattgggctaatatccgattctgtttttcagtgaaagtggggagacactgtgaaaataaattttgttttacctggtaatgaagatgttgtggctggtgggtacaaggtgatttatcagtatgcaaatcaactagtgatgcgtggcaatgaagtggttatttcctttgtatattcaccaaggttttatcataataacttcgtgcgatccatgaagtttcttggtgcttcagccggcctttttcgaaagaataaagagcaagttacttggtatcctttaagtgataaaattattcttgatttcaacgttgtaactcccaagcatttaaaagatgctgatgtcttggtggcaacgggtgtagaaacaagttattttatagctaatgcgcccggaagcaaaggtaacaagttctatttcattcagaattacgagacgtgggttaatggcagggaatttgcagacaagagtttttgtcttggattacataatgtagtaattgccacgtggttgcagaaacttgtacagaatctgtccggaattaaacctccgattgttcccaattttttagagacaaagttttttagtcctaatacagaaatagagcatcgtggacatacggttgctctgctgaatcatgccgagccttctaaacggaccgcatttgggttacagattttggaaaaactgagaactaagattccggatcttgaagtgaacttatttggtgtatgggagatgccggaaaaattaccaacgtgggttcatacttttcgaaatccgagtcagctcactcttcgcgatgacatatatggtggatcatgtgtttatttattgcctagtttacttgagggatggagtttgaccgggatggaggcaatgataagtggggcagtagttgttgcttcagacataggtggagttaaagattatgtcattgataaccagactgggttgttagttaagccggataatctggatggttttgtgacagccattgagaatgttttttttgatgaagagttgcacaagaaattggttcgcaacggtgtgaacacaattttagcattaagtatagagcgttcgacgaccaagctttgtcaagtatttgaggaagtagggaaaaaataaaatgactgagagaattttggtttttgacacaagccagactagtgaaaatttaggagactatattattatggattccgtcaacaaggaattacacgatttgtttccagatgacttgttgattcgaacgacaactcacgatactgttgggaaatttgcttattcttggggaaatcgaacaaagttaaagtttcttggcggctccaatttactaagcggacgatttactggcagaaatgttgcgcaatggcgttttggatttcgagatgcccgaagattaaatgatatcgttggattagcattaggatggcaatcttatcgtgaatttacacgtttaattgatcaaccttttgtccttgcccaaaaaatgctttacaagaaatcattgagttcacattatctacattcggttcgtgattcttacactcaaaaaaaacttgaggaatatggatttcggtcaataaatacatcttgtgtgaccatgtggagacttgatactgaatctttaaagcagttaccgcttcgccagagtgataaagtcgttacgacaattacggactatcgaaataatggagaatacgtaaaagtttacgagaaaatgctagcgacacttttagagatgtataagcaggtttctttgtggattcaggctcctcctgacaaagatttaattgataaattgaatattaaggataaatcaagaattaagtttatcaatccgagtctggaagcttatgatgaagccttatccggagaggttgattacattggtactcgactgcatgcagggatacgagcactgcaacataaacgccgggcattaattgtcgaagtcgataatcgcgctacggaaattgcgaaagacacgaacctgccgaccttgccgatgaaggatattgataagttaaaagatatcatccaaaagccaaatccgattgatcttcaaattccttttgccgaaattgaacggtggaaacaacaatttgttttataaacgtgtgtataactgcataggttagtttaaagaatgttagttttaatgaagtcttttttgatatcttggtttatttggaactttttttaaatgatagggaaaagcaaactggtaatgatggctttgttggggtattgttttgttggtcatatgaatcaagtttgccgattgatgaggaggagtagcaaatgaaaggtataattttagccggtggatcaggaactcgcttgtatccaattacggaggccatctcaaaacagttggttcccgtttatgacaagccaatgatttattacccattgtcaacaatgatgttggcgggtattcgtgacattttggtgatttcaacaccgcgtgatattgatcgttttgaggatcttctaaaagatggtaaacaattggggcttaatatcagttacaaagtacaggacaaaccaaatggactggctgaagcctttattgttggtgcagactttattggggatgattctgtttgtcttattcttggcgataatatcttttatggcagcggcttgtccaagttggttcagcgctctgctgccaaaacaactggggcgacggtgtttggctatcaagtcaatgaccctgagcgttttggggtggtggcatttgacaagcaacaccatgtgcagtcgattgtagaaaaacctgagcatccagaaagcaactttgcggtcaccggtatgtatttctacgataatcaagtggtagagattgctaagaatcttaaaccatcaccacgaggcgaactagagattaccgatgtgaacaaagcgtatctcgaacgcggccaacttgatgttgagctgttgggtcgagggtttgcttggttagatactggcacccatgaatccttacatgaggcggctagttttattgagacagttcagaagcgacagaatcttaaaattgcctgtcttgaggaagtagcctaccgaatgggttacattgatcgtgatcaattacgcgaactggcacagccgctcaagaagaacgattacggccaatacattttgcgattagcagacgaagaagcataggaggcaaagacatttgagtttaaaagttattccaaccaaattaaaggatgttaagttagttgaaaccgatgtgttcggcgacaatcgcggttttttcacagaaacgtatacccgggaaaagtttgttgaagccggaattaaaaatgatttcaaccaagataatcagtcactgtcggccgaagccggggtcttacgcggcatgcattatcaaatggcaccttatgcgcagacgaagctggtgcgcgtggtgaccggggtcgttgaggatgtcttggtggatattcgcaaaggttcgccaacatatggtcactgggaaggttatatcctgagtcagtataatcatcgccaactcttggttcctaaggggttcgcgcatggcttcattactttgacgcccaatgttaactttgtttataaagttgagggttattatgcccctgaagctgatcgcggaatcgcgtttgatgatccggatattgggattgactggccgatgtcaacggcacatctgattatgtcggaaaaagatcagcatcatccgcaattaaaagatgccgagaataactttatttacggggagatttaaacatgaaacttatgattacaggcggggccggctttatcggctcaaactttgtccattttgtttataagaaccatccagatgttcagatcatggtcttggataagctgacctatgccggcaacaaagccaatatcgaagacgttttgggcgatcgggttaagttagtcgttggcgatattgcggacaaagaactggtcgatcaattgatgggtcaagtggacacggtggttaactttgcggctgaaagtcataatgataactcactgattaatccggatccgttcttacacagtaacgtgattggcacctatactttgttggaagcggcccgtaagtatgatgttcgcttccaccacatctcaaccgatgaagtttatggtgatttaccgttacgtgaagatctccccggccatggtgaaggccccggtgaaaagttcactgtcaacagtcgttataacccttcaagcccttattcttctaccaaggcggccagtgacatgcttgttcatgcgtgggcacgttcttttggcgttcgggcgaccatctctaattgctccaataactatggaccctatcaacatattgaaaagttcattccgcgacaaatcaccaatatcttgagtggcattaagccaaaactttatggcaccggtaagaatgtccgtgactggattcacaccaatgatcattccagcgccatctgggatattttgaccaaaggcaagattggcgaaacttacttaatcggggctaatggcgaacaggataacaagaccgttctcgaattgatcttgaagctcatgggcaaaccgactgactattatgatcaagtcaaagatcgcccgggccatgatatgcgttatgccattgacgcctccaagactcgcgaagagttaggctggaaacctcaatataccgactttgaagaaggcttggcggacaccattaagtggtataccgaccatcgtagttggtggcaagatgaaaagtcagcagttgaagcgaaatacaaaaagaatggtcaataaatcgaactcaacttcaattagttgaacctaccaatttttaaaatgttgaggagaagataaatgaaaattttgattaccggcgcacaaggccaacttggtacagaactacgccacttattggatgcacgcggcatgacgtatcgggcgactgacgccaaagatctggatattaccgatgaagccgccgttaatcagtattttgcggactatcagcctgaggtagtgtatcactgtgctgcctatacagccgttgataaagccgaagacgaggcaaaggctatcaatcagctggtgaacgttgacggtactcgtaatctggctaaagctgcggagaaggtcgatgcgaccttagtttacatcagtactgattacgtatttgatggcgacagcaaggaaatttatacagttaacgatcaacctgcgccacgcaatgaatatggacgggcaaaatacgaaggcgaacagcaagtgcaaaagtaccttaagaagtactacattattcgtacttcttgggtatttggtgaatatggtcacaacttcgtctacacgatgttgaacctcgccaaaacgcataaggaattgaccgtggtggacgatcaatatggccgtccatcatggaccaaaacgctggccgagtttatgacctttgccgttgataagcgtttagattacggaatctatcatctatccaatgataacagctgtaattggtatgaatttgccagtgctattttggcggataaagacgttacggttaagccggtatcgtcaaaggaatacccacaaaaagcatggcggccccgccattcgattttggatttaagtaagacgaaggccaccgggtttgagattccaacgtggcaagacgctttaaagaatttcttgaaaagtatagacaaataatgatcatcataaaaatgtcaatttgccattttgggtaaaaaagatatttagattgtccaaagcatttggccagttttatcctccatatgataagaatgtaaatgataagtagagacaattttattattgcgtcttgtgagtcttctagcatatgtctagtttttggagcttgtttgttggacaatgctaatctttcggatagcttgatctgcactgtactaagtggagatggtctataatgacccggattttaaacccgggttttaaactttattcgtttgtaagatagcatgtcacttgaaacggtgatgtaaacaatacgaatttttaagccactattaaaaaaagccgacaaaatccggttttccgttgtattttgtcggctttttgggttctaaattgaccgtagatagtgtttaggcacccatgaaattgtatatgatcggcacaaaaacaactgtataataattatgctattgactaatgaggcaattccaatataatcagaactgtataaatcattaattagggcaacttgagcagttttgttgtatttcttgaaagtagaactgtttatgggtaaaaattaacagtgaagattaggcatgaattgcagccttatgctctgttgctcggatgtacgatttttatgctgagttaaagttgacattttgtaatagtcggattgttctttatctaatgagatttcacactggttagtgtacaaattaaggttgctactacattaggaatgttataagattacttgaacagagaatttggggaaactttacttatatgattgccaaatattggaggggtaaatttggagactgcatctaagcacagacaaactaccgttgaacaagttgatcttggggggttaacaccgacatatctagtaactaaacgttgtttcgatttcttagccagttttgttggtcttgttctgcttagtggtgtttttttaattttgtccattctgatcaaaatagatgatccgcacgggaaaattttttattcgcagacaagaatgggaaaagatggtaggacgtttaaaatgtggaagtttcgatccatggtaactggagcggacaagatggtcgacaaattacttaaaaagaatgacgttgagggggcaatgtttaaaattaagcatgatccgcgaattacgcgtgttggacgagtcattcgaaaatacagccttgatgaactgccacaattatataatgttcttcgtggtgatatgagtttggttggaccaagacctccgttgccacgtgaagtcgtcaagtatacagattatgatcgtcaacggttagcagttgttcctggtgttacgggattgtggcaggtttcgggacgaaacgaattaagttttgatgaaatggtcaggttggacattcagtacatcaacaatgcgtgtgttactgaagatcttcgaattttattcaaaactgttcttgttgtcgttcatccaactggagcctattaaagaagcatttttcatcaactgtattggcttgtctttaagcggatttgaaacgatgacttcgctatagacagtcttgaagaataagtttatctttaggggcggctctccttttgggtgggccgtcttttttagtgcgtctggcatgggcggcaaactagaagcagagattttgaagccggggttaggatcgttttaggaaccggattagatgttgatgccatcgtgtggggtgtggaagtgtcgatcctagatagccacccagcacgccatacaatggttctaactgtcagtagttgtcattatttgggagccaaagctggcggcgatcgtgtggcgcaatttaggcagcgatggcgttgcttgtgaagattaatgatcgttgatgcgcctctgtcgtttcgaatatgggcatgaacgatatagaagccattaggtgcaagagattaaatgcgcacagttggacaatctttcagctgataggttagatcgtcactgatgacgtagatcttcctgttttgcgagcctttaccacgataattgtcatgaacaaaagaaacatggatgtttgaggctggtatttcaaaaacgaacagtggagatttatagttggacatttattcatactttacttactttggtttagttcagtagctaataagcgtgacatagaatactgagtaggtgtttttttacggtatcgggaaaaggcccacattttcattgtcgataaatatccaacatcaaaaagtatagacccaaaaaactacggcacgaattgattaattttccatcaattcatgccgtagacttttatgtcctttactttgcatctaacgcattttggataacatcatgtgcccttgtaagttctttatcagacatcacttcataatcttgcccatcaatattctgaccagtaccatgcaactgatcactcttgatcgtattgccagcatcacggtaatcggttgccaagttcttaaccgaccctagcgaaacatcagtccgaacattcttcccaacagcatcgaggaacttctgactcaacacagtcgttggattcttcttaagcttaccgataacagacgtcaaaatgagctgttgccgcatctgacggccataatccccttgaggatcgtcataccgcatccgcgagaacttcaaggcgtcactgccgtttaagtcatatgactgacccttaacaaatgatttgccttcatagtcaaagcttaatggcgaggttactgtgacgccaccaacggcatctaccatctgttctaggcctttcatgttgacgagcaggtaaccatccaatttgatgtttaacagcttctcaacggcttccatggcggtgtcagaggaaccgtaagaataggctgcgttgattttgattgtgacgtcatcaaaatcgactttggtgtcacgtgggactgagaccatggtggttgtttttgatttggggttgagtaccatcacgatcatggtgtcggtacggcctttgtaggagcggccaagttcgcctgtgtctgtaccgagcagtaagtatgcgaccggctttttgctggtggttttatcatcggaagatttgtttgtcttcttattataggaatatatttgcgatgtcgagttgtgaaccatgtagtacacgaagccgccaaaccccagcgcagcaacgagtacgacgagtagaacgcgtactaggatctttttcatctttaaacctcatttcctccgtaatctttgcatattataccgcaaagtctgccagctcgctgatctattgtgaaacgttaacaaactgttacaaaaaaatttgaccttgggagcgcttcattagatacttagatagtattggaaggggaactgaatgatgattgatgtgcattgccatatgttaccgggaattgatgatggttcaaaagacttaaccacgtcgcttgaattggcacaggcggcggtggctgatgggattacgcatgcgttgatgacgccgcaccatatgaatggccggtatacgaatcatgcgactgacgtgattcggatgacagatgagtttcaagacgagttagaccgccgcaatattccactgacggttttcccgtgtcaggaagtgcggattaatgggcagttgttagaagcaattgaccataacgacattctgacttgtgacgtgagcgggcattatgtgttaattgaatttccgtctgacgatgtgccgctttatacccaaaatatgttgtttgaagtgatgcagcgtggcatgattccggtcattgtccatcctgaacggaatacccgactgatgaagcatcccggtttgctttatcagatggttgagcgcggagcttttgcacaggtgacggctagtagctatgtgggcacttttgggaaaaaggtacaacaattttccgaagacattatcgatgcggggttagcacatgtctttgcctctgatgcccatcacttaccgggtcgcagttatgagatgagtgcagcgttcaagcggttgactcgtaagcgtggcgaaaagaaagctcggatttttgaggaaaatgcccgggccttggttaatggggatccgttagtgcggtttaatgagcgtaaggttgaaaagcgtttgttgtcgcggtattaatcaactgagaaacgccttgcctgacttagcgtgagaaaaaattagcactcgggttgtgcgagtgctaatttcatgctataatacattatgtaaacaaggaaaaggcgcaacagtatcagtgccaacaagtgaataagcacgacacgaaagtactgtcagagcgcctgggagtgctttttttgtagagcgtgaacagggccgcttagaaaccggagtgtaagtggccttggatgtgctggtcgggttttgaccagtgcatccaaggtccttacacgcaggtttctggccctgcgaacgcgtttaggaaagcagcaaggatcttgttcatcctaacatgctccccgccaccaccgctttttccccgcatattcccaacaaggaggaattcaactatggcaaactttaacgatccgtttttcaatcatgacatggacgatgtattcaatcagatgcttcaaggaatgggtaaaggcgagtcagcccgttatgtggtgaatggccacgaaatgacgccggatgaatttgcgcagtatcgtgcgaccggccagctgccaaagcaaggcgatgaaatcccggttgaaacgactggcgaacaagccgtcaagaaaggcggtattcttgaaaagcttggccgcaacctgacgcaagaagccaaggatggtctgcttgatccggtgattggccgtgatcacgaaattcaggaaactgccgaaattttgagtcggcggacgaagaataatccaattttggtcggtgacgccggtgtcggcaagaccgcggtggttgaaggcttggcacaagcgattgtgaagggcaatgtacctgaatcaattaaagacaagcagatttggtcgattgatctgtcgaatctggaagcaggcacgcaatatcgtggcagctttgaagaaaagattcagaatctgatcaaagaagtgaaagctgctggcaatgtgattctgttctttgatgaaatccatcaaattcttggcgccggtgcaactggtggcgaagagtctggcggtaaggggctcgcggatattatcaagccggctttgtcgcgtggtgaaatcactgtgatcggtgcgacgacgcaggatgaatatcgcaataccattatgaaggacagcgccttggcacgtcggtttaacgatgtcacgatcaatgaaccgagtgctgccgacacagtcaagattctggaaggcgtcaagaagctttacgaacagcatcatcacgttcagttaccggaaaatgttttgaaggcggcggtggattacagtattcaatatattccacagcgctccttgccggataaagcaattgacctcattgatatgaccgcggcacacttagccagcaagcatccgattgttgacaaggtggaactggaaaagcaaatcaaggatctcaacgcgcaaaaggatgcagcggcaaaagctgaagattttgaaaaagctgccaaccttaagaaggagattgccgacaagcaacatcagcttgaaggaacgaacaacgagaagcctgtcgtcgcaaccccgaatgatgtcgctgcagctgttgaacgtttgactggcattccggtttccaagctgggtgcatccgatattgaacggctgaaaggcattggtaagcgcctgaagggtaaggtaattggccaagacgaagccgttgatatggttgcccgcgctattcgccggaaccgggctggctttgatgaaggtaaccgcccaattggcagcttcctgtttgttggaccaaccggtgtcgggaagactgaattagctaagcagttggcgttagatcttttcggcagtaaagatgcgatcatccggttagatatgtccgaatatagcgatcgtacagcggtatccaaactgattggcaccagcgcaggctatgttggctacaatgacaacaagaacacgctgacagagcaagtacggcgcaatccttattccatcgtcttactcgatgaaatcgaaaaggctgatccacaagtcttgacgctgttgctgcaagtcttagacgatggtcggttaacagatggccaaggtaatgtcgttgactttaagaataccgtcatcattgccacttccaatgctgggtttggcaatgaagcattaactggcgagaaggagaaggacgaagatttgatgaaacggttggcgccttacttccgtcctgaatttctgaaccggtttaacgggattgttgaattcagtcacttaaccaagaatgatttgggtaagatcgttgacttgatgcttgaagacgtcaacaagactttggcgaagaaaggcatcacgctcaccgtgacggatgcagccaaagattggttgattgcccaaggttacgatgaagcgatgggtgcacgaccattacggcgggtcattgaacgcaacatccgcgataaggttaccgacttctacctggatcacctgaaggctaagaagttacaggctgacttgattgatggtgcgattatcgtcagtgaagtgcaaccagcaagcgacaagccaaagaaagaagctagcggtgcgaagtaatgcgcacagcggccgtcaagcgaaaaaaatcgtttggcggccgctttttttgctttgaaaaagtagtataataaaatttgaaataaattgcgcccgtctgttttgcccacaacttttagaacgatcagcatgaaggcttattaaaagacaatttatcgccagtattttatatgtcagattatggtgaaaatatttgaatattagtaatcgaaaattaatttttcaaaaattgttattgaaagcggtataagcttgtgctaaatttaaagagaaccaaccgctgatatgaaactgatgtatcagattttatgctaaaaattcacaaacttatattgacttaatttggctgtaaatgctgttatttattgttggtgagacttaagctttataataaccgttcatcacttaactgctagatgtgctttggcctgatattgatgagtcataaccagagtggtcactgtgtaaacgcttatttattgtcatatgagtctcgttgtgttaagttatcattaagataataaaaaagtgtcttgggtgaatcaatataagccggtgaatgttgttagcaacgagcatgtgggtggtattagctaggaaacgatagaaatatactgttgtttctgcgaggggtgattggatgattaagttgtatacgtcgggttcttcgaaatcaagtcgagaggctcgggcatggttagaagccaatgggttgccatttcaggaaatttcgttgtcaaagcaaggtatcagcaaggagcagattcttgagctcttggcgcggtcggaggatggcgttgatagtttagtctcgcgccgatctaaggcatttcaggcacttgacattgatttcgatgcgctatcactaaagcaggcggttgatttgttggcagaaaaaccggctatcctgcgccgtccgatcattgtggatgaacgccgactgttgtttgggtttaatcaagactctgtccgggtctttttaccacgtgaagtccggcggcaaaagctttggacggctttgttaaatacatcgagtgtgtgaagtgtgccaaccagcgtcacatgcggtgcttgaccaccattaacgatacagaatatcgttaatggtggtttttttagtggtatgaataacagtcaataaggaatcttggttggtatagtttttagcctgttatggcagaaaggcagcgccaacttgtgcgtccatcaagttgcaaagcacgctgagggttagcagatatttataattttcttggaaaatgttgaaaccgtatacaaagactgaaattatgctatcatattgccatgagtcaaaaattggtctatgcgaaagggagctgcatcatggatttgtacagtgaattgacggccaagtatcaaacggttccggccattgccaccgagattatcaacctggaggcaattttaaacctgcctaagccgactgaggcatttatgagtgatattcacggggaatataatgcgtttcagcatgttctgcgcaatggcagcggtaatgtgaagagcaagatccgttcatgttttcgggatgagatgaccgagacgactttgcagcggtttgcttttttggtgtattacccgtcggaacggttggctgcgattcatcaggaattgcaaggggatgatttgcagcagtggtatctgaccacttttcgccggttgattcgcttgctggcgtttaccgcgactaaatatacgcgttcgaaagtgcgtaaggcgatggcgccggagtttgtttatattaccgaagagctactgtataacgatgcggacacgcctgataagctggcttattattggcagattattcgtaacttgattgttttggagcaggccgatgagtggattgaggcgacgtgtcggacgattcagcggctgacggtcgatcattttcacattgtgggcgatatttatgatcggggaccggcgccagatcaggtagtcgagagtttgatcaagcgtgatcagcggcattcggtggatattcagtggggcaatcatgatattttatggatcggtggtgcagctggttcggcactatgcattgccaatctggttcggatttcagcccggtataacaatctaagcattcttgaagatgtttatgggattaatttgcgccatttagcacgcttggcggaacaatattatcaggataatccggccttttcgcctaaaatggggcgctcggatcgaccaattaccgaggcggaacggttacaaatcacccagattcatcaggcaattgccatgattcagttcaaacttgaaggcccggccatcaagcggcgtccggaatttgaaatggatcatcggttgctgctggataagttagctgcggatttttccacgattcagctgaacgggcatacttatcccatcaccaatggctgttttgcgacggttgacccggctgatccttatcgacttttggaggaggagcaagaggttattgattccttagtcgagtccttcactcattcggaaaagttgcatcgccatatggactttttgatggatcgcggcagtatgtatctgcggtataatcgcaatttgctgttacacgggtgcgtgccggttgatgaagatggcaatttcattggtttaacgattgaaggcacgacttatacaggccggcagttgtttgacatgctggaagccaatttgcgcctcgcttacagtcagcccacggaaaaggcggatttggcgactgacctgttgtggtatctgtggaccggtccgaattcacccctttttggcaagcacgacatgaccacatttgagcggtactttatcaaggatccggcgacccatgcagaaggccgtaatgcttattatcacctgcgcaaggatcctgatttcatcaaaaagattctgcgtgagtttgtgcttgatccggaagtcggtcacgtgattaatggtcatacgccggttaaaaaaggaaccgatccaatcatggcgaataacaaaatgattgtcattgacggcggattttcaaagccttaccaaaaaacaaccgggattggcgggtataccctgctggataattcttatggcatgcagctggtcacccatcagccgtttacgaccaaggccgatgcgattgccaatttaactgacattatttccactcgccgcgttgttgaaaccgaagcccggcgccgtaccgtggcagaaaccgatattggcaccgcgctgcaggctgaggtggaggtgttaaaacgacgccttgctgagttacgaaatggtgactaaccacggttttaaaatgagcgttgtttgtcagcaagcattttatcccgtatagttattaacataataagttagaaacatggataaccatagaaagggtggcttgatgcaaaaaacgatgcgacatccggtgctgaaatggctgtggatcatggcggcgcttgcgcttattgcggtgagtatcaatatgttttacgccccgcatgcagtggctgctggtggcgcaaccgggatcgcgattctggttcaggaagtggccgggattcaagttggcttaaccaccatggctgttaatctgctgatgctagggctagcatggtttttcctcgatcgcagcaccttaaaacgcattctttttggcagtttcatgctgccattacttttgtggatcacgcctgagattaaccttgtgaccgatcggctattggccattattgtcgggagtgtggtatttgcttttggggtcggcttgctttaccaaatggatgcttccagcggtggaacgacggtaccgccgctaattttcaagaaatattttggtttgaagccgtctgttatgttactgatcacggatgtcatcgtttcgctcttcaatattccggtgtcaggtgttgaggccttcattcttgctgtatttgcactcacgatcacgagtctggtcatgaattatgtcgaaaccggctttgaccgtaaaaaagccgtttacatcatgagcgatcagctggatatgttgaaacagcggattcgtgacgaaacgccacacgggttaacggtacaaccggttgtcggcggcttttcagatgaaaacagggagatgttgatggtcgtcgttgagcaaagtgatttccggcgcctgattgaactgattcatggtattgatcccgatgcctttattctgaccgtagccgcgactgaagttcatggcggtagtatttgagttgctaatcggtttttcgaatttttaaagattaaacatcatgataaattgctcagtgacgatatttgttcactgggcgtttttttgttgaaatgacggggataaacgagctgagtaaggcctaaaaataacaatatttataaaacaccgcaaaccaacttttaaaaagatttctttgataatttggccttaaaaaaccaaaaccgcttattatcaagtattatcctgattataaataacaaaagtgactttttaaaagtaagcatatttgtttacctacttcattaaattgtgcataatctaaatcaagagatggccatctcgaagttaatagtgtggtaagtcattttgcaatatggactgggggagtctatatgtttcgcagaagtctgatcactttcgctcttgtattgggcgggctgtttggtacgaccacagtcagtcatacaattcagagccgagacttggccggattgcgcaccagcacaagggagaaagctaatgatgtaagcacatcgagcgatttactcagagcaaccgctgcggtgacgccagaaaaagttcaggcggcagcgcatcctagttggagtgttcgctcaggtcaagcagtcgttaaatcgtctgacccggcatcatccggccagacaaaagtaagtcaaccaagtgctgttagcgcgtcggcaaccaatcagaccggttcatcaacaagttccgctgcgtcagcttcaaatgcgtcagccggaaccgcaaccgctggcacatcgaccgcgcaatttaccgttgcggcggcaccggctaaaaccgcgtcggccgccacgaatcaaacggcaaaccaaccaaccgctcagccgcaagcacaaccggcgaaaccggcagcggcatatgcgagtcgggtattaatgtttgccggggtcaccgttccgtacattattggtaatgaaagtatggacgccgcgccaataaacggtgccgcaacttggggcggtcaggcaaattacagcaacgtcagcgggcagaatacgcactttatcgggcataatcccggtgcgtttgctgcgatgctttcgcttggtatcggttcgccaattacggtgaccgatgccgccggaagtccgcgcacgtatcacgtttatcggttagttcaggtttcgcctgaagccgttacagctgacggtcaggatctttggaacgaaattaccggtacaggtggtggtcagcgcattacgctccagacttgtgttggtgattattggcgcttaattgcctttgctcgctaacaggtgtgaatcgaaattgtcagtttgtttggatgagttttagaagaaagatcgcgatatccatggcaatacaaaagcagctgccagcgcatgaagatgcgttgacagctgcttttaatttgcagtttgaaatcggtgcgtgacgtttgctttaatcaacgggtacattgacaatccagccgtctggtgcagggacgtcgccaaactgaatacccgtgagttcgttataaatcgcctgagtatgtgggccgacctcggtttcggaatagaagacatgttcgtgatcgttgtatgtgatgctggcgataggcgtaatgaccgctgcagttccgcacgcgcctgcttcaccaaactgatctaaatcggtgatggcaatcttggtttcttcggttttcatgccgaagcgatcatgtgccaacgccaagattgagtatttggtaatacttggcagaatcgaaggggatttcggtgttttaagggttttaccgtccttagagataccgaaaaagttagctgaacccacttcttcaatatatttatgttcgatcgggtcaaggtaaatcgcatcgccataaccatgttcgtgggcaaactttccggcttgtagcgaggccgcatagttaccaccgactttagcctgaccggtgccgtagtgagcagcacggtcatgttgatcggccaccacaaacttggttggcaccatgccgcctttaaagtaaggaccaaccggcatcgcgaaaacatcaaagatatattctttggcgggggcaacgccaatattagggccaacgccgattaacatgggacgtaagtataaagttgcgccggtgccatatggcggtacgtattcatggttagcggcaacgacttgtttgaccgcctcaatgaagcgatcttcaggaaacggtggcattaaaagtttttctgctgagttgtgcagacggtgggcattttgatccggacgaaaaagctgaatggctcctgatttggtgcgataagccttgagtccttcaaaagcaccttgcccataatgtaaaattggcgaaccttcattcaaagttaaattgggatcgcttgataaggtgccgtcatcccaagcgccgtctttccagtgggcaacataccgataaggcagttgcatgtaatcaaatcctagattgttccaatcaatatcgacgctcatcgtcatccctccagtggttggttgcaattgccaaaacacaaacttgcctagtaccggaatcggtttagtctaacattgtgttttcattaaataatatagctcttatgttagattattctcacaaataactcaaccggaaaaattgtatttactgttaatattttcggaaagcggttacaattaacggcgaggaggattatattcctcttggaagtaagggtggtcagatttaaaaaaagtgatccggtgagcgtttcttgagccttttcatggttgtgctgttacacttgtggcggaaggaaatattcgtgatgcttgaaccacatgcaacgagtcggatgatgtgattgggggagtgatcatgatccaaggattaaaagattggttatacctcttcaactcagggcaggattttcaaagttacaatcggtttggtgcccatgaagtttcacctggcaaatggtcgtttctcgtctgggcgccacatgcacaacagattaaagttgtcggcgattttaacgattggcgcggcagtccgctgacccggcaaggagaaaccggctgttggtacggcgaactcgcagccaagaaaggacagttgtataagtaccaggtggtcagtccggatggggccacacatgaaaagattgatccatatgggtttggatttgaacgtaagccaggcagcgctgcccgactggttgatattccgcgaatcaaatggcatgacggttcgtggctaagcaagcgtagtaagtggcgaccgtatgatgaacccttggcaatttatgaagtacacttaggttcttttatccgcgatacacatgccggtccggatggcgggtatatgacctatcaggatgcgattgataagctgattccttacgtcaaggaactgggttatacccatattgagtttctgccgttgatggagcacccgcttgacgcttcatggggctatcagctgatgggctactttgccccgacaagccggtttggcgacccggcagattttctgagattggtggatgccgctcacgtcgccgggctgggcatcatcatggattgggtgccagggcatttcattaagaataccgatatgctcgctcaattcgatggtaccccgacgtttgaatacaccgatccgcaccgcgccgaaaatgttcgctggggaacctggaattttgatttaggcaaagcacaagtgcaaagctttctgatttccagcgcgatgtactggcttgatcattgtcatcttgatgggctgcgcgttgatgcggtctcgaatatgctgtacatggattatgacgccggcaaagaaaatgatcgcaatcggtttggcggccgcgataatcttgagggcattgcctttttgaagcagctgaatacgaaggtgtttgccaagcatccggatgtcttgatgatggccgaggaaagttcagcctatcctaaggtgtccgcgccgattaataccggtggcctagggttcaattacaaatggaacatgggctggatgaacgatacgctgaagttctttgaagaagatccggtttatcgccacagtgatatgaatttattgacgttttcatttatgtatatgtataacgaacaattcgttttgccattttcccacgatgaagtcgttcacgggaagaagagcctgatgcacaagatgccgggcgatcggtacaaccagtttgccaatctacgcaccatgtacgtgtggcaaatgacgtttccggggaaaaagctattattcatgggcagtgagtggggtcaattccttgaatggcgtgactggagcgagcttgagtgggttgatttgaaagacccgatgaaccataaaatgcaaacttttacgaaaacgctgaatcatatctatacaaaccgaccgagtctgtggcaacaggatcatgaaccacttggcactaagatcacaatggcggatgaaccggatgtcatgagttacatccgttatggcaagcaaaaagatgacttcacggtggtcgcgttaaattttgtcccggtgcaaaaagaccacttccgcgtgccagtcccaagcttgggcacgtacacgattcttttgaatacggaaaaccttgactttggcggtacctggaccaaatggcaggcgactttaaccgcccgactaggtgatcattacggcgagccggcttggttagatgtgattttgccagcaatgggcgcgttactaattgttcccaaaaaactgcagccgttgcctaaaaagttggcgactgagcaccaccagcggccagccgcactttccggaaagcagccgccactggcaatttcaaatcaggaacgaccggccatcagtcatcaacgcgactgggggacggcgcctgcccgaacgcaaccggtgaaaaaagacctgattgttaagaagcataagaagaagtgaggggggaaggcgcaagttgcgccgtcatcatgagtactgaaatgttaggtatcattctcgctgggggtcaaggcacacggttgggtaaactaaccaaaaccactgccaagccctcggtaccttttggaggtcgctatcggattattgatttcaccttaagtaacttggctaattcaggggtgaatacggcaggtgtcattacccagtatcaaccgcttgaattgaatcggcatattcaaaacggggcgagctggggactcaacgagcgtggtgccggggttacgattctgcaaccatacgcgtcaagtgaaggcgaaaagttctttgaaggtaccgcgcatgcgatttatcaaaatattgcgtatatcgattcttataatccgcaatatctactgattctatccggtgatcatatttacaaaatggattatcaggccatgttggattaccacaaggccaaaaaagcctcgttgaccgtggcggttatgccggttgccaaagatgaagccaagcggtttgggattatgaacaccgatgacacggatcggattattgaatttgaagaaaagccggctaagcctaagagcaacttggcttcaatggggatttacattttcaactggccaacccttaaacagtatttgactgaaagctatgcaaccgatggggcgatggaagacttcgggcacgatgtcatcccagcctacctgacccataacgaagccagctatgcgtatgcgttccgtggttattggaaagatgtcgggacgattcagagtctgtgggaagccaacatggaattcttgaatccgaataatccattgaacatcggcaatcgcaattggcggattttcagccagaatgaagctttgccgccaatgtttttaaccaagaccgccaaagtgtcaggctccatgattgtggatggctgctatgttgccggtgccattgaacacagtatcctgagccagaatgtcaagattggcgaaggttccgtgatcaaagacagcatgatcatgccaaacgccgtgatcggcaagaatgtcactgtggatcatgccattgttggcgaaaatgcgatcattggggataacggtaaggtgatcggcaaaccggacgaaattagtgttgttggttatggggaagttctaggaaggactgaaaaagaatgagaaaaggcgatttagcagcaatcattgatctgaatgaaaaagatgaccaaattcagccattgacagcagcccgcccgattggaacgctgccatttgctgggcgttatcgtctcattgattttccgctgtcgtcattggatcatgcaaatgtacgcagtgtggcgattttcctgcccaagtcgggtcgtagtgtcacggatcatatccgcagcggctcaacctggaatatggaccagataacaggtggtgttttcacgtatccgtacatggctggccgcgattatgaagatccgcagctgcgggcacggtattttgacgattatcttcagtttctgcgtaaaagcagcgctcaatataccattatcatgggaacccaaaatgtcgccaatgtcgatattgatgcgattgtggcctaccatcaagctggtgaaagtccggtaacggcggtgtataagaatctgccggaagctgccatgcaaccggaagatctgactttggatatgaccgaattgggaaccgcaagctcggttgttccggccgcggagaatcggggacaccttaaagaaggcaagattccggcgttcatggatatttacctgatcggcacgattgacttgatcgatttgctcaccgatgcttcggaagcgccgacttttaaacgtctgccacagattatgcgggaagcggttttgcaaaacaatgccaacgcgtttgaatataccggctttttggccaaactcaatacgatcaagcgttactttgacgccaacatgagcatgttagaagaccaaaactaccaagctttgttatatagtgctaactcgatttaaaccaagaacaagaacgaaatcccgacatttttctcaaccgaatcccatgttgccaacagtttgttagggaccggtgattttattgaaggggaagtcaatcactcgattcttttccggaatgtgcatattcatcgcgatgccttggtggatcacagtattgtgatgcaaggcaccaagatcgggaccggttccagcgtgaaatacgcaattttagacaaaggtgttatcattggaccgaatctggctttggaaggcacaccggaagaaccattagtgtttgccaagaatcagaaagtttttcaaccagatggccagggggtgacggcccgtgcttaaagtactttttaccgcagccgaaagcgcgccgttttataaaaccgggggcttaggcgatgtcacctatgcattgcctaaagccattaagaaacaaggcgttgacattcgggtggcaattcctttttacgaacgcaaatttccagcgaagtatttgcctaaagtcaaaaatctgactcattttacgattgaaataggcggacagccggtttatgtcggccttaaaacgattaagctaggcgatgtcacctattatctgattgataaccgacaatattttgaccgggacggcttatacggttattgggatgacggcggccggtttggctttttccaaatggccgtgattgaaatgctgcaggtgattgagtggattcccgatatcattcatgccaatgactggcacacagcgttcattccggtgctattgaaggaaaagtatggctggattcaaccttatcaagcgattaaaacgcagctaaccatccataatctgcaatttcaaggatggtttccgccgtcgattctggacacggtgtttggtatcggacggcaaagctttaatgatgacggctttgcccaggacggctcggtgaactggctaaaaggcgggattaactttgctgatctggtttcgactgttagccccagttatgctcaggagattcaatcaccggcatttggcgagcatttggatggcactttacgcaaacaaagtggtaaattagtcgggatcttgaacggcattgatgatgaagtctataatccggcaaccgacccgcatttgacgtataactacagtgccaaggatttaaaaggcaaagcgaaagacaaacgcgttttgcaagaagaaatgcatctgccaaaacgttcggatccgctttttgcgatggtgagtcggctgacccggcaaaaaggggccgatttgctcgttgatgccttggaaaacttcctggttcaaaataacgtccaggtcgtaatcctcggtaccggcgatcgcgacttggaagaggatcttctgtcgttgcaagatcgcttcccagggcaattggcggttcgaattgattttgatgaagcgttggcgcaacggatttatgccggtgccgattacttcatgatgccaagcgcgtttgagccaagcggattggcgcagatgatggcgatgcgttatggtacgttgccgattgtgcatgaaaccggtggcctgcgtgattctgtcacgccatacaatgccgaaaccggcgctggtaccggttttagtttctgggattacaatgccggcgtgttggccaagattctgtgcatggcgaagcacgtttattccgatgagccaaaagtttatgcccgtctgcaacaacaggctatggcgatggactttgattggcatcattcggcggcggcttacttgaaggggtataatcgcatcctaggtaaagcatgagtgtcatcgcgaggtcatgtcgaatgaaagtcacagccgacaagacggcatttcgtcttagctgcggatcggacattcgatgagacctcgttgttcatgttcgccaaaatggttgcgatggtttaattttgatgaggtgtatatttgatggcattaacaaaggaacaattcatcgcagactttaaagacatggccttgaaaatgtatgcggcaccgcttgaagacctatcttcacaacagctttatcaggcattggccttgttgacgcggacatacattgcccaaccttgggctgacaccaagaagcggtatgatcaagaagagaccaaacaggtttattacttttcaatcgagtttttacctggtcggctgttgcagtctaatttgctgaatctgggtattttggatgcggtcgaggcagggttacatgccttggagttgcatccgcagaagatttttgatgccgaagctgatcctgggttaggcaatggtggacttggacgattagcgtcagcgttcatggatgcgatggccagtgtggggatggccggcaacggtaatggcattcgctatcaatatgggttatttaaacaagcctttgttaacggttatcaagttgaactgccagatgattggatgcgcaatgggttcccatgggagacgcgcaaggaaaatcgggcggtcacgattaaattcggcggctgggtggaattaaaaccaagtcgcagcggtaatttgcgggtgatctatcaccaaactgacgatgtactagccgtgccttatgatgttgccatggtcgggtatcacaatggcgtcgtgaacaatctgcggctatggtccgctgaagcgccgattaatgccggctcgcggtttaccttggaacaaaaagaacgcatcaatcaaatcacccagatcttgtatccggatgactctgacaatgccggaaaagaattgcggttgcgccaagagtatttctttaccagtgccgggattcagagcattgttcgtcattaccggcggacgcataacagtatggcagggtttgccgatcgggttgcgattcatattaacgacacccacccggcgatggcgattcctgagttgatgcgggttttgatggatgatgaacatgtcagttggaacgaggcatggcggattacattaaaggttatgagttacaccaaccatacgttgctatccgaagcacttgaagtctggccgattgatatgttcagcggtctgttgccgcggatttatcaaatcgttcaggaaatcgatcggcgcttccgtctggcttttgttccgcagtttgggcaagccatgattgatcgcattgctcctttaggtaacgggcaggtacggatggcttacttagcaaccattggctctcacgcgatcaacggcgtggccccgatccatagtgagttattgaaaaaagatgttttgcacgacctgttccagatttttccggagcggttcaataataagaccaatggcattaccccacggcgctggattcaaatcggcgaccgtccgctggcgcacttactggataaaaaaattggcactacctggcggaaaaatccgttggcattgcggaagttacatgatttcagcgatgatccgcactttttgtccgacctgaatgccgctaaagccgaaaataaacgggcattggctaagtacattgatcaaaccgtgcacgttaaggttgacccggatgctattttcgatgtgcagattaaacggctgcatgcttataaacgccagctcttacatgtattaggaattttagatgcctatttagcgcttaaaagcggtgaaaaacgaccgaaacgcctgcatattttcggagccaaggccgcacccagttatgtttatgccaaagagatcatcaaggttatgaatgcggtagcggatatggtgaacggtgatccggaagtcagcccttatttgcaagtcgttttcttacctaactacggtgtgacgatggctgaaaagatcatccctgctgctgatatctccgagcagatctccacagccggtaaagaggccagtggcaccagtaacatgaagctcatgagtgccggcgcgttaaccttagcaactctggatggggccaacatcgagattaaaaatgcggtgggcgatgataacattgaaattttcggcttaaccgaagatgagattgccggttattatcagcgcggtgattaccgggcccgcgacttttatgaaaaggatccgcgcttgcatgcggtgttggatatgctggttaatggccagattccgggaattgaaacggaaggccgcgatatcttcaattccttgctgacgtataacgatgaatattttgtgttagctgactttgaaagttacttagccgctaatgccaagctggatgccttgtatcaacagccgcaagcctgggcgaagaaagcgttggtaaacattgcagaaagtgggcgcttttccgcagactttacggttcagcgctatggtcgcgacatttggcatgtggtcccgcaaacgccagaagatgatggctcaggcaactgatgcgttacatggaggaaaaagatgtttcaatttgattcattcaccgatcggcagccttttggggcagttcggaaggcaacaacgattcatttcacggctaaagctgacggtgcggtgacgcaagcctcactgattatcatgccggatgggcgcggggatcaaaccgagacattgccaatgaccaaaagcccgaatggttatacggtgagttttgccccgcagacggctggtttatggttttaccattttgaactgcaaaccgatgaaggccgccaacgctttggtgcggttgatggcggttttggcgggatcgggcaagtttatccggaaaatgccgatgtgaacagttatcagctgaccgtggtcaatgagtttgacccagtgccggaatggtatcggcatgcgcggttttaccatattttcgtggaccggtttaataacgggaatgcggatggccacgtcaacgcaccgaaagccaattcttttatctatgggcgccagtcggatcggccaatgtatattcgcggtaccaatggcgaagtgttgcgctgggatttttatggtggtaacttaaccggcattcagcaaaaattgccgctgttagctgcacgggggattaatgcgctttatctgagcccgatttttcaggcgcgcagcaatcaccgctatgataccggtgattattatgcgattgatgaagtgttaggtacattgcatgatttcaagcagtttctggcggcggctcatcagctggggatgcatgtgattctggatggtgtgttcaatcatgtcggtgccgacagccggtatttcaatgccgtgaacgaatatgacgatgttggtgcggcgaacagtctggattcaccatacgcatcgtggttttcgtttaaaagatttcctgatgactataacagctggtggggggttaaagacctcccggcgattaataaagacaatcaggattttcacaattttattgccgctaaaaaagattcggtgatcagttattggaccgatctgggcgtggatggctggcgtttggatgtcgccgatgagctgactgacgactttattcatcaaattcggacgacattggatcagtttcctgaccgggttttgatcggtgaggtttgggaagatgcatcgaataagcaggcttatggcaaacgccgccagtattttgaaggtggcgagctgaacgccgtgatgaattacccgttgcggtcgatgttgattgattttgtcaacggtcaactcagcgcggccggttttgtccgccagttaatgacgctcaaggaaaactatccgcccaatgcgtttgcgtttaattttaataacattggcacgcatgatacggcgcgaatcttgaccgtgttgaatggtgatcggcgtaagttacaattgattgtgtcacttctttattggctgccgggggtaccttgtctttattatggcgacgaggcaggattaaccggcggcaaggatccggacaaccgcgccttttatccatgggggcacgaagatcaagccattttggatatgtatcagattgcgttacagacgcggatcgatcaaccagctttagcagccgatgcggcatttttcccgttcacgtttgaagacagcctcggttttgtccggcaaaacgaggcccagacgttggtcgtcttggccaaccccacctgctcgcctcaggttttacaagacccgaatgccaagcttgttccggctaatctgcggtcacttttgccaatgggaaccatggtgccgcctggaagcgtgatttggcaagctatctaaaaagtcgggattgtagctataggtagctgttagaggtgctaaattagagatcgcaaaaagcagcaaccaaaaaatggctgctgctttttgagtcgccaggtaaaacagctggtctacattgtcaccgcaagcgtttcgcgtaatccgctagtttgataaacgcgggtgtctttggtgacaaaaatcgcttcctgaccttctgcttcgattgcatcgtaaccagccgggacgccagcgtagaaaccgactgaagataacacgtcaccgataagaccattatcggcaatgacagtgatgctggccatgttcgactcgaccggataaccggtattaggatcgatgaggtggtggtattctttgccggcaatctctgaatggcgttcaaaaatgccggttgtcacaacggcttttggctcggttgtcagcgttgcaatgctgcgctggccgggatggcggggatccgcgattggccactgccacaaaggaatgccactggccgctttaccaacgaggcgctggttgccacctaagtcaatcaagccgccttcaaccccggttttatcccataaatcatagacttgatcgacaataaatcctttggcaattccgccaagatccaaaaccattccttctttaggtaaaaagacggtttgattttccgaatcaagctcgactagattcgggtcggttaaagctagggctgcattaacttcattggcggatggaacgcgcgcatcggcaaagccaattcgccataacttgacgatcgggccgattaacgcgttgtagcctagaccacgtttgctccaggctactgcttgggcgatgagattaaacaccggtcgtaccggaatgtggaccggtgttttaccggcctgggcattaatcatggttagcaacgattcgtcatcataaagcgatagcaaatgcgcataagcctgaatcatactgacactttgattaagtaattcgttggcaccatcggcataaacggttaacgtattgtccgcacctaagccgtgaaaggttgttgtcgttgtcatattgcacctccaagtagtcattgattatcctaatgcatagtatgaacggtttgcatatttgttgcaatcgttatgatttcaggtattattcgttgtgaatgtcaattgattcaccgcgtgtgctcagcgcaattcatgaggaggccaactatggcggcatatagttcagcacaacaggaagcattaaaagaattcaagcaggatatcggccacttaaatgccttatccaattcaagtcggcaaaagctgattatgattctcggtgcagccgataatcacgtaggcgttagtgttaatgatctggctgatgcaatcggattatcgcagccagctacctcgcatcatctcaaacacttgaaagatattgggatggtcggatcccgccgtgaaggcaatatggtttattattatttaaccttaaacgatacaattgcccggcttgagcggttaactaacgccttgaagcgccagatcgcccaagcgtgacaaaagtcttattgttcagcgtgaaccatggctaatgcaaataacaggttattcctatgtaaaagttttgtaagaaagcgcttgatgccgttaaaaagcgtgtttaaacgatgattaagatcaattttgctttataatagcctctaacgacttttctgacgagggggaattagtatggatgctggtcgcaatattttaaaagatgaacaacgccgatttgcccgtctgaaaagtgcccagcatgcagcggcgttgaatctggtcgtttatggtggtttaacagtggccgaattgtggatcgcgcaattagcacattccagggcattggcggcagatggcttgaataatctgacaggtgtggcttcggcgcttatcttattatgggggctgcaagtttcccagcaacgaccagacagtgagcatcgatttggacactggcgatttcaaacgattgcaaccttgttttcaggtctgattatgttagtcgttggactggacgtggtgcttgatggctaccacgggttgcaggcatggtaccaaggtaaagtgcaagtgcccggtgttttggcggtttatgtgagcctggctgcgggggtggccatggcgagtgtttcgttgatgaatcatattcgcgctaagcaactggacagcagcgtattacggacagcgtctaaagacagtttttccgatgctgcgactagcggtgggactttactggccattctaggtgcgaaggctgggtggctgtggctggatggcggcgcagcgattgcggtcggccttttgattttatatgccgcttggacaattctacgtgatgccatttttgaattgacagatgggtttgacaccaagaaaattgcggcttatcggcaaacgattacgcaggttccgggagttctcggggttcaaagcattgaagcgcgttatgccggcgatgcggtgttgctgacgatcggcattcgggtggatccgacaatgaccgtggcggattcttatgaattaggcgaacgagtcgaacgcaaattgatggatgcgtacgatattctggatgccgatgttaaaacttatccggccgatttaccaccggaagatgcgccgcaagatccgtaagattgcggtgggttttccgaaacgaggcttttgggaattagcgcgcggttttcgtggatgagtttaacgactgcctctgtacaaatagcgtgcatgtgttaaaatttgacctataaaatttaccagctgagtcgcagtagtgttatctaggtaggcattcagaaaaacggtggttgctgcaaaccgttccgcctgatagcacgaattacagctcaatgaattctggccgcgggtcatgccgatatccatgagagtgatgcaaagcataatttgggtggtaccgcggtgaaagtcgtccctgatcttagttgatcagggacgacttttttcgtaattaggtacattttggctcgaggctaacgtgctgatcatgctagccatatcgtaatgaggaggatttttctaatgacagaaacacagcgaggacagattttagatgaattaaaatggcggggggcgctgaatcagctgaccgatgaagccgggctgcgcaagttaaccgaagaaaaggcggttagcgtatactgtggtaccgacccaactggcgattctctgcatgtcggccatctgattcctttcatgattctcaagcgcttccaattaatgggacatcgaccggtcattttaatcggtggcggaaccggttcgattggggatccatctggccgcaactcggaaagggtcttgcagacaatggagaccattgcgacgaacaagaagaaattgacggcgcagatggagaatctgtttggaaccgacgattttcgaattgtggacaattacgattggctttccaaaatttccatgctcgactttttacgggattacggcaagttgttctcggtgaataacatgctgaataaggaagtcgtggcaagtcggcttgagactggcatttcttacactgaattcacctaccagattttacagtcggttgatttcctccatttgtttaagcatgaagatgtgcagctgcaaatcggtggggcggatcagtgggggaacatcacggccggcattgatttgattcaccgacttgagggacctgacgcccgtgcttacggcttgaccaatccgctgatgttgaaagcggatggtactaagttcggtaaatcggctggcggagcggtttggctggatccggaaaagacgtcaccatacgagttctaccagttctggtttaatcaagacgatgcggatgtcgaaaaattcctcaagttcttcacgttcctatctcgtgatgaaattgccgagttggtcgaggccactaagacgcatccggaaaaacgtgcagctcagcgcgaattagcccgcgccgttaccaagtttgttcatggacaaaaagcagtcgatcaagccgaaagcatcagtgcggcacttttctcaggcgatgttgcggatttaagtgctgatgatattaagcaaggctttaagcaatttccaacggttgaagcgccgcaaacggcagagaatattgtgacctggttggtagacactaccaagatcgaaccaagtcggcggcaggcccgggaagatattcaaaacggtgcgatcaccatcaatggcacccgtcaacgcgacttggattttgaagttgatccaagcacgcattttgatggtcaatatgtcatcgtccggcgcggaaagaagcggtacttcctagttaaaatcaagtaattcggttacggtgagacgatgaatgaagctaggtagcgagtcgcggctagtttcaatccggttagcattaaatgacaaaataagcaggaagtcaggagtaaagagccgcttttattcctgacttttttaaatttaaaaacgtaaatataacttagaaataaaatggttattaaaatgatcataaagtgctgctgaagtaatcgcaaaagtattctgatggtaaccaccctgtaacgagtttgtaacagttcagtgttagtgtgaaccttgtgaacaaaatgagagcaggagtggcgataaaatgagattaaagcaattggttacgggtgccatcacggttgcaacattagccggtgttggggtttcgggtttcgcggcaacaaccgttcatgcggcagacgacaaagcgagcctgcaagcgcaaaatgacgatttgttgaaacaggttcaggctgccaacgaaaaaagcgccaaactgaacaacgaggtttccaataaggttctggcgattcaggatgccgaagccaagatcaaggacagtcaggccaagatcgctgatttcgcatcacaactgacaaaagccaatcaggaagtcagcaagcgtaagagcaacttgaaagatcagctgatctctctgcaaaagcgtgccggcgactcggttactggcaatgtctattttgactttattttgaattccgacagtctgacggatcttgtcggccggtcattgacagttagcaagttgagtcaagcgagcgctgaagctttgcaagccgttaaagattccgaagccaaggttaaaaacctgaaagccgctcaggaagctaaccaaaagaacctggttgcaaccaagagccagcttgaaagtgataaagccaagattgatggcttaaaggcggatgctgataaggcagctgccgatgctcaacaaacgattgatgctaacaaagaaaagctggcagccatggccgctgatgaagctgccaaagctgaggcggctcaaaaagcagtgacagccgttgctagttccaccgctagcgcatcaagcacttctgcttcctctagcacaaccgcttcttcaaatagtctcggctctagtaaagctgcatcttctcaggctcccgcttcagctggaagcagcacagtttccgtttccggtggcagcatcgccggtaacgccgctaaatacctcggcgtaccgtatgtttacgccggcacatcacctgctgggtttgactgctcaggcttaatctattacgcagctaaagaagccggaattagcctgccacgtacctctcaggcgcaaagcacacttggctcatatgtttcggtttccgatctccaggctggcgacttggtcttctggggtagcgttggtaatgcttatcacgttggcgtttatatcggtaacggccagtacatccacgcaccggagccaggacaaaacgttacggttcaaagtgttgcttactttgcagcaagctttggccgtcgtctctaatttatcgttcacatcctgcaaatagtaactaaaagatcggtcatggtgaccggtcttttttagtaagcgcgaaccggcgcggttagcaatcggagtgtaagtggcctctagcctaaatggctggtctctggccatttagactagaggtccttacacgcagattgctgcgactgtgagcgcgttatagaacgcaatgtcagctctcttaattgcctaaataagaaactttactgcctactagctactttctgaagtcaaataggctttggccattgcaaccaaggtccttacacgcagattgctgcgactgtgagcgcgttacgattacgcgagcctgaacatatccattgagtatgaatgtatgcgacaatagaactcattaaagcgttcatcaacgtagcatggcggtggagattcaggaggaggtttattatgattaaaattgatcagcgtcagttaaatcaggcagatgtgcttgccctttatcaagcggtcggttggaacatgtacacgcgagatccgaagaaacttgagcgggcgatagcgcaatcgttaagcgtgctgggggcttatgatggcgatcagttagttggtttgattcgggcagttggcgatggtgagacgattttatttattcaggatttactcgttttgcccagttatcaacggcaggggatcgggcggcaattggtagacgcattagtagatcaatttccacaggttcgtcagcgggtccttttaaccgatgatcagccccaaactcgcgccttttacgaaaatattggctttgttcaaagtagtaaagttggtgtgattgctttttaccaggatttgacgtaagtgaacccggtcagcgagtttggcatcaaagcgcaagggtcgttgattttgagctgacgaatcggcgtaggtttggtacaatcgaggcaatcatttaaggaggctgctcatgaaggctgcgcataagttgattgtgatcacaggggcaacagggactggtaaaacaacggtgagcgcgtatctgcgcgacaactaccgaattcatcgggtgatgactcacacaacgcggccaccgcggactggagaacaaaacggggttgattattattttgagacaccggcaagttttgcgactaagcattttattgaaaaagtcacttatgccggctatgaatatgggtcatcacatgagtcgctggagaagaactgggctaagcatcccttcctaagcatcgttttggataccaaaggcgcgattacgtatgttcgtgagctgccaaaagaagtcgtcgttttgtttctgaccattgacgatcccacggttttgaaagatcgcctgcttggtcgaggagatgagccgaacatggtggcagcgcgattgaaaagccctgaatacaaacgcgacttaaccttgcctgatgaacttaaaccgtttgcgacagtcattaaaaatgatcgttgggatgaagcgcgacagcaaattgaccggttcatgaaggacttggcgcttaaaagttgtggctttttgtcggtcgacaccgaacagaagtgacgtggtggcaaaaagaaccctggtcgagaattatcgcgattcattttgtgaaatgtctagtagaccggtaatgtgtcgataaaatgcttgatggcagcactaaaaggcctctaatgacaaaaatcttgtcgttagaggcctttaacgtttttattttacaattttcgacatggcagcgacaataaggtgccgttctgattgttattttgtcgttttcttaactgccttgataacccgttttgctcgtgaacgggttttggggtttttacttttgagacggcgtgcagcagatgcgtaatcggttttttcagccatgttgcttcctcctatcaggcgtgatacactgtaagttgctaatcgtaaccagtacgatttgatagaatacacgtctagaattcaagtgtcaagccaaaggagcctcttatggataacacagcgattgctttgaagcagttaaaacagcatggctaccgcgtcaccaagcagcgtgaatcgatggttgattatttaggtagaaatcagcatcggtacacagcggtgacgattctcgatcggtatatgcgcacgcaatttccaggggtgtcgcatgatacgatttaccgcaacgtgaagtcgttcattgaaatgggtatcgttgaaagccgtatggaagacgatcaaattgtcgttaagcttcagtgcgactttcaacatccgcaccaccatcattttatttgtaccaactgcggcaaagtgatcgaattaaaaatgtgtcccttgaattattttgaagaacaggtacccggcgctaagattcagagccataattttgaactctacggcttatgcgcagcgtgtcaagaacatgctgatcgcttgaaaaacgctaatcggtagctgaagcgctgtgaaaaaaatttaacggtacgactaaatgaggcggcatcagatcaattatctgatgtcgtttcgtttatttaccaactgccttttccatgcaggcgatagatgttggtaaagatagttcaaagcagcggttttcgctagccgttttggctgctgcttagaatgtcgtataattttagcggtaacttaagatgcttcgggctgtttttagggtaaaatgaatcgatgaatgaaaggagctggcttcatggcttatcgaacaccgccattattaccgccgactgccattgtttcgctcattgtcctgattagtgcctataatattgtgaatacgattaatccggtcaatcaaccaaaatcggcaaccgaacaaagtgaattggtttcaaaaataaaatccgaatcggcttcacgggctgcgcaatcagcgtcttcaaaagctgagccaagtcaaacatcaacttcgcagccagctgcagcaagtcagtcgcaggtacaggcgagtcatccatctggtgaaaaagaaacaacgagcaccgaggcttctacttcaacgccgagcgcttcgaccgcatcaacggtttccacttcaacgccaagcagcaccacgaccagtgacgaccaagcatccgatcaaactggtactgataatggccaagagactgataccaccagcagtggcggtcaataagccgcggaaaggatgagatgatgttaactgtaattgatattatcaaccgcgtgcttggctactttaatattgctgacaagccaaaaggaaaagccttcacgtggatagcgtttgtcgccaatttttacctactttacatcgccattcaaaacttacggtatccggattttcgaattcgtggtgcattgttcatgctggcgtttgttgtctttttgtattttattgccttaaacttcttatactattttacaaataagacaacccggtttgatatttcgccgacagttgagaagtggttgggcagtaattcggctaagaaaactgctgccgaaaacgaattgaaaacgcaactgggggcagcaccggccagtggcgtgtttacccaggatcaattgctgacggcggatgtgaccatgacggctgaacagcaagccaatttggatgacttagttgccagtctggtcaaacagggagtcttgagtctgaattatcaagggcttgatgacaaagcgattagtcgcgtggctcaagaaacccagcagccagttctagctattggcgcgccgtttccaattccgtttttcgatttgcagcacacggatcacgagctaatcatcaccggtggcttgaatgcgttgatggctaagccgctagcaaccattgaacgagttggtttgttaccggcagcagaggcgcaacgtgattatcatctagtcgccgccaatgtctttttaattggcggtgagcaaaagttactcggtcgcagtggtttgcgcaaggagaagcagccatacagcttaacggtgcagctggcctatcaggataagacgccggctgcaagcgaaggcgaacagccggccacacctgcaactttgccaacacgagaagaggcgcggacttctgtgacagaaaacaaagcaacgtcttccgcggaagaaccgccgttgcctacgcgtgaaagtcggcgtcatcagcggtaggtagtcgctactgtcagatggttaagaataaaaatgcatatgagtcgcgagttttgaaagtgccactaaaactcgcggctctttttttaatgctgatagttggccgatactaaagtgccgtatggtgatcagagttcacgggtaagtcacgacgaaaatcgttgatggtgcggaatcccgagtttcgggagttttacggattcggcggtcataaaacttgactttttgaaaagaaatatttgcgtatcattaattttctctgtaaaatccatgataagagcaagcgaacccaaggaggtcctcgaacatgtctatgatcgaatttcacgatgttaacaagtattttggcaaattccaagccttaaaaaatattaatctaaccatcgatcgcggtgaggtggtgaccattatcgggccttcaggttctggtaaaagtacggttttgcggtgcatcaatggtcttgaacgaattacttccggacaattgattgtcaatgactttgacttggcagacaaaaaaaccgatatgaaccggattcgtaaaaatgtcggcatggtctttcagcattttaatttgtatgcgaataagaatgtcttgcaaaacatcactttaggccctgatttagtcttgaagcgagacaaggcggaagttgaacaggaagcccgcgatctgctaaagatggttggactggagagtaaggcggatagttttccgggtgagttatccgggggccaacaacagcgcgtggccattgcccgcagtctggcgatgaagcctaaagccatcttgtttgacgagccaaccagtgccttggatccggaaatgatcggggatgtgctggacgttatgcagaagatcgccgaacaaggcatgacgatggtagtggtaacccacgaaatgggatttgcccgccatgttggcaatcggattgtctttatggacgatggcaagattctagtcgattcaaccgatgtcaaccagttcttcgacgatccgcaagaacctcgcgccaaagagtttatcagtaagattatcaatcattagtgtgacaagaccagttgaggattgattccagttatgaggcgtttgctggcgggacatttccgccgggaggactcgcgctacgataacgcgttggctcccgaccagaaacctgtgtgtaagaaccttggtcgcaatgaccacacaatccggcttctacccacgctggctggcgctcacgaggagggacattaaaatggcaaaaatgtggaaacgcatgctcctgccactggtgttgttactattgatgataccgttaagcagctgtggcaaaagtgtggcggatcgtgatattttaacgaacgccaaggcaaccaatacgattatttggggcgtcaaggctgatacccgtctgtttggcttgatgaacattaaaaccggtaaaattgaaggctttgatgttgatatggccaaggcgattaccaagcagattttaggcaaaaaaggaaacgcccagctggttcaggtgaccagtgatacccgcgtgccgatgattaaaggtgggaacctggacgcggtgatcgctaccatgacgattaccccggagcgccaaaagattctggacttttccgatgtttacttcaatgccgggcaaagtcttttagttaaaaaaggcagtccgattaagtcagtgaaggatttgaagaaaggcaccaaagttatcggcgtgcaagggtccaattcagttgataatgttaaaaaagctgctcccgacaccactgtcttgcagttagccgattatgcgcaggcgttcaccgctttgaagtcaggccaaggtgatgccttgactactgacaatgggattttatacgggatgtcagaacaggataagaactatattgtcaccgggggtaccttcactaaagagccatacgggattgcaattaacaaaggccagaagccgtttgtcaaagccgttaacaaggcaatcaaacaactcaaacaaaacgggacttatgcaaagctgatcaagaagtggttcggcgatgtgccaggattcagtcttaaggaggtggaataacatgtggtcaattcttaccaataattggaacacctttctttccggacttggtttcacgttagcagcgagcattttagctttgattggcagcttgattgtcgggacgttatttgcactcatggaaatctcgccatttaaaccgctacgagtcatcgggcgaatttatgtcgaagttgtgcgtaacattccgctgctagttattactttggcattctacgtgatcgtgccccagtttattgtcaaaatcgatggctttaccgcgggcaccattggcctgttgatttacacgagtgccttcatcgcagaaaccgtgcgtgctgggattgaagcagtccccagcggccagatggaaggtgctcggagtatcgggatgacttatacgcaggcgatgacgcagattatttttccccaggcatttaaaattgtcatcccgccactgggcaatcaatttatcaatttggtaaaaaatagttccgttctggccttcgttgctggatttgatctgatgtaccaaggtaaattaattgcggcgacaactttttcgacttttgatacgtacttaatcgtcggcattttctatttgattttgacgatgccgttgagttacctaatgcgttatctcgagaaaaaatgggtgaccgcctagaaaggagcaggttttatgcaaaattttgttgatgcgtattcgtggattaatttacggtacctgctccaaggcttaggggtgactttggaagtttcgattgcctcgatttttttcagcttcgtccttggggttattttgggcttggcacgctatgtcaagattaaatatttttcggcggcggttggctttgtcattgacgtcatccgtaatttgccgctactgctgattctattcttcacttacttcgctttgccagacattggcatccggcttaacgtcattgttgctgccattgttgcgatgagcatctttgaatcggcaatgttggcagaaatcgttcgctcaggcatcaatgccgtaccgcgagggcagatggaagcggcgcgcagtaacggtctgaccttctatcaggcgatgcggtacattatcatgccgcaagcattgaagaaaatgatcccaccgattgtcagccagtttatttcgctcgtcaaagacacatcactggcaacgatcattttactgccagaagcgacgtatcacgcgcaaatcatttatggtcaaaatattaactacatgattccaatgtttgtggcattggccgtgatgtattttgttgtgaattacgcgttatctttggcaagtcggtggttggatcggcggttggtacagtcgaattgaatgattctcgatatcagtgctttaatagccattaaaatcggtcctcggcagacgaactttgtctggtcaggaccgatttgctttagttattttgcaaaatcatctggcaaaagcgcacaggcggtgacacggtgtcacctcaattttaaatataggcaacgatcgttccttttcgtaactgggtacgttgcctcaccacacttggcaaagtcttggatcgatttgggttgctgttactttttgaccacaaaccgccgatgacagctgggaagcccccgttcaagcaaatgatcggtcaggctgttgcaaaggggtaacagttaaggcgttgaccggttcttatcattttcctaacatttgcgattagctgcggtggtctggtcgctgctgtgataccatgagagagaaataaaacaagcaagacggaggaaattatcttgagcagctacttagtgaccggtggcgccgggtttatcggttccaatttgacggagcttttgttgacggatcctgacaatacgataaccattgtcgatgatttatcaatgggcttgcgaaccaatattcccgattctagccggattaccttttatgaacatagcatcacggatcatgccttcatgtcccagcttttgatggaaggccgatttgattacattgttttgttggctgccattgccagtgttgctgattcggttgaacggccgtacgcgacacatcaggttaatcaggaagcgaacctgaacatcattgaaaccttgcgcacccagaaaataccttataaaaagttattctttgcaagttccgctgcagtttatggtgattctcctgagctacctaagaaagaagacatggccgttaaaccgctaactcaatatgcagttgacaaatttgccacggaacgcgcggttttgaattatggccggctttatgacatgccaatggtttgcacgcgctttttcaacgtatacgggccgaagcaaaaccctaagtcgccctatagtggggtactgtcgatcatgatggcggcgttgcaagaagacaaaccattcactttcttcggcgatggcgaacagacccgcgatttcatctatgttggtgatgtcgtgcatgcgattcgcggcttgttagagaccccaagcgctcgggatgatgttttcaacgttgctaacggcaaacaaaccaccttaaatcaggtcgccaaagagcttgaaaaactcactggcaaaacgttacatgccacccataaagccccgcgtcttggtgacattcgcgattcatatgcacaaacggacaagctggatcagtttgacttcatgacccacacgccacttgcagagggacttgccaagtatgtggcgtcggttcagtaaacaatgatcggccaggcggtgagatactggctggttatttttgtcgtgttagcgcaatctatttttgtaggagagagatgctttgggtaatacacctgttgtttccgttgtcatgccagcttataatgctgcgacgtaccttcctaataccgttcagtcggtattggaacaaagctttaaggatttggaacttttaattgtagatgatgcttcgtcggatcacacttttgaagtggtggaaaaattgtccgctacagatagccgcattacctatattaaactagacgagaaccaaggtgtggcgaatgcacgcaatgtcggggttcagcattctagaggcgagtatgttgcctttttagatagtgatgacatatggctaccagataagttgaagattcaattaacgtttatgcagcagcatcaggttgatttttcctattgttcctatgaagttgtggacgatcatggtacaaaaattggtgagcgcaaaatctcagaaacaaaattggactatcatgaaatgctgaagggaaatcgaattggattgttgacagtgatgctatcacgtaaaattgctcaaaagtatccgtttcccgagattaatcatgaagattatgcttgttggctatcgattgcccgcaatggcacggttgcttatcttgcatccgagcaaattctcgctaaatatcggaagcatcagacttcattgagcgcaaataaaattcaggctgcccaatggacttggacaatctatcgtcgccacgagcacttgggtttatttaaaagcttctattactttctccattactcgttaatgggcctcaccgataaacgataacaatcagaaaaggagaagcgttatgattcctaaaattatccattatgcttggtttggaacgacgccaccgccatttattgaagcgcgcgttaacgagtggcgaacacaacttcctgattgggagtttaagttttggaacgataagaattttgacttaagcaagtatgcattttcggaaaaaatgtatcaggcgggcaaactgggttatgcggccgatgaattgcggtacgcagttttgtaccaatacggcggtttttatttggataccgatatgattgtcaagaaggaccttgcgccgtttttgaatcaaaaaatggtatggggatttcagtatgataatagtatcctaacgtcttttataggtgcagagtccaaaacaccgctgttagctgagattttagatgtatacgcaggtcggaagtttccggatttacaagatgacatgcagaaaatgaccagtaatcctgttgtcacgaaaatcctgatgcgtttataccccgattttcggatgaacggtcagcgtcaggaattggcgccgaaaattacggtttatccgcgcgattactttacatatgccagtcgtaactcaaatgcaaactatatggagcatctttttgataattcatggggtagtgctaatttgggcatgcgtgggcgtttgaaacatgcatttaaaaccgttttcccatatttatgggctgacatttctgcgcgacgaggtataaaaagtgctgagcgtgatgggataccttatcaacgctgagaggccgttgttgggtgtttccacgataaatgaccgacatggcggacattttctgtacgtatgctataatgagtgagcttgtttttgaccaaagatatttattgagagggttgctgtatgaaacagagtgccgaatggaatggcttcaaacggctgttaacaatgatcggcgacgtcggtctttttaatttaagtatattactcgccttttactggcggtttggatctgatattcctgagtggaactttaaaatgtatgaaggatcggcagtctatatctcgctgctttttctactggtaaatttcttcttaggcgtttatgtttattataatcggcgaatcagtgacattatttttaacacggtccttgcccagacaatcacgatattgggactaactatgattacgtttatggggcgtttcttcgctttcccaagactagtcttagcttattctttcctgctcagcattttgattttgggcatttggcgagtgttcatctactacatgtatattcactttacaagtaattacaaagtagcagtgttgtcttatgaacatgaattacctgctgttttagagaacttccattcagcaaagaataataagcacaaggttacctacgtcgtttcagaccattttgttgagaatgctaagaagatcattgacaaagtggatatcttttatctcaccaagagcttaccggacgaacaacgccgtgagatcattgatattattattaaaaaagagaagacaattctattgccgtcaacctttgataacttaatgatgctgcgaccaaacttaatgaactttgaagatgaaagtgtcatgggaataactcaattcagaattaagcctgaaagcgcgattctgaaacgtatcttcgacattgttgtcggacttttgatgttggtggttgcttccccgtttatgcttgtaacggcgatcttggttaaattatcatcaccaggcccgattatctataagcagacgcgcatcaccttaaaccaaaaagaatttaaaatcttaaagtttcgaaccatgtcagctacggcggaagcaaagtcaggaccagtccttgccaaggctcatgattcgcggattacgccagtgggtaaatatttgcgcaagttccgactggatgagttgccacagatctttaacgttttaaaaggtgatatgtccattgtcgggccacgtccggaacgtccatatttcgttgatcagtttaatcagcaagagccgcattactatttacggcacaacgttcgtgctgggatcacaggttatgcgcaggtttatggtaaatatgcttccgattatcatagtaagctaaagtttgacttgttatatatcaaaacttatagtatttttctggacgcgcgtattctgttgcaaaccattaagattcttttcgacaaagtttcttcgcaaggacttgaagaggatactgaaccagaacggcagaagcttcatgatctagtcgttcaacaagacatcacacatctgtcctaatgcaggaaattggcaacgtttgtaatttagcgtcaatcaaacaggtgacggatattggaatggaaaaaccacctccaatatccgttttttgttttttctcaatgcaaattccgagtagtggtacctagtcaccattaatttcgacaaggattatatatcaattcaggttaattaaatgagtgacggcaatgaattattttgaattcggggatataattaagttatataaaaagggaggcgcgggaaatgaagaagctacttgtgatagtgcctttggcgttacttttgaccgttgcggggtgcggtcagactggtcagaataaccatgcaaaagcatcaagtaatgttagtcagacaaacaagtccactaaagcgtcggcgaatcgcgaaagcaacggggttaatggctcaaagaaaagtgctagtctcagtagcagcaatcaggttggaagtaaggcgtcagattcttccagtagcaagaatttgcctgagcaacgttatgcaaagttgaaaaaggcggtttttaatcaaattgcctcagctaagtggccatcttcatatgccgttgccgagtcacaatatttgaatattttcgctactggtgatcaaagcaactattcgattttcttcagcccgggaagcgtcgcactgccctttaacgatccaacgttgcagaatataaatgcggaattggccatccagaaaaaaacttatccaaatgcctctgatgcgcaagcacaagtagcggtatcccagtcaactgccagccttccaaaagtggcgcttggagacggtattgaagcaactagccagggagcggcaggatcaacttacctgacatggacagagggtcgatggatcgtgacggttaaggcatctgccattaacggggaggatcctttaccattagctaaacaggttgtcgcttggtttgccagccatgcgttgccggtgccagatcagcgcggcaccgttgatctaacggtgacaaacgctaatgttcgtcagaatcagattacttggacagaaggcaatgcgctttatatgatttccgggcttgagccaataaagacaattcaagaaggaacagcgacacgttaacagactaacaatttaagcagcactgacaaatgtaacctctacaatttggtggaggttttatttttctttaagtcttctgtagcaaattgcaaatgctgatggaatttagattcctattgaataatctgctataatttttctgagtttaaaattattcttgcaatgcaacattagtcgtttaatcaaaaaaagaatgaggtgccgacttggcaaagatcaaagttatgacagtatttggaacccggccagaagcaatcaagatggcgccggtcgttttgggacttaagcagcgaagtgatgaattcgaggaagttactgtagtgacaggccagcatcgagaaatgcttgaccaagtgctttcaattttccatattcagcctagctacgatttaaacattatgaagtctcgacaaacattggcagatatcacaagcaacgttttacttaaattgggccagattattgcaaaggaaaagccagatattgtgttagttcatggcgacacgaccacaacatttgctgctagtgtttctgctttttatcagcagaccaaggtgggccacgttgaagctgggttacgaacatgggaaaaatatagtccttaccctgaagaaatgaatcgccagttaacggatgtcttgagcgacctgtattttgcgccaaccgagcagagtcgtaccaaccttttgaaagagcatcacccggaaaaacagatttttgtgaccggaaacacggctattgatgccttggaccaaactgttcgggatgattatcaccaccaagtacttgagttaattgatccggacaaaaaaatgattcttgtcaccatgcatcgtcgcgaaaatcaaggcgagccgatgcggcgagtattcaaagtgatgcgagaagttgtcgaaacacacccagatattgagattatttatcctgtccatttaaatccggttgtacaggaagccgctgattcaatactgggtcatcatccgagaattcatttgattgcaccgcttgatgtggttgactttcacaatcttgccgcacgtagctatttcatcatgacggattccggtggtgttcaagaagaggcaccgtccctaggtaagccggtcctggtgcttcgcggtacaacggagcgtcctgaaggggttcaggcgggtacacttaaattagtgggaacagatccaaagactgtcaagactgcaatgttgcaacttttggacgatgatcaggaatatcagcgaatgtccgaagccaagaatccttatggcgacggccatgcttcacagcgcattttagacgctattttatatgaatttgggaaaaaggcaactcgcccggtagcatttaagtagcagaataaacatcacactcgccactgcaaatttttgcggcggcgagtgtgattgaaggagaggaacgaatatggcgcttccagtattgtggatcgtaataccctgctataacgaagagaaagttttaccgatcacggcgcctagatttttaaaaaaactaactgaattcattcagaaaaagcggattgcgcaaaatagccgtgtcctttttgtcgatgatgggtcaaaagatcgcacatggtctttgattcaggagttttcgcaagcggacgaccattttttaggcattcagcaaagtcgaaaccggggccatcaaaatgcagttttggctggtttaatgaccgctaaagaccactgtgacgtgactatctctattgatgcggacggtcaggatgatctcaatgctatgaacgacatgttgacggcttatgaagatggctgtgaggttgtttatggggttcggtccgatcgaaaaagtgattcatggtttaaacgggtaagtgctcagagcttttaccgatttctacgtctcatgggtgtggatgtcgtttacaatcatgccgactatcgcttagcaagtagtaaagtgcttcaacacttggcagattttaaggaagtcaatttgtttcttcgcggaatgtttccacttgttggcttcaaaagcacctcggtttactatcaacggcatgaacggctagcaggaaagagccattactccctgtctaagatggtggcgttggcaattaatggcgtcacaagtctgtctatcaaaccgattgtgtttattgccgaacttggaggcattgtcagtcttttcggctttgtcggaaccatttgggcagttctgatggcttttcgcggggccacggttgccggatgggcctctattgtttgtattgtttcatttatgggaggcattcagttactaagcttaggggttattggtgagtatgtcggtaagacctatctggaaagtaaacaccgtccccgttttattattagtcaacaaacatggcagagtgaagagcgccataccaaagacgagtctgaaaagcttaagtgaggttcttcaacgtcaaggtattaatggtttgtagatgcgaacaagccggaaaaaaagcacctaccaataatcacgggtaagtgcatctgaattgaaaatgaggatccatgttcagactgttttaacgctaagacgcctgctttttagccgctgaagacataactgtaacaacgcgatgatgccggccgccagataacttaatgaaattaccacaatggtataaacaacgctgtgtgatccaattgcatcgatgctatatagccaatcggcgataaagggatggtagagatataggtttagggaccacgcgctgcttattaagaagattttactgacgaattcaactcggtaactaatcatcatgacagatagcgcgaagaaaacttcactgaccacacgataacgcatttgcccatgcatctcgtctaaagtgaagaacagagcgaagattgttagcgttattaatgtcaagggtagataatatcggcgaataaaaggaacaaggcgttgttcataaaaggcaaaaagaacgcctacagggaatacaagtgcggcattgataagccattcgcccataccttctgttccgatgtaaaccatataaacaccagtaagaaggaataagcaggaaaacaaaggtaaaggatgtccatgagaaattcgaagagaaatccaaaaaacaacatagaaaaagatgatggctaacacgaaccaactgtcatttacgaacggcgccccatcagtcattgaaataaccgcttgagccagtgtcaatcccataaactggtgcttaatcggaaagatgatcgccattgcaagcagataaagtaccacaattggtaacactcggtgtgataaaaaattctttaagtaagtggatccctttatctgatactgacgcatgacgccataacctgagacaaagaagaagatggcaacgccaagcctgcctgcaagcgttaagcgagacgaaaaaaaagtcccgcctacttcaccgatctcttgattgatatggtgcagaatgatgaaaatgatactaataccctttaggttgttggtagcgtttttgcccaaatgcccatcctgaagattttgacttgggcgcatacttgcaaaaataaaaccgatgaatggcaacaaaataagatccactgccaatatccctccttagccgaattgatctaatagcaacatccgaaaagtagtataacatggcggtgttgcaatcttgaaacttcatccgtggcaaaataagtcgtgatgagctcaccaagaccttttcaggggctgcggcataatgaaagcattttgggggatgactgtttggagaagcgtcgttaaagtcgggattatattgaaattacaagcttcaacgagaacctcatactttggagattgcgaggagaattggaggaaatacataaagtgaaacagcgtgttgaacttattcttgaagattctaataagtttattaatcggttggcaaggtacctgcttgttggggtcttcatattctgcctattgtgtctttttaaaatccaggtggtagaaggagctgcttggggaacacccgcctttgtactgggaggtatgggcgttgtaatcaccttttttttactttttaaactaagtaccgttaacctctctgattggcaagctctatttttgctggcagggatcacgattattttcttgggactttggaattatgtgtatcgaacaaagccggtcagtgactatcaggtattgcttgaaggtgcgcgtgatattgtcaatgggacttttaagagccaagcagttaagcctagcgattactttagatattataatttccagattggctatgcctattatctttcagtgttcatgcgcgtgtttggtgatcgtcttttatactttaaaattgttgaaatggtggtcataaccttaactgttctgacactttataaaacgttaaggctattttcaaatcgtcatgttgctttttttggggcagggctgtttgcatttttcccatttatcttcattggcgccggcattattaataaccaacacgagggtctgttgttggaagccttagcgatatactttgttcttaaacgtcgatcttggctgaatcttttaatagcggctatttgcatcgcagtggcccaggttttgcgtccgactgcggtggtagtggcaatggcgattttggttgccttaattattcaagcgattcagcaaaaaagtcggcaacgtttaggtgaggccgtcttatttctaagctgcttttggatccttgggtgggccattaatcagctgtttattctttcgggtattgcaccatacgggatcaaaggcgggaacccttactataagttcttaattggtctgaccgggaaaggcgttagcggcaagtatacgacaagtgcccgaaagtcacagctctattatgatttgaaggcctatcacttcgattatgcactttataaagacgcggctgccgagaaactaagaaatgcctttacacatggcatcgatattcaggaagttatgaagcgattcacaggcttcattggaaatgtcgataatcaatataatcttggcggtaatcaacatttcctggatcgccatccgttactaatctcatctttgaacttttcagggatagttatttattccagcacggttttggggaccttcaagcgtgttttaacggaaaaacgggtgacaacgcgaatgagctaccttttaccggcgcttgtttttggtatgttcttttttgcttatatttttatggaaactcaggcgcgatatcggtttgaacagtattatgttttattcttgttggcggtaccgacactttaccaatggcttgttcaggttcagaaaagaactttcgaccgtgagatttctgatcaccgaatttgattgtctttaagaatcgtcagtacttgagccacaaatttttttgtcatcagaatgtttctttaaaacttgtcgtggtccatgtataatggtctgtgtttaaggtttcgttctaggaggagtttttatggggtcaaaggagaaaattttgaaaaataagttattttgggcgtctgctgcgattgcttcgtcacttttgttttcacaacttgtattggggacaccagtcagtgtatctgctgacactaatgagagcacaagcacgcagtcaacacaaaaccaagcagcggctttccatgatatgaatcagcattctaatgaaagtggcgcggggatgccgaataccaatgctgcaaacggcgtccgaactttctcgagtgctcaaaatggcgatacgacaacgcaggctgcggcacaggcaaatattcagacgtttgctgcaagtccgttgaccatgatgagttttacgattggtaatcaatcggtaccgcgaacagacgtagtagatattgcgtcttatcaaggttggatgacgcaagcgaattttaatacactacgttcacttggcgtaaaaggtgccgttgttaaggcctcggaaggaaccaattaccaaaatccatttgctgcaagcgaagttcaatatgcacggaatgcgggtatgacggtttccatgtatcattacagtcgcttcgggtcaagtgctgatgcagtggcagaggctaatcattttgctaacacactagataagctaaatgtgggtaagcaggtcaatgttgtggcggacgttgaaggaaatgacgtgagtggcgatgttggcggtaatttaaatgcattttggcaaacacttaatcggcgtggatacacacatcacgttttatacaccggtaaatattatgaatactctaatgctgctatcaatacagtcggcaaaagccgcacctggattgcggattatccttatacgccaagtgctaattcaatgtggaatcaggactttggcgcttggcagtattcttcattagcctatttgcccggtgcatcaaagtcaattgatgtcacggttgactatacaggcttatttacacagcccaatgcggtaacgccaccggcccctgcatatgattcaatttcctcgacaaaagcagtaagttatgatgccacgattgtcaatcagaatacgcgaaaagatggcatttacactgctgcgccttatcacacgagtgcaacaactgccatttctaattttgacggtgttaactataataaccagtctgtgcatgtacaagctgaggccactacatttcgaggtacatatgtacaggtaaaagcacaagatggcaaggttttttggattgacaagaacgggacggcacaattttcgtttgataaagttgtttcaaataaagctgtgaattatacggccacgattcaacaaaaggggcgtgctgatggcatttatactgccggtccttaccatacctcagttgaaacatctggtggtaacagtgatgccactaagtataacggtcaaaaggttcaggtgattgctgaagccgttacaactagagccggtggtacaacttataatcgagttaaattagcgaatggccagactttctggattgacaaacgcggcttgacaacgacgacagcgactgggacatcgagttacgataagattcttactactaagtctgtaagctatcttgccatagttgatcagactcatcgcgccgatggtttgtatcaggaaggcccatatcatacatccgctgcgactgcgatcggtaatgccaataccaaatcattaaatggccggttagtgcaggtcatcaacgaagcgacaacttcgcgtccgacgcactcaacctacgttcaaattaggttaggaaatggtaaaacgtattggactgataaattggcactaacgagtttttcgtctttaagtccaattctatctacaaagagcgttagttatagtgccgttatcaatcagaagacccgtactgatggcttgtatgtggacggtccataccataccagtattacaacactgggtggtaatgataatgcaaagcggtttgacggtcagcaggttcatgcctctgttgagcaaaagacagatcgtggcacctatgttaaggtacaatttgcaaatggccagacctattggattgataaaagtggtttaacagttaaataagcgtcaggggtttttagaaccggctctacgttaaacaccttgtaataactggtagaattgttatcagcggctacaaggtgtttttctgttaagtcggtcggttgttaatggtcgtgacacttttctactctgagcgtgtaaactattatcattgaagatcttagacgagatgatagaggatggggacaataaagatgcaggaaatcaggggcgtaaaatggaagcgtgatggtttatggatcgtggggattattgtaatggcactcgttgtcttagctccgcagattaattaccatgcaatggcaattggagatgattgggaatttcaatggaatcgtttttatgaagccgcaatgcaaattaaaaatggccacttcaactttttccaatcgatttatgcatttcggcagtcaggacgggttgttaatgctgtttatggaagtgcgtttgcttatttaaacggttttattttaattctggttaaaacttggtttagagcgcagattatctcaagctttttatgtttactgacagcgggaagcggcatgtattttttggcacgctattgtcgggtcaaaaggcaattagcatttggtgcagcggtgctatacatgggtacgccactagtcatgttttacgtcacagacacagcattaagaggttggggggccgcacttttgcctttcgccaccattccattaattcggatggtgaggaatcatgatcggccgataaacccggttctctttggcttggctgctggaagtctactggcagttcagaactttacagccttactgtatgtattaagcgcggttgttttctttattccgggtctttatctcgcccgggatcgttaccgaacattattagctgcaggtggggctgttgccatcgcggtgggactaaacgcagcaacgttggccgcattgattgatttacatcacgaaagcctggttatgccgtaccgggttaaagacctgatcgggagcgcctcacaattatcgctgggcaatatgacacgtttggactttggcttgattctgtcatttgttgtcgtgattcaactggtctttgcggcattgagttggaaaaaccttgctttgtatgaaaaaatcatcaatgttgacggacttttatttctctggctcagttcgccactttttccgtggaatgtcataggaaagcatttccctgtcattcaaacaattcaatttcctcagcggtttaatgcggttgccttgacgatgattattttaggggcagtcttgtcacttcagaaactcgggcgtggtaactttatgcagttgcgcttaatcgccgccgcttttattagtcttgcgggattaaacctgattaatggctatacgtgggttaacgaaaaggcatcagcatggagaggggatcaattggctgttagcgctgactcgaccattaaagatcaaagtaaaattcgagatttgttcaatcatgcctatgatcagtcacacgtctttagcgttattaccaaaaatacgccagactacctacctgtaacacaaaccggcaacaccctttttgcttatgatgcttataaaagtcagattttgaatcatccactaaaagtagtcataggcgttaactctgatagtcaagttgtttataagtggaaagcaaaaagccgaaaatcagtgctgattccggctattgtatatcgacattcaacagtgatgttaaatggtaccctgttgtcgcggtcagaatatcatcggagtaatattggtgcactcatcgtaacgcctcgcaagggaagcaaccaggtgacgcttggctatcagccgtctaggttatttgatatagcaggaatcataaatattttgacgtgtttagcgcttattctttatggtggctttaggatttttttggtaaatatgaagtggttaagcgttaagggagaagatgcggattcgtcccgacgccgacatgatgacatttagtgagaagcattggcataccacggaggagaagctattgtcgcctaatgtaaggttgccttaagttgctaggtttgtcgcaggaaagcggtagggctgtggtataatgctcaagaaagtcacaacatattgcggcagaacgtctacccatcagtgtgcaggctttatttttatggcctggatcagcagctttcctgttgcatgacaaagaataatgagtgtcatttgaagctttgatccagccatcataaccggaggacaccatgaattatcaattgagtatcgtcattccagtgtttaacagtgaacagtatttaccgagactatttaaaagtttgggtgaagtgccacctgaggtagaaatcatcctcgtcaataatggctcgactgataacagtgcgagtttgttacagcattatcatgagacacatgccgacactgtcataattgatgaaaatcgccgtggcgtggcatttgcacgtaatactggtctggacaattctaatggtaagtatgtctggtttatagatgccgatgatgtacttcttcctggtgcagtcaatcgcattctacgggttatcaagggcaccggctttgatttgctcgtctttgattatctctcattggtcgaaaaagataaggttccaaaagaggcgccagcagtgaagaaagctgagaagactaagcttgctgacatcttacatgaaatgttgacgggtgcccatgatcctatcggtggatttccgcataacaaagtatttgcaagaaagcttatcggcactgaacgcttcgagaatttacagtatgccgaggatttggcctttttcctgcctattctgctgcgtgccaataacatttatcggttacacgatgctttgtatgtttactaccagcatgcaggttccattgctcacaagattaacaccgagaagttaaccgattatgcaaaggtggtcgatgaagtcgaacgcgtgctacgttcgagtgatgttgccgcaaataaagatgttgatgaatacatactgaggagacggttgtcgatttattttcaaaatcttgcggcatcaaacgaccttgggcttaagcggcatatccgcgacaagatggcccaatattcgtttaaaaagttaatgctatacaagaaagacaagaagttggtcattaagatgctgctttacaaattcagagttttggatatttttccatttttgctaaaatacgtctattaactttgcgatgcagacgttctatgcgaagagagtgagtggatcaggaggaaccatgaagatattatttgtgtctacgggacatgtggatgatgattctagattattaaaagagagtgccgctttgcaggctgccggccatgatgtgacaattcttgggtggcgggaggagccacatggtcgaatgacgaccgatacttttgaatttgacggtcagaaactgaaggccatcttcactggaatcaagttgtcgtattcttttaaatattttaaggtccttgcgttcatccgctttgaagccttcttgtatcgctggcttcgtaaacatttacacgaatacgatgcggttcaggcatgtaatgtgcataccggttatgtgacggcaaaggttgttaagaaaacaaaaacaaagttcgtttatgatatcttcgactatgcacctgacacgcgcaattatcctgaatggtatcggaaaatggtcgttcactgggagaacgtgacaatggcaacggcggattggacgctaatctgctctgaagaccgccggcgccaaattgaacctgctaagcctaaaaatctggctgtgatctacaattcgccattagatagttcagttgctgcagatgccgaggttataaatccaaaacaaacgagctttagaatcgtatacattggtggacttagcccgtaccgatgcttaccggaattgttaggtgccgttgaaaataatccggcgctatcattaaccgttgctggccaaggacaatttcaaaatatgtttgcggacgcggccaaacgcgatcaacgaattgactatttaggcgttgtgccttacgagaaagtcaacggaatcgagaaaacggctgatatcttagtcgcgctttatgatcccgtccttaaaaatcatctctatgcttcaccaaataagttctttgaagctatggaattgggaaaaccgctgttaatgattaagcggtctggtatgtcgaactggttaaccaaatatggttttggtgcggtttgcgaaccttctgagtcaggtattgcggctgggttgcaggagcttgttgacaagcgccaagattgggccaaagaagcggttttaatgcgacaaatataccaaaaagaattcgcgtggccattgatgcaacaacgactgcgacgaatttatgcaagttttgaaactaagtgaaatgaggaagcaaattgccaaatcggtttgaagtgacaagaaaaagcattgtatggagttatgcaggaacgatcttttcgatggcaagcaactttttattgctaccaatcatctttcatttccttaattcgcaagagattggctattggtatttgattttaagcatcaacggcctgattgctttgtttgattttggctttgatccggcgtttgcccgtaatattgcttatatttggtcaggagccaaaacgctgaaatcacgtggggtagataaggaacatgatcataccgtgattaattatcatttattggcctccacgattcacgctgcccgcgcgatttatatgattctagcgatagttgccgttgtgctggttgggattttcgggaccatttatatgaacgcgtttgtgttcagcaaattaccagatgctgaatataagtggacatggctggtattttgtttctcgcttttcctaaacttgtatttcggctatttttcggcattgcttcgcggatcgggtaaaatcgattcagtcaataaggcacaggtattctcacggtcactccagattctgctaacatttggtggctttctgatttatccgtccattctatcaccagttatcggactggtgatgtatggtattattttccgaaccatctgcagtcatttttactggcaagatgaagaggttcgatctcatcgtgatgtactgaagtcacccatgaattggcatgaaattaaggaaatctttttgtttatctggccaaatacctggcgtgatggccttgtcagcatgtctaattatgtaacttctcaggggatgtcactgatggctggagcctttttacctctgtccgtgacgggtgtttattcggtaggggtccaatttgcgtctgcaataggaactgcctcttctgctatcaacggcgcctataatccgattttacagtcaaattttgttaaacaagattttgcttctatccgcgataagacttccaaagccgttgccgcctatgtttggctttttcttatcgcatcggtagggacgctattagtgattttcccattactgaagttgatcaagcccgcctctgtcccgacactggaagtctttttaccattaatcctgtattattttctttatcagcaacactcggttcatgcctcttatattgctaatgcaaacattattccctataccaaggcttttcttatttctgcgggtgctaacttggtaggtttatggttggggcttgaattaacgaatggtaacatttactttctgctgttcttcccgattctagttcaagccgcttataataactggcgttggccgagttattactataagatgattgatagcacgcttttgtcctctataaaacaaggtaccatcgcgtggggaaaaacctttgcaaatttctttaaatctggatcaaacgtatgacttttgccgatgttgcggtatgatgaaaacgcaaataatgaaggcggctgtctataattaagaaatgtgtttatgatggaggaatcatggataacttattgagtatgaaagaattgctggtctcacttcgaaagaactggtggttggcactttgcactttgttgctgggcgctgtgatcgcaggcggttatgcttatggtgtcaagaaaccgtcttattcatcaactgctctggccgttgtcaatcagcagaagaataatactgaatcactgagccagattttaaatcaaaaccaatatgattcggagttactggctactggtaaatctttgtttaaaacagcggctgtttatgatagagcatctgcacaattacttcaaaaagaacagctgaaaattagtagtggtgatttgcaaaaacaggttaaggtagacaatgaagataattcgcgtgccttttcgattcatgcaacggcaaaaaatgccaatgatgctgcgtcaattgccaacgaggtagcggcggcatttcaaaagaccatttcgtcaattacgaatcatacagataccgttacaattttagctaaagcagaacctagtgatgttgctgcaggtaccaaaccgcttgtcctcatcgtgattggtgcgattataggattcttagttggtcttgcctggattgttcttagagaaattaaacaggcaactattaagacaaaagagacgctgattaaggtcgcaaaagcaccggttcttggtgttatctcgacgaagaagctatgaactgatctctgtatgatataacggttttgacttgatcgtgtttaatttaaaggagttttccatgacaaatgaacttgcacatcaatttgtgagtgatgcgtccgtctctagccaagaatttcggacactcagaaataacttgtcgttacagatgagtcggtctgatcggccagttttacttatcacctctgctacagaaggtgagggtaaatcttacgtggcagctaatcttgctgctagctttgcaatggaaggtaaaaagacgttgttggtcgaaggtaacctacatcggccgattttagcttcagtgtttgacgttaaggatactgaaggactttcttccctgattcatgtcaatgacgctcaggcggttaacgttgacgatcttgttattaacaccaagattcaacaactcgctgtagcccctgctggcagtgagcttggtgatccggccaagctactggcaggatcttcatttaaaacctttcttgatcaagtaagacatcaatttgatttaatcttaattgatggcccggcgatggctgatgctagtgaagcgggcttaattgccgagcttgcaacaggtgttgtgattgttaccaaggctaatggcccttctaagcatcgtgtagcgcagacaattgcccaagttcgacagttaccggctactttaatcgggactgtgttaaaccaagcttaacagtggtaaaccagagggcttcatcggcaaatgatgaaacgttgatcgcataaagggcagtaggagaatgatgttgtggctttttatttaggtctctttgcaattatgataatcttcatgttactcggacgtgtgacaatgtcgtccgtttgggcatggctgggtgtcttcatgcttgctgttgttgcaggtttgcgatatgaaactggtaatgattttttgccatacaagacaatctatgcgggtgattattcagctggtcaagtcgaacctggatttttattcttgcgcaatgtcttcaacttggttcatgcaccgttttggcttttccttttagcttgggcaacggtcacgttagtcttattttattgcttcgctaaagaatactttcggcctgcgatcattccgattgcatattatatgagtcgctttttctttatgcgcgatatgggacagattcgtgcgtcacttgtatgtgtcatttgcatgttggcactaaagtttgtttacgatgagaagccgttgccatttgtgttggtagttggtttatcagcaacgatccatgtttcggctctattctttttgctcatatatccattttggcttctatttcgcaagatcacttttaaatgggtgcttggttttcttgttctgggtgcagcgggaggttttattgctcctaaaatcttaagtgtgatcattgtgcacacattaccacgctatgcaccgtacgtcacaaacgctaattatttatcagcgggtttatttgacccggtaacccttatgcaggttttgatctgtataaccggtttttatattttacaacgtggtattgttgcggatgccttgattggtggcaaagacaagtttaagttcctgatgttggtttacttatttgccaccttaacattgctgtctttgtcacagttatcaacaattggtgggcgactttcgacaattgcaacaaccacagagacggttgttttgcctaccatcgtcttttcgattatgccaaaaaagacgcgaacattagcaatggtaggtgtttgtggcgtcatctttgtgttaatcttcttaatcagtggtgcatataagacctttattccttatcaaatggctttttagttttcgattaacccccaattgtcgccattgtcgacaattgggggttttcacgttctaaagatgtacactgactctggcttgagttttttcgcttattaacatttgtttgtatttaaaaagacggttttcatttcagtgcaaaattgcatattatgacagggatatcttttaaagtatcttttgtaaactagacgtgataccattaattttatgaactgaatgcgattaaattataagtggttattaaagtccatttggggatggatttctttttgggaggtttgtgtttgtgattgatcttgagacacgttttagtcggttaaatatcaaagtagctgtccttttttttttacttacgatatcgcccaatccgatgttggattcttttgccgttacttctaaacgaactgagatttaaactgaagcaaattgaggagctaaagtatcaagctgttttctggcattatttgttaagcgtttcattaacagaagaacgttggcggcaattcggtaagcgcttaagtaaacggtctcatcggcgtgttaaagcgaatacttggttggtagctgatgtgccggactttttgcttaactgggtaaccccagatagccgccatgttggactggatattgatgatcatggacatcttcttcctcaagcacgaacgcttaaggctaagatgggatttttggcacctcattcgctagtggtatcaccacggttttatcggttattcgtgcgcaacactggattggagaaaagtgcgcgcattgaggctaacaaccgtctttttaaaacctacaaaggctttaatcgctaccagattgcgctatttttaagaaatgcttttgtccttttaatcatggctatcataactggcatcgtaacgatttacttggcatctggtgactacgacttaaaattaacgctccttgttttttcaagtgcacgtttggttttgttcaacattttgccgatcttcgttgtcatgctcgtaacttacttgatttttaatcgggtgcaattggcaatttttgtcgggcaagccctagctattattgttgctatggttaattacttcatgttgcaatatcgtgactatcccttcgaatttgcagatatttctttggcatcagaagctagcaatatgggttcaagatatagttatattccaccggtaaagtacttctttatcattggtagcttgttgatactgactatcatcgttggtctatttcttaaacctgcgatgattcgttggaatacgcgcataatcgcacttgttcttgtgatggtcggatcggctttcatgcttcatcggtactacttagtcgatgattattatactttggcgaacaatgacccctggggaccagatgcagatcgctatgttgttaatggctacatgttttcttttattcactcagttaaaaacgactggttacttccgcctgagaattatgatgccgcaagtgccaaatcggcgctgactcaatatcagtaccaaaatattcctgccaataagcgcgtgaacgtgattacaattcagctggaagctttccaagatttttctaagtgggatcaattggatatcgatccttctgtctacgcgggatttcatcaggtagcatctgaaggtatggcaggtgaattgacgaccacaatttttggtggtggaactgtggatacggaacgcaaggtgctgaccggttttgcggatttaagccccattaatggtatgactaattcatttgttcattatttcaatgagcaaaaatacgtcaccagatttatgcacccgggcgatgcatggttttataatcgccaaaatattgatcgatatctcggtttccaaaagacactcttcagagaaaactattatgacaagaatgttgctaatgtggacgttgttcctgattcagaagtgtttactgatctcgtcaagcaattgaaagccgtaaacgcaaatggtaagcaattctttaatcaaacagtcacgatccaaaaccacggtccatatggcactgattttgatggcgacacattgctaccgtggaaaaagggatataacaaaaaggattacgccatcattaacaattacctgactggcattaaagagacttcggatgcgctcttggaacttaaggatcagctagatcaactagatcaacctgttgttttagccttctggggtgatcataatccatggggcggcgacaagaattcaacatataaaatgcttggtgttaatttgaagcagtcgacacgggaaggctacgagaattattacaatacaccttacgtcatgtggtctaatcaggcggccaaaaaattgatggccaaggatttttccggacaaggacagaccatgagtcctatgtttgttcttccggaaatcttttcacacgtgggatggaaaggttcacagtatatgcaagtgctgcaagatctcgaggcacaagtccctgtttttggcgaaaaaaatcattatatgattgacaataagcttacgacaaagccaaataaaagtgagaaggcggtcattaagaaattcgatgatgttcaatattatttgaaatcgaattatatgctgaatcaggcaaaacttaaatgatattgggtttggtgcttatctgcgggaacgactcacatatatgatgacttgattaaaagaaaaccattttaccgtttttttaagtgtctcatggtaaactcaacttcggataatctttgatcacaatgtggagggtaagcgtgaaacacaaatatcttttgttagggtggggccttgcgctaattgcggtattggccgttataatctgtttttcgttaaagttgtatgttgatcaccagactaatgtagcgaagtcgcttagtgctagccgccattacgcctcggttcgtataagtgaatcaaaacgtagcatgtttagcaagcaggcggcatcacgtcgccaacaagaggcggctcggcggcagtcgtctgagcaggtacaatcgaattctgggcgtacccatattcctgcagccgacccgtatgcttaccccatcgctcaagtcaaacaagagatgaccgccccaaacactagcagcatcaaagaaaaagtcgtgttcctgacatttgacgatggtccgaataccatcatttctcctcaagtcttggatattcttaatcgggaaagcgttcatggtacctttttcgttgtgggtcgccaactttcgccggaaacgacaccggtcttgaaagctgagtatgatgccggacatgcaattggtttgcacagtatgacacacaactacaatttgctttatccgaatcgagtgggtgcaacatcggcaattgaaaatgaggctaaaacagagcagactgctgtgaaacaagctttgggacccgatttcaatactcacctatggcgctatccgggtggccattttagttggaaaggcttgactggagctgatactggtttagttcgcttaggacttgattggatcgattggaacgcggcagttggggatgctttgggtccggcacaagcgccgaaaacagaggaagctatgctacagtatcacttgcggtctttgatggtttatcccgacagccacgtacgcgttgtattaatgcatgatgccgtggggaaggatctaaccgttaaaacactgcccaagattattgcgtattatcgcagtaacgggtataaattcggtattttggagtagtcgggtttgtagaagcttgattgaaattcatatttgacattttaagtggcgtttttcaatttagaaattccgttaagaggctacttgtggcttcgctgtgatcagggctgcattttcccgatttctaagcacaccgcgactcgtactgcaacaaaaaaacgctttgccacccctgcttacaattattaagcagggaaaggcaaagcgtttttgtcttgctttgaagcgtaaattaaacgccttcttttaccgcaaaccgtgccaacttacctttttgaaccgggttaacaacggctgtaatgcgcgtgccgtgttccgtgtagtcagtggttttgaccacagtttcctgattgaggtagttgacgagctgaccttgatcaaatgggatcaggtaggtgtgttcttcatcttggccgaagagattggctttgatgagatcggtgagggcttggagcgagcgtttgtcacgagccgagtagacgaggcgttggccgtttatttccggataacgggtgccttcgcgtaaatcggctttgttgtaagcttcgatcatcgggatattggtgatgccgacttcacggagcgttttttcggtgatggccatcatttccgggtaattctcatcggaataatcaactacctgaatgagcaagtcggcgttggcagcttcagcaagggtggctttgaagctgtcgatgaggttgtgcggcagtttggagacgaaaccgaccgtgtcgctcagaaggaatttgcgattatcaggcaaggtgatttggcgaacactggtatcgagcgtggcaaatagcatgtctttttcgaagacctgtttgtcttccgggcgatccgcaaaaagctgcagcagcccgttcatggtcgtgcttttgccggcatttgtgtagccgactaatgcaacaactggaatggcgttgtcttcgcgacgggcgcggcgtacttgatcgccgacgctggcatctttgagttcttgccgcaagtgactgatgcgcttgttgagcacccgacgatcgagttcaagttgggtttcaccggcaccacgcgtggcaaatccggcgccgccaccgacttgctggtcgaggcggttggcgctgggatgaagccgcggcaacgcatattgcaattgggcgatttcaacctgagttttggcggctttactgcgcgcgcggtcggcgaaaatatcgagaatcagctgcgtgcgatcaatcacgtgcagtttggtctgcttttcaagattgcgcaattgtgaaggcgataattcatcgttgataatcacggttgaagcctcgcggacatcagccagttggcgaatgtcgtctactttgccggaaccaaagtaagtggccgctactgcgcgatcgagattctgccgtacttcgccgacaacggtgtagttatccgctttggctaattcaccgagttcggtcatggtgtagtcaaagtcaggttgttgccgcgaaatgccagcaatcagtacattttcagaagttacttcattagatatttgttcagtcataaattcctttcatagatccgggcgttatcgccacagatcggtactaacgaatcgacagtcatggtgcaaccttgcgtaaccgcatggcgattcacccctctcatttgaataagtctagtgtaacacgggaattttggaaagactattagaacggactattcgaggactgttcaggctagtaaaaaaagcagcacgacagtcaaaagccgttgaaactgcgcaacttaaaagtaggcgatataaatgcaataagtcattcatatgcggcacttccagattattttcccaccggtggggccaatacttgaatatggtcagcgatgacagtcaattttagcggcgtcttggtgctcgggtcgccgtcaacccggctttggagcgtttttggagcctcgatggtaagttgctcggtggcgaaatacgtcatgccgggtagtttctgaaagttgccggtgatgaagtaggggatggccagtagtgagcgccaccaggttagttttggggcgataaaaacgtgcagatgaccatcatccacggcggcatctggcaccgcattcgtaaaaccgccaacggaattggtcatgctgactagcagaaattgggtgtctttttcccagtgattatgggcgctgttcaagtgtaggatccagtgttggtgttgggccaaaactttaaaaccctttaataagtagatgatcggaccaaaatggcgtttttctttttgagtgacggacaacgccgcattggctaaaacgccgagtgtcagggtacttaccatgtagcgatcattgacctgtgcaatgtctaatggctgcggcttggcttctagaatgttcttgatcgccagtggcagcagcaacggaatatgcaggactttagccaggttgttgaccgtgccttccggtaaaatagcgagtgttggcggttgtttgcgcggtgcgagcccggcaacgacttggttaatcgtgccatctccgccaactgcaacaacaatatccgattgggcttgataagcaaaatttcgggcgtcatcagcacttttggtcggtgccatggagacttgccgctggcgatcttcaagtttggccttgagctgttcggcggcagtcgggcctttagcgtggccggaagcaggattataaatgatcgtgtagctgagcatatggcacctcctaatattctgagtcttcaacgattgtttaaaaataagtcgaagcagctatgcaaaaaccaatttctacaattaattttatcacgttgttacgatggctacttaacttactgccagcatagtaagtgccaactttttgctacgatggacgcggtgtggtaacgatgtcgttgactggtagatactcgcagttgattttttctgctggacaatccggttacagccaaaaaatgccctagcaacaggttacgttgccagggcatcgtataactaatctttattcgccaaaacgttctttaacatagtaagccagaactcatccctcatcaggcgaaccagctacccgttgatgccgaccgtttgcggtgactttgagcaccaccccggcaatggcaaggtcaacgatgataatcagtggccactgaatgacaggcgttaagtgatcgagtaagttgacgtgtatcccataagtagccgcgacaactagcccgactaagctgagggtagtgagtaccaaccaggtgttgcggctaaacgcaaggccgttgttcgcttgccgctgacgtttggcgatccacggcatcaaaacgccaagcgcgaccatgccaattggcaccacgatattcaaaccgagcatgagtgcaaaagtgtccgcggtggcgtcagtcgggaagaagccaagggtgccaagtaaaaaggtaatccctaacatccagataccgacaactaagccgacttttcgatttttaagaaacgtataatcaggcgtcgggaaccgatcctgatgtaaccggaccatcgtgtaggaccagaacaagaagcaagtggacagcgggctgacaataccgttgagattgagcagccagttgaagatgtcattgattttcggcaaaagtgcgccgagtgccatgatcaacgcacacagaatcgttgtcatccagtaaccattaatcggcaagccgtcttcgttcatctttgtcaactgacgcggcatgaagcgcttggccacatcggacaggaatacccgggttgaggcgtccagaatcacagccagctgggctaacatataaataccttgcaccacggcgaacagatacatcagactgttgcccatcccgaattgacgaccaatggcttgaaacgcatagtaggaaccattcattttcaaatcatttggcagatggtgggcgttaaagtatacccctaatgaaaaggtgccaaaaagtgtcaggaacatggtcatgatcgcaatcattttcaatgctttgggaaaatcacgggcaggatggcgcatgtccttggtgtaaggtgcagcaagttcggagccgttcatggcaaagacgaacaagccaaaagtcgataggaagctcagtgaaaagaaatctttggggatgaaggccttgaaatcaaacgggcgggtggcaatcggggcgcctttggataaaccgatgaaggtcatgatcacgaataaaaccgtcatgataaacatggccccgccgccgattgttgacatgatctcaagacttttatttttaaagaagtgctgtaaccagataaagatcacaaagataacggccgtgagaataccgaaccatgcgttaccaaggttagcttgaatgttgccgttgccgttggtgatccagccaaaagaaataacaaccgaattggctacgtccacgacataaggcagcccggtgatccaataaaaccaagccgcatagtaaccaaccgtatcgccattggtttcgcgcatccagctggtgatcccgccgccatgttcggaaaaagtcgaacccatatgcgcgacaatcagattatacggaatgacataaaagaaggtcatgataatccagctggtgaatgccaccaagccttgattctggaagttatagatgatgtcgtcaaacccgatgacggtgacaaagtccatcaagccgacaatcatccagggaatgaactgcttttgcggtttttctaaatcattcatattaaaatgtgctcctttactaagttcaatcagccgctgattttgaacttagcccgggcgctttgttgcgaaaggttcccacgattaaccaactttcataaggattttcatagctcatgtgtgattatagcaaggattgcggctagatggggccaaaaataaagaaaagctaaagtagcttacaaacccgttagtttcgatccggcatccgttagtgcattatcaggaaaaaattgctggcagccattatcattaatcttgtaaataaaaagcaagcacattgcaaatggaggtttatcatggacaagcaacctgttgtaacggttgaaaatgttacgaaaacatatggcaaacaaggggaaaaacaaacgccagcactaaagggtgtgagttttcaggttgaacccggtgaattcgttgggattatgggtgcttcaggctccggtaaaaccactttattgaatattctgagcacgctagacaccccgacatccggttccgttcgcatcaaaggcgccgatgtgaccaaactcaaaggagacgccttatccgattttcgcgccaaaaagatcggctttattttccaggatttcaacttactagaaaacttaaccggccgggaaaacattgcattgccacttgccttgcaaaatgtcagcgctaaaaagcaaaccgaagccgttgataagatcgcgcaaacgcttggcattgaacgcgtgttggatcattacccaaccgaactgtccggtggtcaaaaacaacgggtagccgcagctcgggcattggttcagcagccggatattctttttggtgatgaaccaaccggcgcacttgattccaaggctgcgcgcgaattgttggataccatggcgcatttgaatcgtgacgaaggcgtgtcgattctgctggtgacccatgatccgttttccgccagctatgccagtcgaattttgttcatcaaagacggtcagatcggttctgaactggttcacggtgacaagagtcaagaagctttctatcaagagattcttgagaccctcggcacatttcagaagtaggaggcagcaagaatgttaagtaaactcgcacttggcggcttaaaaaaccgtttccgcgactatgcggtcttattctccggactggtcattgccagcgctgttttctacatgtttatggctttagcaacgaacacgagctttttaaagaaaaattcacccatcggcttcaccccgtttatttttgggttcggggcagttttgctggcgattatcacgttagtttatattgtgtacgccaacagctttttgctcagtatgcgtcaacgcgattatgcgatgttcatgatgctgggcgcaaaagggcgtaaaatcggccagctgattttccttgaaaccgtcacagtcgggattatggcgacgattggcgggattcttattggcatggttggcacactttttattggaaaatggattatcgccgctttacatgcaccagccacgggtttttcaccgatctgggtgccagccattttatggacaatagggttcttctttgttctatttcttttgtctgctatgtataacgcggcaaaattgctgaaaacgccgatgttgcaattattacatcaggcacagacaccgaatcggattaagcaacgcaaaagcagctttgccttgcagattgtcctcggtgtgatcttgctggccatcggttattacagcatggccaatgtccctaagtttcagttaatggcgattccgctagctttggtaaccattgttttgggaacatatttcttatttaattccgtctttgtggctttaatcagtttaatgaagcggaatcggacatttgcagccaagcagttgcatacgttcacattgtcccagctcagttttcggattcgggactatacccgcatcttatccgtagttgccatgctgtttgcactggctttaggcgccattaccgtggggatgggctttacgcatgacattcccaagctggcaagtcagtcgacagtttacgacgtgacggttgcttcaccaaatgccgccacccgcgcagaaatcaataagttgcaggatgtgacggccaagcagcaatacgaacttaaatcagatgctaaaaccgtctacatcagtaaggcgaaacttgacgcccatccattggaaattaaagcggtggataaaggcatcaatgcacccaacatcaaagtcaccagtcagaactttgaaaagctgatcgaattgtaccccggtgcttttggcatcttcatcgggaacaatcgcggcaagcagatgaaggttgcggatgctgccacttttgccaagttgggaaattcggaaaccttgacgaccattaaagttaaagacttcaatcagaattatgatacgattcaaaagattgtaacgctgcagcagcaccaatatccacggctttggagcagcaatggcgatcagaaatttgaattctatgcggtggtcaatggcctgtattccggcttggctttcatgggcttcttcctaggaattgctttcttggcgatgttggcttcaacgttgatgtttaaaattctatcgggtgccaattacgataagaaccgttatctcatgttgcaaaaaatcggtgcccggccgcgcgtcttacgtcggtcgattcgccaggaaatcggcgccttgttccttttgccaggagtggtcggcatcgtgcacgtgttattcggattacagttgttcaagaccctgttaagcgagccatatggtcatttgttagtacctttcgcgttattcatcgtgctgtacggtctgtattatctggcaaccgtctggatttaccagagtattgtgattaataagaacctggcctcaaagtcgtaagcaacccggcaatgtggtgtgaaaagatttgaaccgttaaaatgaatcgtaatcggctttagcgatggttttgcctatcacgctaaagccgatttttgtttagtgcgttatgaaaaatcaaaatactgccgggccaaccgtgaagcgctattcgtcatggtatgaccggattgagctttcatttgcagagtacggggtgatatgtgcatctgttccgatttcgctgttttgatgcgtacatttggtctggtcgagcgcttacatggcttcgtaaaatagaagctgtaagaaagattaataacaaacgtgctaatggctattcgggtgcagtaggtttgacgctttttaagacaacaaaaaagttgatctgtttatttgacactgtatagggatagctttggcatgatgaccagaagaaagaaggaacgttttcatggcaggttcaaaaaaagatttcttgaatccggaatatacacaggcgtttattgattcaccatttgtgcaacagatgcgtaaggtgacgtggaatctttatcaacatggctgggatgaacgaaatggcggcaatgtcagctatcggcttacaaagcaggaagtcggtcagtacggcgatgttcatgaagtcaagcgcacgatcccgattaagtttgatgctagtgccttggcaggtcaatatttcttggtaaccgggaccggtcgctatttcaagaacgtcaaagacttcccggaacgcgatacgggactggttcggattaatcaagacggtcaaagtgttgatttactctggggcttttccgatggcggccagccgaccagtgaattcccggcacatttgatgacccatatccaacggcttaagcaggatcctaatcagcgggttgtgatgcactgtcacccaacgaacaccattgctatgacctttacgttaccgtggaaagaaaaattgttcagccgcattctctggaagatgcaggcagaatcaatcgttgttttccctgaaggcgttggtgttttaccatacatgacgccaggaaccaacgaaattggccaggcaactgccgaaaaaatgggccaataccgcatcgttttgtggccgctgcatggtatcttcggtgtcggcgattcgattgacgaaacatacggcttaattgaaaccgttgaaaaagccgctactatctacaccgcaattcaggcgcaaggtggtcagtttgtcaacgaaatcacagacgaaaatctggaacagctggccgaacgcttcgatttgaccccgaatccagagttcatccacggcggttcactcattgagcaaaaagaattggttcactagtcgcagtggcctagatagggaataaagttgtctgaaaaagggtcacacaaccatgcaaagctgggtgtgtgacccttttggtttcatcaaaaaaagcggctgaaaaatcaccgcttgaaggtttaaattgaatcaggcttcgaattcattataacttaagaccttaatgcctgtgtccgtcagtaatattttactgattgaaccattgcgcggtgagtcggttactacgaagccatcatttttgccaaacttgtcaacaatactgcgaatcgttgtgccatgactgaccatcagcaccttgtcgccttcatgattctccgagcgcaactgccgaaatcctttcattagccgcgtccagtaagttcgagcgtcttctgcttcatgaaacggatcagcgtcatgcatgaagtctttagacgcatcgacaccgtatttttcgagaatctccggataagtacgggcgccatgggggaacccaaccatgtaccaggtttgtcccgaatcttcaccttcaaaatagccgtaaaattgttcccggaaaaacggcgtcactgtcagcggaatcttacccgtgacatttttgcttaaaatcaagtctgctgtccgggttgcccgggtagtgtcactgcaatacgcgtgggtaaaggcaacattacgcaagatgactccggtattggtgccgtccttgatcccgttttcagtcaacggcgagtcgctccaaccctgcattttgttaaagtgattaaaccatgtctgcccatggcgcactaggtagacggtaatgcctttcgtagccattaaatttgcctcctcgacagtctaacgctcgccgatttcacctcggcaaacattttatctttctaatgttagtttagcatagaagcaggagttggttggcgggaagcgtgaccaatattgtggtgcggcgaggtttttgtgtcccgaaagcgcgaaaaagatttgccgtcagcgtaggctttggcagttgataaccgggatgatttaaacgactcgctccaagaaaccaaatttaaagcgatggacctgtgttattcttaaattataatttttggagacaatgggggcagttaaatggcaaaggggttattaattgtaaatttgggatcgccggtttcgccgcagaccaaagatgtccgacgttatttgcgggagtttttaagcgatcagaatgtgattaccatgcctaaaattttgtggcaaccgattttacgtggatttgtgctaccatttcgcagttggcggtcagcgacattttatcagcacgagtggacgcaggctggctcaccgttgattgcttatacgcaagtcacacgtgatcgcttgcgccaggcacttccggattgggatgttcaaatggcgatgacttatggcggtcagtatcccattgccgcaactttgcaagtaatggcggcgcgtggggatcggccgattgttgtcattcccctttttccggcgtatacccaaagcaccaccaagacaatcctggaaaaagtcgcagcatcgggtgttaaaacattgaacgttgagcacttttacgagcagtccgcttatcagaagttattagcgcaacaactggacgatgcctacatacaaggtgactatgatgccgtgattatgagttatcatggcattccaaccgcgatggtgcggcatggcgatccttatcagcaagcctgtgaagcgactacagcaggggttaagcgttatctgaccaaagtgccaccggccattgtagagacgtgttatcagtcgaagttcggaccggtgccgtggttaaagccgtatttacgcaaccgtttaatggccttagcagcgttgggcaaaaggcgggtgttggtgacgacgcctagtttcgtgacggattgtttggagacgttagaagaaaatgatgttcaaaactatcaaacttttcgcgctaatggcggtaaagtctttaaaactgtccgccccatgaatggcagttctgcgttttgtgactttttagcaacgctggcgaaagaaaaggttgctgcagaggtgatgcgtcatgaccaagcgaaatgagcagctcagtgtccagcaagcaaagcctagtttggatgagattaatcgcagtgtgcaggtaccgggagtgtatgaaccatcgtttgttcaaaagttcctggcttacagtggtcccggcgcgttggttgcggttgggtatatggatcccggtaattggctgacggcgctggaaggcgggagtcgctatcatgagacgttattagcggtgttgctattgtcaattttggcggcaatgttcatgcaaaccctggccattaaactcggggtggtcgcgcggttggatctggctcaggcgattgcggcgtttgttccgaagtggagtcgaatcggattgtggctggtgaacgaagcagccatgatggcaacggatatgaccggagttgtcggtacggcgattgcgttgaagctattattcggcctgccattgatgtgggggatgctgctaacgatcgcggatgtgttggtggtgttgatgtttttgcggtttggcattcgccggatcgagttgattgtgttggcatctattctgacagttggcattattttcggcattgaagtggtgcgggcgcggccgtcaatgggtggcattgttgcggggttggttccgcataccgggattctgactaatcgtggcatgttgttattaagcttaggtattatgggtgcaaccattatgccgcataatatctacttgcattcatcgctggcccaaagccgccgatacgatgaacatattcccgcacaagtcaccgaggcgctgcggtttggcaaatgggattctaatgtccatttagtcgcggcatttgtgattaatgcgctgttgctgattctgggggcaactttattttatggcatgagtagccacgcgaccgcatttgaaggtgtttataacggcttgaaaaatccggcaatcgtgggtggactagccagtcccctaatgagcaccttgtttgcctttgcgttattgatcacgggtttaatcagttcgattgctagtaccttagctggtcagattgtgatggaaggctatttgaacattcagattccgctgtgggccagacgtttattgacgcggttggttacgctgattccgatcatgatcattggctttgtgatgggttttagcgagcaacactttgagcaggttattgtttacgcgcaagtagcactgagcattgcgctgccatttacgctatttccgctagtggcattaaccgatcggcgtgacttaatgggccagcacgttaattctccggtcgtgcgctggatgggatacgttttaaccggcatcattacgttgttgaatgtgcaacttattttgtcagttattttaccgtgaatacaataaaacggtcgatgcgcagttatgcatcgaccgttttattggtgaatctgatctggtacgtgaaagatattgcgatcagtaacttcctttaattacgaaaaaggatccgcgaatggtgccggcgagttttgacttttggcgggcgaatttaaacttgtccgcgagttcggcgggaacggtcatgccatcgctgagtttaaagccgaccgcccgttttttgggatcagtaaggtgatacatcacattgatagctagtccatcttgataatagacttcaacccagcgcagatccggtagcgcaaggtcacagatttcaagtggcttggcagcgatatggagctcgcgttctgcaagaattgcctgcacccaagcgaggctgtccggtttttcactgacaggataggcgacatagggaactttatatttgttccaaatataccgggcttcattggctctaagcccagccaaagccggtgcaacaggagaactttctaagccgttggtgctaacggttttaaaatcaacggtgtaagccatggtgagatcctttcatgttaaaaagatgcatagacaaaaaccgcgaccatattaacagtaagggcgcggtttttaccattagtcgttaaaggtgccgttttcaacatcggaaatgaattgcttcaaatgcttgaagtaaaccggtgcgttgtcaatcatgtgatgatggccgccatttggagtcgttaccaaccgagcatgcggaattacttcagccatgcgctgggcagcttttagcggcatggtttcgtgttcgccaaatgtcagcaatgtcggcactttgatgttgtgaatttgatcgctaatgtcccagtccttcagcttaccggtgacgacaaattcattatcgccttggaacgcattgtaaaccggcgttgccatcgtgctaattagatgtgagattgccggtggctgcttgcgatcaacatagccgcgatttaagacatccacatatttttgatattgcggatcgtcccaatcgccggctttttcgattttcttcatatattttacggctgaaggtggcaatgcttcttcgcggaccagattgatatgctcaacatactcgttaatattgtccaccatcgatgaaatgatcgcgcctttgagatgctggccgtatttcaacgcatatagttgggtcaaggcaccgccccagctttggccgatcaaataaaagtgatccaatcctagcttcttgcggacttcttcaacttcaccgagaaaataatcggttgtcagatattttttagcaatttccggatcagaataatcgggctgatccgagtaaaacgacccgagttgatcgtacatatggacttgaacgccgagatcagcgagttcttcaccaaaattctcccagtattcgtgcgtgccaccagggccaccgtgtaggcaaagcaggtgaatgtcaccttcgccttgcgtattggtccacaagtggtagccattgtctaaggtcaggatcgttgttccttgtttcatttgatcacctttttttcttagaataatctcattgtaccacggaaaatagcctgacaacggcgtaaaaaaggaagtgctgccatttataactattttgtactgagatcagtcattggtgagtatcaaagcagaatttcacatcctgattgagcagcattaatttaacttttcaacctgtgcgcggatattgcggatgaggtgcttgtccccggagaaaatgaggtggtcaccaaggtgcagttgggtgtcgccgtgaggagcaatgaatttcttttgtcgataaatctggcttacggtgatgtcgtcaatgaacggtaaattcttgagctcaagaccggcaaaacgcgaattgcggatggtgacttcatagatgcccgcaattgtatcatcaaggattttcaacgtggacggggtttcgatcaagctacgcagcaacgcaacgttggcatcgagtgcattgaaaacttcaacgccgtcatcgcgcaatcggtcatagcgatcagaggtggtatcttttgcggcaaaccgggcgatgattcgtggaactttctgtgctaatgccatttttgccaagtcgtaattggtgtccgcgtcgaaatcacccagcaccatgacgtcacaataatatgcgccggcagcttttaacgcgttttcctgataatccgttaatgtgattgccacttcggagttatacgtccgaaaattttctacccgatcggtaaatagttgcacctcatagcgctcaggacttaaatgttgtgcgatgggtaccgtcaaaagattgccgccaataaaggtgacgcgggtctttttgaaggtttcgggctcaggcttgaagaaactattgaaaaggattggccccgccacacaggcaatgaccgctgccagtgtgaacgcgccggattgctgctcggtcacgataccaaggttgcgcccaacggttaacgtcggaatgaccaaggtgatggtggtggtggctaaaaacgtgcctgccaatgcgttttgcggcttaaaccgctgccgcaaaacaggaatgaggccgattttggtgatgaaaaagccgatgagcaccaacggaatcaaggagaggctcttaggatcagcgactaaagctttcaaatcgaggtttgccccagtgacgatgaagaaaattggaatgaagaagccataacctaaggaagtcaatttatcctgagtttcttggcgcggaccaaggagcttcatcaccatgccggcaagaaaggcacctaaaatggactcggcacctactcgtgaagcgatggtcactaaggtgaagactaagaagaacgccaaccgaatgtctagttgcgtggtgcttttatcaatcgccgcaaaaaagctgtaaatgtgtttgaatcgcgctagtaaaaccaacgccgccagcagcagtaacagcagtaaccatagattgttatcgcttgaaccgtttaaggctgagtaaatagtcaggctgataaggggaatcacttcacccaaagccgcaatcagcaggatcgtttgcccaagcggttgatgtaacaactcctgttcttttaaagccgcaatgacaacgccaagcgcaatcgtggtgaacagaatggttgcaaaaatcgggaagttatagaagtgaatgaatttgagtaggtaactgaatcccaaactgatgatgatgaccgttgcaaatccaactgtggctagcacgactggattggccggctgaggtcctttgtccgtcttgggctgtggtttgaaaagcgaaaagtcgatttccatgccagacaggaagatcaggatggtgacaccgagttcacttaacgcctgcatttcgccgccagtatggacccaacctaagagacttttgcctaagatgatgcccactagaatctcggcaacagcagtcgggatactattaatatgaaagtgcgccattaacagcggcgtcaacaacgcggctgtcaagacgattaaaagtgaaatagattccataatggcctccgatcagagataatggatgagtcaatcgtaacgaaaagtgtttataaatgaaaggaaagcgtatgatacaaaatcaaaaaccttcacgtcaaggtaaatcgtttttcaatcggcgtgccgtcatcgttggtacttgtgtgttaatcgggttgttggtcagtttaccgtttaaaaagattctgttaggcgtggcggttggattggcggttgggtatgtgttggaggcttggacgccgttgttgcgcgggaagttgaagtaggggcatttgtgttctggcttatgcccataacgcgctcaccggcgcagggatctgcgtgtaaggacattggtggcaatgggcaaagtccggccattacgtttaaggccgcttttgttctagcttacgcccataacgcgctcaccggcgcagggatctgcgtgtaaggaccttggtcgcaatggccaaagcccggccatcacgtttatggccgcttgtgttctggcttatgcccataacgcgctcaccggcgcagaagtctgcgtgtaaggacctcagtcgcaatggccaaagcccggccatcacgcctgaggccacttacactccgacttctaaccgcgccggttcgcgctcacactcttttttgcggcgtttcctcataagtgataagatgttataacgattatttaataaccgttaaaggagatgacgtcgtggctgggaatgaacaagctaaagagcagcagcatttggatgcgatcatgaaggagctttcgggtgccaaggagcggctttctaaagagatggccaagaccaagaccgaagagaagaatatcagtgataactttttcaacgatttttctttaaacttcacgaattatgctgaaaccattgaaacagctgcttcgattcagcaacagcagcgggtgcttgatgagcggacgaatgcttggaagcaaagcgcacagcagctggtgacagtgcagcggctgttgggaaacccttattttgcccggattgattttcaggaaggtcgcgaaaagccggagacgatttatattggcctcggttcgtttacgaatgaggctggcaagtttctcatctatgactggcgggcaccgattagttcgatttattatgatggcggcttaggtaaggtgacttatcaaacccctgatggcccgcaacaagtcacggtctccttaaaacggcaatttgtgattaaaaacggtcaaattcagaccatgtttgacacaaccgaaaccattggcgatcaaatgttgctggaagttctgggtgaaaaatccgatacccagatgaagaccattgtcacgacgatccagcgcgaacaaaaccagatcattcgcgataccaaagcggatttgttgttcgtccaaggggcagccggctccgggaaaaccagtgccgtgttgcagcgggttgcgtacttactttatcgttatcgcggtaatctgacgagcagccaagtgatcatgtttagccccaaccaacttttctccgactatatcagtaatgtgttgccggaattaggcgaacaaaacatggtccaatttacgtattatcaatatgtcacccggcgcctgccacatattgaggttcagaacctcttttcccaattcgaacagcagttgacgccggtgcaaaagaaaattgcccgggtcaagggaagtttggacttctttaaaactgcccagacctatgcaacgagtctggaacgctccggattgcggtttagggatatccggttccgcggcgaagttttcttttcacgcaagcggattcgggagatcttctacagctataacgaaaattatcatatgggcaaccgcctgaatgcgactaaagagcggctgattaaaatgttgaatcgcaaaattgaatccgagaccaaagcacagtgggttcaagaagcagttcagaatctaagcgatgaagaaattcgctccatgcaacaagatgggccaaaagaatttaagaatagtgacgatgaatatcgcttctttgcccggcagttggtcatgaaaggttttgacgcgattcagcaagatattgtccgcaaccggtttatcaacattcgcgggcaatatgtcagctttttacgcgaagtgcctgccatttacgacttagcagcggaagggatttccgaagctgactggcaagcagaagtggatcactttattgccatgttcaaggaacgcaaactgcccatggctgacgcaacgccatatttgcacctatatgatttgattaccggccggcacggagaacgcgaaatgcgctatgtctttgttgatgagattcaagattacacgccatatcagttggcttatcttaaagccagtttcccccgtgcgaaatttacgttacttggcgacttgaatcaggcaattttcacaaaggatgactcgcggacgctgattaatgagaccagcaagttgttcgatccggagaaaacccgtgtggtgcagttgacgcaaagttatcggtcaacgaaacaggtgacggatttcaccaaagccattttgacatccggtcagaaaatcgttgccttcaatcgccaaggtccattgccgaaactaattgtccggcctgatgaagcaggtttgatgaccgcactgcaagctcagctgaaggtgaatgacgaggccaaacaaaccaccgcggtgattgccaaaaccttggaagccgcagaagcaatttatgctaagatgaaggctgccggcattaaagtcaccctcatcaagtccgaaaatcaacgcttggcggccggcgtcattgtcgtgccaagtttcttagccaagggattggaattcgacgccgtggtgctgtggcaggttaacgcgaaaaactaccacgaagaagacgaacgcgaattgctatacaccgttgcatcgcgggccatgcatcggctgacaatgctagccagtccggatgtgacgccgttgttggacaaggtgccagaagaattgtatgagcgggggtaagcgaatggttaaaatgcgtgatacattggcagtttccagttatcgcgtctttccagggatgctaaacgcccatcagacgctgtttggcggtcagatcttcacctggatcgatgacgtcagctccattgccgcgcaacgattaggtcgacgcggattagccaccggatcactggatatggttcgattagccgcaccggttaaaatgggggatgccctaattatcaagtgtatggttagcggcgtcggtcatcgctcacttgaagtcttcgtgcaacttatcggcgagcacttagctagcggcgagcgttttcaagtgggaacggcctttgcaacttttgtggcccgccacaaggaagacggtccactgccaccagtagaagccgaatcggactttgaaaagcggctgctcgcgggttacgctgaacggcgggcggattatcggaagattaacgcgagctttggtgaagtgccactggattgaaagttgccgagcgctgatgttgatcaaaagatggggcagatatggggaaaatgtgtttgctacagtgttagcgtataaacgtatgattagagtttatagctgcaagcaaaagacgcgctattttttcgttctggcgaaaatagcgcgtcttttgtagtcttcggattcgggtgattggaatttggcgcggttcaaaaatggttagatacccatctcatttcggtatgcagaatttggtaagtccggaatagtttggctagacgcatcattagactgcatgctaaaatgaatatgtaaaaaggctagcggtttccagtcgctagcccttgtggaactaacaacgccgtcaacagcggctcagaagtggcaaatagccatcctaagtctgtcaaacgttggggatggctattttttgcgcttgttttcggctgtcaacactgtgaccagcacaatcaacgtcatgaaattatccacaacttgattgaccagactcagagcttcgaagaccgacaaacacaggctcctttcttcagtgggttgtgagcttcagggaagaaaaccatctgcatcacccccttcgtctgagagtagccgccatctcttgacgttgccaatttgattgtagcaaaccggtgttcgcggttccacacatttcaattgttatgctttatttttaacgtttaatagccgcaaattgaattgctgtttattttaaattcgtgatgagctggattctgagttcgcttggctagacgcacaattaaaccgcatgttaaaatttttaaagcaacaacgccattaacagcggctctgagattacaaatagccatcccgaggctgtcaaactttagggatggctattttttgcgcttgttttcgcacacccttggcaaacctgtcttcacgcggtaaagttaatcataaatccattcccgcacggttctgcacatctgcggattcattttgaaagaaggacgattattttggcaaaacgttatgtcggctcctgtaccacagtgttggtcggtaagaaggcttccatcgatggttccacgatcattgcccggaacgaagatggcgaatcaccattacatccgcaaaagtttgtgtacgttaaacctgaggatcagccgcgtcattaccagtctgttttgagcaaattttccattgatctgccggccgatccattagggtatacgtcaacgcctgaagctgaggacggtcacggtatttgggcggctgcagggattaatagcgaaaacgtggcgatgacctcaactgagacaattaccaccaatagccgggtgctcggcgttgatccgcttgtagctgaaggcatcggagaagaagacatgccaaccatcgtgctgccatatattcacagtgcgcgtgaaggggtgcaacgtctaggcagtctgcttcaacaatatggcacctatgaaagtaacggaattgcctttgccgacaaggatgaagtttggtacttcgaaagcatcggcggccatcactgggcagcgatccgcattcctgacgatgcgtacgtggttgcaccgaatcgcttcaatattaccgattttgattttgccagtgatgatacaatgagcagcgccgacctgcgtgatctgattgagacctatcacctcaacccagacccagaaggctacaacttgcgccacatcttcggctcggccactatcaaagacacccgttacaacaacccgcgggcatggtacggccaaaagtatttcaatccggaattcgacaccacgccaatcgatcaggatcttccgtttatctgccgcactaacaaaaagatcagtatcgaagacgtgaagtttgtcgaaagttcccactacgaaaacacgccatacgatgtttacggttcgcttggcacgccggcgcagaaaaagctgtaccggccgatcgggatcaaccgtaatcaggaacttcacattttgcaaattcgtaacgatgtgcctgctgcaattgcaggtgttcactggttggcatttggcccgaacaccttcaacacagtggttccgttttatgctaacgttaccgatacaccggcagcataccgcgacaccggcgataagttcgatgtcaccaaaatgtattggctcagtaatctgctggcaacgtttggcgactacgacttttcattgttcaaagatcaagaagatgtgtttgagcaaaagactgtggctgcttgccgtcatctgcaacttgaaacggataaagcagtgcaggatgccaaagacattcaggcacatttaaccgctgttaacaagaaaatggccgatttagccatgaccaacagcaatgaactgctgggccaaatggttgccgccgcagctccgaatatgaaactggcctttaagttacaggattaatggaggtatctaaaaagcgctcataccagagcgctttttgtatgccaattattgcttggcccgcctgcgataatcgcgaaaccgcaatgttgcccgaatcaaaaataccggcataaggacaaccagtaacaggccgaccaacacaatggtaccttttgtggcccgaagttgggtaagaaccagcaaccacaatgcaaaggctgtgacactaacacagaaaatgaccagcagtatgtaccacgtccaataccaaaatggacggggattgcggcgaaaggtgggaacaagaaaaatggcgatcaaaatcgaaccgagaaagctcaggatctgacgcatgatgccgttcacctccttttgaaaatggaccttgtagcgggggacaaccttaaagttcttgatacggtttttcggccgctatcttttctgcccgttctttaactaacgcgcggcgatagttgaaaaatctgatgctaacccggtaccacatgaagagcccggccagcaagagcacagccgcaacaaagacgatcatgattgaaatcgggtccgcggtgaggctttcaatcaataaccaagccccagctgcggtaatcccaccatcgataagcgaagtgagcaccatgcgaaaaccgttaaatttaggcgatgcggtcaaatcaaattctggcataaagatgggggccagtaaaaactcaaagataatatcggagaagagttccagcaagaactcgatcatgggcagcacctccagccggcttgttaagttcatgacagcgcttcgttggtttgattgtgaacaattattctgaaactgtcaagataaacggcagttaagaaaaacgtaaggaaaccgcagttgcgaagatcacaaacgacgccaaataggaaacggtatgtcaatatttttgggcgtgatcggcagcatttgccattgcgatcaagggcctttgcacatgccttttcatcggatgaacgcgttttcgcggttaaccaaacatggacgcgtttctatgctaaaataagaacattaaacgcaaggacacggtaagttatgcaatccgaaatgaatttctacaagtttgatcgggcagaatggtcacagtttcattcgcaaaattttaccagcgtgaccgatgccgagctggcgcaattacgctcactgaatgatgaaatcagcctcgatgatgtcaaaaccatctattcaccattacgccacttgattcacattcgctatgaggactaccagggcgatatgtttaccctgagccgttttctgggcatgcagcgcaatccgcacacaccgtttatcatcggcattgccggttcggtggcagtcggaaaaagcaccaccgcacgactgctgcaattgctgttgagtcgggcttatccggataaacgggttcaacaaattaccacggatggctttttatatcccaacgcggaacttgaacgccgcgggattctggatcgcaagggttttccggaaagctatgacatggaactgctcattcattttatgaacaacgtcaaaaatgcgagcggggtggttcgagcgccaaaatatagccatcagatttatgatattgttccaaatgaatatgaagtcattgaccggccggatatcctgattgtggaagggattaacgtcttgcagctgccaagcaagcagccgatttatgtcagtgactatttcgacttttccatttatgttgatgcggatccggtgttaattgagcagtggtacctggaacgtttcgggattctgctggacacggccttcaccgatccaagcaattactactatcaatacgccattggcaatcgggctgatgcatttgccatggcgcggcaggtctggcatgatgtcaatctcaagaacctcaaggaatatatcttgcccacaaagaatcgggccgacgtcattttgcataaaacaaaaggacataaaattgaccaggtttcgttgagaaaatggtaaaatagagccttggttggttttcagaaactgaggggtacatgtgtgaaagcttgaaatcagttagactggtgagactgtcacttgacagttttactcagatgagaggcttctcacccatgattgaccagcttatgaaaactctgtaaaattagtgcattcaaacaagggagtgtggcggactgtggcaaatgaccagaacaaggattacgacaagatcatcgtcctcgattatggtagtcagtataatcagttaatcacccggcgtatccgggaatttggtatctactctgaattaaagcctcataccatcacagcggctgaagtcaaggaaatcgcgcctaagggaattatcttctctggtggtccgaacagtgtctatgacgaaggtgcgctcggggttgatgaggacattttcaaacttggcattccgattctaggcgtgtgttatggtatgcagctgatggctcaacgactcggtggtgatgtcgaaccggcagacaaccgcgaatacggcaaggccgacatcgaagtcaccgatgccagcgccaaactcttccacgatctgccaaaagaccagactgtctggatgagtcacggcgatttagtcacccgcgttccggatggcttccgcaccacggccaccagcgtcaactgcccaatcagtgcgatggacgacgatgaccgtaaattctacggcattcagttccacgccgaagtgcaaaacactcaatacggccacgaaattctgcaccattttgccttcgacgtctgccacgccgaagccaactggagcatggacgacttcatcaccaaacaaatcgccaaaatccgggccgaagtcggtgacaagcgcgtccttcttggcctctccggcggggttgactcttccgttgtcggcgttttgctacacaaagcaatcggcacccagctaaccagcatcttcgttgatcacggcctgctgcgaaaaggcgaagcagaacaagtcatggacagcctcaaaggtaaatttggcctcaacatcatcaaagttaacgccaaagaccgcttcctcaatgacctaaaaggcgtcactgacccagaaaagaaacggaaaatcatcggccgcgacttcattgaggtattcaacgaagaagctgccaaactcaacggcatcgaattcctcgcccaaggtacgctatacaccgatgtggttgaatccggaaccgataccgcgcaaacaatcaagtcccaccataacgtcggcggcctaccagaagacctcaaattcaaactaatcgaaccactaaacaaactcttcaaagatgaagtccgcgaactcggcgaaaaactgggtatgccacattcactcgtctggcgccaaccattcccaggcccaggcctcggcatccgggttatcggtgaggtgactgaagataaactggagatcgtgcgcgactccgactatattttacgggaagaaatcgctaagcacgggttggataaggatatttggcaatattttacggtgttgccaggcttccgttccgtgggtgtaatgggcgacggtcgcacctacgactacaccatcggcatccgcgccattacctcaatcgacggcatgaccgccgactttgcccggattgactgggatgtattacaggagatctcgagtcggattgttaatgaagtgaagcacgttaatcgcgttgtgtatgatattacttctaagccaccggcaacgattgagtgggaataaaaggtacatgttaattgaacccggaatgttgatttaacggcgttttcgggagatacaaaggatacgattggcggggaaattgttacgttccccgccaaaatccccgccaagtttgggccgaatgagggctgagttggcggggatttttgtagccatttgagaaaacgctatacattatttaataccttcttgtagcttgctatattctattagataattagcttaagaacaccgcgtagggggagcaaaatggcaatcaccgagtacgaagatcaaattcaagaaatcgtgaacaaatctgatcactccgagtttatctatgattttctgggcgtttacgatattcccagagcaaccgttaccaagctacgcaaaggcatgaacaaccttgcaaaagaagcgggtgcggtctatttgaaaaacaagttgtacttcagagaaggcactggcgatttaatgcaagactatgccgacttgcaagaacgggtcgacgaacttggttccaagccgcgttatcttctggttacggattaccagcatttgctagccaaggatacaaagactaacgagacacttgatattgaatttgcgaagttgccacaatactttgacttctttcttgcatggaacggcattgaaaaggctgatttcgataaggaaaaccctgctgatgttcgggcggctgaacggtttgcaaagctatacgatgtcgttgttaaagataacccggatgcaacacgcaaaggattgaacctatttctgattcgtattctgttctgtctgtttgctgaagataccaatatctttgaacatgacttgttcactaatcgagttaagcagatgactgctgatgacggtagcaattttgaccaattcatccgtagtctctttggcgtgctggactttgagaaaggtcaacggccagtcgatactcctagttggttgaacgacttcccgtatgttgacggcgacttgttcaaagatcggcatgaatccttacactttagcgccaagtctcggaagctcattattgaagctggggagctgctcaaatgggatcagattaaccctgatatccttggctcgatgattcaggcggttgccagtgaagacagtcgtagccatttaggtatgcactatacttctgtgccgaatattatgaaggttatcaagccgctgttcttggacggattacgtgaagactttgaagcagcaaaaggtaatgagaatcagttgcagcagctatatgaccgcattggcaagatcaagttcatggacccggcctgtggttcagggaatttcttgattatcacatacaaagaattgcggcagcttgaaattgatattctcattgaacttaacaatattggtgtttcgacgatgtacgttccatcagttacgcttgatcagttctacggaattgaaattgatgactttgcgtgtgatgtgacgcggttgtcgttgtggattgcagaacatcagatgaatgttaaattgcacgagcagattagtgatgctgttcgtccaacgttaccactgcaacatgcgggcgatatttatcatggtaatgcattacgagaaaattggaatagtattatgccgttatcacaggatgaagaagcatatctttttggaaatcctccatatttgggcgcaagaaagcaaggagcagatcagaaaaatgatataagggaattgatgggaaccgtttctggaattaattctttagattacatttctgggtggttcgtaaagggtggagaattcatttccaagactaagtgtcagttggcttttgtaacaacaaattctatttgtcagggtgaacaagtaggcgtattgtggccgatgttgttttcgtatgagttggaaatatcttttgcatacacatcttttatgtggaaaaataatgcaaaaaaaaatgctggggtaacggtaattattgttggactggtatcgaaaggacaaacaagcgttgaccataaattattttccgacaatagaatttcagttgtggagcatatttctccctacttggttgaaggaaatgacgagactgtaaaaaaaagttctaagcaaatatttggactacctaagatggcgtttggaagcatgccaaatgacgatggcaacttgatcctggatgaaaaagagtttcgtaatctttctcgggatactaaacgctacattaagagattcgtgggttcgcaagaattcctaaatagtattaatcgatactgtatttggctgtatggtgcagaccagaaatatctaaacaatgacttcattatgagcagaatttcgaaagttagagaatatcgtctgtcgagtaataggttagctacaaaacgattggctgcaagttctgagctgtttggcgaaatacgttggaaagatagacccgccatcataatacctcgtgtttcatcaggaaatcgatactatgttccgatgggttacgtagactctgactccgttatttctgattctgggattgccgtctatgatgcttcggtatggctgttaggacttttggagtctcgaatgcatatggtttggctgcgtaacattggaggaaagctcaagaatgattatagatattcagctagtttggtttacaataccttccccgtccccgaaatttcatcacggcgaaaaaaagaaatggaagaaattgtatttcaaatattggatatgcgtgaggaagatggaggcactcttgctgagcagtatggatctcccttggcagacaaaaaccctaaaccaatgagagaagctctccaaaagctgcaccaaaatttggaccaagttgttgatagagcatacagaaaaacagacttcactgataataacgatcggttggctacgctactaaatatgtatgaaaagaaggtgcagtctcttgataaataaaaatgtggtagacgttaattaccatcaaactggaaaaagtacgaatacgaatgaactaggcatgcgcgagatgcaggcacgagtctatcaacatcgcagttcacagtacattttggttaaggcgccaccagcttctggtaagtcacgggctttgatgtttgttgcgctggataagttggctaatcaaggtgtccgaaaggttattgttgccgttcccgaacgctcgattgggaagtctttccaacacaccgagttagctaagtttggtttctatgaagattggtcagtagattcgcagtatgatcttactctaaatggtggggatgcgggcaaagttcagaaattcattgatttcatgaacgacgatacggctaccattctcatttgtacacacgccacgctgcgttttgcgtatgagaaagtcgatgatgatcataagttcgacaacgtaatgttggcgattgatgaatttcaccacgtttcttctgaagacagctctgtccttggtggtgcgctgaagaacattatgcataactcaacggcacatatacttgcaatgacggggtcttatttccgtggcgattcgtcgccaatcctaacgccggaagatgagcagcagtttgataaggttaattacacttattatgaacaattggacggctacaaatacttgaagtcatttggcattgattacaagttctatcaaggctcgtatctcacggctttggataaagcggtagacgtgtctaagaagaccatcattcacattcctagtgttaattcaagtgaatcaaccaaggacaagtacaatgaggttgacgctatatttgataccattggcacggttgagtcgcaggacgatgagacgggaatatacacgctcaagagccatgtggatggacgtttgttgaaggttgctgacctagtcaatgaagaaggccgcgacaaggttcaagaatacttacgtaagatgaagcaggctgatcagttggacatcctgattgcgttaggcatggccaaagaaggctttgactggccgtgggctgaacaagcattgaccattggctatcgccgttcattaacggaaattgtgcagatcattggccgggttacgcgtgatagctccaataagacgcatgcgcagtttacgaacatgattgaacagccggatgccaaagacggtgacgttcaatatgcggtcaactcgattcttaaggcgattactgcctcacttttgatggaacaagtactggcgccagagattcatctgaaagcacgtaagcataagacggacaagtcttccggcaatggtggtgatatctttgtccgaggactgaaagatccatcgaccagggctgtccgtagcatcattgagaatgacatgcctgatctgaaggcggctatcctgcaagataacgcagtgaagaatggtattgcggctaatgtagacgctgagacgatgaacaaggtactgattcctaaagtcattatgacccgctacccacgcctaaataatgaggaagtcgaagaagtccgtcaatacgcggtagcagacaccgcgctgcggcatgcagtcgtggatcaaactacggacaagcacggtaataccaacgagttcttacgaatggctgataagttcatcaacgttgatgagttagatatcaatttaattgattccatcaatccgttccaacgcgcatatgaagtgctgtcacagaatattgacagtgacgttttgcgggcaattcagcgttctattgacgctaagaagtttgacttcgatgaagctgaactcgtctacctgtacaatcagactaagcaattcatcgctgataatggtagggaaccatataaaggaagccgcgacgagcttgaggtgaagatggcgtatgcgcttgctaaattaagggatatgcaggcacggaggcagcagaatggataatcaaagcttgattcggtcgctggatgacatttttaatgatccggacgcaacgtctttgctcgctagcaaactcaaacatactcccgtaagctatgaccccacggtagaaggatttcaagagattaccgattgggtgattgctcatgacggtaacgagccacagaagctgcgagatccctcacagatgaaacagcgcaagttggcaagccgattaaaaggtatccgtgaagatcctgagcgtcgggatttgttgatgccgtatgatactgcagggttactaagtgttcatgaagacggcccagcgttgaatgaaattgtgaaaaacgaaaagcaggatttctcatcgttggatgatattcttagcgacgattccattctgtttaagaaaagtgatcagcaggctgccggtagcaagttgttcgataccaagaagctcaacgaaattcagcgtgagcaagaaaatcgtccggaagtgatctctcagcgtaagccgatgaaggaattcagtcagtatgaagcgatgttccacaaggttcaggctgaaattgcttctggtcagcggcagcttcgcccgttcaagaattacgagttgctgagcaagcacttctacgttcttaagggacagttactgtatattgatgagattggcgaagaagttgagcttaatgacaacagtcagcgaaaaactgatgcaagaatgcatgtaatctatgataacgggaccgaaaacaacccgactcgaaatgggcttgcctcatctctgtatgggcgtcaaggcaggattgttacggaagttgagcatggtattgaactgacaagtgacgaccatgtgacggggttcatatatatactggaatctttgagcgacaaccctcagattaagcgaatgcaagcgaagcacccgttgtacaaggttggcttcactactggatcggtgcaggcaagaattgccaacgctgagaatgagtcaacttatctatatggtccagtacgacttgtcggcgagatcaaagtagtgaacttgaaagctgaagcgctggaaactgcactgcatcatgctttagcagaataccagttagatgtagatattaccgcagctaacggacgaattgttaagccgcgtgaatggtttgtggttgaccttaatacgattcaagaaatcacgactaagattgtcatcacactaaaatcaaagcagtaataactaagattgagggagctcaacatgaacatcgaaagaattgttgttagcaactacaagatatatcaatcgttaaatttttcgattcaaaatgaaaataatattttcgttggagataatgggtcagggaaaacaacgcttcttgagtcaatatatttagcacttacaggtaggattgatggacaaaacgctgagcggttattaacacccgacatgttttctaatgacataagagctgaatacatcaatcaattaaagagtacgggcaaagcttcgcttcctaaaataattattgagatatattttaaggatgaggatgaatatgctctacagaaaggaaccgagaattcgcagaatattgattgtccgggaattagatttgaatgctcatttgatacacaatatggcaaagagtaccagaatcgtctggaaattaccgatgatgaagaagcaggttttcaagtgttagatattccgattgaatattattcaatcaaaagaacctactttagtgggcaaagtgtcattcaacggagcaacccatttaaagtgttttttgttgatggcactagaaagagttattcgagctatattggaaagtatatatactctaccatcggaagtttattatcagataatgaatcttctcagataagaactgtttatgagaatatcaggcaaaacttgaagcagcacagtattctgaaaaaattcaatgaggataatcaagaaaacctacacttggcagggaagaatgtggcgttaacagttcgtgaaagcttacctgatgattggctgcaggaaataaccgttagtgtcgatgattttccgtttaataatattggattcggtcttcaaaagatgatcgaactggaacttgcagttggtaaatcagctgatcaacctggtatattgctgtttgaagaaccagagaacaatctatcatatccaaatatgtcaaaattgataaatattttggagcaagggagtaataaacaaaagtttatttcgacacatagtagctttgtggcgaataaactaggtcttgataatctagcattatgtggtggaggcaatatagaagcactgacagctttgagtaaagatgacattgagtatttcaaacggcttccgggatataatacgttgcgagtgctattgtcatcttgtccggtattggtcgaagggccgaccgacgagctgttatttaacgcagcgtatatccatgagcgtaaaaagctgccgattgagaatggtgttgatgttattgtggttgattcgttggcttttaaacgatacttagacgttgcaaaactgattgagaaaaaagtgattgtaatcacagataatgatggagatgaggaagcccttggtcgtaaatatgcaggatatttagatgatccgttattctccttttatgttgaaagcaatcactcgcttaagactattgagccaagtatggtgaatgcgaacgtggtgaatggcactcttccagaattgatcagtgttgtttttgaaggtaaaaaagattctgatactataactgcggacacccttgaaaaatatatgactgcgcataagtcgctttggtcgatgcgtgtacttgaagctaacgccgcaatctcatatcctgctaatatcattcaagcagttgaggcatgtatctaatgggaaatcgtggaatacttgcctgtgccggagcagggaaaacctacacaatttgttcggatgcgctatcttctgaaggcagaagtttgttaatcacgtatactaacaagggacgaacaagcattgaaaagcaaacattagagctcaataatgaggttccaacggacaaagttaatgtagaaacatggttcggatttttgctaaaagagattatacggccctaccagtccatatatttcaaagcattgaagtcgggttcaccggtagttatcaattactttcagagcatagatttcagtactacttatggacgcttcaataaatataagaaagggacatttcaatacttctggtcaaaagggaggatgttgagacataacgaaactgtggtgttagcgaatattttgttcgagttggccggtgataagattatcagacggcttgagcagcaatactccactattttttttgatgaagttcaagatttgaccggtactgatatggatatacttaggcacttaattgattccagaatagacgtagtcatggtcggagatccaaaacaatttacttatcgaacacacgaggagcataataagaactcagctatttctggcgtaaatattgataaattcttcaagatattagagcaaaagggaaagttgcaggttcagtataaacaagttacgcgtcggtttggcagcgcactggcagactttgcaaatagcgttgatccaagtggcgaattactggccggttccggagaagtatcccaatcggaacatgaaggcgtgtttattcttccgttggagtacctagcagaatatcatcatgcttatagtcctacttacctagtttatgatagcaagcaggccaaaaagctaccaaatttctgttcagaagtaattaactatggcgattcaaaaggaatcacaagagaggatatcgtaattttgcccaatggacagtttgacaagttccttttgggtaaaccacttacagcgccaactaaatattatatagccagtacacgcgctcgtcacagcattgcttttatcgttaagaattcagataagtacagttctattcatagtgattggcctgtatggaaacctcgatcatagagttattcctttacgaactggttatgtcaggaaatattgcaccggtctatgatgagagtctattttactatcagcactttgcctcatcttgtcgaaccatgaatcttatcctttaggaagacctccataataaagggagactgctttaaaaatagactacttaacttcccatctccatccaatcacggaaatatcccggaaataacccttaaagtgagaatgctcgccgctttgaggattattttttgtgctttattaggatgccaccatagtgattggctaattttgcgactttttcagtagatctttttttgaaatatttaagaaacagttaaagcgcggtttacaatttcaaatcgcgtcctacaaaccgtctgtatatggtgagagcgaaagttctcacagaccttccggaagggtcttgcaacgtatgccgccgtgcgcggcgtgcagcgcgaaagccgctagcgcgagcggcggcggtcggcgttagccggccgccataagcccccgggctctaataggggggcaaatattagagacaaaatacacgtaagtaggacgaaagcgccggtggcaagccgctttgcgtaagcagaaaggcgactttgctgtcaggtcgcttcgaaaggagctaacatgctgaaagatttgaacttggtcggcgggatgacgaatactgactggctaaaccagtttcatgatgagatgcgcatgcacaagattactcaaggccaattagcgacgactgccgattatagtcggtcacatttgaaccagttgctgacgggaaataagccaatcaaccaacaagcgcggttgcggctgacgttagcgatgagatcgttgactggtcagaacaatattgacgtttgtattgattatttgggtgtcaccttcaagtcgcacgattatgaagaactagtgacggaactgttccagatcaacctgaatcacttcaatcttaaggaaggcgcgcgatacgggtacgcggcgaccgtcaaatgtggtgaaatcgatgtgctgctgtcgccatatcaagatgcaaatgcagacggttatgatccaagcgaagatagcggcacaatgattgagttgaaaggtcaaggctgccgttacgttgaatcgtatttgcgccagcaggatcgcacctggtacgacttcttggagacgtgcattgcccttggcggtcacttcacccgcgttgacctcgccatcaatgatcgtaacggtttgctcgatgtgccgaccttgatcgagaagtgtgaccgcgatgaattcacctcgcgttttcatggcttccgagataatcgcaccaagcagtgggaggtatcaggcagaaccttgtacctgggatcgccgcaaagtgaagtctacttctgtatttacgacaaggcttttgagcaacaccagaagcaccctgagattgcgatagaagaccagccgatacggacgcgctttgaggtccgattacgccgcaaacgcgccgctgcggcaattaagaatctgttggcagaacgtgatccagagaaagttgtgttcggcatcatcaaccgttatctgcgcttcttgacgccgagccacaaagcgaagagtcagtgggcgacagatccgcgttgggatgctttcatcggcaattatcgcgacaagctacgactatcaaccaatcctgaaccattgagttatgcacacattacccgctggctgaggaaacaggtcgcgccgtcgctgaagatgttgcagctgattgatcaatataatggcaccaccgagctgaaggcgattattgacggcgggaagctgacgcaacgccactgggatttgatccatcactatcagcaccaccgcaatggcgttttgacggatgtagaaccgggtgagacatcaaaaaagagcgactacgccgaccaaagcaagtagtcacccctcacagataagatttgggtcctatctggtttgattatctcacttcaatcaacgagaaggaagtgacgtagttggataagagttttgtctgctatcaagatctgatggcattaggatttaagcagcacactgcgcgcgatatcattagacaagcgaagcaaaggatggtacaaaaggggtatcccttgtatctcaaccgaaacttagggcgcgtaccgcgttctgtcgttgagtccattctcggatcaccgatgaatggagctgttgagaatgagtaaaaccaaatatccaggcgtgttcatagacgccaaaggtaatttttactatgaaaccgagttaggcaccgataagatgagtggcaagcgcgtccgcaagaaagggcggaaggacagtcaaggaatgccattcagtaccgcgtttgcggcgaacaaggaacttacgcgggtgaaacgtgaatatcatgaggcgcatgggtttacgaactttcgcatgacctaccgccagttcatgaaagacgcgtatatcccggcatacaaaaccgacgtggaggaaagtaccttcgctgtccgtaatcgcagctttgacatctgcatcgcgcgttttggcgacttgttgctgcgtgacatcgatatcaccgacgtgcagaacttccgcacgtggctgctcacggatcagaaagacggtggtgccggctactcccaaggctatgccggattggtgttcggctgcttccgcaagtctcttgaccatgcggtgcagatgcagtatctgtccagcaatgtgtcgaagcgagtcaaagcgattcctaaggccaaaagcagcgtgccgttctggacgaaagccgagtttgaacaagtcatcgcgcaaatctgcattgatgacatctatgggcacctgaactttgtgatgttgtggctgtacttcctgactggcgtacgcgtcaacgaaggcacggcgctgtggtggcgggatgttgatcttgctaagaagcagctgcacgttgaccacatgctggtgatgaagaaccggcatgactgggaacgccacgactacactaagacggacagtggcaagcggatcttgacgctcgacgatgacaccgtggcaattctgcgacgttggcgagaggtgcagacgagtttcggtttgggcgggattgatgacttcatcatgacctatgacggcctgccgatgaccaaatcgacgatctcgcgaattatccaccgctacgccaagttggcgcaggtgcacccagtcgaaggcaaggggctgcgccacagtcacgcgtcgtatctcatcaatgagttcaacgtctcggtgctggtgttgtctaagcgcttaggccactcgtcgccggagattacgctgaagcattattcacacttgtggggcgggctggatgcggatatcgcagagcagattgcgggtaacattacaatcaagacggcgggtcagaatcaggtgcggttcgtgggtaatcaggcggtgaagtacgatcaattaagccccgccaaactccccgccaaatcggcagttgaggcatagaaagtctgtagtgacgcgggttaacgccgctgaagttacgcttgagtgggaatagagatgcataggctttttgaatttgctcaaagtggctcaagctctgtcaactctgcctaatcatggttggcaatcaatcgaatattcatttaaggctgctagaattcacttggttctggtggctttttattccgttcaaagatacgaactgctgtattcagaatgcgcagtacaatgcttggtacttatgtgcttaggatatatacttaaataagttattaatatcttgggggaaagactttggaatcagaaaattttgaattactggagaatacagatattacaactttcctgattgatcgaccgtgggtgacatatcgaacaaatgcggatcttgaaaaactgggagctagatttggttctccaaatccggaaggctcaaacagattgcgccgaatgagttcaataatcaagtcaactcatgcaagtaatcgcacgagttcgttgttatcgtttttgttttccccagcgcagttgcgaccagtcattaatgagtatcttgctggaagtcgattttcgcaattgaaggaaattgataactttgttttggaaggtcttactggtgatgtttccaaggatattttgattgtggcggaagcaattaagcggcgtgtaatccaagagataaacgcaattcttctttatagcaactttaaactcgtatctagtggtaattcgtgggaaattgtcgcagcagataacgatataaaaatctccgttccaatcaagagaatcaactcaggatatatttcaaacttgttggcgcaggggctagatgacttgcaggataatgactttgatagtgtggttacaaagtctagaacaatcgtcgaagaggtattccttcaaatactggctgataacaatgtagagtgtaagcataatggtgacattagtaagtaccgtaacttggtggttaaaacgcttggaatgaggccttctaaagagtggaacccacgtgttacaaaaatgatcagtcacttaaatggaattattgatttgattgcagaaatgcgcaataaagatggcgatgcacatgctagcaatgagcgagtgaaaattaaggcagccgaagcagaattgttactcaatacgtctgttagcgtggcaacctactatctaagaattagtgataggcatacgttgggatgaattgattgatcatttggaggaatgcaatgggggagcaaagcaacacaacgctcaataggtagacccgaaaaacattaggtagcgcgaccttatgctagttatgtggttgtgtcctttttttctcgtgatgtgaacaattcaggctgagttcttataaatgtgaatgccaaataaaaataaatgaagtatctaaactgtgagactgctgaaaaactcaataaagacacagactaaagactgaaagcacaaaaatggctctgattgcagctgtgtcagagtatatccacaaaatcatattcaaatcctgtacatgccgcattgccgaagtgtcttgctagcctctttggcaaggtagtctggagaaagtttatgtatgattttgcatatatattctgacagataagaagtgaaggtcattttcgtgctttcgctgcttttagtagtttactaagataagcgcctttattgattatggttttgtaacttttaactaaattttggagttactagaggggctggggtgagaccaattaaatatgaactggagatgtagttaatcttgttaggaaattttgacgtattgactccaagtatatttgtaatatttatcatcgctaatgtcagagtccttattgataagcatcggaataacaagggcaaggaaacaaaattttggaaattttttgaagtgtaccaagataataaagtatctggcgttagagttctgttaatagtgagcctactaattaggattatttttgttctttttggattggcaaaaattccaatttttaataccctttatggcttctcgggggttaccatatctgtctttgtttcttacttctattttcgcctattatatttgtcactatacagaaatactaagacatttataggcgctgttgtatattggataataactataacagtatttatctttatctggttaggtgttgtcccgattctgggaatgcgaggatcgaatattagttggaaacttttaatagtatttgtaactgcgattactccacttgctcagttcattaggactattttagacaaagacatatcctatcacaaagattcattagtgttttttcgagaggtggctatatttttattctttattttaggtgtgtaccttgtaaatgttagtgttggtttatcgatttattttattcaaaacccgcaagagcaaaccacaaagataaataaagttgattataatctttttgacgcaaaagcctctgatttcactgctttgcacaacgcggttttattttcgactagattatttgctgggggccaacaatttctttcaaattctgacccatcagtgccggtacgccaactagaggaaaaaggagtcaaaaagttatctgcagaacaaactaccgaactttatcccattcttgctgaagcaacattaattcaattttgttacacagtaattggttttgcgttaataatggattggatatcaaggcgagtgacgacgtttactgaacataactctggaataaatccaagtataaatggtctaaccaaagaaacactgcaaattgaggctattctgggtgcccgaaaaagtcagttgatagaaaaacgcaagccaataatacacagaaaaggctgatttactatctttcggattttgaaggaaaaaatgtggagaaatttccaaattattttgttgccgttacattggcgggtacaagaggatagagagatgcagtatcaacgaagaaatactggccgcgccattttgctggctttgcaagatattcgtgggttgcatctagaaaacaattaaagttgacaggcagtggattgttgaaccggttgaacaatatcgtctgcatatcacacctacaaacatttacattagggtctactgaataattatgaactgtctgtaatacaagactttcattcgttattattacaaacaaaatgcagtgccagatgcctgtaaaccgcataacttcggcgtaggggcttgcagtttaacaaccaacgatatgagaagtcacatggtttatcgtaaaaagacagttcaacggtcatttgaatcgctgggataggcactaggaatgccactcagcactaacaatcattgggtgcaattggccgagattttttccgtgggctgctatggaagaggtgtaccaattaatcttcccttcaaagttgggtcgtgctgctaagccatttcgccttctgtacggtgctcaattaattaagcaaaagtatggttggtctgatggttgtcgcggcgcatactctgccaaccatatattcgccgctttttgcatgcacattaatccaaaagaaaaatacaagaacaggagtttcgcctgtaaactgtttaacgacaaagaaaaacaaaacaggggaaactccatatatgaacgcacgctttgcgatattttgcgtacgcgggatgagtcagattctgaaaccattcgtcgagcaatgattagttactcgcagttaaagcataaagacgtcgggcggctggtaagctatgtggatttgttcaaagtcatgcgtacgtgtatagcgaaaaggtcactcggagaaagataatgctctaattaatacgaataacggggtcagtattgattgaaaacacttattagttcaagtgaggagatggcgtgaggatgaatactgaagagcttaaaatttggttggataaaccggaaggcgatcatcatgacttcaaagaacattggtaccataaaggccaaaaaccagaattagttaaggatatttttagctttgtaaatacagttcatcatgatgattgtttattaattcttggtgtaaacgatcaacgtaaggtcactggcgttgaggatgacgaaaactggcgccttaatcagcaacagttaattgactttatgaggaaattaccaatttccggggagcttattccgcgtcttggggttgagacgatacatattggtgagcatgaagttgatgttattcggatctttaattctaacaatgtgcctgtatttcttgggagaaagtggaatgaaaaagggcttccgaacaatgttatattacctggccagatattcacaagggaacaggatgttaacactgctcgagattcaaccgctgactatcatcaagttgaaaggttattcaaaaaacattttagaatggatacaccaattgaagaacggtataagtatactttaagcgacacctcaaactggaggtatacggaagctgatggatttgtgtttcagtatagccctaatccagatttttacatggttctttgcgatgatgatgaggatcgttataaagcagaagcatactcattggatcagtttcggacaaagatgagttggcagtctctgaaaataaagttccgtcaaagcacgatagatactttgttagtagtttggttggatggcggaagacttgtggttgttaaaccggatgttggaattttacgaagtgatagtagtaggccgttgtcgtactactgtttgattgaaaatacgattgctggccgagtgcaaaatctctttgcaacgggactaccgttaacagcagatccgtattctttgaatgcgttttataaaagtgtcgtgctgtttcgatctgaggacgagaaaaacaatcttgagtcacttttggcagaacggattgacgatgtagaaagtctgatcaaaccgaccgaggatgaaattactggtatagctggtcgaatggccatggactttaaaagtacagaacaagaagtacaagacactacgatcagttacatgcttgttcaacacgcaatgggaagacttatgaatgactgtctacttgattatcggcgtggtaacgacatatctggggtcatcagtaggtggcgacaaaagagaactgagggttaggtacttgtctaccataagattgcgttcttgttttcttttggtgtgatgtgactgattcagcttaagaaggcatagaatttttagcttttgaagatttaaccatcgactgctatttcaaacattcaatcaaggtttgcccttagcaattaacatgattttaactgtaacaaaaagacgcaaagcaaaaatcactctgcttgcttcttgttaatcaggggcttacactgcaagtgaaatcgacaacctgctttacttacgagcttcggtattccaatttgaagacactattcgaacgattgctgatttattgtatacagattatgcaactgcaacttttaaacttcgatcacaattgcgtttaaactggcttcacaatacacactcagaaagtatttgaacggcaggtgaagatgatgcaaaaagggcatagaacacgcgttaaacctaaactccccagtttctcgaacgttaaagcgttaaagtatgggaatacattagagatgacgaacagtatttctgattccagtccaattttagttttgccgaaccatcaatatatggtaagacgaactggtcagattaagaatatgcagcctaaatcggtgacacgggcggacgatatagcgtcggttaagcgaacgatgcggaaattacgccggttggtgattgcaaattttaatggtggcgctgatcaactatgggtaaccctgacgttcaagcggaatgttcaagatccgaaagatgcttatcaggctttcacacgatttcgactgcggatgcggcggcgttatcgtgtcagttatattagtgtgattgaaccgcaagcttctggtaactggcactttcatgttttaatgaagtcagatgatggcagttctttgactatatccaatgatcagatggctaacatgtggggagaaggttttgtgaaggtcaagcgccttcataatggtgaaaatgttgcatcatatttgatggcgtatttgaccaatctcgacattgaggatacggataaggtgacaggaaaaaagtctaagcgaattataaagggcgctcgcttagtgttgtatcctcggggactacgaatttatcgcgccagcaaaggcattcaacgacccaaggaaatgagaggagtaaaaattgatattttgtgtagggaaaaaatcgcaaatagccctagcgcagtttttaaatcgcaagttgaaaccaatagtggcttaattttgtatttcacgactgaatattatcgtacccattagctcttaaagagaggcatcatgggtaatgttttaaaagaacaaccgtgatcttaacaggagataatccgcaaaacccttcgaccattttgaagggtttattttttttgcgaaaagtgtctggaaaaacgtaaaataaaagtcgcaattaaatctttaatgacgtatttatatgctgtataatgtcaccagatacttatttacactaaaaactttggaggcttccaattatgaaaaagaaaaccatttccacaaccattgctaccggcttgttactggccccgatggcattaggcttggttgctaaccaagcaccagccgcaactgttcacgccgctaccagtaccattgctaagacgccaagcaataacgctttagccaactggacggccaacaccccaagccacattaagcagcaaatccaatcccaaggcattgacccaagcaacgccaaagccgcaatctatacgattcaatggggcgacaccctttggggcatcagtcaagccaccggcatcacgattgatcaattggcaactaacaaccacattgctaaccgcgacttgattatcgcgggtgccaaattgacactgaacggttccgctaaggctcaggcctttgtgcaaaatgctccgggccagtccgctgaatccaaagcatctgtcagtggcgcaggtaacatcgcagcgaataccaccggtgccgcaaccgggaccactacgactgctactggcgcaacgactggtgctacgggttctgccgctggtaccagttctaaagctgacaccagcaccccaagcaccacgccaagcggtactgaaagcaccggctcgggtgtcaccggcggcaagactggtgcgaccaccccaagtggcgaaggctccagtgccgtaaccccaagcaccccaagtaccggatcaagtgccggttctagtgctgcatctggtagcagttccagtgccagtgagggcagctccagtgcctcaacgccaagtcagccaagcaccggttccggttcggaaggttctggcagcagcactccgtcacaaccaagtaccccaaccgccacttatgcggacgtcaccgttaaagccgtcaccagcgacggcacggttctaaagaccgctacgatttcgcatcaggcagtcggcaccagcgtcactgcgcaagccagttccgtcgctgttagtggttatgacttgaacgacaattccagcaagtccgccaccgtgaccaagagtggcgcggtcatcacgttcacattcaagaagcacgaaactccggcacccgctggcaagacctatacgccgaatgtcgatcacattaagcagctcgtgatggccaagtacaatcttgcgtcacacggcaaatattggggcaaaccggtcggcacaccaggcgacaacggctcaatcgttggtgctgatggccatctctatctagccaccccagaaacatggccgacagacagcaacccttatacttctgacgagcaaattgccgaagctatttgggaaacccgtgttactcaggcactagatgaccctaacaatgtctctgcagttattgataccttaactgctaccggatcaactaccatcaatcctaatggcactgtctctggtaagattcagacctacatgcacttaacttggtaccaaaagttctaaaatctcacacctcaaaagaaggtcactaccatgctaactttcattctggaagtcgcttatgcggccatgatcatcttcagcctagaagtcacccattattcgatcgtcaccatcatttatgtcatcctgagtatggtagtggttggctggtacaattatgaacgcaaccagatgactagacgataactccagtccaaatgcatctataaccccgaaagtctaacgtcttgaaagaaggctacaatcgtgaccatatttgattttatccacgatatcttcgccgtcttgggcaatttcatcatgcagctcgtttacatgatgatactgatcgttcatctgatcatcacggctgaccccatttccgtgttgattttcggccttttgtgcatggttgccatcggtgcatatggctatcacttgttggcccaaaaccaccagctgcttcgctagttccacctttcccgatctggtgatgttgctaacttgacttagcaaccggcggtccgattccgccgcgggtacttgcgcgggtgcccaaatcgtaaatcccgcgctaataccaaacccggttgtatcacgcatttggtcccaatcaaatggaccacgcatagccgttgcggacgtgatgacggtcgatcgggtttaaacgtaccaaagcaaccgtagctcagtttggtagagctcccgcctaaacgacggacgtcgccggttcaaatccggccggttgccttgaccaagtttaatcacttggccgaataaagggctatgatggtgcgccaccaccgcaaaatgttggcgtgagtatgacctcagggtgctatggaagtccccattgtcagcgtgccgctgtacgccgccctgagttgttttatatgcacgagcttgtcaagtggtcaaagacccggcacctgccccggcttgcacgtacggaggaatgcagccgcattaacaactacgcaagcttcgttggttcgaatccaacgctcgagcttaactgcaaaaatagcgaagataaagatggtgggggaaagttaagggttttgaggtaggttattttagaatcggtgcaaagcttagcaacacactttgggaggagttcatatgtttaagaagaagctagtatttattttcgtccctttgttagtcattatgcttgttacgttatctggttgtggttcatccatggctggtacttaccatggaacaagtgggagaactaccatgaccttatcaaaagacggtagtgctgggtatggagaaattactgctaatggagactcaaaaacgtggcatggaaaatggaaagtcagcggtaattcaatccacatcgtcttaaaaagcagttctgactatggatttaacttaaaaggtacgattcatgataaagacacgtttgaattacctgatcaaagaggtacaggggaaaacaattcttgggatgatgaaactttcacaagatccagataagaacaatcctgactctaggaaaaaataaatcatcgcgtatcattgtgatgattataatgatgaagcgaagtatatattgttgtaagtagccgcacgaaaattgaaaattgtacttacataaataatttaagtggagatcattgtgtacatgtccaaaaaggccctaaaactcaactagttgtgagatatagggctatttttatggactcataaatatttttaaaagcatgttgcaaaatttgtatcttcataagtgcgtcattactgacatattccagtattgtaagatatatctaaatccctttgaatagtttattaattctcgtaacgtggcattaaagctgcttctacgggaggaatcattcagtgttgatgaatattgggagaattgtgagggaaagacgtcaagcgaagggtatgactatcgagcagttggcggaaaaagcggatgtttctgtatcgctaatttcccgtctagaacgtgagcgtgttgataacattaaattggccaatttagcagcgatcgcaaatgcactgcaactgcagatggcagattttttcagagactcgcgtttgcaaacccctaaagttgttgagcttttggactacttggccgagcagcctgaagagaaacgtgaagatgccgccgcgctcatgttacggctgatgaagctataaatcgtaggtagcgacaatttgatgggcaagtgcttcaacaccactagatttgtgagcgtgatacaagtcagcgagattgatagtcttgtccggtaactcaagtgtcaacagtttaaagcagtggtagtcaagaccatactttgcgctgacaaatatttcaaatttcaaattctgtaaatcgagcagggtttgttctagattcatagcgattcctccaaaaacaaaaaataacctcaacaattgctgttggggttattttagtccgctcaaaaactgagataaagtcttgttagcgagagaaatttgttcgtattattaatattatgtatcttgtatagaacaaactttaaacaggctgtcaagcttcgtcaagatttttttgatttgcgtacttaaagttttgccttcctttataagcggagcatggtacagtatgaatattaaagcgattttgtctggcaaaatgcagatacatttatttgaagttgcccagcaaaatatggaggattacatggcttcgaaaccaatctacaccttttactgcaagttacatgatgtcctgcccgagacgtggcggttgattcaacttcctctgaatcgaagcgttgcacagcttgcctatgctgtgatgacaacctttgagatgcaggcgcgtcatctgttcaatgtgacggtttttaaagatccttcaaatcaaaactctttgcgtcgatctaaggatgacactgtttatacgacggatgttgacgaagaccgcgaagtttatggttcaagtgtggccgatgcggtggctactcagattgacagtgtctttgcgccggggcatcgtgaggcggtgttgaattacgattatggtgatgggtggaaggttagtattgtgcttgttgacattatgactgatccagagcttaaagtgcgggacttgccgcgggttattgcgggcgcaggttatggcattgttgaagacatcggtggcacatatggcttataccagttggaggatgcttttcagaatccgacttctggcactgatcatgatattgaagagaagcaagctatgcgcgagtggttttggcttgatcattttgatatgaatgagtttgatcgtgatgaaatgaatagccggatcaaaaagattccaggtatttatcagcgagcgtatgagaagtggaaagcaccgactgcggctgaggctcgcttgatcatgcgggagaattaagagaattgcctttttttcgaacggttaaggacttgaaatagcttgatctttgaggtgcgtttgtgacgtaatgaattagtgagtatacgggggatagagagatgtcgtatcaacgaagaaatgctggtcgtgccattttgctggctttacaagacattggtggggttgcatctagaaagcaaataaaaaagcgcattgctgacaacgaagaaactggttttacctacgatgatgtttttgaaaaggtggcagcgaaatccggcaaagaatacgtaccatttgattttgatttcaatttttcattaaaagaattgggccttttggggtatattgaaccaccacaacgcggccaagatattgcattgacagaaaaaggacgcgcatctgatgctagcttgtatctatctgctgatgaggcggcgagaattgccgattattggcaaaagaaaagtgacttgcggcgcgcaaaaaatgcaagtcaagcatcggccaaagtcgagccaataacttcggatcttgacagtgcagatgataattccgatacttggcaggcacagttaatcagtcagctgaaacagttttcgccagcaaagtttgagagcttttcgcgacttttaatttcaaagatgggtgtcaagattgacaagaaaatgggaatagtgaagtcggctgatcatggtattgatggatttggttactttgaatctggtgaattccgtacatcacgcgttgcaattcaagcgaaacggtttactgatagcccagtatctgaacctgatattgataagtttaaaggcgttatggatggctttaacgcggaatatgggattttcattacgaccagctacttcacagatcaggcaaaagctaaggcggttcgtggcaatcgttcagtaactttagttgacgggcagcgaattgctgaactggttgaacaatatcgtctgcatatcacaccagtacaaacatttacgttagacgactattatttcgaagagtcgtaagcctccagtagattggccactttgcgtttcagaccagtcccaatcagacgaacactatttaaaatccccgagcctaaaaagtcgccagtcgcgtgcatttgcacaaaactggcggcttttttaatgagacttgattgaatacgttgaaaacaagagtaagaatttaaaattgctttttgagaatataagaaaagatgttgtattaaataaattcatgatcagtcgtttacgcatggtcatcacttattgtccttttgaatcaacgtgttcacgatcttgtggagtgcccggataacttctggatctttaatcaaagcgattgaagaagccagttcggttgtctcatctccgtcttctggaaaagtgaagaattcttgataactgacgtctaatccggaaacgatgcgttctagtgtgctcattctgatgtcgccgcggcttccgcgttcgattctggctagcatggaaacgtccatgttggctttttcggctagttgttcctgggtcatggatttgctgagtcttaattcgtggattcttttggcgaccttttcctgtaaccgcatcccttaaccccctatctgccttggtcataacatcaacgctacctgactccggattgaaggattagggctaaataacacatatttttaaaaaaagtggacttattagaccataaagctttataatattatttgtggttgacagatgatgtgaggagcaattgccatggtaaaccttgttattcgctggaatcatcggacggataaggtttgcgccactgttggggtggtagtgtatatactttcaatcatgttgccaactgcaagtcgtaggcagatcaagccgacttttttgaatgcatcatgaaaagcatatggggatgttctttttttcgacaagatgcttacaaaatataacagtctgtgtggcgacaattttcgtgtggggcgaagattatcgttgcggttcgtatatcattagtttattttaatggcttgcaggatctgtctcttcctagtaagttgtgccttgaatatcctgtctatggcgggatattcttttagtttacgctgattttgatcattgtgaatttgcaaattgattctgtaaaaaagatttggtaacttttacaaaaattgttgaatagtttgtataaagaaatcgaaaatagaagtataataacatttgtatttaatattaaaggatttggaggagtacaaatgggaacaacgcagcggcgaaaattttggacagcgcttacgaacaacgaacataaggtgacattggttcatagtaagcatcatggctggttggcaattggattaacgttttttgcaatggggactgcaggaatcgccttgtcaagtcagggccaagtggtgcatgcaagtgaccaacagcctgcaacgcagcaaacagcgaccaatcagggccgagtttggaaagttcgtccagtaagccaaatcgaagcacagattaaagcttccgagacaggctcgacgaattacaacattcagtggggtgacacgctttcaacaatcagtgaagcgctgaatcacaccggcttcacaacatcggtagcgcgactggcagccattaatcggatcgccaacgtggacttgatttatgccggtgccaagttatccctgcaaggtagcggtgacaatgcgacagtcacgacgcaagacacctcgggaaataatcaaacatttaatttaaatccagcaaaaccggctacccttacaccggcccaacaagctgaggctaaatatactgtagttggcggatcaactggcggcacttcaaatggtggcgcgtcacctgctcctgctgtcacacctaatcccggcagtaccgataaggatgccctccaaaaacaactggaagcgatccaagcggctaaggataaagcagaagctgaaaaagcagcggccgaaaaagcccaacgtgaagcagaagctaagttgaccgtcttgttgaacaatgaaaatacggagacgttggcgcagttgcaagccaaacgaactgcagcgcaaaaggcagttgatgcagccaaggctaaagtggcggccacgcaagaaaagcttcaagctgctcaaacagcagcacagcaagcacaaacagctgctgaccagacaaatgcggcagttgctgcaaaacaagccgccgttgatcagagcacagcccaagtcaacagcgtcaccacgcaactgagcgatttgcagaatcaactaaatacgctggcagatcaagtgaagaccaacccagattcacaatcaaaggttaatgaaacaaaagcccagttggcagttgcacaacaaaagctgacaagttatgaaggccagttagccgatgcaactacagctctgactcaagcaaagcaaacagctagtcaagcgggacaaaaattaaccgcagccacccaagcggttaatgcggttaaaaatgaggctacgacagcccaaaatgaatttgaccaagctgaaacaactttgaaagctttacccgcatccgtgacgagtcaaaacagccaagaagcagaaaccgttaaagctcagttggctgatttgaaggtcaaagtaaaccaattagatacaacgattgatacgcttaacgctcaaattgcaacgtggcaagatcgtttggcaacggcacaagatgatgctgcgacagctcagactgacttggccgctgctaaaaccaaggctgagaaagtcgacacaaccgaccatcaacagactgtaaaagctgctcaaacatcagttgctgacgctaagaagactttaccaacgatctatgtgccaaagaacactgacaagaaagtcaccatcaacaaagacgaaaatggccagacgctcaacaacttggacgggtacaaactcatcactgccggaacgcctgtcaagtcggttcagacttctagcaacggtgacacaatcacgacttatacaacgaccaatgtttatcataagattgcctatcagacagttaacaaaacggtcaatgtggatcagtccggaaatgcgttaacaaacacagatggctatactaaagtttctgtatcgagacaagttgctgaatcaaccgatcctaagactggcgatgtcacgacgacggttacattaaccactgtttggaagaagacggaaacgccaacgcatactacggtcaacaagactgtgaacgtggatcagtcgggcaaggttttgacaagcacagatggctatacagaagtttcacgttctagcaagtcggaagacaccaaggataacgctggcaacatcaccacaacggttacgaccaccattgtctggaaaaagaatgagaccccaacgcacaccaccgtcaacaagaccgtgaatgtggaccagtcaggtaaggttctgacaagcacagatggctatacagaagtttcacgttccagcaagtcagaagacaccaaggataacgctggtaacatcaccacgacggttacgactacaattgtctggaagaagaacgagacgccaacccacaccaccgtcaacaagactgtgaacgtggatcagtcgggcaaggttttgacaagcacggctggttatacggaagtttcccgctccagcaagtcggaagataccaaggataatgctggcaacatcaccacaacagttacgaccacgattgtttggaagaagaacggggccacaacgccagccattgtgaacaagaccgtcaatgtggacgaagcaggtaacgttttaactagtgttgacaactactcgcttgttaacagttcaaaaacgtctaaagaagacccaagctcatcgacaacaaccttcaccacgaccaacgtttggaaaaagaataccgatccaaacgaaacaatcatcaataagtttgttaacgttgatgatcaaggccacgagctaacttctactgatgggtatgtttacattggtggaggatcagctacaagttggttaacgactagtgatggtcacaagacaacaacaatgacctacacaagcacgtatcacaagccacaagctaaaaccattacaaaagaagttgatgtagacgaaggcggcagtaccttgactgataagacgggttacgtcaagatttcgtcaacgccaattacaacagtatcgaaggatccgaatacttgggatacaacaacgacgatcacgacgaaaaatgtttggcgcaatgtggaagctgcaggaaccattatcggcgcaattaagagtgtcaacgatgctaccacgcagctgattcaaacgcagatcgaaaagaatgatcggaaagtttcgattgaacaagccgcacagtacacagataaagatctgactatggccgttatcaagaagttcaatgtgctgatcaatggtgaacagaagctgaacagaagcgtaccggtcatgttcaaacttccttaacttcagatccgaaagcttatgagatggaagcaccgcgcgccgttgaggttatgttcaagtttagccacacgcggccggttaatgcaccagcaagtggtactgaagccgtcacctatcaaaaaggcgagccttacatgagccgaaatactgagaacatttcaatttcctcgctttggaagaaagatgtcgatggcagtgccgataagctgagcactttgattgcggaagcgatgttcaaacaatacattgtggatgaacgtccagaaaacaaccatggtgaaacaggcggtcactaccaaaacatcattaattctggctacaagaacatcgtcatcggcgtttacgtcattgacgaaggctcgtattacgcagcctcaactgctgttgccacagggaatgatggaaccttcaattaaccaatgatcgaaactgatcgctaaccacgctggtgctgtgaagttttacatttcacacgcgggttcgattcccgcggtggtttttgttatatgatcacaaagaagctgagattaaatgagttcttaacctaactgatgtctgtgtgaaaagataaactgccagaaccattgcttatgtgaaaagcggttctggcagttttgaaatgtcatcattgggcaagcgaacaactttttagtcatcgttactgataatcttaaggtttctttttactgcaaagagtatcatagcggtgaagaatacaaaaaagatggcggtttggatgagtcggtgcttatcaaccaaactggttaagaatccttgttcacgcaatgacagaatggcgcccaataaatgaaaaatagcggtggaaacgatgctacttaagaaagcttttcgccgggcacgctttaaggcagctggataagcatcggctgtcacttcttcttttcccagtccgtttttcctgatggctagggtcgtggtggcaatcaagatcaaaaaaattcccgtcagttgtatgctggacataatataaaacgcgtcttcataactgtgaaatgggataaggaaagacatgacattgattgtcagttcaaaagtcagaattccgaggacggcatgaatggctgcgcgtccgagaatagcataggcgtgttcgtcaattggttcttgaatgccgaaaatacgggcgatcagtttgctctcaaagttcttcattcttttccctccaaaacaatgtgttgagatccgtgcctagtgtccacgacagtttgagacaaagttccaaagaaggattgtatttcccattttcgatgaggttgatcgtttgtcgggcaacgccgatcttttctgccaaagcaagctgcgagagtttcttttcacggcgaaattcacgtacacgattcatgggaagctacctcctttcaaaataaaatgtcacatttaattgacacggatagcatacaagaaggttgcttttttgtcaattataaatgacatgttatgagtccgagacaagattaaacggcatcaacagcaagtatcgcgcttgttgtcgatgccgtttagctatgattggagagagttgagagattaattaataaattattgggcataaatcgccttgagcccggcaatatcgccatcagataattgcgtaaccccgcgcgtgactggatacatcaccgaatcagtcgactggctatgatccagtccgagcgcgtggccaagttcatgcatggccacagccgcattaatggattgtgatgggtaagcgaggttgagactggcgcgggcatggttgataacggtaacctgtgcgcctagcgtttcaacgataatggtcggaccgccttcaccaagctcagtggtaccaagactggcttggctcatgtctttttgataactggaaaaagtgatttgattgtcgcttcttttgccttgaccggggatgagcttaacaataccggttgcgttataagcgcgcacggcattggtgaagacagtgtgttctgcttgcggtaaattggcatcaaaatggtaatagtaagtacgcttaaggtgtcggccttggacaatattcaaggccgaggtggctcctgctggcgtacttgccgagcgtgaagttgcctggctagtggtgcttgaggcaagactggtggaggaggagtccgcagatgaattgccatgcagccagttaccaacagtgtgtgttgttgtagtccacgcctgggcgataccggccttcactgtttcgcgggttgtaaacggaagcggactttcggtgctataaaccagaaaaacgcctgcgacaagcaagatcagccaaaataaacggttgcggtgtttcatgcccattggcctcatttccaaaaaagaatttgctgactgcgtacgattattttatgctaacttagacgcggttgtcgtgcagctttagactgatattttaacggttttgtagggaatcgtcagccagtagtgtcacaagtgaacgatctcaccgaaaaagcttgttagtgagccatcagttgaaaaagtggaggggatcaaatggattctttatcaagcgtgctccttgcttataaccttggtcacgtcacaaaaacgattccaatgacaaatggtaaaagcagcatggcatggcgaattgagacaatatcgggaccagttttagtcaaaacagttcccagtacggcacaggctttgtttgaatttgcgctaacacaagctattcaagacgttgatagccgcttgacgccagcaattttgttaacccaggctcagcaaccatttatcagtgtgaaccggaaaatttatcaagttcagcgattctgggaacaccatccctctgcacctacattagcggcagcactaaactgttatctaaaaattcggaagggcttagatcagtttgaatatgattggcaaccgcaagatccgcaaccactgcagcaactgtggcaaaagcagcatcccaagttgcagcaaactcagccggcaatttatgcacatttggtttctcagatagaatcgctgctcttgctcgaccaagctcaggaagcatgggtgcatggcgacttaggacggtggaacttgctcacaatgacgaataggcaagttggtgtcatcgactttgggcaagctcgtcgcggtccgcgatttttggactttgcggctctttatcatggttttatgccgaggcagagagtcgcactatctgtctatactgagcgtttttgctgtttagctggtattagtgaaggtgatcggttaatttttttagcaacggtgcgcttgtggttggtaaaagggctattggtggctgttgataaggctccagatgcgattaaagtctttgatcaagcgtgtcatcaggttgaacaattggcgtaatcttcctcgcacacaattgattttcctcacaaaaagtggcacactaaaagtaagtaacaggaaaggtgacggtaagatggcaacgatcaagttatcgcagtcgtttgttgatttgatgaagaagaagcattttgaccagaagattctgttgttgattgctgatgatggcggcgggcggtattctttacaaggcggggcctgcagtatcggcacaaagtttacgttaattgtccttgatgaaccggatccggattatcaagtaaaattggaaaatgatgccggattgcaactgtacacttccgactatgacatgattttctttgcaagtggcttggcgatggactttaagcaaggcgcgatcagtatcaaagatgacgctcatgcttatttggacggaagcgttcgaattgccaagggttcagatgtgttggcggcctttaagaagggcatcctgatgagtggcgctacttgctagttattcgcggcagtattagaaaataagtaaattagacgacactggcgatggaaatttcgttgtcagtgtcgttttttgtctaaccgcagtgagctagtcaataacgttaataggcaagcacagcatgtgaatgtttgtaaactcaccgtagatttttttaaatgacaaaccttcttcgttgccttttgaccaaataattggtactattgcaccataaaataacaagtcgaacggaggctttttccaatgcggatcaaagaccgatttaccccatcaaaacttaatgtcggggctgcgcttggtgcagggttctttgatgcgcttcgcaggtagactttcggtcggtcataaaatgggattaacgttaggcggctgagaggtcgtctttttgtttgccattgtgcagtcctaagtagtcgattcgattggtttggccagtcggaggaagcgaggggacatgcaatgcaaaaaatcatgcaaatcggtgccttgaagaaacgatggttgttgggattattcattttgcgggttgccattgatgggtttaatgtggcgatttcgatgttgattcagctgggattgaccgctgcattagcaggtcacacagggatgctgataggtgtttttgctggcatgcttgcagcaacagtggtctataccggactctactggctgtcaggcgttgtcatggagcggctaaaacgacgcttgagtgtggcagtcgcccgggcgttgatggcaagtttcttggcgggggatgctcaagatgtaccggatgcgggtgtggcaacgaatttactgatcacggatacgcagaatgtgatgcaatttttggacagtggtgtgctgccgttggttgattttggcatgacagttagtttaggactggtgtatgtcgcgacacaatcttggcagttggccgtggctttcattggatttgggcttttatttgccttggtgtcgcgccatttatttcgccgccaaaatcaggcacaaaccagtttaattgcggtggatgatcggcataagggatttttcaataactttttggcaaactttgagccggttcgtaatctgaatgtctttggttatattcggcagcggcatcaaaccatttttcaggaagcgcaaccggctattcggcaactggcaggcgcaaccggggcgctggcaggtatttttaatggcggcatttatttggcagaggtgctgacactggcgctagggtttggcttgcttccactgacgcatcaatctgttgccggtgttttgggagcctggaatgccggtgtagggtccattctgtggccgtttttaggattggctccaaccattggctatctcgcgcaacaacggacctctctgaaccggattttgccgcgcttgcaggcatcatcaaaagttcaaatcgcgtctaccgagatcgattcggcacaactgttgaccatcgtaggcgatcaggttgcttttcattatccgcatagtgagcgccaattattacgaggattgaattttaaaatccataatcgcgggatcacttttatcgttggggcaaacggtgctggcaaaacaacgctgatgaaattgatcctcggcgatttgacgccaacatctggtcagattaggctccagggatccgtagataaagtcaccccggctgaattaatggcatttgtcccgcaacgcagcgtgatgtttaccgcttcggtgacggccaatttgcttttgaacacggaggcttcgtcacctcagataagaccgttactggaaaaacttgggctgggaaaatatgctgaggatctcaatcagattcttcagcctgcacagttatcgccgggtgaacagcggcgattcggcattgcccgcgccttgctttcaaatcgtccgtggctagtcttggatgagccgttctcggatattgatgctgccaaccagatggcagtgatgcaagtgttgcgacaggctgcccacacccacggcattttgatgatcacgcatacgtttaattttgtcacttctgctgatcaaatcattaaggtgggtgaataagatgactgaattaaagcagttttggcatctttttagtacgcggattgtgccagtgctatggattattgccatgatttgtgccgcaattgagtttgggttagcgcggttgattcaacggttgacccagcgaggtgcacttaccatgccgttgatgatgatggctgttgtagcagcaggggtgattggcggtggtcgctggctcatcgcacgctggcaaacgcaggcacattatcaactcacccaaacgctgcaatcacgtttaatggcagcactaatgaacggaccggttgcagtcgatcttgaagctcgaaatgaacggctcaatagtttgacaaccgaagcgccactagcagcacctttgtttatcaaatcggtaacggctattttagtcggattactttcatttctcgctgccagtctatttggctggttaagctcctggccgttgatgctcatcattattgggttgtgcttgacggctttgctgattcctaaagtaatggccggtcgtttaactcaggcacaagacacgcaacaatctgaaaatgcgcggatgcaagcagcactgttagaaattctcgccggaagaatgcttctgaaagattatcaaaaagaacagtttggtttgcaactatttagccgaacataccaaagctttgctaattcccaatatcgcatgggcctgcaacaaaccggtacgattgtcatggggtttgcactgggcttatttgttgatattgtgattttgggcgtggaattactgtttgtcggcttcaaatttatctccatcgggcaatttgctgcgtttgcaatgctgacgcccagttttacctggttattttacagtatgccagaccagtacgctcagttatcacggaatctagttgcagctaaaagaatcttcgggttaattgtgccgttacaagcagcatcgagaaatgttgctgctgaaagccaagaagcgccctcagctcaccagccaaaaaactcggtacaacagttgcttctcaaacacatcacttacacgtatccagatgcatctcggccggttttggcgcaattggacttaaagttaaatgtggcggcacatgaaaagattctgatcacagggccaagcggtggcggtaaatcaactttgattcgaattatcttggggcttttatcaccgcaagcgggcagtgttcaaatagaaccggctactcttgaagctccacgccaacttgcgcacatcatcggctttgtaccccaagtggtggctttgtttgatgatacgttgcggcaaaacatcgcgcttgaccgcaatgtaagccagacggcactatcggaagtgttagtccagactgatttacagacatttgtccagcgattgccagaaggactcgccacgccgcttcatggccagacaagagccaatgtttcggccggtgaattacaaaagattggtttggcacgggcacttttggcacgacggaatgttttggtgttagacgagccctttgcaaatttggatgccgccgccgcaaaaagcctcagtcaacgattgcgtcaactaccagtcgcattgattgtcatttcgcaccgccaagatgttgaacaattttgggatcgcgcgctgcagttagaacatggacggttgaacgaagccaagctttgaataaaagtaattggcaagcgctctcattttccgtatagtgaagataccaagaaaggagatagagaatgtttaactggttgattttgggacatatcgtatttggcctcattgcatttgttgggtcgttgctgttggcgcttggtttccgtacctcctttgccagcctgacagcgatgcagcaatgggggattggcctttcgatcggcggcctgtttgccacgatggccttcgttatgttcacagcggcgaatatcgtacctgcgctattattcatcggcgctggcttagcacttttatggatccttttccatcaacgcgcgaaggcctgaagtgtctatgctatttactgggaaagtcgactgagcgcttactcggtcggcttttttaaaagagcaaaaagttaagctgatgaagcaagtcagattttggatagatttaaataaaacacttttaaatgaacacagctggcaacatatacacgattatggacgtgtcaaattgattcgttgttcgcggagacatttagcactcgttcaggccctgactcaaatattaattttgcaattaaaaaagtgttttttaaagcgaattaaaagtggctgagtatctaccaaaactgatataccagtttttcttaatgttatttagtttcctgatgagacatttctacaaaattacccgttgacgaaccgtttttttaaaagtatgctaatgacaatttcttcgagaggagttcacgtgatgacccagtttaaccaagtcatgtccatgtgcatgtgcagctgctatgaacaacatagcggttctatttacatggctggagattggcttaggtgacggtaatcacgtgacttgaacgaagaacgaaactggcggtgtatctagaatcctagatgcaccgccagtttttattttctaacgcgtttgctggcgtagaaatatgggtgtaggaaatttggctaaaatgatcaatgccgggcccggttatcatatgcaaagccaccgttcttacgcgcgctgactcacgctccataacgcgttcaccggcgcagaagtctacgtgtaaggacctcagccgcaatggccaaagtgcggccatcacgtctgaggccgcttacactccgacttctaagcgcgccggttcacgctcactataacgcgttcgtcagcgcaggaatctgcgtgtaaggaccttggtcgcaatggccaagaccgggccatcacgcccaaggccgcttacactccgattcctaagcgtgctgactcacgctcactatattttaggagatggctttttatgaaaaagcaccatttgttaacggcacttattacaggcgttgcgcttgcgacgttgttggtcggttgcggaggtcggagtggttcggcgtctgggaatgctcagacgctgaatctaactgaagaagatgacccgacgacattggatgtcaatgatatgcgcaatgccaatgaaaatgacattttatctgaagtgcaggaagggttgacgacgattgaatcggcaaatggtaaggataaagttgtcttaactggggctaaatcctataccaagtcggcagatggtcttacttatactttcaagttgcgtgatgctaagtggtcagatggcaaagcggtgacggctcaacaatacgtcgattctttccggcggctgttgaagaagaaaaatgccttttcgcaggccaccaatgcttacttcatcaaaggtgcagaggcctataacactggaaaaggcagtgccgaagacgttggcgtgaaggcaattaacaagaaaactctccagattcagcttgcttatgcttacccatcgcttttgtcagacatggcgtcagtgatttattatccggttcgactcgacaagatcaatcaggtcggcaataaaaagtggaaaacagacgttaaggatcaagtgttcaatgggccctttaagctgacttcatggaagaagaacgacaagatcacactgaagaagaacccatcgtactggaatgctaaaaaggtaaaactgcagaccgttacttataccacaacgagtaagccgtcaactgttctgtcgttgatgcaaagtggtcagttagatgccttgtcagcttcgggtaaacagattgctgactttaataaacttgccaagagtaataagctgacttctcgcacgcaagatggtgccggtaccacggtcttgattatgaatcagcacaatggcggaacgcaggggctgttcaagaataccaaagttcgcgaggcgttttcattgtcaattaatcgcaatgattacaataaggcggtcagcgatggtcaggataagttgacctatacaatggcaccgcaaacgctgaatgttggttcgaccaattatggtaaatatgttggcaatccgctaaaagaagcccaggcacaatataataccaaagctaaacgccaagcattgttgaaggaaggcctgaaagagttaggtaagtcaactgatctcagcaagttgaattttgtctatttaaccgttggcagtgatgatacgggtacttggttgaaacaggcgattaagcaacaattaggcgtcaaggtgaccatcaaaacggcaccagatgatgccagctttgttcaattgcgtaataaaaatcaatacgacttgctgggcaatggctggttggccacagctgatccgaactcatatttgagcctatggaattcaaacaacggcttccaaaagttcttcggtgggtacagtagcaagacttttgacgcactcgacaacaaactgaacggtaatttgaccactaaagaacgcctagctttgtacaaacaactggaaacgcaattggttgccaaagactttggcgtcgtaccgttaaccaacccacagtcacggatttacatcaataagtcggttaagaatctgcaaacaacggtgtttggcggaacctttaactacacttatgcatcaaaaaagtaaccaattgaaaacattcgtcgttcttttgactaatgtaagttaagactgttgggagatggcaataaatggcaaaccatgattttgaaaataggtggttgcacttatgattaagctgatcattcggcgtttcatcgaattgctgatatcgacctttttaatagcaactgcaacgttcttcttgatatctgcagtaccaggcgatgcgttgagtgcgcagaccgataagttgccggaagccacacgggaacaagtctataaaaatactggtctggacaagccggttttagagcggtatgccatcacgatgaataacatggtacatgggcaatttggtgagtcgattagtgacccttctgtgaccatgagcagtttgattcgtgatcggttgccagcatcggcccggctgggtattcagcagatgctgctaggcattccgctggggctgttgcttggcattttggcggcggtttataaaaacacctggattgatcgtgtcattacgattttggcactgttcttaatgtcaattcccagtttggtgttgggcctgcttttgcagagttattttggcggaaaacttggctggtttccgattattggctggccaagcggtgatcagacttggtggggtggctggatttatacggtcctgccaaccattgctggtggcattggctacattgcgggttatgcgcgtttattgaaaaattcaatggtcgatgttggctcaagtgagtatgtcatgacggcacgcgcgaaaggattgtcagagccgcaaattgtcttacaccatatcgtgcgaaatgcctccattccaattattacgtcattaccggttaccttggcattcggtattaccggatcggtgtttatcgaaagtattttcgtcattccgggtgtcgggcaatattttgtcacggcactgaataatcgggacgttccgattatcatgggcgaaacggtgctgctggcgatcttgtatattgtcacgatgttcatcacggatttactgtatacactggctgatccgcgaattaaactctatgacaactgaagggagatggacgaatggctgcaagtgatacggattttcattttgttcaggcaagtggcaattttagtacgccaactgtgctgaccgagccagaccaagtcgcgaccatcgaagcaaatgctcccaaaagtatcagtttctgggcatcggctcgccaaaagttgttaaaggatcggcttgctgttgcctgggggatcattttgatcttaatcgtattggcggcgttaattggtccacagattcaacattatgatcctaacctcattcgtgttaacagtcgtaatgttggcccaagtgccgctcactggtttggaactgatcgcttaggtcgggatttgtttacccgaacctgcattggcgttcaggtgtcattgatggtcgctattttgagcacttttttggccattggttttggaaccatttatgggatgatcatggctttctttggcggctgggttgacgaaatcttgatgcggattattgaagtgtttaattcgttaccgggcttgctcattacgatgctgattatggtggttttaggcaatggtatgtggacgatgctatttgccttggcggttaccagttggtctggttcagcgcggcaggctcgcggattggtgatgcagttgcggggcttggattatgttacagcggcagtgatgttggatacaccgttgtggcggattatggcgcggcatctggttcccaacatgatgagtattttgattctggatattggccaaagcattccggataacattttcggtgaagccagtcttagtttcctagggctggggattcaagcaccgaatacgagtttgggaattttgattgctaatggtcaagaccagatgctccaacatccgttgcaactgtacatcccgattttgattttaatcgccattgtctttgcgtttaacattctgggggatggcttgcgtgatgcgttggatccaaagtttcaggactaattgaaccgactgccggcaacgagaagtgtttcgtcaggaaaacttcacccaaaagccgttgctcaggcagtcgcgatgagaaggattgaaggaggaccatcatgattcaaaaacatccctggcaagtcatcaccgctttatttgtcggcttgtttgtcacaacaaccggcttttccctgacgcatgagcccgtgttagtggctttgctgtgggggttgcatcaaactttttggctgctagttggcttagcgttacttgcagtcggcattaaattactgctacacacgcggcgaccgcatgctgctttaaccagtcgctttcttggcagcctccccggaaatggtcaattggcacttgtggcagcgattaacctgctgggtggtgcgttaattgatttgtatttgtactgacaagcaacgcgatctagaatcgtttatacaaagcagtaaaatggctaaactaattcatgaaaggggcgcggcatgactgatattgtttccattaagaatttaaacgtgacatttcatgaagcaaatgaaaatgtttatgcggtcaatagcgtcaacctgactttgcatcaaggtgagacgctggcattggtaggcgaatcaggatcgggcaaatcggtaaccacgcatgcgttattaggcttactgggtaaggatgccgaggtcaaagcggacgtcatgcgatatggtgacaccgatcttttacatgcaagcaaaaaagcttatacccatttacgcggtcaggaattgggcttgatttttcaagactcgctcagtggccttaacccgaccatgcggattggccgtcaaatcggtgaaggcgtcaaagcacatcaacatctacatggcgcggcgttgaaaaaagcggtgtatgcttctattcaagatgtcggcctcgatgatcctgctttgattgcccgcaagtatccgcatgaactttccggcgggcaacggcaacgagcgatgattgcgatggctttgattatgcacccgaaagtattagtcgcagatgaaccgaccacggctttggacgttaccttgcaggcacaagtcttggatttgattaagacccagaaggcgaaacatgatctaagtgtcatttttatcacccatgatctcggcgtggtggctaacattgccgatcgggtggcgattatgtatgccgggaaaatcgtggaagtcggcactgccaatgaaatcttttacaatccgcagcatccctatacatggggcttgttggatgccgttccgagttcggatgaccagcgggagcagttgtttacgctaccgggaacgccgccggatatgcgcaaaccaatcacaggtgatccgtttgcaccgcgtaatccttatgcgatggcgattgactttaaagaagcaccgccgttgtttcaggtatcgcctacccattttgttcgctcgtggctgcttgatccgcgcacaccaagctatcagccgccagtgacgattcaaaaacggtgggaacggtttgcagatatgacggaaaaaccgcaaaccattgtcgcgagtcaggcttaggtaaagggagatgatcatgtttgacagcaccattgtttaccattgacgacctgagtgttacgtttcataaaggccgccagcccattaaagcagtggatcatattagcttcacaattgagccggggacaacggtggggttggttggcgaatcgggctctggcaaaaccaccacgggtcgcgccattgctggtatcgggccgatttcaggcggcaacgtgcgctttttggatcagtcaattcagcatttttcccgtactgagcgcaagcagtttcggcgccaagttcagatggtttttcaagatccgtttgcgtcgctgaatccgcggcaaaaagtggcggatattattgcagaaggcattgataacttccatttggctggctcgcatcaggaacgaatggatcaggtcttgcagctgttggcgcaggtcggattaccaccggacgccattaatcggtttccgcatgaattttcaggtggtcagcggcagcggattgggatcgcgcgcgctttagccgttcaacccaagtttctggtgctggacgaaccgatctcggcattagatgtgtccattcaggcccaaattgtgaacctattgcggcggattcaaaaagagcagcagttgacctacttatttattgcccatgatctatccatggtgcactacattagtgacaaaattgtcgtcatgtaccgtggtcggatcgtagaagcaggtgcaacggaagcggtgtatcgccatccgctgcatccctatacgcaaacattactggcttcggtgccgcaagctgatccgatttttgaacagcaaaagacccatgttcaatttgatcatgaaccgattgcacccacggcaaacttagtcgaggcggcaccggagcactgggtactggcggcgcaaactgaagcgtaatagggttaaattgtaatagatgaagaaatgccttgattatttgggcaacagaaagtgaatgaagttaaacgaaaagcctgtgtgaccagttgtggtcaacacaggcttttctgttggagtaagttcttggatggggattattcgataaaatttaacccgaataatgatttgctagttggtactttgttgaacgtccctgcccacttcttgaattttctggtcgccttgtaactcagccaaggcacattctatcgttcaccggctaatatccggcaacaaactctccagattggctctactcaaaggttcattaatttatttctgtaacaagaactttgaactccccagatgatagcttcctttttattgattcaaccagtttattaccgtttatattgtaacagtattaaactgtgtcaattcaatatctctttcaatttttccatctctcatcacgattgttcgggaagttttctcagcgagttccaaatcatgagttaccataataatcgtttttccttgacccaccaattcatgaaataaacccattgtcaacttacgtgaatgggtatccaaagcgctggttggttcatctaaaaaaataatctccgggttagctaaaatagttcgtgcaatagccactcgttgctgttcaccacctgaaagtgcgtcaattggctgattgagttctactttcaactcaagccgtgttgcgattgcttccacggaggatttttcaatttttcgtccattcaagatacctggtaacatcaagttatcaaaggctgatagcgatggtatcaattgataatcctgaaaaataaagccaatttcttgccgtcgaaacttggctaattttgaagcactccattcataaggagattttcccttaattagcacttccccttcagtaggtggcaataaactagatatacaatacagtaaagttgattttcccgaacctgaaggacccacgatcgatacaaattctccttgctttatctcaaaagaaatatcacttaaaacctctaacacatttccctgtgccaactcaatttccttttttaggttttttaccacaacaacttcattcatcatgatccctctactttcctatccattgacataagcttttctcttacccttttccaaccaataaatcggtgcaaaacaaaggaagaatagggaaaatatccccagcgtcaataaaatatttactgtccaatttgcccggaaaatatcaccgccgcctaaaaaggcaacccttaacaacggaatcgcaaataaaagtgttcctaaaaaagtaatgagaatcgaaagaatcgcagccgtgccgatctccgtcaatttgagttcaaaaatccaacttggcgtacacccggtaaaaaagtagttatctgtttctttttgcgttttcatcttgaaaagactaattgaagtgacaatattcgccaagctaatcaagatcggtgcaccaaaaacaaaaactagactaacaatcaaatcgtagatcgcactttcatcatttctaccgtctactaacatttttgtatttaaaaataaggcaataaaattcccaatcagtagggcaataacactaactggtcgaattagcttgatcatattttcttgatggaactgcaaatcataaaaagcagaacgaatcaacggatgtttggtaatcgatggcagatgggcaaccatctttaccattttgataaataaaggacgaatcaaaaaattcatggcgacaatcagcaacaaccataatagtaataacagattcattgcatttttcatactattcgtataatcagccacgctactgggatctggtatcgccttcaaaaataatagcaccgttccaacgatacatccgatgattgccagagtaccgatgaccatcccaccatttttcttgccttcttctcgatcagtggacactctcccttttctccggcgataatttttcaggcaatatctcatacaagtcatactgatcaagaccgtttgtatcaagaggacgattcctatcgtgtttcctgtcaaagcaattggtaaactggacaatgattgtgaaccagctcctataggtaaaaggcgtaaaaatcctctcgcagccggtactacaaataggatcccgaaactagcacctataatacctgtcagtagcatttgtccagtcatcaaaaaactcagctgtattggtgatgcacctagcataagcagaatatcattggtgtcatcaaaaaaatcaatgcattgcttcatagcattatttgtgaataagcagagtatcacaccgccgattactattggcacttgtagaaataccccataatccacaccgctacttgcatcagcactactcaaggcacttaacaaaacgatagcggcaccaaaaacaatccctgagataatgaaaattggagtcaccgctaaccaaattctccagtgctttataaatagctttgtaactactctattcatcgtcttccctccaattcaagatattttttcacattaacacgataaaaaatcgaaataatcagtttctggtccaatcatttaaggttaacggtgatgctaggattgaaattcttctgtataaaacggatattacttagtttcaacccatttttccagtaagtagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttcgtagataggctggaagtggaagtgcagcgatgcatggagcggaccagtactaatcggtcgaggacttaaccaagtaagagcgcgagcagtcgcgattagaaaccggagcataagcgggcctgagcgtgatggccgttctttggccattgcggtcagggtccttatgcggaggtttctgcgactgggagcgcgtttcgatgaaatacgttaagttccggcaaaaacaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctgtttattccggtttagctcagttggtagagcacctgactgttaatcaggttgtcgtcagttcgagcctgacaaccggagctcataaaggcatccatcaatgagtggatgccttttttctatattattttcagaagggtaaatggtctcgtaactttggcttgtattaacctatgattccgagtcgggaaatttaacaacgagtggctactaaagttcactagcttgaccgcctctgtgtgaattggcatcatgttaatatgagtccttgtaagtgaagggagtgtcatttttggataaacgattgcaaatacgtcagcagaaaaagcatcgtcatcgtggcttgaaaattttttcgattgtcgcgggtcttattgtactaatggctgtgtgcgggatctttttctttccgcagattaataacacgattcgcaatgtcactggtaacgacacaccagctgacagtgcagttaaagcacggattgtgtcaggtattactgctcaaaaaaccggcaacccggcaacagatgctgttttacagcgagcagctgatacgataaaagaaacgaaaatgagtacgattatgaaagctgcgcaggatcaggaccaggcagctacattgctgcaaaaggcgacgggtgttaatcaggatcaagcaaagttagctgcaactgttctctttaaagaacagtcggtgacaccgattcgccaggcaattgcttctggtgattattatcaggcctatcaagatgccaagtcattgcaacaacaaggtgatacgagttcattgcagagtatcttaacgggccagcaataacataaaatagcttcgatcatgacagattaacagtcagatcgaagctattttattggaattgttgccttaggttggctggtacgtaaaaatcagctcgttatgtgatcggattaatcgtcctgtgacagttttatcggacatcaccatgcccccgggaagcaatgcgtggtgataatgaaaccctgaaaagttcggtgcggtaagcttgaattgatgaccggttttggtgtgtagaacttgcacatcacgaagcggtttttggtgactatcaaggtatttaatcacaagtgtggctggcttaggttggtggatgagcgagtcggcagttgtatagacaaaggtaagctccggggtttcgccgctcatggtgccagccacagtcggatccttaacatgttgtccattaggaaggattgctttttgaaaatcatagccaatcaatggcggtgcggttaggcgaaaatgatggtctctcgagttcattaagtgattatccggacctagtgctttaccgttttcatcaacataatgaacagttagtctgacttgtatcaattgatcctcatcctttttgaacttgaaaatcacttatcaagcattgcgggcagtaaagcgtgcttgcttaatcgttggctgctctaattcatccagcagtgctactgctaatgtgccgctatttaataccgactttccctgactgtcttttaaaagggtattgtcgccgcgcacgtattcggttgccggaccatgttgaaaaatcatacttggtgaaataccaagccagttaacgttgtcagtccattgcaacaactgatattctctgagctgattcttgggcgtgttgatgaaggaaggagcgtgggggtctttctttaacaagtcatagagacgtcctccgtcagtttctaggctgccagcaccgagaataaaaacgatgcgtggggaagtagtctcgcgcagttcatgaatcaggtggtcggctaagtcgatgtgcagataggcttggtccacggtggtgccaaaagcatcgacgacaacatcataattttgtaattcgttgtgcgtaagtgtaaacgcgtcttgctgtattaattccgcgtctggtggtaaaatgccaactcccttgtctgggtggcgaacatagccagtcacctgatggccgcgtttcaaggcttctttaaaaatagccgaccccgcattgccggtagcaccaataatcgcaattttcatgtatcacaacatcctttcgtggcgagtcgtttcaatgtttatgatacacttactaaaagtagatagacaattaaacaagtctaaagttagtcatctttttccgcaaatttgtttaaatactagaaagttaacaatacaacggtaaggacaattgacatcaacatatagaactaatccacattcagagtgatttgtttttgtgaaattggtgatgactcataccaccttgtaagcccttaatagtggcctttttgaaaactaaacggccattggcgcaaaaatgatggttttccggaccagaacttgattaaaaaaatcgcagacgtactggttttaccagtgcatctgcgatttaagttgtatgatgccggctaggtgactcgaacacctgaccctcggtttacgataccgatgctctaccaactgagctaagccggcataatgacccgtacgggatttgaacccatgttaccgccgtgaaagggcggtgtcttaaccacttgaccaacgggccatcgctgaacaacaagtaagattatacaggagcagtattgcgctgtaaagactttttgtgcgacaaaattattttagattttttagattctacagagacgtttgtgaatttagaaaagattctaaaatgccacaaaagttttgtacaaggctataaatcagtttgaccttacattcggcgatcactacagcaggaatcagcttaatgggatagtttgctgatcattgccgcagtttgggcggggacaagagccgttgtatccaacttagtgctattgacggttgtatactttggcaatcgcgcaatggccttcggaatagcatccgccgttcgaatgccagcgtgaatatcagcagtaatatttcgctttaatttctctgcactgggcatcagcgatacatttaccacttgaacatttttcagcattaaaccacccaaaacatcatcaatgatttcttgttcgtccattacccagcaaaacacaatattaatcaagtccggtgcttgaataaacgcgttcagtaaatggtggatattatccattaccatcgctttggtcgcatcattcaccacaaatggatccattgcccaacaccagtcaccgtctagcatcaccgcttgaggcaaccgcttaaccagttgttcgctaacggctgtcttaccggctcccataggtccgccaatcaaatatagtgtttttgtcacgctggtcatctccatttttaaaaaagagtgctaactgttaaccagctagttgctttttagtatatcagttcttaaggtaaaacgtgccaaaaaaatcgtagatagctgcttctatttgagacgttaaatgtagccgaattctaaaagtgccagagtctaaaagtccttttttcgatacaattttcgaccctgttaggcgcttatatatgctatgatcaaacggtaacaaaatgatcgaaggggtgcgagatgcatagacaaagaacgcatttaacaaaagggtggctttgaccggttgtcttactagctgtggtcttgatcgctggaggtatctggtttggacttaaccagcaggctcaagcaagggcgcagcaggcagcctcatcatcgcgggttaaagcgcgttcggttgcgcgttcacgctcggctgccaaagccagtcaagccgaggcgtcatcccgaaaggcagaagacccggtttataaagattttgctgatgaagggcttagttatcatcaggttcaagtcgctaaaaagatgccgatcacagcagtcggggattcagtgatgctgggtagcgcttatctgtataaagaaatcttccccaaggttgatctggatgcaacggttagtcgtcaaatttatcaggcgccagagctttttaagtcactcgcggcgtctggtagattagccgatacggttattattgggttggggacgaatggaacctttacagatgaagcttttcagtcgattatgaccagtattggcagtaagcgacaggtgtattggatcaatgttcgttctgatgccgagtggacaaatgaagttaatcgtgatcttgtgaaaatggcaaaacgttattcgaatttacatattgtcgattggtatgctgcttcggcggaacacgataattggcttacagcggataaaacccatccgacaactgaggggcagctgcattacgttgcgacagttgctaaagcggttttagcgaagtcaaagtaaggatataaacgagttcggttggcgaaaatgttggctttgtatgacgatgaggtttgttgatggtcgtttgattctggaacaggtggaacaggtttccggacgcaggagtttgcgtggaaggcctcgcacgcaatggtcaaaggcggccgcttacattccgatccctaaccgcgctgggtcgcgctcactcatttttggaggtggtttatatgcaggctttgctcgatattaatcagcctggtgcttatctattgatgagtgtcgggggaagtgctgctttgcggcgccatcttgctgaaatgggacttgtgattggtaagaagctgacggtggtgcagccggcaaataaagctaccgggttggttatttttttccaaggacagcgattggcgattagtgatgagattgccggtttactcgtggtgcagccgtttgccatggatgaccatcagcctgctgttgcgttgggggagttagctttgaatcaagtgggcctgattcgcacgattaagggtgatcccccgttgcgtcatcgcttgatggatatgggattgacaaagggaacactggttaagattcaccaaattgcgcctttaggtgatccgattgagcttgcggttcgcggttataagctgagtattcgcaagcaagatgcagctcatgtgttcgtaacggaggtgggtgccgatggacatgcatgaaactttagcactcgtaggaaatcctaacagtggtaaaacaactttgtttaatgcgctgaccggttctaaacagcatattggtaattggcccggagtaaccgtcgaacgcaaatcaggccggctaaaagccaatcatgccttggtgctagaggacttaccaggtacgtattctttgtcgccatacagcagcgaagaaattgtgacccgcgattttttgctcgacaatcaaccggatctggtgataaatgtcgttgatgccaccaatcttgaacgtaacctgtatttaacgttgcaagtgatggagactggtcggccgttgattgtggcgctgaacatgatggatgtgctggaaaaaaacggccatcgcagcattaatttgaaaaaattaagttatgcactccaagtacccgttattggcacgaatgcaactaaaactgccgcattgcaggaactggttcagaccatccaagcaccgctaccgaagccgtatacttttcccgagtatgatccgcgactcgaatcagccttgacgatgctggcagaagttattggcgatcgtgttccccaagaacgggtgcggtggtatgcaatcaagatttttgaaaacgatccgcaagtcatggaaaaattggctttttcacctgcagagcaaaaacaggtcacggagattttacatacggcggagcatatttttgaagacgccagtgacagcatcattgtcaacgcacgatatgacttcattgcgcgggtgattgccatgtgtggtcgatcaagatgattttgtgatgtcgatgagtgatcggattgatcggattgtgacgaatcgctatctggctttaccgatctttgttgtcgtcatgtgggcggtttattatctttcaattcagacgattggaaccataggcagcgattatctgaatgatacggtgtttggcagctggcttccgagtgtggtcggcgggacgttgaaaagctgggcagttgcaccatggttatccggtttaatcgtggatggtttaatcggtggcattgggtcggttttaggttttcttcctcagattatcatgttgtttttgtgtctgggcatccttgaagactgtggctatatggcgcgcattgcttttgtgatggatcggttgttccgacgtttcaatttaagcggaaagagttttattccgatcctgattgcgactggctgcggcgttccgggaattatggcgaccagaactattgaaagtgaaaaggatcgacgcatgagtatcatgttgaccacgtttatgccatgttcggcaaaattaaccgtgatcgcattggtgagcggcacatttttccccaacaatagctggggggcgccgtcagcgtactttatggggattgtcgcggttgtttgttccggcatcttcttgaagaaaaccgccttgtttgctggaccgcctgcaccatttgtgatggagttaccagcgtatcatttgccccggctgaccaacctttatcgcagtgtgatgtcgcgcgcacgggcatttgtgcataaggctggaacgattatttttctgtcatgtgttttgttgtggtttttgtcgaactttaatttcactttgcagatggttccggaaaatcacagtatgctacgtgcaatcggcggcatattggcaccgctgtttgcgccattgggttttggtgattggcatgcaacggtcgctacattagccggcttgattgcaaaagaaaattgcgtcggaaccttgcacattagttttggtgctagtggttccgggagctttgcccagacgttacgcgcgacttatccagcgatggcagggtatgcatttttgatgtttaacctgttgtgcgcgccatgttttgcggctattggaacgatgtataaagaatttggcgatgcgcggtggacatggcgggctgttggctatcaaaccggggtggcgtacttgttgaccatgttggtttatcaaagcagcctgattttcactggccaagcaggtgggttgagcatcgtattagtagggcttgcagcaggactcatcatttacggtttgtggctcaagcgcccagtaccggcaatggctgcgagctattgaaccagtcatgatagaaaacttggttgtaatttaaatatacgaggagtcttgaacatggcaacatggataattggtagcttagttgtgttgacgattgcagtggttttgtaccggacctttttccgtaaaaatagagcgggcggctgcagccagtgtgaagatattggctgtcctttaattgatcatgctaaagtgatgcaggccaacaagcagcgtaaagcttaggcgacgggatttatccaaccctacccgtaacggttgttgggtgatgcttacggcttaatttttagctgcagcggctattttaaaattcgcgttgtttacgacaagtctgtataatcaggttgtgaaagccttttcaaatggatgaagttcgggttttcttttggtgaattttgaggagaatccgagcggttagggggatgcaaccatgacgagtaagcagaagtttccagtcagtgatgtgacagcaacaagcggctatttttccgcgctcaaggcaacggtcgaaacagctttttatggtaacaatgttcaggcggtgacgacgattgcggcagcctatgcattggctaaaaaagcacctggtgtcatcgtaaccgatttgccggttcaacatgccagtgagcttggattgcctgaagatgcccgcgttctggttgcaaatgacggacaggtggtggggcgcacggcagccgcacgtcgtatcatcggccagcccggggttgatactgctgagctgacgaaaattgcacgcgaggcggtctttgcaggtacacgcaaatcatttttgagtggacatgtggttgttggcttgtcggctgatttcgcagttgaggcgcatttgatggtgccggaaacctacgccaacaacctttacacttatttgctgaactttcagattaaaacgcctgaagcaacgcagcaatatgagcagtcgcggccgcttccggaagatgatctttatctttatgctgatcctgactggcatcatccggattatccggacggcttggcaatttttgatccgttgcataatgccgccattattttaggcttgcggtattttggcgaattgaagaagggaacgctgacactggcttgggcaaccgcgcatcgaaacggttttgttgcctgtcatggcgggatgaagcagtatcagcgacaagatggtaccttcacgatggcagcgtttggcttgtcaggctccggcaagtccaccatcaccctgaccagtcatggtgaccggtatccggttaaggtgttacacgatgatgcgtttgtcattgatcggcagaccggtgcgaccaccgcgcttgaaccggcatattttgataaaacccaggattatccaatgagcgacccgaatacgcgttattttctaacggttcaaaatgttggcgttacgctggatgatcacggtaagaagacgttggtgacccaagatattcgtaacgggaatggtcggaccgttaaatcgcgttatgtgacgcctaatcgggtggatcatttggtggagagcgttgacgctattttctggatcatgaaagacgatgctttaccaccggttgtcaaagtggaggatccaagcttagccgcagcctttggggcaactttggccactaaacgctccacagccgaaaatgtgcgtgccgatgtcgatcgggaacagttggtcattgaaccgtttgccaatccttttcgtagttatccgctgggagaggattatcaggatttctatgatttgttccagcaacgcggcacggcttgttacattcttaataccggtttttttcagggacaaaaagtcaaaccaagcgatacattggatgcgattgctgcgattgtggatgggacggcggcgtttaaaccatttggcccattgcctgccatgcgctatttgagcctgccgaattttgcggtggactttagcaattcggcttatcgggccttattacggcaacgattggatgatcgcttgacgtttttagccgataaagcaaccgtcgctgacgggtatgatcgcttaccgcttgcggcaactcaggctttggaaaaagtcgcggctgccttagttgaatgatcataatcagatgcctataaaagtggctcgcccaggagcaacgaacggcgtatcaaggggaacctgcttgccattcttgaaaatgctggtacggttggtttccaaacagccatgtgcgcactgaatttgatgagttgacattgcaaaaataggcggaataagggatagtagaaacaaaatgagacatgcgctttagacccagatcgaggataagcatgagtaagggaggaaatgcgtatggctattcactttgtggtatatgaaaagccccagtgcgaatcgtgccgcttgacgaaacgctggttgctggctcatcatcagcattttcgcactacgaatcagcgcggtgaatcgaacttggtggatacgagtgcggaagatccgttgaaacgtgcttggagtgcccagaaagtcgttaagtttcgagcggatggttatgatcggtttccggttgtccgtgtgcgtgacgatgagaccggggatgtgctggctacttggagcggctttcatccagaagcattggcaagctgggcggcgattaatcagctgagttaactggttttaacgccatgatcaagcgcacactgctgaagggctggttcaataatctgaattaaaaaacgctaggaatcgcatcgtctgactgtggccgatgttcctagcgttttttgttgtggtgatgactgaacatagctcggtttaatccgttttggattggagcgttaacgatcgctaagttgctgcagtattttcatctggtacggtggaatgttgccatagcgatcggggccgacgttaagtagtaagcggccacgtttaggatggagtgttgcgatcagctttttgactgcggcggttgtgatgtagtctttagattggctgaattggttgtagccaaaacttttatccataccgcgagtcatttcgaagtagcgcttattttccttccagtcactgttatattccagtgtccgataatcgtaatatttgagctcgccgacatcaccgggatgtttgcgttcttggttcatgacgtactttgcggcgatattaaaaaccgcccgccctggcttattgcgcagccagttgggaaattggcgccagcggtcattgactaagccgtcaggaacctgatcgtagtaatacctgaataaatcaggcaaacccggatcgtcaggatagccgatgtcactccacaaaatatccgagtgatagcggtcaatcagttcatgccagtgcgcccgtgcgtactggttataaatttttgatcggtcatttcctaacatcagtgaaccgtaatcagcgatgggcacgtgcgggaaggtccagtctaacaatgaagaataataagtaccgaaatgcatgccgcgggcgcgaactgcctgtgctaattggccaacgaaatcaaagtcaaggtgataatcaggttgatacggattcgctacgtcggtgtcatacagcacaaatccgtcatgatgctttgtcacaatgaccacatacttcgcgccggcattggcaaaggcatccgcccaggcatcaacatcgacttgctgggcactttgcttaaacgttttggcaaagtccgagtaaggcgcattgccataatgttcacgatggtaacgggcagcggggctgtcaggaaacaagatactgttggcataccattccgcatacggttgattagcaaaaaagaacttcagcggcttacttttgatgaaagtatcataatccggcacattggtcggtgcaaaagccgggacactataaagcccccagtgaatcataatgccgaaatctgcttgtttaaaccaagcagggggatcgtcgcggtgaatgttgacaggtgatggtttaaccataaactatacctccagtgagcgcgagccgacttctgcgccggggagcgcgttatgatgtgagcgtgagccagcgcgggagaaaacggagtgtaagcggccttggacgtgatggccgggctttggccattgcgcccaaggtccttacacgcaggtttctgcgctggcgaacgcgttaatgtgagcgtgtaatagcatgctcaattcaagtaactaacaattagacccgcttatttttctgacttgcagctgcagttttggcggccaattccgcatacatctgggtccgtgcctcaccttgcaatgggtattgcttcgttaaaagataagctacaagcgaaaagactgcaggtaaaccgaataaaaccacccccaggcttttaagcaaactgtcgggaatgcgggtggctttttccagtatttgcgcattatagccaactaacaataaggctaatccaacgccaattgttgccaaacccgactgcagcttttggagaaacatgttaaccgcattgatcgttgcttccattcccgaattgagtttaagtcgattataatccatggtttccatgatgatgaggttagctggcacaaattgggcgccggctagggtcatgacaattccgataagaagatagaaaagccaaggattatgaatgacctgaaattcgttgatcgcaaacatgattagcagaaacggaaccattcccaaatagcagatttgaacgcctcgaagtgctgacatatatttcatggctttttgggaaattaacgtaccgccgattagggtgactaaggtcaggagcccgaagtacatggactgaatacctaagttggcaacgccgaatgcgtacttaatgtagtaaagcgatgttgccgtcagtaacgcccagacaaagccgccaacaaaagtgaaatagagattgacgcgaaatggcttattgatttttaccatccggccgacatcacgtaactttggcggcttggttccttccgcaacaggcccttctttgaccatgaagccgccaattaacgagatgattaaaaatggaatgatgatcaaatctacggtcaatggaatatttggactttttttagttcccaagaagctggcaatcgccataaaaaacgcgaagaccacaccgacaacattgctggtaattcgtggccaggaaattaatttagcccgaatttcctgatcagcggacatggtgctggtcagcggaaccgtgacgataatggttgctgaaaacataaataagaaataggtgatgtagaggtagacttctttgccgaaatcacttaagttttggggaatgtgaaacaacatcattcccaaaatgccggtaaaaaaggtgccaatcagaacatacggtttaaatttcccccaacgagttcggggtgaaatgtcaatcaaatagccagtccaaaggtcattgatggcatcccagagccgtccgacgaataatagcgtggtggcgactgccgctgctttgccagggacgttggtgtaaatcccggagtaatcggtaataaacatcatcaaaacagcagtataaagataatacgcggttgtgctgatcaaccccatggcattaacgccgaagaaagtccgtgaatctaaggggtaattctttggataacccttcaatgtaaaatcctcccaagaatcaaataagtgcggtgacaaattaaaaaggttttcgcaactcgatttttgagttttgaccataagatttttaacttgcaggcttcttgactcgattataggtgatgtttttaaaacatgctattaactgcctcgaattgtaaacatcttcgttttataaccgaccctgcaattagaatctttatggctgggatttgcacggttgttggaaaatattaaaatataaatgcaaaatatccaaaaaatattttcgttatcttatttttaatgcaagtagatactaaatggctgccttcaagaaatcaccctgtcaagacagggtgataaggcatagataaaacaagttttcacaaatagatacattgcgtgcaatgtcagggaaaacggttttcacagactggtgtcatgtctgcaaatcccaataataatggcctttgtagcggttatataacgttaggtatttaaatattagcatataattatattgattataagccattaacaagtataattaagtctgtaagttgatgaactcacaagattaggagggacttttaaatgtatgcagtaagcaatgaacctagttatgttgaagtaattaatcaaaatctggaacgccttctcgtgtttgagactgtttttaaagagtacgtccacacatgcaagaacatcgagaaaggaaattgctatgcaagcgaaagtctcgaccgcttgcgactttatttcaccaaaaatgtcattaagttctgtaatttcgtagatagtgtcaatgccgagtcagcaccatgcaactatgctgcctttcataaggtactggtaagtggtctttgcggtattcgcagcggcgttttgaatatgttgcaggcgatcgacacggatcaggtagatcatgaacgatttgcggccggattagcggaacagcaagcagctcgggctcaaatcgattcggctttttccaagattcttgatccgatcttttagtccgcgttcttgcgtcaatgtggcataattgaggcaagggggtgacgacttggcaatttggcgcatgatgtttgcacggccgcagtttaagcatcaggaaattaaacgaatggtcgatgaactcaatcaagacggtaactttggcggattacccattcatcggatcagcctcacgcgacaaacaaaagagctgatttacgttgacttggattttgagctaacaaccgggttgacccaacccctatttgagcagatggccaagtacattcttgtttcagttgctggattggcgcatgcaccgcaacccatttacttaatggcaatggcaaatcctttttcaaaattaaatatcagttattacatctatccggatcatagcttggacttaatctattggcagccgctgatgaaagtccaatcctgaaccagacggatggcgtgactgaattgaccgaatcggcaaggtattgtgtgatgattcggtctttttttcgccaaaatggttgccaagtcgggactgattttcattttgggctttagaccgattatcaagtgctgggtaagtatgctaagatatggcaagttatttcatttcggcgcgttgtcacttgttgtagaggagaatggtctttgctagagctaaagcatataaaaaaatattaccaaaccggtgattacaccacgaaagcacttgatgatgtttcggtgcagtttcgggagcaggagtttgtggccatccttggtcccagcggctccggtaaaacaacgctactgaacgtgatcggtggccttgatcgttatgattcaggcgacttattgttacatggccggtcaactaaaaacttcaaagaatctgattgggatgcttatcgtaacaactcggttggcttcatttttcagagctataacttaatcatgcaccttagtattttggaaaatgttgagttgggactcacgttgagcggggtttctgccagtgagcggcgcaaaaaggctgaggcagcgctggttaaggttggtttgaaagaacacatggggaaacaacccaaccaactgtccggtgggcaaatgcagcgggttgcgattgcgcgggcgattgtttcggaaccgtcaatcttgttggccgatgaaccgactggcgcgttggataccgaaaccagtcaggaaatcatgcagttgattgccgatttgtcgcgggaacgtttagtcgttatggtcacccacaatccgcagctggcgcatgattatgcccaacggattattgaatttaaagacggtaaaattctatctgattcaaagccatatgatgttgaggagcaaaccggacactttgatttacgccgcactaaaatgagctatctgacggctctgaagttatcttttaccaatatcatgacgaagaagggtcgtacttttctgacggcattcgcatcaagtatcgggattatcgggatagcagtggtcctggccctttcttcgggttttcaaaagcaaatcgacaacacgcagtcagagacgttggcgcaatttcctattaccatttcgtctactgccgtgaacttgacagcaggggcggaagataatacgaaaacgtccacctttaagacgactaaaacggtggaagccaagcaaagtgccagtgataaagcacagcacaccaacaaacttaatcaaaagtatatcgactatgtgaatggcatcagcaagcgattgacgaataatatcggttatacgtatggcaccggaatgaatttgttgcgtaatgtcaacggaacggtgaagccggttcaattttcaactgccaaaccgacgagcaatcaagcgcagcggagtttttccagcgcaagttcatctgtttatcccgtagatcgtgaaggcaagacaagctacctcaagaagaactatgaggttgtcgccggtagctatccgaaatccgacaatgacgtcattttaattgttgatcgggacaattcgactaatatcaatgcgctgaaaaaccttggcttctcagttaaaaatggtcaaaaaatcaaatttggcgacattgtcgggacgaagctaaaggcgattgccaatgaccattattatcaaaatgtgggcggcagcgtctatgtaccaactaaaaattacgctgatgcctataatcaaaatggtaatcgggagctgaccgtaaccggtgttttgcgaacccgttccaagacgagcgatggtcttttgagccaaggttttgcttattctgatcggttgaccaaagatttagtggcaatgaataagaattcggcagttgtcaaagcgcaacgaaatagtgacgttaatattttcaccaatcaaagtattgatgatgccaccaaggatcaactgattaccggattgggcggatcggaaacgcctacgcagatcacgatttatccaactagtttcaaggataaggacaagatcttgagttatctcgacaagttcaaccatggtaagaaaaaggccgatcaggtggtttacactgacttggctggcactatttcgagcatgacaggcgggatcatgtcagccattaccattgtcctggttgcttttgcagggatttcactggtaacttcgatgatcatgattgcgattctaacctatacgtcagtacttgagcgaaccaaagaaatcggcgtcttgaaggcattaggtgcgcgtcgaaaagatatcacccgggtttttgatgctgaaaccatcattctaggggtcagttcagggatactgggcattatcattgcctggttgctgacgttcccgatcaatgcgattttgtacggcatgaccgaactgccgaatgttgcgcagttgaatcccgtgcatgcggtgattctgattctaatcagcacgatcctgaccgtcctcggcggccacattccagcgcgtatggcagcaaacaaagatgcagcgattgccttacgagctgactgatgtctataaagattaacaattgatcgtttatcaaaaaagcagtggtgtctgcagtgggcacctctgctttttgctttaccgaggaagaagatctcctttgagcgtcaaaagctggggagcctaggtttaaaaatgctatgaaggcatagaagcctcagtcatgtttacggtttcatttgtcttcatgccaaaatacctctataatgattacttatcaattggcattttgagggaagtgtcatgagagcagctaggaggatcatttcctagcgagaggatgtatttcaattggataattcaaagaaccgcacgtttatgggtcatccccgcgggctattaacgctgtcgatgaccgaattctgggagcggttcagctattacggtatgcgggcgatcttaatctactacatgtactatgcggtagaaaaaggcggtctgggattcgaccagcccacagccttatcgattatgtcgatttatggatcactggtttatttaagtgccacaattggcgggtttatcagcgatcgcttgctcgggtcgcggcgaactgtcttttggggcggtgtcctcatcatgctcggacatattgtgttgtctttgccaattggcgcggtggggttatttggctccattgtgctgattgttttagggacgggactacttaaaccaaatgtctcggaaatggttggcagtttgtatcctgaagaagatttgcgccgagactccggtttcagtatcttcgtcatggggattaacttcgggtcgttgattgcaccgatctttgtgccgtggatggctgacaagtttaacttccacgctggtttttcgttggcagcgatcggtatgtttattggcctgatcttttatgtcattgatgggcgtaaatatattaatccggctgacaatacggcgcctgacccgttaaagccggaagatattcggccgctggtgatgcgcgtcgtgggtgcgttggtggttgtcgcggttattttagccgtgatggcaagcctaggtgctttgacgattgcaaacgttattagtttgatcaccatcgttgcgatcggcttgccggtttggtactttattttgatgatccgcagcaaaaaggtgaccaagactgagcgttcacgtgtcattgcgtatatcccgctgttcttagccgcgatgatcttttgggcgattgaggaacaaggctcggttgttttggctttgtttgccgcccaacagactaaattggactttggattctttaaaatcctgcctgggaattttcagacgttgaatccgttattcattctgttatatggtccattgtttgcctggttatggatgaaactcggtaaacgccaaccgacctcgcccaagaaattttatctgggcttgatttttgccggcgcgtcgtacttatggatggtcattccggtcctgttatttggcagcagtgctaaggtttcacctttgtggctggtgatgagctgggcaattgtggaaattggcgaaatgctgatttcaccggttggactttcagttacgactaaattggcacctaaagcttattcatcgcaaatgatgagcatgtggttcttagctgatgcatcggcgcaggccgtgaatgcgcaaattgtgcgtttctatacaccaagccatgaagttgcctattttgctgtcgttggcctggtttcagttatctttgcgattgtactggtctttttcacgccgcgcattgaaaagctgatgcaaggggttaattaagcgggtgatagactggcgcgcaccggtaaattaacggaggtgtggtgatggtaaaagttgcgatcagtgtggataaccattttgatgttaatcatgttgatggtttcgaaatgttgaaacaccaagcagcctatctcgttgaacatggctatcaagtctacgtcaatgccggtgatacgtataacgatttcacgaaaacgctggcgtactatcaggcattgcaacgggaagtcggcgatcaagtgattatccgctttttagctggtaatcacgacatggttaagggtgcgacctatgctgaaattcagtcagatgttgacccgctttatttacacgaaaaggttttgtcagtcccgggaacgaatgcggttatcgttggaaacaacggttggtatgattattcacttgcgcaacttggaaagtcgaaaacgtcggctgaatatgcgcagtggaagcgagcgttttggatcgacagcgccattgactcaccgataagtgacttagagcggatgcagcgggtgcttgataccaccaaagcggctttggtggccaatcgcggcaaacggatcatttatgccacgcattttgtgccgattctcggtgcgatggtgtacgcagttgatcgcctgtcatggcagatggctaccgcgttaatgggatcggcaaaactaggcgatctgctgacaaatcgggccagtgccgtggtgtttggccacgagcattttcgcgatgcccctaagctgctaggcaagacaacttattatcatcaaccgctgggctatggtcttaaacgcctttttgaatggcaaagtaccgactggctgacggaatggcgcgacacattagtcacattggaagtgcccgcagctttgacagattaagcaaaaaattaagtatcggaggttataaaaaccacctgaaaatggttgatttttataacctctttttgtacactattaaagttgatttatatcaatcgcatggaggagtagcgaagaggctaaacgcggcggactgtaaatccgctccttcgggttcataggttcgaatcctatctcctccatttcataaatatcggattgacatcggaccgatcagaagcaaaaggccgtttgacatagcgattttgtcaaacggctttttgtatgcgctcggttccgtgaaaagtcgttgggagcttacgatacggaactttccagacttttggcattaataatccgattataagcagccaaaatattatcgaagtcttccggcgtgggatgaggctgaatggcgaccacctggcaatttggcaaattgagtaaagggagattggtaatgatcaggtcaaattggcgggcaacggtttttaactctgctaaggtactggccggaacaagctcgagtttgaggtttgaacgtaaatggtaattgagttcattcagcaaaaagtgactatgctcaaaactcgtattgaagaagagcccagttcggactttcggggctttttgctctaattgcagcggcagtgtttcccatgatgtcaccaaagtaaataacagcttggtgatgaaagcatcatcgattcgaacgttgactttttcatttctcagtgcagtaaccagtgtctgtctggcgtgacgaataaaagtcttgctaaattgattcatgctcgcaaagaaagcctcgctcggactgtacaggatttttggcgggccccacgtatattcgatggcgttatacaagcgcagtagaacttgttcgcgatttggcaacgataaatgttcagttgcaacgatcatgtcaagaaaatgcgtaagtgcgcgatggatcgcgcgaatttcagcatcctgatgtgttttagtgagcagatcggcgtaagaccaagcatttcgcggattaaaaaagagataaaacagatgcgagaaaactaatgaggagcagtcaatcttatagcagcgtgcaattgattggcgtagttctggcgagaaggttgcattttcaattgccggggtcgcattttcaaacgtgtgcccgcgactgttgcgtttgaggcaaacgaagatcgtcgcgcgtaacttgttgataaaggaaaaagactgatatctgggggttgtcagtgtcggataatgtgcgaaaaactctgagatgatggcatcaatcagttttaattcatcctgtggcagaaaatcatcgataaaccaatacctttctagaaaataggtgtaataaaaaaagtggatcttcttttcgtcgccaataatgtccagagattgcgtgtcaatatgaaagccatagtgcggtagaatctggttcaaaacttggatatggcgctttaatgttgattcactaatataaagtgcttcagaaaattgagcgatcgataaaaagtgttgtagaaaaatttgctctaatatcagaaaacgcgtggactgacgataaatagctgaatagatatataagggattgtgtgctgagtcataagtcaatcgaattccataccgttggctactttcgatttttgccggtgcaatatattgattaatagtaccgatgttttgggggatcgtccgggcaggaatccgcgtttcctcagccacccgattaatggtcatccaatccttgtcaagcagaaaactaatgatgtcgtaatgcttgagtaggctactttctaacagctcttccataaccctacctccccaagtagtttgttgccgtcaaaatttgcctaacgttaggcaagttttgaactagaaccaatcattgatttatttatactaatgtcatattgcataagcattgttgggttcactataaattatagagagataatgcttgttgtttcaattattaagcaccagccactcaaaatataataatttatatcaaacattttgagaataggcagggattacgttaattgtttgctgttttgggtttaataaaggggaggcatgttgaagtgaaaaaggggagactgatattactattagccacgggactgatttcaatgggtctttgggattcaagcggtgtcgtattggcagcgaataagccccaggctggtgatatccatttgggtggtgccgatggttcgagctataggaagcttataaatagcatcacattccaatatagcaacgacgccgtggtatatgacgaaggtacggataccttcaaaattccaattcggttcggctcgcttgaatcagacggtttggatcgatacttggagtttgggtattcgtttaacgatgccttagaaggaaaaattaagcgggttgtgatttcacctgatgggctggtcccagcggttattacaagtcttaacgcgaacagagaatttgcacggcgctgggatggtagtgatggtaaaagcgttagtcaccaactaggtggacgagcagatgccgtcatctacatgcaggcgcataagattatgcctgaggattggattgccgttcggatggaaactaatcgagtggaagggaagcaccctgttcacccggcatttcgatccactcgcattcttgagtacaacgatttcggccctgcgctcaatgccaaacttttagaagccatgaagaaaaaggcgattgatgacacggccaaggatcctaaaccggttcaagaagaagttaaagaaaaagtcgaccccatcacggttgacgaggactttgacaagctcattcaggaaatcgttttaaacgcgcataaggaacaggctaaacgagatattgatgccgaagccgccaaagtcagcgctgaaattgagcaggatccgaccttaacggcaacggaaaaggcaaagcaaaaagatggcgttgcagccgaagcaaccaaggccaaggcggcaatcgaccaagcgcaaaccgaaacaggggttcagcaggcgcgagatgccggcattgcagcaatcgatgcccaacatcagcctggaaccggactcaacgtgcgccgagaagaagctaagcaggcgattgatgccgaagcggctaaagtgactgctgagattgagcaggattcaaccttagctactagcgaaaaagcggcccaaaagcaaggagttgctgatgaagccgcgaaagccaagacggcgattgatcaggcccaaacgattgaagccatcgataaagctaaagatgatgggattaaagcaattgatgcccaacacaagcaaggcgctgacttcgatacgcgtaaagctcaagccaaagacgccatcgatgacgaagcggccaaagtcaaggatgctattgatcaagacccaactctgacgagcaaagacaaaacggcccagaagcaagacgttggcgatgaagctaccaaggctaagaccgccattgatcaagcgaagaccattgatggggtgatccaagcgaaagatgatggcatcaaggcaattgatgcccaacatcaggcaggtaccgatttggcgacccgtaaagatagtgctaaacaagcgatcgatgatgaagcggccaaaataactgatgccatcaaccaagatgacacgctaaccagtgccgaaaaggagacccagaagcaggcagtagctgacgaagcggctaaagccaaagcagcgattgaccaggctcaaaacgcagataccattcttcaggcccaagctgacgggattaaagccattgatgcgcaacatcaaactggcacagagttagatacccagaaaaccaaggctaagcaggcaattgacaaggaagcaaccaaagttttaacggcgattgatcaagacccgactttgaccagtgctgaaaaaaaggcgcaaaagcaaggcgttgccgatgaaactgctaaagccaagaccgcaattgatgcggcgcggaatgctgatgaaatcgccaaagcgcaagaagatgggattaaagccatcgatgggcaacatcagctgggcgtggacttagcgaagcgcaaagccgatgcacaagcggccattgacgcagaagctaccaaagttggcgaagcgattgatcaagatcctactttagcgagccaagaaaaggcggcccaaaagcagaccgttactgctgcagcaagcaaggctaaagatgccatcgccaaggcgcaggatgccgatggtgtaattcaggctgaaaaagcaggcattcaagccattgacgatgcgcatcagtcaggcacccttttagatacgcgcaaggctgatgcaaaaaaagccattgatgccgaagttactaaaattaatgaggtcattgaccaagatgtcacgttaaccagcgccgagaaagccactcagaagcaaacggttgcagatgaagcagccaaagccaagacggcgattgatgcagctaagaatgcggacactattgatcaggccaaagcatccggcatccaagccattgatgccgtccatcaaagtggcacccttttagacacccgcaaggaagatgccaaaaaggcgattgacgcggaagcagctaaagtgattgcggctattggccaagatgtgaccttgacgcaagcggaaaaactaacgcaacagcaagcagtcgctgatgcagcaacgcaagctaaggctgccattgacgccgctaagaatgccgacgcggtggaccaagccaaagcggatggtatcaaggccattgatgcccaacaccaagccgggttggcgttgaacgaacgcaaagaagcagccaaaaagctaattgcggaaaccgctgataaggtgcaggccgcgattgatcaggatgtgacgctgaccgcgacccagaaagcagcgcaaaaacaggcgattaccgcggaagtcactaaagccaatcaagccattgatgcggctggcaatgctgacgcggtcgatcaagctaaaaatgcgggagttaaagcaatttatgaccagcatcaatccggtcaggcactcgccgatcggaagcgtgatgccaagcaggcgattgatgccgaggcggcaaaagaaacagctgccatcgatcaggatgcaactttaaccgcgaacgaaaaagcaagccagaaacaggcggttgcggatgaagcaactaaagctaaagcagcgattgatgcggctaaacaggctgatacagtcgaccaggccaaaactggcggggttaaagcgattgacgcccaacatcacgctggccaagcagttgccgatcgtaaagccgctgccaagcaagccattgatgccgaagcggctaaagtaacgggcaacattgatcaagatgaaaccctcacagcggcagaaaaagcggcgcaaaaacaggcagttgcaaccgaagccgataacgcaaagcaagcgatcgacaaagggcaaaatgctgacgccgttgacaaagctaaaacagacggcatcaaagcgattgacgctcagcaccagtctgggcaagcaattaaagcgcgccaaaatgacgccaagcaggctattgatgctgaagccgcaaaagtaaccaaagcgattgaccaagatccaactttaaccgccgctgaaaaaaaggcacagaaacaagcagtcacagatgcggcaactaaagctaaagctgctattgatgctgcgttagtggccgatgcgattgatcaagcactggcagatgggattaagacgattgatgcccaacaccagtctggtatagcattggataagcaaaaggcggtggccaaacaaacaattgatgccgaagcggccaaggttagtgaagcgattgatcaggatgtcactttgacagccgaccaaaaggctacacaaaagcagaccgtggcagatgaagcaacgaaagcaaaagcggccattgaccaagcctctgacgccgatggagtgattcaagcaacaactgctggcgttaaagccattgacgcgcaacaccagtccgcaacgccatttgatacgcaaaagcagcaagccaaacaggccattgatgctgaagcggccaaagtaagtaaggcgatcgatcaagatgtgacgttaacggcaacgcaaaaagctgaccagaagcaggctgtgatcgctgaggcagacaaagccaaaaaggccattgacgcagctggtaatgctgatggcatcaagcaagctgaaagtgatggtatcaaagcaatcgacgctcagcatcagtccggtcaggcactcgcagatcggaaaggtgatgctaaagctgccattgataccgaggcggcaaaggaaacagctgctattaatcacgatgcaactttaaccgcgaatgaaaaggcaagccagaaacaggcggttgccgatgaagcgactaaagccaaagaagcgattgatgcggctaagcaggctgatgcagtcgaccaggccaagaatgacgggatcaaagtgattgacgcccaacatcactccgggcaatctcttgacaatcggaaagccgatgccaagcaggccattgatgctgaagcagccaaggtgacggcagcgattgatcaggataacacgttgaccaaagcccaaaaagctgcccagaaacaaggggttgcgacagaagccgacaaagctaagcaagccattgatgctgccggggatgccgatgctgtcgatcaagcaaagacagccgggattcaagccatcgatgctcagcacaaagccggtaaaaccattgatagccgtcatgatgacgctaagcaagcgattgatgacgaagcggctaaggtgattaaagcgattgaccaggatccaactctgaccgctgcccaaaaagaagcacaaaagcaagcggtagcaactgaagccgataaagctaaaaaagcaattgacgctgcaggcgatgcggatgctgtagatcaggcaaaaacagccggcatcaaggctatcgatgagcaacacaagtcaggacaaacagttgatgcacgaaaagatgacaccaaaaaggccattgatgctgaagccggtaaagttactgatgcaattgatcacgacgccactttgacggctgctcaaaaagaagcgcagaagcaggcagttgctgatgaggctgataaagctaaaaaagcgattgatgcagctggaaatgcggatgctattgatcaggcaaaatctgctggtatcaaggcaattgacgaacaacacaagtcaggacaaagcatcgagactcgtaaagatgacgctaagaaagctattgatggagaagttgctaagataactgatgcgatcgatcatgacccaacactgaccgatgctgaaaaggcagcacaaaagcaggccgtcatcgctgaagctgacaaggccaagaaggcaattgatgcagccggtgatgctgatgccgttgaccaggcacaaaaggctggcatcaaggcgatcgaccagcaacacaaatccgggcaagcactagcaacccggaaagatgctgctaagaaagccattgatgaagaagctgctaaagtaagcgaagccattgaccatgatgtaacgttgacggacagcgaaaagggcactcagaagcaagctgttgctgacgaggccaagaaagctaagcaggcgattgatactgccgacaatgctgatggcgttgatcaagcagtgaccaaaggcattcagatcattgacgcgcagcaccagtccggccaagcgctcaccgatcgtaaggctgctgcgaaaaaagccatcgatgccgaagctgcaaaggtaggccaagctattgagcaggatccaacactgacagcaacagaaaagaagcgtcaaaaacaagccgttgcagacgaagcaacaaaggccaaagcggcgattgatactgctgctaatgcttcagcggttgaccaagcaaaaaatgccggtattaaggccattgatgctcaacacgtctctggtaaagcttttgacctaagcaaagacgaagctaagaaagcgattgatgctgaagctaccaaagttcaaggtgaaattgatcaggacccgactttgaccgctactgccaagaaacagcaaaaagaggcagtgacgacagaagccggtaaagcaaaacaggcaattgatcaggctaaaaatatcgaggaggttacgaccgccaaagacgccggtatcaaagcaattgacgcgcaacatcaatcaggtacagcagttgcaacccgtaaagatgacgctaagaaagccattgatgaagaagctgctaaagtcatcaaggcaattgatcaagatccaacattgactgacgcagaaaaaacggcgcaaaagcaagcagttgcaacagaagctgacaaagcgaaaaaagccattgatgcggcaaaaggtgccgatgcagtagacaaagccaaagcagctggtatcaaggccattgatgcccagcaccgctccggtcaaaccatcgcggcgcaaaaagatgcggccaaaaaggcaattgacgacgaagctgctaaagtcatcaaggcaattgatcaagatccaacattgactgatgcagaaaaggcagcgcaaaagcaagcagttgccgcagaagctgataaagcaaagaaagcgattgacgcagctggtaacgctgatgcggtgaaccaagccaaagcagccggtattaaggcgattaacgatcaacatcgtgccggcaagggacaaaaagtcaccaaagcaacacctttgccaacgactaaggcacctgagaagcctgcagcacctaaaacaaaagttatcacttcaacagaaggcaaccttccgaaaacaggggagcaacaatctctgtggatggtgatcctaggtgcgttgctgagtctgttctcaggattgttgttcgccaaaaagaaagcatcacattaggcgttgagatcaaggttcttaagctcaagaagttgcagttatgaatgatagggaaacctcatcatagaaagttgattttcggaaactgacagccggcaagtgagacgttttgtctcatttgtcggctgttttgctggctatacctgttgatgatttttaaatatttgattcatttttaaattcagcggtccagttgattgacatggtatagcccaaccgctacgcttaaagcatgacaaagaagggtgtgagtgtatggcaattgcagcaacggatctttttaaattggtatcgctgtcgtatccaattgcaacaaatcgcggtttttttgttcaggagaatcgaatttcagaagaagataatacttattatcaacgcatttatttggtcaatcgccgcggccaaaaaacgacttacgggtttgatcagaagcacgatcgtcatccgcaagtcagtccggatcagcaatggctggcttttcttagtcaggcagctgacaaaacaacgcaagtcttccttcagcggattgacgggggtggcgcgcagcagttttccaatgaaaaggaaggcgtgaccaattttggctggcaacctgacagcaaggcactcttgctgcagacaacggtaggcgctaaaccgcaaatatccgagtcggatgcgaaaaaaccgcaaccggtaacggtcactcgcgccccgtataagctgaatggtgtcggtttgctaaaggaaaatgtcacttatgaactgcgaattcagcaacggcggcaaaagaccagccacctgattatgaagcggcaacatgattttgacttgggagcgatttcgcctgatgggcaaaaaattgcttttgcagccgagcggttaccggatgatcctaatgattttagtcaggcgacttatttgttcgatttgacgagtcaaaaaatcacaatggtcaatgaacatttaccacaagcggcactgtctcctgaggcgttttcggctgatgggcagcagctgctgttggtgggatcggataatcatttgccaaatgtctcgcaggatcatctgtggcactatgatttaaccaatcatgaattgcaagacgttgccgatgatgtagattttgacattcccggttatgttaatagtgattttcagcaggatctgtccggtaaagtggccgactttgtgacggcagattattatctggctcgtggtttcgatcatggcaaaatgagtctgtatgctggcgggcctgacgagcggttgacgcctttgattgatggtcggcgtcacgtgacggactttgcattgacacctgatcatcgtggcgtgattttcactgagagtacgatgaccattccgagtcggctggtttattttgatttggcatcggaagaagagcaggttctgtatgacccgaatcgtcaggtaacacgtcacttgggcttagttaaccctcagacgtttaattttcaacgagacggttttgagattgagggctggtattttccaccgcaacaggcgtcatcctcgcatccggcaattttgtatgtccatggcggcccagcagtcggatatggctatacctttttccatgaaatgcaatatttggcagcaaaaggctatggcgtgatttgtccgaatccgcgtggagggttaggttacggcgaggcatttacggccgctgtcattaaacattacgggcaaggcgattatgaagattgcttggctgcggttgatgaagcgctaaagctcgatacaacaattgatccgcaacgtctatttgtcactggcggttcttatggcgggtttatgactaactggattgtgacccatacgcatcgttttaaagcagcggtaacccagcgttcgatttccaattggctgagtatgtatggtaccagtgacatcggttattactttacaccgtgggaactagagggaaagtggactggcgatttgtcagatgtgcaagggctttgggatttttcaccattagctcacattgatcatgccagaacaccgacgcttgtgatgcacagtgaaaatgatgaacgctgccccatcggccaaggcgaagagttctacattggcctgaaactgcatggtgttgaaaccaagttcatgcgtttcccaaagtcaaatcatgatttgtcccgcagcgggttgccgaatttgcgagtggcacgattgcaggcaattgtggattggtttgacgcccatcaagcacaaccgcagatggctaaaggagaataagaatgacaattggatttatcggtgccggtaatatggcgcgggcaatgataagtggtttattggctaaaaaggcagttgcaccaacagatattgtcttacatggcggccagccgcttcattatgaaccatatgccgccaaaatcggtgcaaaagcattggctagtaatcaggcagttgcggagactgcagatattgtttttctggcagtatcgccaaaattaggcgaaccgattttacaagcgattggatcaacgttaaaaaaacggcatgttccggttgtctcgatgctaaccggtgtttccgtggcgacactcgaggaggcattaggcagtcacgatcaaccggttttgcggattatgccgaatgttaatgttgcgattaatgccgggatgattgcttatgcggctaacgatgcggtggctggtcaattagatggccttttggatttgttgaatgttttaggaaagaccgtgtccttgcctgaggaacagttttcaacgtttgtcgctttagctggttcatctccggcgtttatctatttgtttattgatagcctggcgcgcgcgggggtcaaatatggtctggagaaggatcaggcaacggccatcgctgctcaggcggtgatgggcagtgccaaaaatgttctcgccagcgatcaatcgccctttgatttgatcgatcaagtgtctagtccgggtgggaccacagttgccgggttgttggcgatggaagaggctggactcatgactgcggttgtcaaaggcgttgatgcaacgattgccaaagatcgtcacggttgataaaggtggccgaccggttggctagcttgcaagtctggtctataccggttatactaattggtgatattcgggactttaaataattaggagtggtattgtgacggttacggtattgaaacacgcaacgatttatacaggattagaacggattgaagacgggtacatccgctttgatgacaagattttggcagtcggcgatatgtttgattatcaagcacaggctggcgaacaggtcgttgacgttcaaggtaaaactttgataccaggattcattgatgttcacgcacacggcggctatgggtttgatgccatggatggcgatgctgatcagatcgatcaaatggcaactaaaatgatgactcatgaaggggtcaccaccctttttgccaccaccatgacgcaatcgactgaaaacattgataaggcgatgcgtggggtcaagcaagcagcggaacgcaatcgcattattcaaggcgttcatttggaaggcccgttcatcagtaaggtcttcaaaggggcacaaccagaagaatatattaagaatcctaatattgatcttgtcaaacagtggcaggaattgtctggcggcttggttaagctgattacgtacgcacctgaagatgaaggctcgcgtgaattcgaagactaccttttggcgcataacattgtcccatcagttgggcatagcaatgcgacgcgggaacaaatgctagcaagtaaggcgacccacgtcactcatttgtacaatgctcagcgtggtttacggcatcgtgaacccggcgttactggccatgcaatgctggaagataacatgtattgtgaactcatttgcgacggcttccacattgttccggatatgttacggctcgcctttgatcaaaagggaccggaacgcatcgaactggtaacggattccatgcgtagtaaaggcatgccagaaggtaagagcgaattaggcggccaaaccgtttatgttaaagataagcaggctcgcttagccgatgggacacttgctggttccgttttgatgtataaggatgcgtttaaaaatgccatgagtttcatggacgcttccttattcgatgcagttgaaatgtcctctgtcaatcaagcacgcgaatttaacctcacttcaaagggaacacttgaagttggtaaagatgcagatattaatatgttggatcgcaatcatgatttgatcgcgacctacagttatggtgagaaacacgatacggaagcttaaaccataaaaagaggaggcgatgaggatggatgtgccagtttatattcaaattcataacgccattcgtgctgatatcgaagccggtaaatggcgggtaggcgatcgaattccgtctgaacgcgatttagccgtcacgtttaaggtatcgcgaatgacattgcggcaggccattcaaacgctggtggatgaaggcattctggaacgacgggttggctcagggacgtatgtggctaatcagaaggtccaggaaaaaatgtccggtgtgactagctttacggatctgatgcaggcccaaggcaaggtgccttccagcaaaacggtctcatatcatgtcgcccagccgacaagttccgaggtagagaaactaaaactggcgcctgctgaacaggtgttgcggatggaacgaattcggtatgccgataaggtaccgatcagtttcgaaaccgcagcggtgccttacgatcttgtgaaaggttttaccaaaaaagaaatgacagccagcttttaccatacactggagaaaaaaggcggttatgttcttggcggcgcacaacaaacggtcagtgcgatgttggctagcgaacgaatttctgaatacttagccatcaaacgcggcgatgccattttacggttgcgtcaagtttcatttctcaaggatggaacaccgtttgaatatgtacgtactcagtatgttggcgaaaggtttgaattttatttagagcgttaaagtaataaggtgatctgaggtcagaaagcagaagcgattttgttttctggcttttttgggttggagggtggaagaaaagcctgcttgctgtaatgttattgccagcttagaagccgtgtgtaagcgccgttcacgcttttacaataacgcgttcgcaggcgcagagatccgcgtatacggaccttggacgcaatgaccaaagcccggccatctcgcccaaggccacttgtgttctagcttacgcccataacgcgctcaccggcgcagaaacctgcgtgtaaggaccttaagcgcaatggccaaagcccagccatcacgcttaaggccacttacactccggtttctaaccgcgccggttcgcgctctgcaattattgcccacttagtatataatcaatagctatattattaaattaaatgctcaatgcttaacgatggctcccattagtatgtctctggaaggggaaagatgatgaccacacaattgggtgaaggattgacactccacaccgatttttatgaattgaatatgatgaacactttttttgaacgtggaatcagtgaacgtcatgctgtttttgaagttttctttcgtgagttgccttttggttcgggatttgcggtttttgccgggttagagcatgtgattgattacttgaatcatctcaagttctcggaaaccgacttggcttatcttcagtcccagaccgattattcggatgcgtttattgattatttacgtcattttgaatttacctgtaccgttcgttcggcgctggaaggcgatttggtttttaataatgagccgatttggcagattgaaggtccgctggcacaggcgcagttggtcgagaccgcggttttgaatatgattaattatcaaacgcttgtggcaacgaaagcagcgcggattcgtagtgtggccggtgctgatccgctcatggaattcgggacgcggcgggcacaggagacggcggcagctttgtggggcacacgggcggcgtatattggcgggtttaatgctacaagtaacgtgttagcaggtaaggaatttggcattccgatcagtggcacgcatgcgcactcattggtccaggcatatggtaatgactatgaggcttttaaggcctatgccgaaagtaatcgcgacgtggtctttttagttgacacttatgatacgttgcgatcaggcgtgcctgctgcgatcaaagtcgctaatgagtttaaagatcgaatcaattttctcggcgtgcgcatcgacagtggtgatatggcgtttatttccaagcgtgttcggcagcagttagatgatgccggttatacttctgccaaaatatacgcttcaaacgaccttgatgaaaacaccatccaaaatctgaagatgcaaggcgccaaaatcgacatttggggagtcggaactcgcctcattacggcttatgatcaaccagcgttgggtgctgtgtttaagctggtatcgattgaagacagcactgggcagatgcacgatacgatcaaactgtctaataatgcagaaaaagtctcgacgcctggcaaaaaacaagtctggcgaattacgcggcgtgatgatggcaagtctgaaggtgattatgtggcactggcagacgaagtgattgatccagagcgtagtttgtatatgtttcatccgaattttccatatatcaataagacggttaagaattttgaggccaagccgttacttcaacttatttatgatcagggaaagcaggtttatcaaaccccgccgctagccgacgttcaggcttatgcaacgcgcagtaccaacgcgctgtgggatgagtatcggcgaattttgaatccacaagattatccggttgatctatcgcagcgggtttgggataacaagatggatttgattaaaaaagtgaagtctgcagtggctgatcgcgaagaataatcgaggaaatagcgtgagacagacaaaaaagcggcgttggggccggtggctgttgttaggccttgttatcggggtcatcgccggcattgcgatttatggcagttatgattatttgtatgttcgtccgcagatagccgccaaggaagagcgtgcgcggcgtcaatatgaaaccgagctgaatcgccatcgcgcaattgagcagcggctgcaaaaccaggcaaaagccgataccggtaccactaataaattgatgcaaccagttgactcgccggatgctaagccgctattggcaaaattgcaggcggcgcattttagcgggacggttttgatgatgcgcaagggtaaggtcatacttaataccggtctgggttatgcggatgtagactcggggcgcttaaacggtcccgagacactgtatcaaattggttcaatccaaaaaggactgacggcagtgcttttgatgaaactggttgaacaaggcaaggtgcgactatccgatccgatcggtcactattttaccgggattcgtactggcaagaaggtgacattgcgaatgatgctggatatgcgcagcgggctaacgctacctcgtgcgcaaccggcaaaactttccgatgccggcattgttcgctggtcaattgccaacttgaattacgaaacacctcggtatgattatcaaccggttaattttgtgttattagcgggtgtcattgaaaaagttaccggccgcttatatgctgatttgattcaacaggaaatttttaagcggctagccttgactcattcaggattcatgcctgaattatatcgtgaacaaaatcaggcttttggctataatggtcccaaggctgatccgtattcaaagcgttatatcgagccagcattgagttataaccgcgagttgggcaccggtaatatttatgctagtgccggtgacttatatcagattatggccggaattaaccaaggtaaaattattagtcgatccgccgtcatgcaattacgcgatttaagtcaaggtcaatatacagccggggtttataattttggcagctacacattgacgcatggcgttgtggcagcacactcggcggcaacggtgatggatagtagcgggcagaatgcagtggttctcatggctaatgccggtcagataacgcgagatctcgcacaaagtctatttcttgatatgattaaaggagtgaaataatgcgtccattacaagcagaaattattaaagcattaggtgtcaagccaacgattgatccggaaaaagagattcgccggagtgtcgattttttaaaagcctatcttaagaagaatacctttttaaaaacttatgtccttggcatttccggtgggcaggattcgacgcttgccggaacgttaaccgaaaaggcgatgcaggagatgcgggcagaaaccggtgacgatacttatcagtttgtagcagtgcgcctgccttatggtgaacaagccgatgaagcggatgcgatggcggccatcgagtttatgcaagccgatgtggttaaacgggttaatatcaaaccaagtgttgatgcgatggtaagtgctgttgaagccaatggtgcggctatttctgatttcaacaagggcaatattaaagcccggatgcgcatgattgctcagtatgcgattgccggcaacatggcaggggccgtgatcggaaccgatcatgcagctgaggccgtcactggtttttataccaagttcggtgatggcggtgcggatctgaccccactttaccggttagacaaacggcaaggcgcggcattgttgaagacgctaggggcacctgctcatttgtatcaaaaggcgccaacagccgaccttgaagacaatcgcccggccttgccagatgaagtggcgcttggggttaagtatcacgatattgatgactatcttgaaggcaaacaagttagcgaccaagctgctgaaaccatcgagcgttggtaccagaagactgctcacaaacgacatttgccaatcactgttttcgatacattttggaaataacccaaaaaacagctaacttcaatgaaatttttgcttttattgagggtcgtggctgtttttttgtctgcttttaaggtatctttgatgagcaataaatgggaggatgaaaacgtgttgcatcgtcgaaaaatgatttgggtgggcgttgttttggggttggctgcattgctattaggtgggactgttcttggctggcagcaagatcattcagcttcacaacgtcaggcacgggtcaagccatcaaagtatcgtgaaaaagtaacgcgcaaagatacggccaagacacaagcagcgttatttgacgaaaaattggatcgttcggttaaaaccaaagcaggccaatctttttcagaggccttgaccaatgacaaatttatcggcagtgctttggtgattcaacatggtaaggtcatcttcaacggtggtgtgggttacgccgatcaagcatcgcagcggcttaatggaccgacgactttgtttcaaattggctcgattcaaaaagcaattaccgcagttgccgtgatgcagctggttgaagctggcaagttacgattagacgatccggttagcaagtatttgtcaggcatccaaactggcgatcaagtaacattgcggatgatgattgacatgcgcagcggttttgcccttaagaagtatcaacctgccgtgatgggtgatatggatattatccgttgggccattgccaacatgacctatttgccacaacaaaactatgcctatcaaccggtgaactatcttttactagccggtgtgatcgagaaagtcgccgggcgatcctatgaacaacaagtaaaaaacgatattattgaacgcctaaagcttaagcacaccggctttttaccggcgatgctgacagattcaaaccgttctttaacgtatacaggtcccgtcaccaatccttatcagacttttatcggcgaaccggagttatggtataaccgcgagctcggtaccggcaacatgtatacgacgactggtgatctttatcggctattgcgcgggatagacagcggcaaagtgattactttgtccgctttgaagacgttgcgcaaccgtgacgatggcgtttatacagccggcatctataatcatcaagatttttattcaactcatggcgttgtcgctggtcaaatggcatcgactgcaatcagtcacgatggtcaaaatgcgatcatcctgttaagtaattacaattcacatgcgctaaatttgcatgatctggcagtgcatttatttcaaacgttggggtgagtgagcttgattaaaatcgaaaggatcttagctacagtggctaaagtccggcaatcatgcttgaggccactttgttctgttttatgcccataacgcgctcaccggcgcagaaacttgcgtgtaaggacctcaagcgcaatggtcaaagcccggccatcacgtttgaggccgttttgttctgttttatgcccataacgcgctcaccggcgcagaagtctgcgtgtaaggaccttaaacgcaatggccaaacccgggccatcacgtttaaggccacttacactccgacttctaaccgcgccggttcgcgctcactactcaggaacttgcgtaagcctgcctagacctgatatactttactcaacctaggggagtaactagcagagcatatctgcgacaacgtcaccaacaaggctatgtctggtgttgtcttaaatagtgagacttatggatctactgctggtaggccataagtctctttttggctaccggcccaaagaaagaaggaggcactattttggcaaagaaaccgccatatgcattaagcagtcaagaagttttgcaagaagaaaaaacgcaattgactggactatctaaggaaaccgctcagactcggttaaatgaaaatgggccaaatgaactcgcccaggctgaaaagaagagcatgttggcgcgctttttggatcagtttaaggactttatgattattgtcctgttagctgctgctttgattgccgggttcttattaagtgaatgggccgatgcgggtattattctcgcggtcgtcttattgaacgcggttttcggtgttttccaagaaagcaaggctgaagaggccattgatgcgcttaaagaaatgtccactcctaacgcgcatgttcgtcggggtgatcaagtactcacgatccctagcagccagctggttttaggtgatattgtgttgttggaagcaggggatgtggtacctgctgatttacggttagtggaaagtgctaacttaaagatcgaagaaagcgcgctaaccggtgaaagcgtaccggtcgataagaccagcgaaccgttgacgggtgcggatgttggtattggtgaccggaccaacatggccttcatgaacagtaacatcacctatggccgcggggttggcgttgtagtcgcaaccgggatgcaaaccgaagtcggccggattgccggtatgattaattctgccgaggaaacaaccaccccgctgcaagaaaatctcaagagtcttgggaagacgctgacggtgatgattcttgttattgctgtcattgtgtttgcagtcgggatttggcgtaatgccgccagtttaccggagatgttcctgaccgcggtttcgctggctgttgccgctattccggaagggttgccggctattgtcacgatcattttggcattgggcactcaaaaaatggcaaagcggcatgcattagtgcgtaaactgccagcagttgagactttgggtagtaccgacatcattgccagtgataaaaccggaacactgacccaaaacaaaatgacggttgaaaaagtttattatgatggccagttgaacgctgccagcgcaggtatccacggtggcaatcctttgatgaccatcatgaattttgccaacgatacgcaggttcaagatgatggtcaattattaggcgatccgactgaaacagcgctagttgcttatggtaaaacccagtcctttgatcttactaaggaacttgctgcagaaccgcggattgctgaagtaccgtttgattccgaacgtaaattgatgacgacgcttcatcgccgcccggatggtaaaatcttggttgccacgaaaggcgcaccggacgaattgcttaagcgggtgacgaatttagccaccggtgataacgttgcgcctctgtctgacagtgaacgcgatgccattttgaaagcaaataaagacatggccacccaggctttgcgagtactggggatggcttataaggtaatcgatgcggttccggatacggttaactcagaaactgttgaacaacatctgacttttgcagggctcgtcgggatgattgatccggagcggccagaagcacaagcagcggttgcggaagctaaatcggctggtattcggccaatgatgattaccggtgatcaccgcgacacggccgaagcgattgcggtccgccttggcattattgatcaaggtgatgatgctgccgttattaccggtgccgaacttgatcaacaaagcgatgaagaatttgctaagaatgtcggcaaatacagcgtgtacgcacgggttgcaccagagcataaggttcgaattgtgaatgcttggcagaaaaaaggcaaagtggttgccatgaccggcgatggggttaacgatgcccctgcgttaaaagcagctgatatcggtattggcatgggtatcaccgggacagaagtttcaaaaggtgcttcggacatggtgttggccgatgacaattttgcaacgattgtggtcgcggttgaagaaggccgaaaagtcttttccaacattcaaaaagcgattcaatatctcttatcggctaaccttggtgaagttttgaccttgttcatgatgacaatgttaggctgggatattttagcgccggttcacattctttggattaatctggtgacggataccttcccagcgattgcacttggggtggaaccgactgagccagggattatgaagcaaaaaccgcgcgggcggaagtccaacttcttctctggcggcgtgggcccggccgtgatttggcaagggattcttgaaggcttgttgacattgggcgtttactggattgctatcacttatccggtccatagcggtgaagcggcgatgcatgcggatgctttgaccatggcttatgcaactttaggcttgatccaactcttccatgcttttaacgttaagagtatccatcaaagcctgtttacagtgggtgcattccggaataaagcattcaactgggcgattctggcatccttcctgttgctggcagtgacgattctggttccgggctttaacgggcttttccatgtcaccacccttgattggcatcagtggataacggttcttggcgcgggcgtgacgatgattgtgatcgtcgagatcgtgaaggtgtttgaacgcgctcggcgtcgacgtttggctaaataaaaaacaaagtggcaggtcagcactgacaaccacgtgcttaagagaggattcgtgcttttcatgaataagcaacaaatgaagttggcgcattatggttcgaccattaatgatgtggtggaacagattcaggctaatcaagataaaatggcaccattgttcgaaccgttgcgaaaagcaattgatgcagatcagttagctgaatatgatcgggagacctatgaggatactcaggtcgtttttcgtgaaggaaccgctcagtaccaaaagttattaactcggttgcaacaagtggcagttccggcgcgactggctgggccgcatcgtacgttggttcatgactttgcggcttttaccgcagcgtgtgaagcaatgactgccagcttaaaacctgacttagaagtagatgtgcccgcctttaatgcttccgaaaaggcgcaggatgagacgattcagaaatttaccaagcagattcaaaaaatctcgctcatcttgcaatgatttttcttgacatgaaatgtttactcatgtacctttaatctaacatctcatcaagtataaacgaatggaggaaacccacatgacagcattgcttaccttaaagaactggcaaagccaactttaggtaggttgcggatgcagcctgccagacgcgcaggttgtgtctatgttggcttccgatttactgtccgcatagatacccaatcacggggctatgcggtttttttattgccgcgacggcctgaacctgtcgcggtatttttattgatacaaaaaaggaaaggttaaccgcaaagtagctttaaccacgcggaatatgtcgatatcacattaaaggatcgacatcaccaaagctattggaatattcaaaatggaggcaagcgcatgaaacgaatgcttggatttatgatcatcatctttggctttttgggtattgcttattttcaaagtggcacaaccgcgcaacagacgcagacaaagccgactgtcggcattttgcagctgacaacccatccggcgcttgatgcgattcataagggcattatcgccggattgaaagataaaggctacgtggcgggcaagaatatcaagattgattttcaaaacgcggaaaatgatcagagcaatctgaagtcaatgtcagaacgctttactgaggaacatgccgctgcaacagtcggtattgctacgcctgcagctcaagcactagccaatgtgaatcaaaagacgccgatcatcttgggggcaattacggatccagtcgcagcaaagttggttaaaaatgttaaaaaaccaggcggcaatattaccggggtttccgatcaagccccgattgcagctcaattgaaacttatccggcagatcatgcctgatgcgaaaacacttggcgtcattgcgacttccagtgatgattccgcacaaacccaagccaagatggtggctaaactaggccccaaagaagggttcacggttaaacggtatgcgattagctcgaccaacgatcttaaccaagtggcgacgcaaatggtaagccaggtggacgcggtgtttgtgccgactgataatacggtggcgagcgccatgcaaactttagtggcagcggctaacgcacgaaaggttccgatttttccaactgtggataccatggttaaacaaggcggggtggcaacgatcggacttaatcaatttgatttaggtgttgaaaccgggcatatgctggcggatgttttaaaaggcaaagccaaaccggccacgacgccgatccactttgaaaaaaccggccgacttattttaaatgaaaaacaagcgcagcagttggggataacattgccgagttcgttagtgaaacaggcagacgcgaaaggaacggtgatcaaatgagtttaggggtttctgcaattgggcaaggattgttatacggtttaatcggactaggtctctttttaacatttcgggtgttggactttccagatatgacggttgaaggaacatttccctttggcgcagcagtggccgtcagtgcgattactcacggtatttccccgattatcgcaaccttgctcgcaacggtagcagggatgcttgccgggctggtgacggggttgttaactaccaaaggccgaattccggtgctacttgccgggatcctggtcatgaccggcttattctcgattaatttacggattatgggacgggccaatttatctttgctacatcaggctaatcttttccaaggatcgttcttaaaagacttgccgccttactttaatagcgtggttgttggtttaattgttgtcgtcatcgtcgtcggattgttgatgttatttctgaacacccagttaggtcaagggttcattgcggcgggtgataatccgaatatggcgcggagtctggggattaatcctgatcatcaaatggttctgggcttaatggttggcaatgggctggttgggcttgcaggtgggttgctcgctcaaaataatggctatgcggacgtgaacatgggcatcgggatcattgttatcgggttagctgctattatcatcggcgaagttgttttcggtgagttgactttgtcgcagcggttggtggcagtcatcttagggagcattatttaccgctttgtcttgctggttgtcttggcgctaggcttcaatgccgatgatttgaaactgatctcggcggtcgtgttagccattgccatcatggtgccgcaaattgatcatcaattacgattacgacgtgtgttgcagaaaggggtgcagatccatggctgaattaaagttggatcacgtgacggttaatgtgccagttgcaactcaagtcaagaccttgttgcaagatgtgacgctgacggttaagacaggtgaattcgtcaccgttttgggtcataatggtgccggtaaatcgaccttattcaatgcgattaccggtgatctaccagttagcggcggcacggtcactttggctggccaaacactcaacgggcgccgtcctgagcaacgtgctcgacacattgccagagttttccaggatccgaaaatgggaaccgccccgcgaatgacggttgctgagaatttattactagccagccatcgtggtcagcgcctagggttacgttcccgggggttgaatgcacaaaaagcccagctaaaggctttggccgcaaaaaccggtaatggtctggctgaggcgcttgataagccaacggagcagctttcaggtggacaacggcaggccttgagcttgttaatggccaccatgcgcaaaccggatttactgttgcttgatgaacacacagcagccttagatccccacaccagtcaggcaattatggcgttaacgaacgcgatcgtttcggagcaacagttaacctgtctgatgatcacccatcaagttgaagacgcgttacgctatggcaaccggctcattgtgctagatgccggccagattgtggcagacttcgatcaaaaacgaaaagcagcattgaagcgtgccgatgtcttagcctttttcaattaagcgagtgtgaaaaaggtaggcaaatttgcttgtgatggctcatttgcttggtcaatgcgcaagtttcatggttagaaaaaaggaacggttcaggtggacgtctgaaccgttcctttttgtagtctgatgaatagtgagatgaacatactcaacaggtatcggatagtctcgcaaagtagcctgatacaaatggtgcaattggtgacgtgctgatgtacactattggctcggaggtaacgatgagacaatgacaaaccaagaattacaagcacgtgtggaagccatttctatgagcgcatttcaccaaccgttcaaccaccaagccgtgtttaatgcgcgattgcgaactactggcggccggttttatcctgcgacgatgaatctggattttaaccccaaaatttttgcgctttatccatctgatgtcacggatggcatcatcaagcatgaattggtgcactaccatttgttcgcccagcatcgcggctatcaacatcgcgatcatgacttcaaacagttactggcagcagttggcggctcgcgttttgctccgtcattgccgatgaacggccgacactatgtttatcaatgtacaaggtgtggccggcaatttgttcggcgccgacggattaatgtcaaccggtacgcgtgcggtgtctgccgtggcaaattacgactgcaggcaacacgaaataactaattgagcggcttttgcaggattaaattgactggctgaaacccggcgcgggcatagacttctcgtgcggtttgattaccgctgaggacgttcagttgaataaaagaggcttgatgactggcagcgaatgcctcgaccgctgtcatgagggttttggctaggccgtgatgacgatgatccggcgtgacaaacaagtcaatcaactgcgcaaagtgttgtggaacgaattcggggctgtccccggttcgagctaaaacgaccaatgcaaagccggtaagtgtgccttggctttccgtgacgaataggcgagccagatcattctgcaagtaatcagcaaaatactgccgattgtcggtggttaagggccggtaagtatccggcgccaatgcagccatctcttgagtaagctgctgataaagatgaacaatcgccggcagatcgacaaattgggcttcacgaagcatcgaatgggactcctttcagaggcttaatatttttcaagccgggccatgatcaggtataaaataaaaaagatccgatcaacagtaataccttgttgatcggatcttgctatgatgcgggcaagaagactcgaacttccatgagcaaaaatgctcacaagatccttaatcttgcgcgtctaccaattccgccatgcccgcatgactaattaagcacaagaaatattataggaaaacgtgagattaaagtcaatagaaatttactaagcgcgaaccggcgcgcttagaaaccggagtgtaagtggccttaagcgtaatggccgggcttgggccattacgcttaaggtacttacacgcaggtttctgcgccggtgagcgcgttatgggcgtaaactagaacacaagtggcctcaggcgtgatggccgggctttggccattgcgactgaggtccttacacgcagacttctgcgccggtaagcgcgttaaaagggcgtaagccagaacacaagcggcctcagcggtagctaacactggcgaccgcaagcaatattgtcaaatcagggactattgccccaacatgagccatacctgaaggcaatggtctgctttgattgaatcagcaacagcagaaaacacaatataaacaaacgtaaacgtctataatttgataaaattagctataaacgattaggaggtgtcagcatgacacgtcgcggaaaagcttataacattgcgatcattggtattttgggagctttgattattttgcaagcctatattccaatggttggttatgttcagatttttcccgcttggccggctatttcgactattcacttgaccgtcatcattggcgggatcgtattgggctatggcggaggtgccagccttggcttattatggggattaacgagtctgattcgcgcttatacatcagcggctgacccggtaactttactgctttttcgcaatccaattatcgcgttggtgccgcgagtcatggttggtttggttgcagcttttgtttttcatcaattattcaaacgccaccagagtacgctggctcaaactattaaaatggtcatcgccggggttgcaggcgctttaaccaacacattgctggtgatcggctttacctggttgttgtttgccagcaaagccgcgcaaatcgttccaggggccaatgcaacgaatttaggttggctgttgattactgccttggccattaatgcggtggcagaggcggtgctcggcgggattgtcaccccaatcttaggtcaggcattgttgcgctttagaagaaaataaggctgcgttaaaagactgggttgcgtgttcggaataatggtgttgatagcacctgatgtgactagatgaactcagtcatggtggcgatttggatcgttaagatgatgtattttaaaagtggaggcggtagtttgacagacgaggaacaacaagttactgatctattgcaggcgatggttagaatccccagtgtggcagcaaaagaaggccaagtggcggacttgatcgaagcctttttggccccggaactaagcgcagggttgattaagcgtgaacgtatcagttatgcgccgggacgcgacaatttagttttgacgattggtgattctaatgcgcagcgctggttaggggttgacgggcacatggatgtcgtggatgcaggcgatcccaacaagtggcagtttcctccgttctcagcccagattgaagatggtaaattgtatggccgcggggcgacggatatgaaatccggacttgccgctgctgtggttgcgtttaagcaaatcgcgcatgaagagcttgatcatggcgttcagttgatggcaaccgtgggcgaagaaatcgataactacggtgcccgccaacttgcggctgccggttatggtgatcggttgaccggtcttttggtcgcagaaccgggaaacagcaatgtggatgcggctgaacgtggcattattgactatacgttaacggctcagggcaaggcggcgcattcttcacgtccagatcttggggctaatgccattcacggcttatttgcttttgccaatgccgcattaactgccaccgcgccgcttcaagctaaagatgatccgattctgggtcacgctacccacaacatcgatattatccatggcgggaatcagattaattcattaccggagtctgcttatttacgcggcaacatccgaacaaccatgattgctgataatgatgcgtttattgccgctttgaagcaggctgctaaaacatcagtaccaaaaggggttcacctatcactttcgattgattcggttttaagtgccgcagcggctgcacccgataatgcgttaattcaaaaagtccagcaggcacggcagcggatcggtttgcagcgcggggctgtggcctatcgaaccggcataaccgatgcggccttatttttccacgatggtttggacttggctatttacgggccaggtaatgacacttcgcacgaaaccgatgaatatgttgacctccaagacgtgttcgacagtattaaggtttacaaagatgtctttaaaaattattagtgtcaactaataccagtagaaaaagccttgtgacggtgagcagctcattcaacgtccaaggctttttgtagcgattagtttggttagctgattggattaacggtctggcgtactggccttaatcctgctcaactgatattcagcgtggtgttgccaagttgcgccggcagcaagtgtccacgcgttgccggttaaattgttttcgggagaaaatccgattgcaacatgaggttgtcccagaatgccgttaaagttgttatcgggtccgatgttagcaaacgagtcaatgcgggtggccggcgcatcggtggcatagtgcagttgccagtcaccggtggctaaggagaatctatgtgcaggcgagatttctggctgttgcttgatggtactttgctggtggtcaatggttaactgagcgtgtaacattgtttgggcgggatcggctgtcaataaccatggcaatatcaatcgtggatgaagtcggatttcggcagtggttttaacggccatatcgatggtccagacattgtcattattcagtcggtgcgtaaccataagggagcgctcgcccggttgtccatcagcgttttcaggtaaatttagagaaaaggtaatggctaagtcagccgtttgactggttttcaccgcccaattccaattctgccaagctccggggatcgttttagggtcatctggtgcaagcggaccggtcatggcgccgaaaagaccgggttgatgcagatagtcttctaaagtgacgaatccaagcaataagttaggatccaacccagtcgtagtgggcaaccggacttgctgaacacgagcgccgaaagttaaaaatcgcagcgtcatttgctgatcgttaactaatgtgtattgcgtaatgcgctcactgccaactttggcaaaaattttggcgcttagtttcatgacgaaaacgcttcccttctcaataaattaagcctacagaaaaattacctgagtttcaatgcaaacatggcgtgaatctgctaggcttgataaggatcatgtatttgatggtgtgaagatcgcgtgtgtcgcggcggcttgcggtcaccataacgcgctccccggcgcagaagtcggatcacgctcaccataacgcgttcaccggcgcagggatcggagtgtaaggacctcagccgcaatggccaagcccaggcgccatcacgcccaaggccacttacactccgatccctaagcgcgccggttcacgctcataacgcgttcgccagcccagaaacctgcacataaggaccttgggcgcaatgaccaaagcccggtcatcacgcccaaggccacttatgcgccggtttctaaccgggctggctcacgctcacttaactagaagggtttagaagcatgagaattttacttaaaaaggcctaccatttgttgtgggggttgtttgtattggcccttatttatagtttttgggcccgcactattttgcctcggcagttgcgaccttatggcgatcctgccagttttactattattagtttatttgtggtgatcaatgcgttgttgctgtaccatcatcattttcggtttcgagatttgaagatggagagcgtggacatcatggaaggtgagaagtttgaggaattttgtgcctatttattaaaacgcaatggcttcaagcgtattcaacttactcaggcttcgggtgatcaaggcattgacattattgcacaaaaaaaaggccagtcattcggctttcaatgtaagcgatacactggctttgttgggaataaggcggttcaggaagtttgggcagggcatcattattatcaacttgatcaagctgcggtcatcaccaacagtgagttttccgactccgcgattgccttagctgacgacctgggggtgatgttaattgatcgcaagaagcttaaacgcttgatgcgcagattaccgagctagaatggtcattgcttttaaggaggttggcaattcatgttgttgggtttaaaagccagtaccgatgagcgccagattcgtgatcgattgcagtatcatcctgacgtttttgagtttcacttgacggaagcagattttacggcgagtggctggcaacattttttgaaaatggttgcctgggttcaaagtcaggtgccgactgttgtttttcaccacccgatgcgatttcgtggtcagcgcaatgagttagcgatgaatccgactaaatatccagccaggtatgactttctgatgaccagttccgttaagcttatgacactggctaaaaaagtgaatgccacggcactgattcacggtggttaccgcgtggacacccccggagattatgccggatggcgtgacgttgcaaaagcacaagatgtggcattggctcgcatgattgcgtttgctcaagaggcgccgggacatgtggtatttgaaaactcgatgtcgccaatctttaggtatggcgatcctgcgtttgaggcgcgtttactgcgctggcggctaccattggcttatgatactagccatacttttatcacgttacgcggggataatgagcgacttatcgccagtctgcgcaacctaaaaccattagtacggcattatcatttggttgactcaatggggcagacgcatgacagtttacctttgggagaaggtcgaattgattggtaccgcgttttaccccagctcaatcctaacgccagccggatttacgaaatcggtttgaaaaatcagtttgattgccaagaaatgatagccagtcaccattatctggaaaaggttgcagcaaagttggcggcggcaaaacatccggcctagttaagcaaaagaccaactggccggtggataaagccaaaaagtgcacgggtgccgcctgcatctgcaagataaagaaaacgtgattgtaagtcaggctgatttaacaaaagttgtaattcccacacgcgtaatggcgattttcgatcaggtttgggcttaaagattaattgtggctgatcattttgggttttcaaaataaaatcatcaaaacgacttggtgctggtgttgtatttaacagtactggggcgtttttactttggtcagcgagtaaggcgagcaaatcaatgacgcgcatcaacggcacctactttctatggctaaaagttaaggattggtgaagacgggtgttacttccgaaaagaatcgcatacaatttaaacagtttaacatgaacttatgtagctagacataaatgcaatctcggctaaagggaccggaatctgggcgattaacggtgcaagccacgatttagatgttttgtttttcggactgtgataaactataacggtttttctgagcgggcattggtgttatgtagcggttgctcaggtcagcgatgggatcttcttcgatgtattataacgcatgtttgaattgggttcttgactgggcggctcgcgctcaccataacgcgttcgccagcccagaaacctgcacataaggaccttggacgcaatgaccaaagcccggtcatcacgcccaaggccacttatgctccggtttctaaccgggctggctcacgctcaccataacgcgctccccggcgcagaagtctgcgtgtaaggaccttggacgcaatgaccaaaaagcggtcatcacgcccaaggccacttacactccgacttctaaccgcgccggctcgcgctcacattttgaaaaggggttattatggaaaaagttgtgattcttagtgccaagcggacgccgattggaaagttgggcggtgagttagcaggtgctagtgcagtggatttaggtgttactgcagctaaggcggcgattaaagcagcacggcttgatccgcaacaactggatcaagcaattttcgggaatgttttgcaggctggatcgggccagaatgttgcgcggcagattgcgttgcatagtggcatggcgacgaactccacggccatgacgatcaatgaagtttgcggctctgggctaaaggcaattcggttaggtcaggcggcgattcaactaggtgaagctaacgcggtacttgtcggcggtaccgagagtatgagtcaggtaccgtattatgctgaggcaatgcgggccgggcataagtttggcgatactgcgttggtggatggtcttagtcgcgatgggctaaacgatgcttttagtcagcaaccgatggggattacggcggaaaatgttgccagccgctttcagatcagtcgtcaagcgcaagacgagtttgcactgcgctctcatctgcgtgcggccgctgctgctgcagaaggccggtttaaatcacaaattgcaccggtgaccatttccggccgacatggcgatgtcacgattgacacggattcggcgattcgaccggatacatcattagcccagttagcaaaattaccgccagtttttgaagttggcggtaccgtcacggcgggtaatgctagcgggattaatgacggggcggctgcattgattcttatggcgaagtcaaaagccgagcagttaggcctccactatttggctaccatcactgactatacagaagtcgggattgacccggacatcatgggttatgcgcctaaattagcgattgaccagctaatgcaaaaaaccggacaaactttaacagccattgatcaagtggaattaaatgaagcattcgcctcgcaaagtgttgccgtgatgcgtgacttaggactgactgacgaacaggtgaatatcaatggcggagcgcttgctttaggccatcccttgggagcatccggcgcgcggattatggtttcattactgtataatctggccgaacgcaggcaacaaaccggtatcgcggcgttatgtgtcggtggtggtatcggtatggcgatgcaagttactttgcatgattaggagcagattaaaatgaagttttatgagcaaacgcccgaagctaggcggcaccaacttgtgcaagaagggtcattaaccagtacagatgccgctttattggctgcggcacgcacgcttcctgatgctactgcgactcggttgattgaaaatgcaattggtgaattttccttaccgatgggcattgcgcgaaatttaatggtcaatggccagcaacatcaagtaccgattgttaatgaggaaccctctgttgttgctgcggccagcaatggtgcgcgaatggtagcggaaaacggcggcgttttagcgcatgtgggtacccatgaagtggtggcagaagtggtcttaactgatttagcagatttgaatacggctagacagatccttttggcccatcaagcaacgatcgcagctgtggccaatgccgcccatccctcaatggtgcagcgtggcggaggcttccgcaacctgaccgtgacaatcttggccaaccggtttttaaaacttcgcctgacgcttaatcctaaagcggcgatgggcgccaattatgcgaatacggttgccgaagctgtggcagatgcagtgacaacctgggtggatggaacggttttggccagcattttaactaacgcaccgagcgagttagtcacagcaactgtgaaattgacaccggcgacacttgccacaaaaacactgtcaggggatgaaattgcccataaaattgtgcagctgagcgatttggcatttgtcgatccagagcgcgcggtgacgcataacaaaggcattcttaacggtgttattggggcggtcttggcgacgggaaatgacacgcgcgcggttgcggccagtgttggggcgtttgccgctgcgactggtcagtatcaaccgttatcacgttggttgatgcgcgatggcaaacttgaaggctatctgcaaatgccattgccgctgggtgctgtcggaggcgcgatcggtgcattaccattagcccaggcggcccgccgtcttggaggttatcgcgacttagccaccatgcagcaggtaattgccgcattaggattagtgcagaatttagcggctttgcgcgcattagccggccccggcattcagtcaggccatatgaaactgcaggccaatgcactggcgattgctgccggagctcaggatcaggaagtacctgctctagtcgccgccttacgcgcaggtgaaatggatctggcacatgccaaaatgtatttagcaacgattcgatcaaaatagaaagcaggccattgaaattatgaaaatcggaattgatgccatcgaaatggataccccggacttttacgtcgatctcgtaaaacttgccaaggttcgcggtgatgatccgaataaatatacgatcggcatcggccaagacgagcaggcggttccgccatctagtcaagacattgtgacattgggagccaatgccgccgcaaaagtattgacgccagcatcacgtgccagtttaggcatgattctggttggaaccgaaagcggggttgatgctagtaaatccgccgccttattcattcatgatcttttggcactgcctgaatgggtgcgggcggttgaactgaaagaagcttgttatggcgggaccgctgcgcttatgatggctcgtgattatgttgcgagtcatcctgataaaagtgtgctcgttattgcggcagatattgcgcgttatggattagcaacggccggtgaagtgacgcaaggggccggcgcagtggcgatgattgtcaaagctgatccgtgtctgctgacaattgaaccggattcggtttatcgatcggcatcaatcaacgacttttggcgaccggtttaccaagatacggcgcttgctcaaggaaaatactcaaccgaacaatatctcgccttcttcaagacagtctgggaacgttatcaggccgaccatcatttaagtgcacatgatttcgcggcaatgacattccatctgccatataccaaaatgggtaaaaaagcattggatctagtgttgccaaccaccgatgacgcgagtgcccagcgattgaaaaaccgttttgaagccagcacgcgttattgtcggcgaattggcaatatttacactggttcgctttatctggggttgttgtcgttgctggatcatgatacgacgctacaagccggggatcggatcggactgttttcgtatggttccggtgccgtcgcagagttcttcagcggcattttgcaaccacaatttaaggaacaactacacgccgccgaacatgcccagcaactaactaaacgccaagaactgcctgtaccggaatacgaagcggtctttagcgataaagtcccgtatgatgccgatgactatcgccctgatccggcatactatcgtggtcagtttattttgaccggtgtcattggccaggagcggcactacgaaaaacaccaatcgtgatgaaccgggtgtaaaagttaaggtagttttgtctggtcagaattaataagcgccaattttttagttgataattattttcggtcggcgccatgtaaaagagtcatagaaagcgaatggacttttccgattaaatggaatcgttcattcgttttttgtgtgagcgcgagccggcgcggttagggatcggagtgtaagcggcctcgaacgtgatggccgggctttggccattgcgttcggggtccttacacgcagatccctgcgctggggagcgcgttatgaagaagcgcgagccggcgcggaacgcgttaaagcgagtgataacaattagaatccgccgttatttgaaatggataaaaatggccacggaaatatttaagtcaaaatacagtctgctaacaaactatctggaacgaacaggctctgtatcagtcagtttgattgactgttattaccttggcgtgggtataatgacaatgactaaaacgctttccttacttttagccgtgacttgatctcgaatcgagtgaaagggtttgcattgttattgattaattgttatactcataatcgtaaagaacttacaaaatgtaagtaataatggaggcaagtgtcatgacagaaaaaatcaatgctgcagacgcaatgatcaaggtgttagaagactggggaattcataatatttatggattgccgggcggatcgtttgatagcaccatgaacgcgctttacaatcgccgccacaccattaattacgtgcaggttcgccatgaagaagtgggcgcattggctgcggctggcgaagcaaaggtaacgggacgcattggggccacgtttgggtcagcaggtcctggtgccgttcatctgttaaacggtttatatgatgcgcaatacgatcatgtaccggtattagcattggtaggccaggtgccgactgcagccatgaataccaactattttcaggaaatgaatgaaaacccgatgttcgccgatgtatcggtttataatcggactgccatgacggctgcacaattgccgcacgttgtcgatgaagccatccgccaagcttataagtatcaaggcgttgctgttgtgaccattcctaaggatctcggttggcaggaaatcgatgataattatgtttcatcggctaatctttatcaaaagccgttattgcctgaaccggatccggagcaagtggcaaccgcttggagcattttaaaggatgccaaaaagccgatcctatacgttggtaatggtgcgcgtggagctcgcgatgaaatcattgcattttccgaaaaaacgcatatcccgatcatcacaaccgcactggcaaaaggcattgtgccagatgattataaggccaacatgggatctgccggtcgggttgcatcaaagccgggggttgaagtagcccgcggcgccgatacggttttgttccttggctctgacttcccattccagccttactttatcgcgccaaatgctaagtatattcaagtcgatattgatgctagcaagtttgggcggcggcacacagttgatctggcggttttagccgatgccaagaaattcatcaaggcattgaccgaaaaggctgatgccgtaccggaaactgcttggtatcgcgctgcggttgctaacaaggcaaactgggctgagtggatgacgtcatttgaagacgatccgcagaccccattgcgcgttgagccgatcttcaaacttatcaacgagatggccgacaaagatgcggttttccaggtggacgtcggtaacgtaacgattaatggcatgcgttatttgaaggccaacgataatcaaatctttacgacttccggctggtacgcaacgatgggctatgctgtacctgctgcaattggcgcccaagctgaattcccggatcggcaagtgtggtcaatttcaggtgacggcgggtttgcgatggtcatgcaggatattatgactcaagtgaagtatcacatgccgattatcaacattgttttgaccaatgaaagtttaggctttattgaagcggaacaagacgatacccgtcagccgcattcaggggttgatcttattgatgctgattatggcaaggcagctgaagcgatgggcgcacaagggtttgaagttcataatttggacgaactcaaggcggcattcgccaaggccaaggatcgtaaaggcccagttgtcattgacgtgaagatttccgatttacggccaattccggttgaacaactggttttggataagcaaacgcaggatccagaagccgttgacgcattcgttaagaagtatcatgccgaaaccttgattcctttccgacagttactcgaggatgctgaaaagacaactgcaaatgtttaattgaattaattcaaaaagcttccgcacccctagtcagtgaaggggacggaagcttttttgattatgccgatgcgcgggcttggatggctgcaatcaaggccgcttcatcggtgaaaatggcaccgttgagcttaatcaagccggtcgtgtataagttgagataatgaaattggttttctgccacttcttgcaaggcggcgagcttcttgtgattagtagcgcccagacgccgactgtctgtatagagccccaggatcggaatatgtcgtgcatatgccacaccaacttcagtcgcgacgccattgtcgatgacgggtccatccaaaatggcaatcattaaatcagctgcctctaaccgctgtgtgtcagcttcagcaatcatcttggagtctgcgtacgcttctttattgttgatggccgcattttcttgagggacgtacaaatcgactttgggaatggcggtgcggatctgggccgctagtttggcattatagtcaaaatcggcgtggctaaacagcgcattggcaaaataaattttcattggaaaaggacctcacttaggatgattggaaaatggcgatgattcgtacaaacgtcaagttaaaccagaactgggtatataatcccgagtcaggtgacaagtgactcagattaacgtctggtgaatttgacaacagcttcacaccgcgctgtttgcggaaacatgtcgatgctttgaatccagtcgacttggtaatgcttggccagcggcaccaaatcccgcgccaacgtggacggattacacgagatgtaggcaaacttttgcgggttaagttgcaatagcgcatcaataaatggccgttcgagtccggagcgtggtggatcgacaatgacagcattgggatgaatgccttccttgagccacttagggaataaggtttctgctttaccgacaaaataatgagtgttgttaaagccgttatttttggcattatctttagcatcggcaattgcttcaggaatcgtatccataccgtaaatcgactggtgacggttagctaggctcatccccaccgtaccaataccacaataagcatcaatcagcgtgtcatccggcgcaagttgcaaggcgtctttggcaatggcataaagctgttcggtctgtttagggtttagttgtaaaaaggcttgcggtgagagctggaaagtacgcccggacaaggtttcctgaatatatggctgaccagccagcaaacgactttcttttccccaaatcagcgaggtgctactaggattgatgttttgggcgatgctgacaaccatgggcagttgggcggcaatagcggtgatcaattgagcttgctttggtaacttggcactgttggtaataaaggtgacttgaacttgcccagttgaaaaggactcgcgaacgactaacgttttaacaatgccggcgtgctttttctcgttataaatgggtatttgaaggtcttcgagtagttgacataaagtcttcaccaccttcatggtcagcggtgcctgggttaaaaagtgcgttaaagggatgagacggtgggatccaggtgcgtataaaccggcgcgaacatgcccatcaatttcgcgaaccgggaactgggctttgttgcgatagtgcgttgggtgcgtcattccgatagttggttttaaatcataatgttgccagccaagcggtttgaatttggccagagcttgggcgacaacatcgcgtttgaatcgcaactgcgcagggtaggcaaggtggttcaactcaacgccgccgatttgcccaaaaagcggttccgttggggtgacccgatccggtgaggctgatcgaattttgtgtgtctttgcttcaagataacgatcgtgaatggctgtgacttcggcgacgaccacttcgccgggaagtgcaccggtaacgaaggtgatcttgcgttgatagtatccgattccggcgccattaatatccagacgcttgatcgttaaaggaaaacgttgaccgattttaaccttggttgccatgaaatactcctttacgctgacaaatggtgacgatacccgagtgattctagtataatgaagattcgggaggattgactgtgaaaattaattattcgaatagtatgagcaaaaaaatgacggcgactgtgtggcaaaatgaaaccgcgcacatcatgcatgttggtgaaacactggatttgaaagttcaacgtggtgataaaatcacatataaagtaggccgcttgaatacggtgcacacgattgattatcaaagcccggacgccaagtttgaaattcaggttaaccgcagtttgcaaaatgcctattttgtggtgatgtttctgatggttgtctttttatggtttacgcgcaccagtaatttgaacaatacgctactgattaccgctgtcatccttggactagccggttatgaagcgctggtttattttgtggggtatacggctaaaccgttgcattgaggtaatttaggagcgagcggttgatcgatgctggcgttgtaattgtttgagtcgctgataaaggtgaaaataatccaaatcagtcggttccggcatccaggtgatcaagggtgtcgtgggatcaaacgggtggcccaaacgcgggatcaccctttttggtttggtaatactggtaatgatcaagtcgggtttgaccgcttcaactggcggaacaacccgaataaaacccaaatcgttcaaaaagtccaataagtcgcgcttggcaaatgagtcatgttcaatcaaaacgttgacaatcatttgcatatcatggttgagttcaggatagttatcgctgaccagtaaatagagcccgctaataaattgatcggggaaatctgcaaatactgactctggcattgacttgggaatttgctttagataacgctgaatagcagttgccaacgtgctgctatcggcttcgtcatacaacgattgcgcaaaatcaagacgctgactaaagcggccattaaggacatattcattaaagctgagccgatacagatttgcaatcatcacttggctttcagcgatgggctggcggtcggtttttttaagctgatcatttaaatggtcaaccaatccggtcacaaaccgattgacgagattgtcggtttctccaaaatgagtgagcaattggcggtcgattttctgtggctggcgggtgaccgtcataaaataaagccgcataaaataataaaactgcttttcggccttcagctgcgagtcagataagttcggaaattgttctgatgtaaaaatcagatcaggcaggtcctcatgtccggaaaatagcaattgcattcggcgattaggtaataagggatgaccttgtttaatccgcataagttgaatggcaagcacaaccagcgcttcttttgacattggttcaacgggcattagtaaaaagtccggatcagtttgattgatgacggtcagcaaagttttggcttgcttttcttcttcagccgaaaaaggccaaccagctccacgataagcgagcataaaaaaagtaaacattgccagacgaatatgaagttcatcgccttcgatcgcccaagtcgtactgttaaggttaacgccattatcagctagataatcacgaaatggcgtgatgcgtcgtcttaaggtggagacgctggtttgatgtacctctttaaatgtgtgaaaatcagggtgcgggtttttaaacacatcatcaaagaagacaaacggcagactttctttaagtaacgcaaaccgatattgattaatcgtgacattgcctaaaaattgcgcaaaattagcctcgtcgattgtttcggcggggatcatttgatttaactgaaccaaaacggtctggaatgccgtgtaggtctgagaatacgataacccagtggcgcggcttagtgcattgatcgataaggttgtttgtggcaaggtcttcattgcccgaaatagctggtagttgataagactatgacggtcaaagaaactggcttcaaacataactaacctccatatatttatgaaaagtataacataactgacagtatgattagagaggcggtcaaagtaacatggcacaaatcaccaagataacggcacaaaaacggcgtggtcggtacaatatttttttggacggccaatatgcgtttccagtcagtgaaacaacgctggtgacttaccacctagccaaggaaatgacgctcacggaagatatgatcgcgcagattaaagtcagtgaagtcgtcgcaatgggcttggagattgggctgaattatatcacgcatcaaagtcgaacccgtcaagaagttcgggaacggttggagaaagaacaactgccagaagatgtgatcggacaaattttaacccgtttgacggagctgggttttttggatgatgtcgactatgtgaaacgctatctggaggccgatctcaaaatgggtgacaccggtccgcgggtcgttcaatacaagcttcgccaaaaaggcattgctacggagctgttagccgatcagctggcaggcatcgaatcagatgagtggacggcagttgccgttcgcgccgggcaaaagaacttaaggcatcatcaaaaccgcgcgtacaaagatcaattgcagcggctgcgcgtgaacctgatgcaaaagggatttgatgaggtgaccatccaggcagccatcgcaaaactcgatccgcagccagacccggaagccgagttggccatgctaaagacagaggcggagaaacagtggcgcttaaagcaacgctatgatgagcgcacccgtaagcagaaggttaagacggcgttgttccggaaggggtttgatttggccgcgattgatgatgtattaagtgagctggtggatgaatcgtaaaacggctgaggcgaaaggctgctgttggggaggaggccagcttctgatccaaacggtactcaccgccctccattcagacatgttttgctgttagtctaaagttttttgcgcatgtggcctcagacaagggagcatcagtttacacgattctgagtcaccttgttcaatattaggatagaaagcaagagctggcggagcggtggcgggctcagtggtgaaattggtcttaagcggagtgggcttctccgctttagaccaaggccgagcttcgaaaccgcggtctttgcgggttcgaagtcgtgcccaccacgttccagcccagccaccgcggagccagctcggagtatcggaaatcacataatgagagtagaaccgaggaaaagttgacacttaccgccgtccgacttacttacgcgctgtcgtattttcatgaggtttgttataatgaaacacggaattttagaaagcgggttaagtatgcgaatccctaaagaaggcgaatcgttcgccattcagagttataaacatgatggcagtttgcatcgtacctggcgtgatacgatggttcttaaaaccagtgaagatgccttaatcggctgtaacgatcatacattggtgaccgaatcagatggccgccggtggttaacgcgagaaccggcgattattttctttcataaacattattggttcaatgtcattgccatgattcgtgaaggcggcgtttcttactattgtaatctggccaccccgtttacgatggatcaggaagcattgaagtatattgattatgatctggatgtgaaggtttttgctgatggtgaaaaacgccttttagatgtcgatgagtatgaagcgcatcggaaattgtggcattatcctgcaacaacggatcgaatcttaaaggcaaacgtcaaagtgcttgtcgattggattaatcacggtaaaggaccattttcgcaggcatacgtggatttatggtatcggcggtatattcagcttgcacatcggatttagtccactaggttttggagggcaacatgaaagagattccacaacagccagcacaattgttggcagggcacgcatatacaaccgaagatagcgaccaactggggacgtttgcaccggcgtgggcggattttgaacaccagtttggttttaaaacactggatcagttgactaaaacacctaatcgaacagctttggttgttttttcgccgtacaatacctttatttattgggttggcagtttgttaccggttgacgtcaaagtgccccaaaattatgagtgttttaaactgccagccgcaactgccgggcaggtgaagcagtctgccgatcgcgtgctcatgaaagaattgccgttagcgaccagctttaatcaagggttacacgttattgaacaagcaggatacccgcttccggagcggcttgggcaaacggatcatccttactatctggaaagttatcgcttgaacggtggtaaggttgccgaggtggcttatcgcctgtacatcaatccgcatcagctaaccggggttgatgaatatgaataaaaaaacaagcacgaactaagcggcttgtcagggtgtgcttctaagaaaatcaaattagaagcgtatttttttcacattcggatggtttaatcaaatcatacacaaggttacgtaagctgtaattgcatttcgcgatgacggattccggcgtctagaaattcaggctggtcggttagctgaaagcccaatgttttataaaaaccgattgcctgcagttgtgctccgagcttcaggaacgcaacgttttgctcgcgggcataggcaataattgcatttaaaaccatttttccaagcccgtgtttgcggtaggccttttcgacggcaacacgctggacgtgataaccggttccttctggtaaaatccgtgctgttgcgaccggtaagccagcatcgtagacgacaaaataagtggctttgccttcatccgcgtccacttccagatttgccggaacgtgttgttcttccacaaatacatgggttcttatctgtacgctgtcgtgatgaacctgagagtctaagtctgttgttgattttacttccaatacgtcagccttctttccgttttgataaattgtttgctattataacactagtgagaagacgttggggaggtcgattatgttcgataagttacgccattcaaaattaatgttctggtcagtcgaattgttagtcttaatttttgtcgtgatcggcttaacgcaggtttcttttttatttgcaccggtcgcgactttcttttcaacgttactgatcccgatcatttcggcgggattcttgttttacctgtttaacccgattgtgaagttattacagcgattgcatatcagccgcaatgtttcgattttactgattttcttagttgtcattggtgcgattgttttgattgtcatggcggtgttaccgaacctgatctatcagataacccaattcgtgacgaatatccccgacttcttaaaaggtgtccgcacatttatcagcaaagcatcgcattatacttggtatcagcggttaaacatcggtaaatatgttgcgagtttgcagatttccccaagtaaactgctgagtcaggtacttggcggtttttcaagtggcctgcctggggtgattggctcgttggcaagtaccgttatcagtattattacgattccggtgatgctcttttattttctcaaagatggcgaaaatttcgttccaagtattcagcgcttgctgccgcggcgttatcatgctgaagtggctactgtctttacccgacttaacgcgaccttatcgcattacattggcgggcaggcgattgaatgtttgttcgttggtacgttcacctttatcggctacttgattatcggcatgccgtatgcgtatctgcttggttttattgccggtgttgttaccattattccttatttaggcccctacatcgggattgcgccggctttgattattgctgctactgaaggatggactaaaatgttgctcgtggtcttggttgtcgtcattattcagatgacggatggcaattttatttatcctaatgtcattggccgctcgcttgatattcatccgttgaccatcattattttactgatggtagcggggaatctgtggggcttgctgggcaccattcttgccgtgccgacttacgctgtcattaagacggtcattacttatttatatgagctgtatcgttttcaccaggagcataagaatgacgaggattttgatgaggaccatgaattgtcacttgaagccccgacgcacgctgacaagcctgattcagaattgaaaaagaaataaggtcttgctatactaaagtgatcgaactacggggatgagtccccgttttttttacgaaaggttgtggattcgaaatgggcagtgacccggacggccagatatggggacagttaatcctcattgtgctgttaacattaatcaatgcaggatttgcagccgcagaaattgcggttgtctcaagttcacgtgctcgaatgcaggcacaggctgataaaggtgatcgcaaagccgccaagctagttgtcatcatgaaggattcaagtcattttctggctaccattcaagtcggaatcacctttgccggtttctttgcctcggcttcagcggcgacgacattagccgataaggtcgctccgatttttgggtcctggtcgtttgcacacgaagcggcagtgattttagtgacgttgattttgtcgtatttctcgcttgttttcggggaactttatcctaagcaggtggcgcttcagatgacggaacgggttgccaagatcagcgtcaccccgattagttggctggcaacgttaatgcgcccgtttgtctggctattatccgcctcgactaaattgctgatgaagctgacccccatggagtttagtcatgaaggcgagtccgttacccgagaagaaatggttgccatgattgaaaatggtcgcaatgccggcgcaattgaaccggacgagtaccaaatgtttgaaggtatcatctcgttgtctgatacgatggcgcgtgaagtcatggtgccgcgtacggatgcgtttatgattgatgccaaggaaccggatcaaagcgctattgatgcaattttgaataacatttattcgcgaattccagtttatgaagaagacaaagatcacgttattgggatcgttcatattaaaaatctgcttaaggaagcccggcgtgttggctttgaccaggttaagatcgaatcggtgatgattgagccggtgtttgtcccggagacgatccccgttgacgtgttgttgactgaaatgcaaaccaagcaacaacagatggccattcttttggatgagtatggcggggtcgttggcattgtcacgattgaagacttgttggaagaaattgtcggcgatattgatgatgaatccgaccaggctgaaaagctatacacgaaacaaaccgaccacgacttcattgtttcgggacggatgccgatttcggaatttaatgagctgtttaaaactaacttagatgcaccggatgttgacacgattgccggttatgtgctcactcaacttggggccattccttcgacccatcatagtgaaaagctcgaactggctccgggggtgcggcttgccactggtaaagtcgaaggttctcggctggtcaatgtgcatattcatttaagtgagacgccgcctttagaagttgtttccaaggaggcggatagttagcgatgccagcactgagagttaaaagtatgttggcagtcgtagtgttatttttggaaggaaacagattatgaaaccacaagaacgagcacaagaagtagcaaaacggcgaacgtttgcgattatctcacatccggatgccgggaaaaccaccattacggaacagctgttgttatttggcggtgtcatccgccaagccggtaccgttaaaggacggaaatccggtcattttgccaaatctgactggatggaaattgaaaagaaacgtgggatttccgtcaccagttccgtcatgcagtttaattatcaaggtaagcgcatcaatattttggatacgccggggcatgaggatttctctgaagatacgtatcgaacgctgatggcagttgacgcggcagtgatggtgattgattctgctaaagggattgaagcacaaacgaaaaaactgtttaaggttgtcaaacagcgcggcattccaatttttaccttcatgaacaagctggatcgtgatggccgcgaacctttggacttaattgccgagctagaagacttgctcggaatcgaagggtatgcgatgaactggccgatcggtatgggtaaagggttaaaaggattatatgatcgcgtcaataatcggattgaattgtaccgacaggaaggtgccgatcgctttttgccgcttaacgacagaggcgaactggatgccagcgagcctttgacccaagattcgatttatacgcagacgctggatgatattgagttgctcaacgatgccggcaatcagtttaatctcaagaagatcatggctggcgatcaaacacctgtcttctttggttccgcgttaaccaatttcggtgtcgaaacctttttaaatagctttgttaagtacgcgcctgagccagggccaaagaaaactgctcaaggtggcgaaatcaaaccgactgatccggaattctcggcatttgtttttaagattcaggcgaacatgaacccggctcatcgcgatcgcattgcattcgtgcggattgtctctggtgaatttgaccgggggatggacgttatcttgcatcgcacaggtaaaactatgcggctaaataattcgactgagtttatggccgacagccgcgaaacggtttctacagcggtagcaggggacattgttggtttgtatgataccggtaattttcaaattggcgacaccatttaccaagggaaaacgccgattcagtttgagaagttgccgcagtttacgccggaactgtttatgcgtgtaaccccgaagaatgtgatgaaacaaaagtcgttccacaaaggtatgcaacaactggttcaagaaggtgctgtccaattgtataagacttatcacaccaatgaatacattttgggggctgtcggccagttgcaatttgaagttttccaatttcggatgctgcatgaatatcattctgaagtggtcatgacgccaattggctcccgcattgctcgctggattgaccctgagcaaatggacgaaaagatgagtagttcccgtaacctgcttgttgaagacgttcacggcgatccgctattcttatttgaaaatcaatatgcagagcgctggtttgctgacaagtatccggatgtcaagttaacggcgaaactataatcaaaagcaggcatcaaaaaagcggccatttacggtcgcttttttgatgcctgtgcttccggactgaccggccaacaggacttggagtactagtaagtgaaaatcttatcggtatgaggatcaacagccgacctcacctaaaaagttatctgataatgacagcggcttattctgcctggcgctcaagcttgggaaccgtgacctctgctaggtggtgtcccataattggcgttacatcaccgattgatttctttagcaagcgatctaacgtgaaggcaatttcttcacgctggatgttgcggcgttcattggtgaataatagctcaatatgcgaaggggcctctgtataaacaactgtggtttgaccgagtgaaaagactttgacgagtcgggcatcggtaccgctcagctgctggtttaccaaatttctgaagctgttggttacgttaattaatcgcatggtcatgccctccatttctctccctactggttttattataaaacagtttaagaaaaaataatattattgacatcgtgatgactggacggaatggatacaactacgctcgttgaggtccactaactttagctttctaggcgtatattcagtaagcaaaagcgctgatcgctgctgcactgacaagaaaagagcgtgaactttttattttgatagttgatcctggaagctgcggaataaaaaaaccggttcaagcaatttatgcttgaaccgatttagtgcgagcctcatttacgaccacgataaccaattggtcgcactgagaacgtttcaatcttcaacaatcggattatttcttggctgtttttgaagaggcttctgccttggctggttcgccaactgtgatttctccgttgctgatccttgcttcaagttccttggcattaggatggtcgaggtaaaagtcagccacacggtcttcaatctgttcctggataacccgacgcaatggccgtgcccccatggatggattgtaacccagagtgacaagcttttccttgacgggatcggtgacatgaatcgttaatccctgactcttgagattgttgttagtgtcattaatcatcagtgacacaatcttcaataggtcgtctttagaaagcggcttgaattcaacaatgtcatcaaagcgattcaggaattctggtttgaagtagttacccagctgatccagcacactgtgggttttaccgcttaacgttgcaccaaagcctacgttagcttccgcatcagttgatccggcgttagaagtcatgatgatgatagtatctttgaaggaaacagttcgaccttgtgaatcggttaggcggccgtcatccagaatctgcaggaacatgttcatgacatccgggtgggctttttcgatttcatcaagcagaatcaaactgtatggattgcgccgaactttttcagttagctggccggcttcttcatagccgacatagcctggcggtgacccgatgagcttagagacgctgaacttctccatgtattccgacatatcaaaccgaatcatggcatcttcagaaccgaatagttctttcgcgagctgttttgccagttccgttttgccgacaccggttggtccgacaaagaggaatgagccaattggtcgcccggtcttattgaagccgatgcgattgcgccgaattgctcgagcaactttatcaactgcttcattttgaccaatgacgtgttgctcaaggtcactggcgagattcttcagttgcgcctgttcctgagctttgagttcaccgactggaatgtttgtcttttcttcaacaattttttccatgtctttttcggtaactgttgggatttcattatctggcaggttggattgctttttggccatgtcttctaacttggtgacctgatcacgatagaaggcggctttttcatagtcttcctgcttgagtgcggcttgcttttgcttttcggcatcagcaatcttagctttaatggtctcaggatccacggttgcaattgtcaggttcttgcgtgaaccggcttcgtctaacaagtcaatggctttatcagggaggaagcgatcctgaatgtaacgattgctgagggttgccgcagcttcaatcgcaccttccgtgtatttcacatggtggaagtcttgatagcgcggttgcagacccttcagaattttaatggtttcatcaacgctaggctcttcaaccatcactggctgaaggcgccgagcaagggcagaatctttttcaatctgacggtattcgttgctggtcgttgccccgactagttgtaattcgccacgagccaatgcgggtttcaagacgttgccggcgtccatcccgccttcagcattaccggcacccacaatttcgtggatttcatcaataaataggataatattcttattttgcttcagttcgtcaatcagttgttgcatgcgctgctcgaattgaccgcgaatgcctgtgccttgaacgagtgaaacgacatcaaggcgaattacatggcgatcctgcaacttggctggaacgtcaccattagcaatctttaaggccagtccctcaacaaccgcggttttgccgaccccggcttcaccgattaaaactggattattcttggtccggcgattcagaatttcaatcacgcgtgaaatttccttatcacgaccgatgactggatcaatttgacctttgcgtgcctgttcagtgagatcaacaccaaactgacctaacaagcctttaccgccgttgccattgcggccattgttgccgttgccgccgcgtcctgcctgggtaggcggaacctgtgcgtttggctgttgcggttgatccattccctgattcatcgcacggaaaatatcatctaagcttccaaacccaaatggatcggatgcgttggttggattcatatttcctcctgcttgtttcttgagtaattgataacagttctggcaaagattgatttcttgccgagtaccattaacaacggttgaaagatgaatagtggctggattcttatgacagttttcacataacattttgtcacaaccttcctgtctaattaggtgccacataacggtcaaaaaggtttgacctttcttgacctatggcaatagtatacaccctcattaccagaatgcaagcactctaaccgcaagagtgctaaaaagatgcaaaaatttcagtgatatcaggccttagcgctttttcaatgcctacttttatgctacccttatgaagtgaggtgaggcaaatagatgactcaggattatgtcgctttaatggatgagttaaagactggtcagcgtgacaagatcacggtgacgccggaaacgtttatggcgtttcggtcggcatggacaaactatcccgatcgtgaagagattgtggggatggccaaacgcgatggtgtcatcgagtaccattaccggtcggtcgattcccgctaagtaagtgccaaatctcatgtggcgcttgtgataggctgaaaaaaatggtaaggtttacatgaattgttttgggtacgagtacgcacacaaactattcggaaaaacactagaaaaatctagttaatacgaaggagcagatcagtcatggaaaaacgcgaatttaacattattgcagaaaccgggattcacgcacgtccggcaaccttgttggtacaagcagctagcaagttcaactcagatatcaacttggaatataaaggtaagagcgttaacttgaagtccatcatgggtgttatgagtttgggcgttggtcaaggtgccgatgttacaatctctgctgaaggcgctgacgaagccgatgcaatcgctgcaattacggacacaatgaaaaaggaaggcttggctgaataatggctgaacatttgaagggaatcgctgctagtgatgggatcgccacagcgaaggcctatttactggttcaacctgatttatcatttgacaaaaagacggttgatgatccttcaaaggagatcgaccggctaaagcaggcacttgatcaaagtaatgatgagttaaaggttattcgagcaaaggccgctgaatcgcttggcgaagaagaggcacaagtttttgatgcccatatgatgattttggctgatcctgactttacgggtcagatcgagtccaagatcaaagatgaaaaagtcaatgctgaacaggcattgaaagaaatttctgaattcttcattcagacttttgaaggcatgacggataatccatatatgcaggaacgtgctgccgatgttcgcgatgttaccaaacggatcatggcacatttgttaggacgtacactgccgaatccggcattaattgacgaagaagtcattatcgtggctcacgatttgacgccttctgatactgcccaattgaacaagaaatatgttaaggcctttgtcactgacatcggcggacggacagcgcacagtgcgattatggcacggtcgctggaaattccagccgttgtcggtacggacgatgtcactaagaaagcgaccaacggggaaacgatctccgtcgatggtttgactggcgaagttgtcattgatccgactgctgatgaagttgccaaattcaagcaggctgctgaagcatttgccaagcaaaaagctgaatgggcgcagttgaagacagccaaatcggttaccgctgatggtaagcactttgatgttgctgctaatatcgggacaccaaaagatcttgatggggtcttggcgaatggcgctgaaggtattggtttgtatcggactgagttcttatacatggattctgctgaactaccgactgaagacgatcagtttgaggcctacaagaaggttcttgaaacgatgaatccaaagccggttgttgttcgcaccatggatattggcggggataagcacttgccatatctgccattaccgcaagaacagaacccattcttgggttatcgtgcgatccggatcagtcttgatcgtcaggatattttccggactcagctgcgtgcgttgttgcgtgcgtctgcttttggtaacttacggattatgttcccgatgattgcgacgattgccgagttcaaacaggctaagcagatctttactgaagaaaaagaaaagctggtcaaggatggcgtgaaggtttccgacaacatccaacttggcatcatgatcgaaattcctgctgcagctgttttggctgatcagttcgccaagtatgttgacttcttctcaatcggtaccaacgatttgattcaatattcgatggctgctgatcgtgggaacgaacatgtttcatacttgtatcaaccatataacccatccatcttgcgactggttaagcatgttattgactcagcgcataaggaaggcaaatgggctggtatgtgtggtgaagcagctggcgatccaatcatggttccattattgcttggtatgggacttgatgaatattccatgtctgcaacttctgttcttaaggttcgcagcttgatgaagcggctttccaccgaggacatggccaagatggctgacgttgcgttgaatgaaaatatttcaaacgacgaaaacgctgatctggttaagaagactaccggacaataaaatgtattgatttaaagaagctgtcaatcctttctagggttgacgcttttttgtttggaattgaaaaattggttgtgatctcttgacggaagatggggcacaagtctggattgtggcgttctgaaacgcgttcgccagcccagaaacctgcacataaggaccctgagcgcaatgatcaaagttcggtcctcacgctcaaggccacttatgctccggtttctaaccgggctggctcacgctctgaaacgcgttcgccggcgcagaagtctgcgtgtaaggacctcagtcgcaatggccaaggcccggccatcacgtctgaggccacttacactccgacttctaagcgcgccggctcacgctcttgttgaaacgcgttcgccagcccagaaacctgcacataaggaccttgagcgcaatggccaaagcccggccatcacgctcaaggccacttatgctccggtttctaaccgggctggctcacgctctgcagatttttcagaaaagtgctatggttattatgtaaactaaatggtcgagctgcgatgcggatctttgctagtaggtatggcggttcacctagtcgatgagggggaattgcatgtatttgcagaatcaaacaaagacaggcttgcgtcaacgacaccattcgttgatgagcgcacgtgttcgtttaaggttagttgccctgatttcaacaatgggtggccttctttttggctatgacaccggcgtcatcaatggtgccttgccatttatttccagtgaacttcacttggctccgggtcagcaaggctgggtgaccagcagtttgacacttggggcagcatttggtgctgttttagtggggcgtattagtgatcgttatggacgcaaacggttaattgctggattagccggattattttttctggcaacgcttgcttcgtcaatggcgccaagtgctatttggctgattggggcaagattgattctaggattagcggttggtggcgtttccgtgttagtgccaagtttcttagccgaaattgcgccaacaagccatcgcgggcggctggtgacccaaaatgaattgatggtcgtcaccggtcagttgcttgcgttcatccttaatgccgtgttagggacaaactttggtgatatgcctgggatttggcgctggatgcttgtgttggcggttattcctgctattgtcttgggaatcggcatttattttgtcccggagtcgccacggtggttagtcatgaaagggcgacaggcagctgcaaaggcgagcttgtcggttcttcgtgcaccgcaagaggttccgcgagaacttgatcatttggagcaaaccattgcggccagcgcgaaacacaagaaagtccgggtcacggcgcttaaggttaagtggattcggcggctagtgctaatcggaataggattgggcgtgattcagcagattgccgggatcaatgtcatgatgtattacggtacctcgattttgcaaatgaccggatttggtcgtaatagtgccttaatcaccaatattgccaatggggtaactgcagttgcagcaacccttgtcaccttacagttgctaaagcatgttccgcggcgtccattgctgatcatcggcttaatcgggactagtattgcaattactggcgtgaccttcgcgagccgcttacctgcaggctcttcatggcgcgcatttacaaccatcaccatgatgatgatttttctagcgttcttccaaggcgctattagcccgatgacgtggttgcttctatccgaaatttttcccgagcaattacgcggtttgggaatgggaacggcgacatttttcctgtggctcgctaattttgcggtcggcgttcttttcccgatcggcttggcaggcattggtatgttttggacttttgtttgtttcattggcaccaatctcgtttctttgctgtttgtcattttgtgtgtgccggagacagcaggaaaatctttggagacacttcatcgggatgaaaaaattcgtctgagtcggtagctttgaagttgagctgaaaatttttggtgaggtgtgcggtgtgttttgatggtgagaccggttgctttgtgaatttggaaaatgcgtttaccataacgtgcttcatggcgcagaaagctggatgtatggatcacactgcaatggttaagaggaggccatcacgctcaaagctgcttatgctccggtttctaagcgctccagtaaacgctcataaacgcgttcgccggcgcagaagtctgcgtgtaaggacctcagccgcaatggccaaagcccggccatcacgtctgaggccgcttatgctccggtttctaagcgctccagtatacgctcataaacgcgttcgccagcccagaaacctgcacataaggaccttgagcgcaatgaccaaaacccggtcatcacgctcaaggccacttatgctccggtttctaaccgggctggctcacgctctgttctggacaaaatgtttgcgctttttataaagtctggtacgatgacaatgtatcaattaattagatgaaccttcacaaaggggagccattggctgagagcggggagacccggacccttcgaacctgttcgttagtgcgagcgtagggatttgtgaatgtcggaaacgaccttctttgtgagtggggattcactgggaggctttttttatgcaacaacataagcgtctggttgtgattttggaaacagcgattattgcggcgtttgcaatggcgttgacttatattccgcatacaaccggtgtttcggcgattgaattgaactatgggttgattccgatcgcggttttggcgatgcggcgcggggcaattcctgcagcgtgggccgggtttgtatgggggattcttgatttgatcctccgcggccttagtggtggcagtgttttgaatccggttcaaggctttttggaatatccaattgcctttacgctggttggcttgatgggcttgacttttgcatcatttcaaaaggctgtccgcggcggtgagaaagtaaaagctagcggctatgcttttgctggcattattgtcggaacctttgctaagtacttcattcatttcatcgctggagttgttttttggggcagttacgcaccaaaaggcatgaatgtgtggatttattcactgatcgtcaacggtggatcggctttgttcagcaccgttttggcaatcgtggttgttggtattttactcacggtggcaccacaactgtttatagcaaaggatggtaaatcactttccactaaagcagcctaaaacaattagtttgttaaggcgctgtcgggggataagtgtgctctcaaaataagttagctttagagatgagattgtctctaaggctatttttttgctttaaaaagctggagttctcgaccaggtttgagcaaaacacgaacattaaaacgaataatatgcgttatagttctattttagtgttgaatgttgttgcttaacgtgctattctcaaaacatcttaaagaaagcaggggacgagatgcaaaaagtagccgtggtcatgggatcaagttcagattggccgaccatgcgacaagttgccacacagttagaggcgcttgatattccttatgaaaagcacgtgatatcagctcatcggatgccggaccagctggcggcatttggcaaacatgctgctgatcaaggttttggcgtgattattgcgggtgcaggtggtgctgcccatttaccgggaatgttagcggctaacacgctgctaccggtcattggtgttccaatcaaaacacgaacattaaatggcgttgacagcttgttgtcgattgtgcaaatgccaggaggtgtgccagttggaacgatggcaataggtgatgccggcgctgtgaacgctgctttgtacgcggcatcaatcctcgctttgcaaagtcctgaattaagtcagcggctggcggccttccgtcaggcacaaacgcaacgggctgaagaaagtgaggccacacttaatgattgatgtggttacctcacctgccacgattgggattatcggtggcggtcagcttggacgtatgttaacccaaagtgccaagacaatgggctatcgagttggcattttggaaccgacgccgaattcaccagccggtcaggtagcagactttcaaatcacggcaccatacgacgatcaagcggcactgacaaagttggctaaagaatcggacgttttaacctatgagtttgaaaatgttgatttagcagctttggaagcagtacgtgatttaacccgaatccctcaaggaacagctattcttgcaacaacccgcgatcgcatcaaggaaaaaacattcctgcagacgcatggtgtaccggtcaccccctttgtggcagtcgatcggcctgaggcgttgacagcggccattgagaaaatcggcttgccaagcatcttaaaaaccacgactggcggttatgatggtcatggtcagcaagacatcaacaccatggctgatgtacccgcagccgagcagttgctagcccacggtccctgcattttggaaaaacgccaacagtttgaccgtgaagcttcggtgatgattacccgcgatggccgcgatcaagtacgggtattcccgattgttgaaaatcgccacaagaaccacatcttgcatctcacactagcaccggcacctcatatctcaccggttttggctgaaaagattgatgatctggcgactaaaatcgcacttggactcgacttacgcggagttcttggggtcgaactctttctcgaaggtgacaatgtcgttgcaaatgaattggcaccacgcccacataactccggccactattcgattgaagcttgcaacttttcccagtttgacgctcacattttaagtatctgcggactaccgattccgccgattaccttaaagcagccagcggtgatgcgaaacctgcttggcgatgatctcacccaagccaaggcaaaatggccgcaacatccagaatggcacatgcatgattatggaaaagccgagatccgtcctggccgtaaaatgggccacatcacggtgaccgatgcgcgcgatgttatggacatacttaaacaaatggaggcagcatggtgaaaaagaccacattactatataccggcaaggccaagcaggtttttgcaacagatgatccggatgttttatggatgacgtatacgaatcaggccacagcattaaacggcgagaaaaaggcgcagattgcccacaaaggtgaattgaatcgcgccatctcgaccttgttgtttaaagaattgacggcagccggaattcctacgcattatattgattctcccgatgccactaccatgattgttaaaaaggcgaccatgctgccgttagaagttgtggtgcgcaattacgcgtccggacattttgtgaccaagttcaatgtcaagccgatgatgaagcttgatccgccaattcatgaatattattacaagtcggatgaattaggcgatccgttcatgaacgaagcccagatttttgctttacacgaagcgaccccggaacagctcaaacaagttcgggctttgactgatcgcgtgaatgcttatctgaccaagcgttttgatgaagtcgggatcacgttggttgattttaaacttgaatatggcacgttaacggatggcactttggtcttagccgatgaattgtcaccggataacttccgtctggttgatcaaaagaccggtgattcgcttgataaagatgttttccgccaagcgcgcggtcccttaacccctgtttatgaagaagtgcttgccaggttacaagaaaaaggagcggctcatgtttaaagctaaagtttatgtgacgtacaaaccctctgtattagacccaaaggcagaagttatcaagactgctttgacccgcatggattatcacaatgtagacgatgtgttgtacggcaaatattttgaattaaagctgaccggcaccaaagaagcggtagaaaagcaagtcgatacgatttgcgatcagttgcttgccaatgtcaacatggaaacttatcgctttgaattagaacccattacggaggatgaggcatgaaagcggccgttatttcttttcccggatctaattgtgacttggatttacagtgggccgttcagaccattgccggtgctgagtgcgagctgatcaagccgagtcaaaccgatttaagtcgttatgatgtggtgatggtgccaggtggtttttcttacggtgactatttacgtagcggtgcgattgcccggttttcgccagtgatgacggcgttgaaagcttttgccgaagcaggcggctatgtgttgggcatttgtaatggctttcagattctgaccgaagcgggtctgctgccgggcgctttgcaatggaatcgggatttgaatttcatttgcgaaccggtgacgttgcttgtcgatcgcgcggatacagcattttccaatcaatatcaggttggtgaacaactgacattgccgattgcacatggtgaaggaaattattacgccgatcccaagacgctggcagctttggaagccaatggtcaggtcgttttccggtatgctgacaatcccaatggcagtcttcatgatattgccggggtgacgaacgaagccggtaatgttttaggcatgatgccgcatccggaacgcgccgttgaagcattacttggcggtacggatggcctaggcgttttcaagtcattgatgcaacaaacgaaaggggtccatgtccgtgacgcacgttgagatgagtccagaagccatcgctgaaaagaaaccgtatttggctttgggattgacggaagatgagtatcaccggtttgctgagttgattggtcatcagccaaatgataccgaaatcggattagcaagcggcatgtggagtgaacactgtgcgtataaatacagtaagccgattttgcgccagttctggaccaaaaatgaccgcgttttgatgggacctggcgaaggtgccggtgtaattgatatcggcgaaggcaaggcagtggtattcaaagccgaaagtcataaccatccgtccgcggttgaaccttatgaaggcgcagcgacgggtgttggcggcattatccgcgacattttctcgattggggctaagcctgttgccatgctggattcattggcctttggtgatctcaacctcccgcacacgcagcatttagttgatcgcatcgtggccggtatcggtggctatgggaacgcaatcggcattcccacggtcggcggagaaaccaattttgatcacacttattcccgcaatccactggtcaatgcgatgtgtgtcggcattatggataaggatcagatccaaaaaggcaaagcggcaggagtcggtaatgcactgatttatgtcggtgccaaaaccgggcgtgatgggattaacggcgctagtttcgcttctggtgatttttccgatgaagaggcggctgatcgttcggcggttcaggtaggcgacccattcatggagaaactgttgatggatgcgtgcctggaaattacgcaggatcatcaacaggcactagtcggtattcaggacatgggcgcggctggtttagtgtcttccagtgttgaaatggctggcaaggcgaatagcggcatggaaatggatcttgacttaattccacagcgtgaagccaatatgacgccatttgaaatcatgttatcagaatcgcaggaacggatgttgttgtgtgtgcgggccggttttgaacaggaagtccttgatgtgtttgcagcgtatgatttggacgctgcagttgtgggacatgtgattgaaggccatcaatatcgactttatcatcacggcaaattggtttgcgatgttccagtcagttcattgactgatgatgcaccgatttatgagcaagtcggcaaaatgccagcgcgcttagctgaaccggcacctgattttgacccgattgtgactgatccggtggcgacttggaaagccatgatgggcacgccgacgattgcggataagtcttcattgtatcggcgttatgatgcacaagtccaaacgaatacggttgtcttgcctggtagcgatgccgcggtgattcgcattcgcgggacccatcgcgctcttgccatgaccaccgatagcaaaggccgttatctgtatttggatccaaaagtcggtgcggccatgagtgttgccgaagcggcgcgcaatctggcggccagcggtgcggaacctttagggattaccgactgcctgaattttggggatccgaccaagccggaagcgttttatgaacttgccgaagcagctaaaggtatcattgctgcgactaaagcctttaacgcaccggtgatttccggaaatgtttcgctttataacgagactaatggcaaagcaatctatccaacgccgatgattgggatggtggggctgattgaagatctcagcaccattaccacggcgaatttcaaacatgcagatgatttgctttatcttgtcggcgaaacccacggcgatttcaatggcagcgaattacagaaattgcaaaccggtgaagttgccgggcggttgttcgactttgatctcgatgcggaaaaggccaatcagcaatttgtattaacggcgattcggcaacaccttgtgacagcagcccacgatttaagcgatggtggcttgttagtggcgttggctgaaatgggctttacgaaccagctgggcgcgcaagttaaggtcgatttgccgacgagttggggcttttccgagactcaagggcggttcttagtcaccgttgctcctgaagatcaagcagcgtttgaggcgctaaatggaccggctgagttaatcgggcgggtacaagcagccccgcaatttgacgtcaccacggttagtcatcaattttcggttccgcttgaagaattgcaaactgcatttgaggaggcactcccatgctatctgaaccaaaaggcttaaatgaagaatgcggtgtttttggtatttggggcaatcccaatgctgcgagcattacccatctgggcttgcatacgctgcaacatcgcgggcaagaaggggccggaattgtcggcttaactaaagatggtatgcggcgccattatggtctgggcttgctcagtgaagtgttcaccaataccgatcaattgacaccgttgatggggcgggcagctttgggtcacgtgcgctactcgacagcaggcggccgcgtcttggaaaatatacagccattgctttttcggttttctgatgaagccattgcattggcgcataacggcaatttaaccaacgccatcagtttgcggcgtgagttagaaagtcaaggggccattttccaatccacctcggacactgaggttttaatgcatttgattcggcgtcaggttggccaaccgtggctggttcaacttaaaaaggcactgaatgaagttcacggcgggttcgcctttgtcttgttaaccgagcatggcttatacgcagcggttgatccgcatggtttccggccaatggtggttggggtcatgccagatggcggctatattgtttgtagcgaaaccgcggcgttggatgcagtaggggctgattttgtccgtgacatccaacccggtgagctgattacgatcgatgacgatggcttgcatttggatcacttcaccaccaacacatcgttagcggtttgctcgatggagtatatctattttgcccgtccggattcagacatccacggcatcaatgttcaccaggcgcgggtgcggatgggtgagcggttggcaagggaacagccggcagatgcggatattgtcgttggggtgcccaactcatccctgtcagcagcgattggttatgccaaagccagcggaattccttatgaaatgggcttggtgaagagtcagtacgttgctcggacatttatccaacccacgcaggcgttacgcgaaaaaagcgtcaaaatgaaactcagcgtgatcaaaccggttgttgccggaaaacgcattgtgttagttgatgactcgattgttcgcggcacgacttctaagcaaatcgttaaattgttgaaagaagccggcgccgctgaagtgcatttgcgaattgccagcccgccactgcgctttccttgcttttatgggattgattttcagacaactagtgaattatttgcggctaatcatagcgtaccggaaatgcgcgatttactggatgtcgaatcgctaggctttctttcgacacaaggcttggaagaaagcgtcggattgccaacgacggctcctaatggcggtttatgtgtcgcctactttacaggcaaatatccaactgctcttgatgattatgcaccggcgttaaataaggaagtcgcatcactcaaagttaatgtagcggaggttagcgcatgacagattataaggatgccggcgtcgacattgaagccggcgatgcagccgtaaaacgtattgcaacgttagccaaagaaacagccaatgacaatgttttggccagtgttggcggttttgctgccgcttatcggttgccatccgtgccgcagccaaccttgattagtgcgacagacggggttggtaccaaactgttgttggcattgcaatgtgatgcgcatgaaacggtggggattgatttggtcgcaatggtggccaatgatttgctcgcatccggtgcccagccattatttttccttgattacatggccgttgatcatcttgatgtaacccgggccgaagcggttgttcgcgggattgcttatggctgtcagcaggcggaaatggcgttgatcggtggggaaaccgctgagatgccggatatgtacccacaaaatcattatgatctggccgggtttgcggttggtttggtttccgaacagaatcgtttgcctaaggatgtggctgctggtgatgtcttgattggcttgccaagttcaggcgtacacagcaatggttactcgctggtgcgtaaattgttagctgaaactgatttagggagtcagacgcttgaagacggatcggaagtcatgcaggcgttgatgcggccaaccagaatttacgttaagcaggtgctgccgctcatgcaacaaggtttgatccacgccgcagcgcatattaccggcggcggtattaccgagaatctaccgcgggtgataccggcaggattgtgtgcgcaggttaatccccaggcatggcatcgaccggagttatttgatcgcctgcaacatgccgggcatttgagtgaaaccacgatgcggacaacgtttaatttgggcatcgggatgattttggtcgtcccggaacatgcagccaccacgattcaggcggcgttaccaagcagcaaagtcatcggtcacgtggttgctgatccaagcgccaaaatacaatggcaggtggcaagcaaatgaaaagtctagctgtctttgcgtccggaaatggcacaaattttgaagccttggcaaacgccgcgcaggctgtagacagtcactatcaaattgcggtcttagtctgtgatcaaatgcaagcaccggtgattcaaaaagcggctgctcgtcatattccgactttagttgtgaactttaaggactatgcgaataaagcggcggccgaaacttatattttaagccagttgccgcctgtagatgcattgattttagcgggttatatgcggatcatcgggccaaccttgctaaatgcttttcccaagcgaattatcaatttgcatcccgcgctgctgcctagttttcccggacggcagggcattaaagatgcgtttgattatggcgtcaaagtgaccggcgtgacggttcattacgtagatgccggaatcgacaccggcgaaatcatcgcacaggatccggtccgcgtaagcccggggatgacgctggcacaattagaagcagccattcaccatcaggaacatcaaacttttcccgcaactgtcaagcaactcattgaagaaggagcgatttaagtgaagcgtgcattattaagtgtctctgataaaactggtttggtaccttttgcaaaaggtctggttgaacgcggttttgaactgatttcaaccggtggtacccatcgcgcactggctgaagctggggttgcggtgaccggcgtagaagcagtaaccggttttccagaaatgctcgatggtcgagttaagacactgcatcctaagatccatgccggcatcttggcgcggcgggatgatcctgcccatatgcaggcactagcagatcatgatattcagccaattgatgtggtttgtgtcaatctttatccgtttgccgcgaccattcagcgtgcgggtgtgacgcgtgccgaagcgattgaacaaattgatattggtggcccgtctgcgttacgtgcggcagctaaaaatagtgacagtgtctgggccgtggttgatccagcagattatgcggatgttttagccggactcgatcaaaatgatgctgatttgcggcaacggttggcagccaaagtcttctccgtcactgcagcttacgatgctcaaatcgcccattacttagatccagagccattcccagagcaattcacgccaacttatcacaaacggcaggacttgcgttacggggaaaacagccatcaacaagctgccttttatgttgagccgaatcctgatccaactagtcttgccgctgctaagcaattacacggtaaagagctttcttataacaatatcaaggatgcggatgcagcattggcaatgttgcgggaattcaaacaaccggcagccgtggccgttaaacatatgaacccatgcggcattggcttgggcgatacgcttgaagccgcttgggacaaggcatatgccgccgatccgatgtccatttttggcggcatcattgctttgaatcggcgggttgatcttgccactgccgagaaaatgcataaacttttccttgagatcatcatggcaccggcatttgatgatgatgcctatgagattctggcgaagaagaaaaatgtgcgcttattgacgattaatactgctgatacgccagaagaattgggaacagaaacgacttcaatttatggtgggttgttgattcaaacacgtgacgacaaagctgagacaccagccgatatgacagtggtaacggaggtcaagccgactgaagctcaactcaaggcattggcatttgcgcagacggtggtcaaacatgttaagagtaatgcgattgtcgtggcacaggctgatcagacgttagggattggcgccggtcaaatgaatcggattggctcggttgaattggcgttaacccaagcgcagcaaaacgacaactttgccggtgcggtcatggccagcgatgcctttttcccgatggatgattgcgtggattacgcggctaaacatgatattaaggcgattattcaaccgggtggcagcattcgggataaggattcaattgcgaaggccaatgaatatggcattgcgatggtgacaacaggggttcggcatttccggcattaagcgggagccggttcacgctcactttctataacgcgctccccagcccagaaaccggagtgtaaggaccacagccgcaatggccaagagcgggccatcacgtctgaggccgcttacactccggtttctaaccgggctggctcgcgctcactttttaggaggtttttatgaaaaaagtcctggttatcggtgggggtgcgcgtgaaagtgcccttgctttgaaatttagtcagtcgccacaagtggatcatgtctacgtggcgccgggcaatccggcgatggagctgcttggtgtcgagccgattggtattaaagaaaaagaggtcccggctttaatcaagttcgcgcaaacgcatcagattgatttgacgtttgtcggtcctgaagtgcccttggcagcagggattgttgatgattttcaagcaatcgggttgccgatctttggcgtcacgcaaaaattagctcaacttgaatcaagtaaaacgttcgccaaagcgtttatgcatcgccatcatttaccgaccgcggccagcaagacggttcacaatgcgattgaagcacatgccgaagcaactttgatgggtttaccgcttgttctgaaaaaagatggcttggccgctggtaaaggtgttgtcattgccaatgatgcagcgacacttgatgatacgatcgaacagttttacgccggccacccggatgccacggttttgcttgaggaatatctcgctggcgaagaagcttccgtcatggcactttttaatgaccaaaagcgcgtgatcttgccgttgtctcaggatcacaaacggcgccacgctgctgatcgtggacctaacacaggtggaatgggtgcgattagtccgttgccacaatttaagcccgatcaagtccaggcggctcagtccttggtggatgccacattggcaggtatgcaccaagatggtttaaatggacacggggttatgtatattgggctgatcttcactaaagaaggacccaagattcttgaatacaacatgcgtttcggtgaccctgaaactcaggtattattgccacagatcgaaaatgacttttatcagcttgtgagcgacttgttggatggccagcagccaacgctgaaattgaatggcctagcctatgcctgctttgtcgcggtgaatcccgattacccgcgggcaaacctgaaaaccgttcccgtcattgtgccaacaaattggccaatcggtacttggttgccagcaggggtagagcgaaccgacaatggttggatcagtgacgccgggagaattttttcggttgttgccggggccgctaccttacctgaggcagttgccaaagccaagcatgacttggaaagtattcaaggggtgctggattatcggaccgacatcggctttcatgccttgaagtgataactgccgctagttttatgtaaaaagcaaataaacaagcaccgaagaccaatgccaccgtcttcggtgcttgtttatttgcagaaaacagctaggcccagatttggcacttaagcggcctattttcagaaatagtttaattatgagttgacaatcatcgtttacagttgtaaattataagtgtcgaaagattacaagtgtaaacggaggccaaggatggaaacaccgaaagttgaaatctcccagtcggaatgggaagttatgcgaattatttggacgcttggaccattaaaaagcagcaccattgcggcgattcttgctgataaaatggcgtggaagatagcgaccaccaagacctttttgggaagactcgtcaaaaagggtgcgctggtcaccgaaaagcaagggcgcgaatttttatatcatgcaacagttggtgagcaagcctcaatggatgcagccgttgcggagttatttagtcatctttgtcaaatgaagatcggtacgaccgtgaatcatttggtagcgcaagtgacgctttccaagaaagatattcaagcagtgcagcaaactttggcggctaaattgcctggtgcaccgacaacggttcattgtaactgcttaccagacggctgcaaggaggcaattgatgaagaaagataatatgaacccttcacaaaaaatgaaagaatcagctaatgacaaaggacagatgcaaatgagtgatcacgaccagatgcatgccgggaaaatgacggatatgtcaatggatcacgaacatatgcatcagcaaacggatatggcatctatgcaaatgagtcaccacgatatgggccatatggcgatggatcacagtggtatggatatgcacatggatcatggcaatatggatcatggtggtgggcatatgatgcatatgggcaatttgaagcagaagttttgggtcagcctcattgtcatgatccccgtgctgttattggcgcagtttatgggcatgaatattcatctcggggtcattgaattgccgattgtctttccggggtctgattgggtcgttcttgttttgtcgtcttttctgtttttctatggcggctggccgtttttgaccggcgcaaaggcagaattgcaacagcgacaaccggcgatgatgacgttgatcgcgatgggcatcacggtggcgtacggttattcgctttatgcgtttttgatgaataactttattgcgcctaatgggatggtcatggacttcttttgggaattggcaacactgatcgtgatcatgctgcttggccattggatcgaaatgaatgccgttatggctgcaggtaacgcggttgagaagttggcggcgttgttgccgaatcaggcacatgtggttcatggtgatcacgtgatggacatgccattatcagaagtccaggttggcgcgcgattacgggtattagcaggtgaacaaatgccggctgatggccaagttgtcagtggcaatagcagtgtcaacgaatcattagtgactggggaagctaaagctattcgcaaggctgaaggtgaccaggtgattggcggttccgtcaatggtgatggcgtcattgaaatcaaggtcaccggtacgggcgaaagcggctatctgtcgcaagtcatgaagttagttcaaagtgcgcaagccaataaaagtaaagccgagggtatggcagataaagtggccggctggcttttctacgccgcattggcagttgggttacttgctttcttcctgtggttgccaagcggggcggcagtggcgtttgaacgaatggtcaccgtctttatcattgcttgtccccatgcactcgggttagcaattccgctggtcattgcacgcagtaccagtattggcgcaacgaatggactgctaattcgtaatcgccaggcacttgagactgcgaagcgggcgcagtttatcttgatggacaaaaccggaacgttgacagaaggcaaattcaccgttgccaaaacaattgcctttaccggtcacgatcaaacgcaggtactgtctgtcatggctgctttggaaaatcattccgaacacccgctggcaaccgggattaaagctgccgccaagcaacaggcgttaaacctgccggatgcgaaaaacgttcaagtcttaaaaggcatcggtctggaaggcgaaatcgatggccaacgttatacgatcgtcaatgcccggtatctaaaagatcatcacttggcttatgatgaagcgcaggctgatcaattagcaggggccggtaactcactggcttttctgatccaggatgatcaagttctagggatggttgcagaaggcgatcagctgaagccgtcaagcaagtcgtttgtcgccgcgttgaagcagcaaggaattacaccggtcatgctgactggtgataaccacgaaaccgccaaaaaagtggccgatcaactcggcatcactgattttcaagccgaattaaagcctgaagacaaagtggcgcaagtcgaagcttatcaaaaacgtggcgttgtgatgatggtcggcgatggcgttaatgatgctcctagtctagcgcaagcggatatcggagtcgccattggtgccggaaccgatgtggccattgatactgccgatgttgtgttggttcatagtgatccagccgatattcttaacttcttatctttggctaaagcaaccaatcgtaaaatggttcagaatctttggtggggtgccggctacaacatcctggccattccactggcggcaggtattttagcaccagttggcttcattctcagcccggctgttggtgccgcgattatgtcgttatcaaccatagtggtggcgttaaatgccatgacactgcatttgaagcgcgcgtaatcgtatttaaaaacagcatccataccggcctactatcaagatatagataataggccggtattttgtgtacaatcgatactacatcttgtggtcaaaagatgatacgatgaaaaagacttattcgttggcgttcatttttgaagcgttgattgaatcaagaacacgcacggttgcgctttaacgtgactaacgcaacctgttaagaaaggcagatcttatgatgaccacagctcgtttaccgcagaatccgcaaccgaaagaatggcttgccagtgaactttcacaacaacgaattgctgattacaagccgtttaattttgttgatggggaaggggttcggtgtagtttatatgtctcgggctgtcgctttgcctgcccgggttgttacaatcgtgttgcccagaattttcggtatggtcagccatacactcaggaactggaagatcggattattgcggatctgggtcagtcatatgttcaaggcttgaccttgctaggcggcgaacctttcttgaatactcaggtctgcattcgtctttgccgccggattcgccaagagtttgggcatgataaggatatctggagttggagcggttacacttacgaagaactcatgcaggattccgaagacaagttaacgttactgagcctcatcgatatattggtggatgggcgtttcctattggcaaaaaaagacttaacactgcaatttcgcggcagctccaaccaacggattattgatgtaccggcaacccaggcggcgggtgagatcaagctttggaaaaacctcattcgataatagtttgaccccaattaaagtcgccgccgctggtggttgggttctttgctgcaaacaaaatatagacagataaaaaagcgagtagctagccacaagacaacaatgacggtcgtgtgcttagctactcgctttatcgttaaagaagatgtcctactcattttggttggatgaatcagatgtatctgttgtttgatgaagtgcctttttgggatgttcaacggtttgaccagcatcattgtaatagctgacatatggaaaatgaatggtgaccgttgtgccttgattgatcacggacgtcaacgttaagtgatgccctaacttttcggccaacttttctgctaagaataatcccaaaccagtcgatttatgatttgacaggcgtccattgctgccggtaaagcctttttcaaaaacgcgatgttgctcgtctttagggatgccgatgccgttgtcgatgatcatcagctgggtttccttgccggtgtcgcgaatggttgcctggatgcgcccaccttctggggtatacttgactgcattggaaatgagctgtgccaaaataaaccgtagccatttgttgtccgttaagacggtttggtcatcgccgttcagtttaaatgacaaacgtttgttaatgaagccattacgttgattggcaacaacgtcattaatcagcggtttcaattgcgtattatgcagcaagtaatctttcgaaaagctgtcaagtcgggaatagtataagacctgctcaacataaaactcgatttgatccagttgtaaattgaggttatccagcttgtcatcgggaacttggccctcaaaactttcggcaagcaatgaaaccgcggccaacggtactttaatttcatgtacccacgagtcaatgaaatctttttggtcttgatgttgagccaaaagcgcggtaatttgttgccgatgcaaggtcagaattttgttgtaagtatccgagacaacctgttccagtccggattgaccccctggtagcggccaatccaaagcagcatcttcagcattctggcgcgcctgcaagcgagcagcaaactggcgaatacggacaaaatgggcgataaagaaggcacttgcaaccaacgtgacgagtaagaccgcataccagaccgttgccaatttaacgcggtgttgcggatccagccaaacgatgatggcagctaaaccgacgcataaaatatagccgccaatcgcccaaatatggtctttaaaataatcgcgaaaacgcatggctgcctcctagggaacgatatagccttgcccgactttagtctgaatataatctttcaatcctgcttcttcgatttttttacgcaagcggttaacgttgaccgtgagcgtgttatcgtccacaaagcgttcatcttgccagaggtcgcgcaaaagtcttgaccggctgacaatttggccatgttgccgcatcagaatttgaagtaatttatattcgttcttcgacagattgatttccttttcgccaatttgggccatgccgttttttagattcagcatgagtccattgtgttcaaggacatcggttccttgatcggcataattataagttcgccgcaacagcgcattgatttttgcgatgaggacttccatcgcgaaaggtttattcaaaaagtcgtctgcacccatgttcattgccatcaccatatccatattggtgttgcgacttgagatgaaaataaccggcacctttgagacttcacgaatcttttggacccaataatagccgtcaaaaaccggcaaattgatatctaataagactaaatgtggtttttcctgcagaaaatcatcgaagacagcgttaaaatcagtcacaacgacaggctcaaactgccacttcttgaggttgtcagcgataagaccgctaattgtctgatcatcttctacaatcatgattttaaacacgcgaccaactccattcctgaacttatcgtacaagttttgtggccgagacacaaacaaaagtgagcgcgagccggcgcgcttagaagtcggagtgtaagtggccttaagcgtgatggccgggcttgggccattgcgcttaaggtccttacacgcagacttctgcgccggggagcgcgttatggacgtaagttagaacataagtggccttggccattgcgcccaaggtccttacacgcagacttctgcgccggggagcgcgttatgggcgtaagacagaacataagtggccttggctattgcgcccaaggtccttacacgcagatccctgcgccggcgagcgtattatggtgaaacgttatcgaaactttttctgatgtctttaatccttcccgtttagaacatttgaaggtcgcactggcatgttgaatgtggcggtttttggtatgatgatgacggaggtaagcccatggcaattttggaagtatctaatttaagtaagattttcggccagcgccacgatcgggttcgggccttaaacgatcttagctttcaggttaaggcaggtgagtttattggcatcatgggtcctagtggtgcgggaaaatcaacccttttgaacattttggcaactattgaaacgccaagtacggggaaggttaggattgccggccatgatctagaggcgcttaatgaacggcagcaagctaagtttcgccgtgatcaccttggttttgtttttcaagactttaatttactagatgatatgacggttgcccaaaatgtcttattaccactgacgttgcaacatcatgtgcagcctgaccgggccgaacggttacaaatggtgtcaaaacaccttaatctggatgctttgttgaacgcttttccgggtgagcttagtatggggcagcggcaacgggtagcagcagcgcgtgccgtgattacacaacccagtctgttgctagccgatgagccgactggcagccttgattcgctggcagcaacagaatttttgcgttatttacgccagttgaatcagcaagagaaaacgactattttaatggtcacgcatgatccatttacggctagttttgcgagccggattatttttattaaagatggtgccttttttgccgaagtaacccgtggcaagtcgcgagaacaattttttgatcgcatcattgatatggaagcgaccgttagtgggggaggccattcacgtgtgggaacagattaaaacgaatctgattcggcatcggcacgaggacggcctacagatactgattgctgccttgattagtgcgattatgtacgcgatcggtgcagttgccaataatcggttaattttaagtgatgccagtaagcgacttggtagcttggatattgtgccgagcctgttgatgattgtcatgatggtgttggcacttttttcaatcagtttcctgctttatttgaatagtctgttaattggccggcgtgatcaggaaattggcttataccgtcttttaggattatcaggcgccaaacttgggctgattgtctttcttgaaagtgtgatgatcggcatagtgggcctgtttgtcggggctttgcttggcttgattttatcgccattgctagggatggtgttgatccggttaatggcattgcacacacccatcggctttatgttttctttgtccgcattaatggacgtcttgacgttgatgggagttgtttatcttttagtcggtgcgatcaatgcgatttatgttcgcagtccgttacgccagtttattcgccagcaagatgtcccggcaccaccaaaaccgcaaacccgctggcgcttctgggtcggtatttttggctttttgttgttggtcggcagtttgttgacgatgttgcgtttgcttccaattggcggtcgcttgatgcgcatactctcctggcttccgggaccgattgtgttaccactctttttattgttggtgatcggcgccttattgctcgggttgtttttggtttttgcttatttcctgccgggactggtagcctggtatcaaaaacggcacgagatgcaaacccataatgcgagcggtatttcccgacatctgattattaagcgcctgcaggggaatgctcattcgttgtggttaaccacgttgctgtgtgcgatcaccattaccatgctaggtagttcagtcatgctttttcaatataatcaggatttggttttacgtgagattccgacaaccatagtcgcatcaggtgtcggtgttgataatgtgaccgatattttgaaacaggcaaaagtcaaaccgaagcaggcgatgacgattccttcaaagctggtttatgctgaaattcgtctccgtaatcagattggtgaagtgcgtaaacagccgggggtctataatgtggttgcgttacgtgattaccagcgcgcggctaagattcaacgggaattaggaccgattcggttgcattcacaagaggctaagttgatgcttccgaccagaagcggctttcggccagttggcgccagacgtaatccgaaccgcgccattatcctgcctggcagtgatacatcgttacgtctgacgcagacgaccaatctttttccaaccggaagcaataattattttgaccgtggtctgttggtgaccaatcgaacctttgatatgttgaatggaacgccggatcgcttgtatatggctaaattgccaaaaacaaaagctgccaaacgcgcacttaccttgctgcagcatttgggcaacagtaagaatctggaagagtttgttaatattggcatacaacagcgtgaaggcgatgatttaacggtgacggatcgagcgagcaccaacatggtatattggcgcaaccccattggtcttcaggcggccgagcagaatttcgtcagtaccttatatgggttcttactatttttgatcttattgcttagcggtgtattcgtcgtggcaaccggaagcatcttgttgttgaagcaagtgatcgcggtgcggcaggaaattcgccattttcagattctgaaacagttagggatggatcctcatcagattcgggtcacgctttatcgccaggctgcagttatttttgctgttccgctcatctgcggtattctgatcgccttatgtgtcattagtgtgatgaccaattatcttgataatccaccctcgcgctatttaggcgtcatgattggcatttacgcagcatttgattggctcttttacgaagcaaccgttcatgtgatggttcgcatgatcgatttaccgattgggcggtggcgaactgaatgaatttctggcatggaaaaacaccagcatgtttgaatcgccaaaacccagtctgtaaagccggacgctgaatcttggtggcaaacttctggtgtcgagtagcttggtgcgggtttaaatttttcattccatcaaacgcagcaaccgctacgaaaatgatttggcggttgacactgtcactttttgtgcgggtcgatcacggtataaccggcctcatgaaaaccattggcagaggcagcacggcgaatgaattccttgactgatgcgagtgccggcgtattcttgaattcgtaatagtcattgctcgtttgccagactgacatcaccaggaaattgtccggatgtttggcttcctgcgctagtaaaatatgattttcgcccaacaaaatatcatgattatcgatcagttgtttaattttggataagaagactttgacgtcatccgtatcaaggttaaagtacatgaaatgcacatagccgctttgctcggttttccctaggctagctaaaatttcatagcgtaggggagcactgaatgtggcttgaccgctgggatcgaaaatcatatagtctagaccgctttgtgctggtttcaagagttttagttgcggatcatggcgttcatcaagcaatttagtcagaaaagacttgctgccgaaaaccgtttgtattgtggacataacgaccacctccacttttattataaacttcttggcggcatttcactttgaaagggaggaaaaactaaatgaaattaacagttttaggttatctcggcggctatccggatgccggacatgcaacgagtacttatttaattgaaagtggcgactatcacttactgatggatttaggtagtggcggtttgctggcattggaaaaggtttttgacccattgcaattggacgcggttttgttgacgcactatcatcatgatcatacggcggatgtcggcgttttgcagtacttctatcaactgcgcaaggggaacaaaaaagtgtcgccattgccaatttacgggcacacaaaggatcctttgaactttgggagcttaacgtttggttcgtttacgcaagggatcggttataccggagacagcaccttacatttagggccgcttacgttaaccttcctggagacacagcatccggtcccggcgtttgcggtacggattaaagaagaaggcaccaacaaagtacttgtgaatacgagtgatacgcgctatttttctggattggttccctttgctaagcacgctgacctgttgatggcagataccaatttccttgccgatcaaccagcgccacgatggcatttgaccgctccagaagccggaacgttagcaaaagaagcgcaggtgaagcgtttactcttaacgcatttgccccaacagctagatcttgtcactttgaaggatcaggcacaagcagtagcgggtggtataccaattgacgttgccggggatgacttgacaattaatgtctgatagtgatgataactgatcgtttaaaatgagaggaaaatgttaaaaatttagttattataacttggggtatttattacaattaaacttataaagacgttgatagatcgcgcaatatcaagactttgaacgcagaattttcatcatttggaaaattatttttctaaatgtgattgcgccgctttgaggcaatctcgtatactatacctgtagttgagaaagatacctcgtcaaagaaaaggagcgagcgctcatggttattttatatacatccccaagttgcacatcttgtcggaaggcgcgcgcctggttaaaggaaaataagattccattccaagaacgaaatattttttctgatccattgaatgttgatgaaatcaaacggttattgatgatgaccgaagaaggaactgaagaaattatttcaacacgttcaaagatcttccaggagctcggcgttaatattgatgaactgtcaacgggtactctgattaagttagtggcgaaatatccaggtctgttacggcgaccgatcatgatggatgacaaacgccttcaggttggctataacgaggatgaaatccgccgcttcttgccacgatctgttcggactttggaattgcaacaggcgcaattattggctggattttaatgattaaattactgacatttttacaaacacttgcttgatgagcgcttttgttgctcaagtggggaaggaaaaaagaactgccttggcacaatggatcgccgaggcagttctttttgcgtacaaaatgagtgcgattttaagatttcaaagcttgcgacttgatcataacaggtacgtgcggtagaatgccgtgaagtacgaaatctgctataatgtagtaagtggtcatgtgatgaaccacaaaagtcagggttccgtgactaaagtgaggtgcagcaatcatggaaatggaacggattaacgcaaatacgatccgggtcatgttaggcaacgatgatctagcgcagcggggaattaccgtgctggatttgcttggtaatcacaagcagattgaaagcttcttctatagtatcctcgatgaagtcgataaagatcatacgtttgcgacaaacgaggccgtgacgtttcaagtcatgccaagtcagtccggactcgagttgttgatcagtaagaacggacaaaagaatgatgatagcgacaccggttctgatggtgatagtgcggatacccaggtaccggattatattcgccagcagctgcaggggttagatgccaacgatcaacatgatcagcaagctgttgacgaaggcggttatattgatgctgccaaagcaccacaaaccgaattagtcttaaaattaaaggattttgaagatttcatcagccttgctcagacgcttcgcttggaaggcggtaagagtgatctttatcgttacaagcaaaactactaccttgttttgactttctatccaaacgaaatttcatctaatgaagcgcacgatgaaatggcagtcgcactggaatttggtgatcggtcaccgttgtcatctgcggttttgtcggagtacggcaaacgattgatggaaaccagcgcattagaaacagcgcggtattactttaagtaaagatggtttaaaaaacccgctcaaatgagtgggttttttcgtgttcttaaacttagcatctctaaaaacatgacgcgaatcatttaaaacggactattatccccagaggagaaactggtcatgtaattcagcagctgatcggcataactagggtgatcgttcatctgacgtaaggtcgtcttaagtgttgccagttggtcagtgatgatcccatctgcatccataaacgtcattttctgcatatcatcgctatcgttgacggtccatgcataaatcgcctgatgccgtgcatgggcttgatcagtcacggtcgttgaaagggtggttgattctaacgtataaccgcttgctggcgttgcagggaaaaccagtgtatatggcagaataaagaacgtcttgagtgtcgggaccttcttacgcagagtggtgaccacatgatagtcgagcgaatgaacttgatcatgatctgccaataagcgttgcgcatatcgctggataaaatgatccatcatttctgggctgtcatagggggttgttttgatttcaaccaataatttctgatggactgcttcagcggcggccagatagtcatcgaaactagcgactttggcggcgtgcccattttcacgcgcggttagctgtgttagttcagccaaagttaaatcatgcggccgagcattacgtccggttaatgcgcttagattttcatcgtgcatcacaacaaattggtgatctttggtttcgtgcaaatccatttcgacataatcgggtttttccttagcagtggcttccaacgccgggatcgtattctgcacgccattttcgttgtcaactccgcgatgtgagatggttaatggctgggtcgttaaggctccggttagataagcgtggtaaaaagcactggtgctagcgacaaccagcaaaattagcgctaaagcactgagacgaaaaagtaccgtccgccgccgtttcgacactggcgcatcaatcgtttgcacggaaatgagttgaaaagtttctgcttgggcggttgctaattgatacagcatgacagtaaagaaaaccgtgatcagcaaaagtgtgacctgcaataaaccaagattaatggttgcacctaataatgaccactgctgccattgctggtctaggtatgtctgaaacccatataatccaaggatcagcaacaccgtcagcaccatcaccggaatgacaatgaggatgattgaaaagagtgttcgccaagcctgaccgcgtgttgcttgccagctgcgaacaaccgttgctgcgggatgctcatcaccaaggattaaagctggtaaaagtggtaataggcgcacagccaaccaggtgccaattagatataacaaaacaaccagaattgcaaaataccagcggtccaaaatgaaatcaatgatgaaatcgggaatcgtcaatttggccaataaactggttttaaacacgatactcgagaatggaaaaaccaaaacaaaataggcaatcaaaatcataatggttgtgggcgtcaagcggcgggtctttttgatcgttgctaaagccagctggcgaaaatttaaatgcgtctgccggtgaatgttttgaatgccgagaattagaaacgcaaactgccaatagacgaacagcagtaatagcaagccaattagcaagagtaagacggcggtacctggcttttccacgataatcgtgcctaagttggttaaagtgatgtagggaacatttcctagacgcaggatttgttgcgcactaaaagtcagcagcgggataattgccagcccgactgcgagattggttacgctgattagtagaaagtaggcgccccagtgatgggcaaagtctttggtgtttcgggtaaacaaagaccagactttgatttttttcttcatgataaggttttgagttgtcctttgaagtcactaatttgagtgtagccttttgtctgcataaccgccgctagctctcgtttgaggcgggtgaacaccgctggcccttcttcttgtaagagggtaccgacttgaaccagactagctccggcaaggattaagtcataagcatcgcggccattggtgatgccgccggtgccgatgatctgaatttgcgggttaagtcgttgggcaaaagcgcgaacgttggcaagggcgattggcttagcataagcaccgccgacaccaccgaaaccgccttttggtttgattaaaacagtatcggtttctggatcgatcatcaaaccattacccagactattgatggagttgacaaatttcaacgggaactgatttaaaatagctgccatttggtcaaactgagccaaatcgaaatacggcggcaacttgaccccggctggcttagtgaagaagctaaacaggttagtcaaaacttcttgcgtacggtcaaaatcataaccggtttgcggcttacctggcacattggggcaactaagattaaattcaaccagaccgttaaaatccgaatcttcaatcgtgtgtgccatcgccagattttcttccatcgacaaaccggcaactgaaatgaaaatgggctgatcagggtgcgctttttgaaaattcaaggcgtagttgaggtagtaatccaagccttcgttaggtaagcccatggaattgattgagcctagttccagacgggcatagcgtggactcgggttacctagccgctttgcttgggttgcacttttggtaaccaaggtgccggcatcgctttgcaccagttcgtctaattcttgttcggtgtaacagcgaacgccgcttgcattcataaatacattatcaaatttaaagccatcaatacttgtacgcagatcagtcataaattcgcccactccttcaatatttgctgttcccatttaagcatagaaaagcctcagaaaccagtcactcaccccggcgtaaccaaaaaagcgcccttaaacttctgttcgtgaagtttaaaggaacgttttgagttatatgcaaattcatgatcaggcggcatgctaggtgaaggcattaaggattaacgccgccaacgcaatgccaccgctaattagtgtcaaacgccgcattttttctggatgatgatgactgagcattaaaatgagccagcctaataaaccaatcagagtcagaacactcgcaccaatgaaaataatcaaaagtccaattcgaataacttgcatgctaatgtctgcctacaaagccaaattgtcattgggggtcacgagaccggcaagtttagccgctttttgacgaatgtcggcgggtggcgtttgcggaagcgtaaagtgcgtttccattttatggggatcgaagtctggtgtcacgctaaccaaagagtagaaaacgttgcttgccacggtgtcgggaatatcagagagtgtgtaagcgcggatttcagcttcttgctttggcagatggcttaggaaatcggccagaacgcgatatgaataataaacagtttcctcatacgttgtcccgaccgcctcagcattaggaatattaggaaaactaatgtgataaccagttttggttttctcgttgcgcgccacaaaataatagtggcatcccgtctttgccatctcaaccactcctcttctttctttttattataacacggtgagaaagattaacaacaaaattacccgtactcatttttaagatgttttctcattaaaatcatagaaaaaagtaccgcttgagtctttgcaaacctgcttcgccgtgatacacttatatgcgttgatttgcggtcgtagtttagtggtaaaactccagcttcccaagctggtgtcgcgagttcgattctcgtcgaccgctgtatagatccggtgagaaagaggaattcaggtcatttgacgtttaaaagtgagatcggctagtgcaaacgatcacgtctaacctgttggcgcgcttttgaggatcagtgttttgagtggactcatgtcaagcagagtggtaccgcgggtgtaggctcgtctcttcgtaaagggagagatgggtcttttttcgtggcatcatgatttaggaggaaattatggatttcaaagaacttgttgttaaagcgcttgttccggttttggatggtcagctggatgaggcgggcatcaccgcgttagttgaaacacccaagtcatctgatttaggcgattttgcctttccaacgttttcattggcaaagatcttgcatcaggcgccgaagatgattgccagtgatttggttgcaaagattgacgcgtccccgtttgagcaggttaaagcagtgggcgggtatgttaacttttatctagacaagatcagttttgcccatgaagttttaaaagcaattgcccaatccggcgagcattttggcgatgctaagcttggtgaaggcaatgtgccgattgatatgagcagccctaatatcgctaagccaatgtcaatggggcatttgcggtcgacggttattgggaatgcacttgctaatatcttgcagaaggtcggttactcgccgattaaaattaaccatttaggtgactggggaacccaatttggcaagctgattgttgcctataaaaaatggggatcggaagccgatgttaaggctgatccgattaaaaacctgttgcagtattacgttaagttccatgaagtggctgaaaccgatcccgagttggaagatgaagcgcgggcatggtttaagcgattggaagatggcgacaaagaggcaatcacgctatggcggtggttccggacggtttcactggcggagtttaaccgaatctataaaattcttggcgttgattttgattcatataatggcgaggcgttttacaacgacaagatggatagtgtggttaaaaccctggaagataagcatttgctaaaaaccagtcaaggtgccgagattgtagacttaagtaaatacaacctcaatccggcgctgatcaaaaaatcagacggcgccaccctttatatgacccgtgatctagcagcagccattttccggaaagaacattatcattttgtgcagagcctctatgtcgttggtaacgagcagcgcgaacatttccaacagttaaaagcagtcttgctggaaatgggttacgagtgggccaatgatatacaccacattccattcggcttgattacagccaatggtaaaaagttgtcaacccgccgcggtaacatcattttgcttgaaaaagtcttaaaagatgcagtgggacttgcccagcagcaaattgatgagaaacatccggacttaccgaatgcagaaaaagttgcccatgaagttggtgtcggggcggttattttccatgatttgaagaatgaacggctggataactttgactttaacctagaggaagtcgttcgttttgaaggcgaaactggtccgtacgttcaatacaccaacgcccgggcacacagcatcttgcgcaaggccaacattgcaccggcgccggaagtagccttgagtgatccggctgcgtgggatgttttacgggctttgggtgattatccaagtatcgtggtgcgggcggctaaagagtatgagccttcagtgattgcaaaatacgcattaaggctggctaaggcattcaacaaatattatgccaacgtcaaggtgttggttgaagacagtgaactgccggctcggttggcaatggtctccgcgacgactcaagtcttggagaatgccctgcacttgctaggagtggcggcacctgaagaaatgtaatcacttgtgtggatgaattgagtcttgtttcatgacgcggtcgacccggcagagacttctaaccgcgccgggtcgcgctcatattaacgcgctccccggcgcagaagtctgcgtgtaaggaccacgaacgcaatggccaagagcgggccatcacgttcgaggccgcttacactccgacttctgagcgcgccgggtcgcgcttaggaggttgttgaatgaataagagtgaacgccaagctgcattggcatggattattaatcaaaaaccgatcgcaacgcaagaggagcttttggcggcattgaaggcggctggtattgatgccacccaggcgacaatttcgcgtgatattcgggaaatgcaaattgttaaagcccaagatgccaaaggaactctgcgctatacgatttttcgcgggtcagaggagtcacagcttgaacggctggggcgctcgattcgggaagtcggcttgacgatcactcgggttcaattcctgaatgtcatcaagacgctgccaagtaatggtaatttgttggcggccattatcgatgatatcgattttgatcaagttgtagggaccatcgccggccatgatacgattgtcgttattagccctgatgaaaaacaggcaaaatggtttgaagaggcttatcgtcatgcttttgatcggtgagttgaggtaagttgtggtttaaaagagctcccataatggttagctaaaaacgctagcgattatgggagcttttcaggttctaactgacatgatgggttgaggattcaaagagcgctgatcgtatagcttattgacgaaacgggcttggactggtgaccgttagaggctcaatcgtcagcggccggatcagacgtacgcgaaacgcatgtaactgcatccgagtggctgtttccgtggctgcatataaaggatcgccaatgatggggaagccgatactggctagatgaacccgaatctgatgggtgcgtccggtttctagattaagttcaatcgtggcagtatccgcggtttcggcaattcgatgatagtgcgtgacagcaaaggcaccatcagcgcgaatcatccgcttacgtttatcgtcaggatcgtgaccaataggagcttgaatcgttcctttttccggaatcccgctcggaaccacggcgagataatcacggtgcatggttttcgttgttagttgccgattaatgatggcttgtgctaacggatttttggcaatgactaataggccgctggttgccatatcaagtcggtgggtgataagcgctggaaaaggagccaaataagcagcagcctgattcattaaggtgccggtttcgccaggttgatttgggtgggttttcatgccggcgggtttgtccacgatcaataagtcgtcatcctcataacgggtgttaagatgcggcgtttccgggacataggttcgatggacaagctcatcataagtcagcgagataaggtcaccatttttaacgggctcgttaaaatggcggtagtggccgttgacctggatggtttgtgccacgcgcatctgatgttggcgtttccgggggattagccagtcttgaagttgatcccggaggctggcgtgattctgggcaatggcggatgtttgaaataacaagaggactcctcgattcgtttggtcataaagtttgcttaaaaacagccggtcgagacttggctgacaacggcctatgctacaataaataagattcataataggaggaaggacatgcaggttctatcacgtgtctggcagagcattcggtggttcttccgccgatttcaggtcattcgctggctcattttacttgggttgacggtcatcctgatcttctctgcctggttcacttataaagcaaaaaccgctgatgttcaaaatatcaagagcaccttacagaccaaaacagttatttacgatgctaacaatgaagaagcggggacattgtacggtcaaaaagggacgtatgttgaactcagtgcgattagtccgcaagtccaaaatgcggttatttcaaccgaagaccggacgttttactcgaatggcggcttttccattaaaggaattttgcggtcggcgttgaactatgttatccatcatggtcaaattatgggtggtgggagcaccatcacgcaacaattagccaaaaatacgttactgacgcaaaagcagaccatgctgcgtaaggcacaagagctattcatggcgattcaactgaataaagtttactccaagcaggatattctcgcgatgtatctcaacaatgcctattttggtaatggggtttggggcgttcaggatgctgcaaaacgttatttcggcaagaatgcgagtcaactggatgccagtgaaggtgctattttagcagggatgttacgtaacccgagttattataatccggctgatcataaagacaacgcgatttcgcgacgtaatgtggttttgcagctaatggtggataaccacaaattgactcaggcgcaggcaaatgcagctaaagcgcaatcggttcaggtggtggatgctttttcaaacgccaacgcacagaaatatccatcttactttgattcggtcatcgaagaagcgcgcagtgaggggattagcgttgatgatattctgaataaaggctataagatctacaccaatctggatcaaacctatcagcagaatctgcaaaccagttttgaacaggactgggcttttccggctaatgcagcagatggtaaacaggttcaaggcgcatcaattattctggatcccaagactggcggcgtgcgcgcagttgtcggcaaccggggcgaacataccttcctagggtttaattacgcgactcagctgcgtaattcgccgggatcgactatcaagccgctgatggtgtacacaccagcgttagaaaacgggtatcactacgactcgattctgaaagacgaaaagcttagctacggcaaaaataattataccccgacaaacgcgaccggcacataccttggcaccgttccgatgtatcaagcactggcggattcgatcaatgcccctgctgtttggttactcaacaaactcggggtacaaaaaggcgttgccagccttgatcgttttggcattcagctcaaatcgagtgatcagaatctagccgcagcccttggcggtttaaaaaacggggtttcaccgttgatgctggcgcgggcatacgcggcgtttgctaacgatggcaagctgccgaccacgcactttattcggaaaatcgttgatgcgagcggcgaaacggtggttgataattcccatccggcaacgcgtcagatcatgtccaaaaaagtcgctcaggaaatgaccagtatgatgatcggtacgtttaacgaaggcaccgggaaaacggctaaaccgtctggctatacaattgctggtaaaactggcagtaccgaggttcctagcagttggggttatggcaccaaggatcagtgggtagttggttatacgccggatattgtgaatgcaacttggattggttatccgacaacggatagccagcactttttgcaaggtaccagcacatccggtgtggccccgttgttcaagcttgaaatgtcgaagctgatgcccaatacacctcaaactgcctttgacaccaaggatgccgcccaaatggccagcatccaaacaccgggaaaaagtgatgacacttggcaaggaattcaagatagtatcgataaaggtatagacagtgccaaggaaactgtgggaaaatggtatgataatattaagagctggttcaaataggctcaaaaagtgaggtaaagcatggcaaacgtttacgacaccgcaaatcaaatggcggcagatatcaagacaactcaggaattccaagatcttaagaaggcatttgatcttttgaaattggacaccgttgcatatggcttgttccagcagttccaacaaaagcaatatgagatgcaacaaaagtcaatgcagggacaggattttaccgatgaagaagtgaaatcactgcaggcacttggcgacaagatgcgtgatattcaaccgatccagaacttgatggctaaagaacaaggcctttcccagatgatggacgaattgaataagatcatctcccaaccaattattgacgtttatcaaagcaagccataagttattggctcacttaaacaacataccaacttgggttagcgaagtggcatgtcgataaagatcaagtaaaatcggttctgagaagacatagctcgttttattttagacggcttgtctttttggaaccgattttttatgcgatggaatccgataaaagccacgtgcaagcggctcgaagtggtggaggaattgaaaacgaagaatcgtgtctgtgttcatgctgccatgtgcctgaacgatcccttccttgtactttccaactgacatcggtatgatttaattagcttgaatagtaaaggaaaaggtgacgaccgtggcaaaacggctttttgattaccataatgaagaagatgtgcgacttcctgtattaattaaatcagcggaagtccgggtagcaaaaaatggcaagaaatttattgccatgatttttcaagacaattccggccatatttcgggtaaattctgggatgcaaccgaaaatgatattgcccagttcaaagccggtgaagtggtgcagctgtcaggaaagcgggaattgtatcaaggcaacccgcagatcaagatttactcaatgcgcttggcaactcaagaagaaggaaatgatccgcgtaccttcgttgaacgcgcaccagaagcgcccaatgccatggaagaagagctaaacagtttcatttttgaaattactaatgccaattggaatcgaatcgtccgaaaactgattcaagatcataaaaaagcgttcttcagttatccagctgccaagtcgaatcatcatgcctttgccggtgggcttgcttttcataccctgagtattctgcgcttggctaaaaatgtggttgcccagtattcaagtttgaacaagaccttgctttatgcgggtgcgattttacatgacttgggcaagacgattgaattaagtggtccgatttcaactgaatatacggtacccgggaatctgattgggcatattgtcctgattgatgaacaaattgtgttggcagcccatcaactaaagatcgatattaatagtgaggatatgctattgctgcggcatgttgtattagcgcaccatggtttattggaatatggctcgccggtgcggccgcaactacttgaggcccaggtgttgcacgatttggacgaaatggatgcctcaatcaacatgatgacgactgcctaccaacatgtcgatccaggcacctttactgaacgactctttggcatggacaatcggcgtttctaccggccaacaaatggtcaaacatatccggatccgcattaagagctaaagacaaactgcttgtgattagaaagccgtcgtcaaacttaaatcatggttttaccggaacaaaaaaaggaactgggacataattctatctcaggatgtgatacttactaaagtccgaatactttaatagaacgggtcattaaaacagttccgggccgtgccaaactacgcaatctccggccagatggggctggaacgctgtgacggcgcttggagcctgcaagcccggcagtctccaagtcgcctaacaacatcagcgacaaaaaccggtcgctgtgttgtttccacggctgagccccatctggcctacgattgctccgccttggcactaaagtccttaaagtctatttacactaatgtaaggaatctaaaaagcgaaccatttctcgattttagcgagaaacgattcgcttttattttgaagctgtgaattatggctcagcctctttgcatgactcaatttcttacttatttgctagttgaagaacttgagctggtgctgaggtagcttgaaagcacatctttaagatcattgtccttgatcgaaacgttggcttttttaagtaccttggtaataataccgttcataacggttgaatcactttgccatgaggtgtagatctgcttttcaagatccttcttgtgttccttcatcgtaccttttttggcaatggagataacacggatgacgtggtaaccgtattgcgtcttaaccggtgttgtggtaatgtcgccagccttcttgagtttgaaagcagctgatttgaaagtggaatccaagctggtgtccgtgttgtcaaaggcagctaacttaccacctttattcttggttccggtatcaattgagttcttcttagctagagattcgaagttcttttcggttggatctttttgataatctgaaatgatctgtttagcttcatcttcggtcttaactaaaatatgctgaacctgaatctttggctgatacttcttccactgactttcaatttgcttggtcgtcggttttttcatatccttgagggcaacttcagagtaaagtgttgtccgaatttgatccttgaagcttgattcggtgtagccgttttgttccaaagttgaatcaaatgaagagccgtattgcttctttagcttgttgaactggctgttaacctttttatccgataccttattcggatattgttgttctaaagcctttaagacgatcatgttacgcaatgttgcctgaccggttgtggtctttttcatggcgtcatagtactcgtctttggtgaccttggcgcctttcatatttgcaaccgtgctgctggaacagcctgctagggtcactgctacgaacaagccaacgacaccgagaatccattttttcatgtaatcacacatcctaatctaaaaagtttcggttaacactgccgtctactataccataacttacggccgtacgcggatcttcacataactttcaagaatccgtcacggcttgtataaaggcaacggtagttattttcaatgttttggttaaggtttggtcggatgcgcagattgattttcttcaagtccggtgatcgcatcattgatattgtccacatgttctttgatggcttccgtgcgcggtgcggtttcaaattcgaatgtctcaacgctggccgtaatatctttcattgccggtttaagggtttggtcgacttcggcagatagttgcgttaacgccgcgctgacttgattgatactttggcgaacctgaccgacaccggtagcgatgccgttaaaataagcagcgatcgcttgttgccgttgtcgtccggtttttttggcggtcaataagccataaatcgtacccgtaagagcacctaacaagagcccatcccgaaatttcatacttaagcctccagttgggtgcggattttggcggccacttcttcaagcttactggtgtcatattgagcactgtgatcgccaaaatgcatcccgaaatcgtcttgattgctgtaacgggggattaaatgaatgtgtgaatggaagacgctttgataagccactttgccattgttgtttaaaatgttcatccctttaatcgccggattactggctttaatcgcacgcgcaatttttggaacgcgttcaaaaaccgcagctgccagctcagtgtcataggcaaaaatgtccggcacatgttttttaggaacaatcagcgtatggcccggggtgacctgagtgatgtccaggaatgccttgaccacatcgtcttcatagaccgcaacgtttggaatctcattgcgaacaattttacaaaaaatgcaatcgttcatgctcttacctcatttctccttgtgcttttgttaataggaaccttgatttcatgctatcatatccctaactgaaattatacagattggaactggtaagatgactttaaaaattgaaggattaacaggcggctacgggaatctaaccgttttgcgcgacgtcagttttacagtaccatccggcaaaattgtgggcttaattggcctgaatggcgccggaaaatcgaccactatcaaacatattatcggactgttgacgccacaggcaggcacgattgacttagacgggacaacattgaagcaaaatcccactgattttcgggccaaccttgcctatgttccggaaacgccggtactttatccggaattaacgttacgggaacatcttgaaatgaccatcatggcttacgatcttgatgccaaagcggcttgggaggctgcggatcggatgcttaaaaaatttcgcttagataacaagctagattggtttccggctaagttttctaaggggatgcagcaaaaagtcatgattgtagcggcgttcatgacccatgccaagttatttattattgatgaaccgtttaccggtcttgatccattggcaattcacgacttgttaaatttggttaccgaaaaaaaacaggagggggcgtcgattcttatgtcgacgcacatcttggcaactgcccagcaatatgctgacgagtttgttttgatcaaagcaggaaaagtgcgtgccactggtgatatggcatcattaaagcaacaatttgacttaaaagatggcagtctggatgacatttatatgaagatgacggaggaagaagcatgattgacttgtggcgtgcgcgcctccgccaacatgtgcaggcacaacaaaaatatttacgccttgtatttaatgatcactttgtcttgattttactgattttattcggcggtgcgctttatgtgtatagccaaattgtcaaaaccttacagccttcctggtggttagctttatgcttggcaattattttcactggcttacttagcttcggtcagctggcgacccttgcagaagcaccggatcaaatttttttgttgccaaaagcggaggcgtttcggcaatatttattaaaaagccgccattatagcttgctgctgccaggcgttttgctgacctttgccagtcttgctatgtggccgttgtttgcgcagctgggtaaagacccggccagtgcgacggttaccttactaatggcagtttggctgtttaaggatcttgacttgtggttacagttactaaaacgctatcaattaccgacccagtggcatcatcaacggttactgttgttggcaattgccggggccgcgttttttgccgggttttatttgcatccggcagtgacccttttggttgcattgattctggatcttgttttcagatggcaattgcgaaccattttggaccaaggacggttgaatttcatggccttgatcaaactagaagatgatcgaatgggtcgggtatatcggttctataacttatttaccgatgtaccaggattagccaatagtgtgcatcggcgccgttatttggatggattcttaaaattagtcaaaccacgccaagcaacaacatggctctcattgtatctacgcggctttttacgtggcggtgagtatctcggcttatatcttcgcctgctggtgatcggtgctgtcattgtggcggtgctgtcgccatggtggctggctttgggttttgctatcttgtttctttacatggtcggcttccagctgttacctttttattatcagtatgatgagattgtctttacccatctgtatccggtcgcgcctgaccaaaaaccggctgcatttgagcggttgttgacggtgttgcttttaatcgaagtggcgacgttcaccttagtgacactgttgcggcttcaatggctggcagcaggggctattttcatttgcggcgtggtttttgtctggggctttacacggtggtatgcacgaatgcgacttaagcagcatcatgtggtggtataggggcgagtggtttttggatggctctcttgtttaagtgcgctggctcgcgcctgtcatcacgcgctcgccagctcaggaatcggagtgtaagggcgttggtcgcaagtccgcctttacgcccataacgcgttcaccggcgcagaagtctgcgtgtaaggaccttgaacgcgatggccaagcccgggcccatcacgcccaaggccacttatgttccggtttctaaccgggctggctcgcactctctttctataacgcgctccccggcgcaggaatctgcgtgtaaggaccttgaacgcaatggccaaagcccggccatcacgctcaaggccacttacattccgattcctaagcgcgccggctcgcgctcactttgcctcttgacgtgaatttctcaagttagtaatattgaacgtggacgcacgagcgcctgggagtgtctttttgacgattagaaccattcctgcggccagatataaggagtagtgcctatggagtttgaattagatgccgggtggtccctgcaacctgcaggcggttccaccggtagtgcgtttcttggggtttatgccaatcaaaagtatttcctaaaacgtaacgcttcgccatttcttgcggcactttcagtcgagcatattaccccacgcctattatggacgcgtcgggttagcaccggtgatgtgttaacggcacaagaatggttggacggtgaaacattaacccgcgagcaaatgatgcagccggtggtagccaaaatgttggcgcaggtacaccattcaagtttattaaaacgaatgcttcgccaagtcggtggccaaattcttgatccagcgcggttacgccacgatttattgcaagacttcccccgtgaccttacaaatcagccgcgggttaagcgtgctttgagcgacttacaacagtggttaccgcgggtgacggttcaaagtgtctgtcacggcgatctcaatcataaaaattggttgcgtgctggtggccgactttatttagttgactgggagcaggtggcattaggtgatccggcttatgatcttgctgatgtcatggcgcattatggtcatcgcaattcatggccagcgtttctaagagcctatggtgccaacaatgatgaatctttggaaaatcggctttattggtatggcgacttgcatttattgaacgacatgaaagcagcagcacagcaccagcgaacagatgaggtcgcacaagttttgcaacaatttgagacattgcagtcgacccattgaatggaagctgtaagcgcgtggcaaagggcctgtggcaaaatccggttttgtctcaggccttttgattgtcgacacgggacaaacgatcaccgcgaagaatcatcacaattatgaaataaaggaagacatgcatgcgattacgtaacaaaacttgggcgaaaccattaatagccgagcatcctgagctaattcttgttcgtccggaaaagatgccggggcagtggcaatcgcgatttaaacagaatcaaccgctttatcttgaggttggttctggcaaaggccaattcattgttgcgatggcgcaggctcacccggactgcaattttattgctttggaattacaagaggctgctattgccatgatcctgaagaaacaggcagtcttaaaacttcccaatcttcaactggttttgggggatggtgccgacttaaccgattattttgctgaagctgaaattagcggtttgttcttaaacttttctgatccttggccaaaaacgcggcatgaaaagcggcggctgacatatcggcgtttcttgcaacaatatcaaacgatcatgaaaccagatgcacggctgcaatttaagactgacaatcaaggcttatttgaatactcgctggttagtatgaacaatttcggcatgacttttgaactcgtctcgcttgatgttcatcatgatcaacgcattccggataatgtgccgacagagtacgaagaaaagttcagcgctgatggtggccgaatttatgaactggttgcgcgctttaaggcctgagtgagcgtgcatttttgacattgataatagattaagtggcaactaaggcgtgcagcctttatcatgaatctaggcagtggtgatgggttgctgtttgatgcgccatagcgaaccatcagccaaggctagaaaggctatttgtcggtgcagtttcgaatgacgaagaatcataccgccgcgatacacttggatacgctgatgatggtcattgatggtgagcggttgtagctcgatccaacttgtttcaatggttccttccttcgcaaaattacgttttaccttggttaaaatgcggttggaaattcgttgattgcggtgacaccaatacccggcaagcgccgtaccagtggcaataaatgctaatgacagcccaataccggaaagtaatcgagaccttgaaatggacatcgtgaagtcctccttttgacgtgagctggtgcgtttagccattgtaatttcagtgtgttcacgtcttgactgctgaaaatggaacctttacatgcctatcttggataagcgcaggatgacgttgcgctgaaacacgctcgccagccttggcgaacgctctgttgcttatggattgccacaccgctgttttaagtataatgtaaaagacggtgagcggcattgcgctgcgaaagttttcctgctatagtctacttataattagtaagcgaaaggatgttggccatgaaggaattaggttcaaatgcagcgattttggatgaggtaaaaaagcctggtaagaaaatgcttttcttctctgctaattggtgctcggattgccgttttatcaaaccagcaatgccagagatcgaaaaagacttttcggattatgagtttgttgcggttgatcgggacaagaatctggaagttgcccaggagatgggtgtttttggtattccaagttttatcgcgtttaaagacggtaaagaaatcggccgctttgttaacaaagatcgtaaaacaaaacaacaagtcgaggatttcatcaccggcttgaattaattttggaggttcaaatgctcattaccagttataatcaaccggcttttggtgatacgcttattgccatcacgggaccggatactgagacccagacatcgcaacgcagcggggatattgtggcaattttagatgatcagaatcatgtgattggctacaacttttttaatgtcagtcagtggttgggagccgtggatggacacgggcagattcaattgaccgctgaacaggtggctcaattaaatgttgccatccagcaagctgatttaccgggtcagcttgaagttgacgaaaagcccaagtttgtcattggtaagattgttgatttcaaagatcatcccgattctgatcacttacatgtcacgcaggtcgatattggtgatgaacaggttcaaatcgtttgcggcgcgccgaatgctgcgttaggccagacggtggttgttgcgttgccaggcgccatgatgccagatggtaagattatttggcagggttctttacgtggggtcgcgtcttacggcatgattagcagtgcgcgtgaattagcgattccaggggcaccacagcggcgtggtattttggtgatgccggacaatctggctgccggaagtccgttcgatgccaaggaagcggcggcagtggttgcggctcaggcgtaattgctacggtgaaaatacaaaaaattttaaagagaggctcgtgggcagataagctcacgagccatttttcgattcttagacggttatagtgacaatattggcatcaatacctatagtcctgcgatcagattcaatgcgaagatgacggtcatagctaatcctagtaagaacatggcttttcgataaggagacctaacattcatctttttgccaatccagcccaaaacaggggcgaatacaaaagtatttagtgcccagtcattcaaggcctccctgaactcttcttcagagaaccgataacaggataccaatagaacaatgccgcatatgatcagtagaacatcaagaattaggaaaagcatgttgtcagcctccaatgaatgtttgtagcaacgacaacttgtgtcacaactaaaatctgctccattatagattaagtgtcaatcatttttcctgttccgtacaagccgacgtttttccgggaaaaggcgctaccggtgtcgttttgatccttacctttattaacgttaaaaggcaatgccagaatcaggctattttcaaactaacgctgattttgccgagttatttttcaatccaggattcggcgaactgatgcttatgctaaaatagagacactgtcgaaacacgataaaaaggggatttgatcatggcgcattatgatgggccggcatttttacatcagaataaatcgccagcatcgcaatccggggaaacaaccgcgaactggcagcaatcagaaaatgacgcgtatcaattgccaccgcagattacgcatgaagccacgcatgaagtgaatccgcaaaaagtcgctgaggcacaggcggatttgcgcgcaatgacacatccgcgagccgaccatcagcgcaatgggttagcgcggctgacaacacccaacagcactgtcagaaacgtgcagcgggatcaaacggactatcgccaaattgcggcggtattgaaaccggatgaacaaagcctttatctttttgccggacatggggtcagtcccagttcgcaggccgccactgacccggttgcgatcgccgtggcttcgtcagtggcggcaccagaagcgacgcgttcaagtgagtcgctggagacaagtgcaagcagcatggcgtcaataactgagagccctgatgagcattcagaagcgaccgactcgaaacaacaaacggaagcggatggcgcaacacaacaagcctccaatgaaacaacatcgagctcctcggcatccgataacaccagtgccccgcatccgccgattcaatcggtggccagtgtgagcggcagcgaagcatcacgccatactgcggaaatagctacttctttgacatcgatgggcaaatctcatggccctaatagtcgaaaagcagcccgcattgaggcattaaggcgtaagcacgaagccaaaaagttgcggaaagcattggccgcccaaaaagctagggaatccgcatcggaacagaaagacaattcccaaaaggcgttttccaggccgcaaagtacggctggcaccacggcatcagtcacacagccaacgaaaagcagcttgtcagcagaaacaaccgagcagcaggcggttagctcacagctgcctgcttcgatgacgacgccggaagccacgcccgtttcaagcggtgatcaaggtgagagttctgaaacaatcccaccggttcgcttattatcaccaccagttgttgctgatcaagcagcccaacaagactgggtgcatcatcagcggcagcggttggatcaaacgttgcaggcatttaatgtcgatgcgcatgtcgttgccgatacgattgggccaaccgtaacgcaatttcaggtgagtcttgctagtggggttaaagtcagcaagattacaaacctcaatgatgatttgaagttagccttagctgccaaggatattcgaatcgaggcaccgatacccggtaagaatacagttgggatcgaaattcctaacttgaaaccgcgtccggtcatgttgcgggaagttctggacacgccggcatttcagaaagctaagtcgccgttaaccattgcgcttggcgtggatctttttggtcagccggttgtcacgaatcttgctaaaatgccgcatggactgattgccggagcgactggatccggtaagtctgtctttattaacagcttactggtgtcgctgctgtataaagcgactccggaacaggtgcggctgcttttgattgatcccaaagcagttgagttagccggttataacggtttgccgcacctggtctcgccagtgatttctgatccaaaagcggcgagcgcggcattgaagtgggtggttacgacgatgaatgaccgctacaaaaaactggctgcagcaggcgtacgtaatcttgaacagttcaatgcaaaggctaagcggcatcatgagtttgctcaagtgatgccatatctggtgattatcattgatgagttggcagatttgatgctggcggctggcactgagatccaagacgacattgctaggattacagccaaagcgcgggcagccggcattcacttacttgttgcgactcaacggccaagtgtcgatgtgatcaccggtactatcaagaacaatatccctacccgcattgcctttatgacggcgagtcaaattgattcccggaccattatcgatacggctggggctgagcggttgttgggtcgtggcgatatgctttacttaggcaatggtgccagtcagccaattcggctacaaggcacctttgtcgatcgggaaatcgatagcattgttgcgtatgtcaaaagtcaccgcggtccaaggtatctttttgatccggcagggtcaagtccgctgaggctagcaatacgcatgaagatgaactgatgcctgaggtgctggattatcttgctggtgaacggcatatttcgacatcaaagttacagcgcgtcttttctattgggtataatcgcgccgccaacctgattgatacgttggaggccaaacatctggtctccgcagcaaaaggggcaaaaccgcgcgaagtttactacacacaagcaaaggaagaggaacattcgtgatgacagaggcaacttattattttattggcattaagggttcaggcatgagcgcattggcattggtactgcatgatttggggcatcaagtgttggggagtgatattacccaatatacgtttacccagaaaggcttggcggctgccggaatcacgatgcttccgtttgatccggctaatctaaagcccggttacactgtgattgccggtaacagctttaccgatgagcatccggaaatcaagcaagccaaagcgatggggcttaagatttatcggtatcatgaatttcttggtcagctgattaaggggtataccagcattggcgtggcgggtgcgcatggtaaaacgagtaccaccggtttacttgcccacacgttaagcggggttgctaaaaccagttatctgattggcgatgggactggcaaaggcgttcgcgattcgaaattttttgtttttgaggcagacgaatatcggcgccattttctggcctaccatcccgattacatgatcatgacgaacattgattttgatcaccccgattattatcacgggtttgaagatgtttacgatgcatttgaaaccgaagcaaatcaggtccaaaaggcgattgtcgcatggggcgatgatccttggctgcgcaaactaaaagctaaagttcctgtttattattacggcaccagtgaccgtgatgattttcaggcccgcaatgtcaagcgtgatacaaaaggcagcagttttgacgcgtacttccatgatgaattgatcggccacttctttgtgccactgtttggcgaacatagcgtcctgaatgccttggcagttgtggctgtcgcgcatatggagaaacttgatgcaggcttgatcgcgcgcgaactcggtaacttcagtggggttaaacgccgctttgccgaaaaagatcttaaagacatgatcattgtcgatgattatgcgcaccatccgaatgagataaaagcaacattggatgcggcccggcagaaatatcctgacaaagcgatcatcgctgttttccagccccatacttatagtcggacgcaagcatatgaaccgcagtacgttcaagtcttgagccaagccgatcagacgttcctgactccgattttcagctccgcgcgggaaaagaatggtaaaattcgctcagaagacattgtggcgcaaatcaagggtgccgctgtcattcagcaagcggatatgcgaccgttgctgaaattccaccatgctgtggttgtctttatgggcgcaggcgatattcagaagtatgaaaaggcttatgaagatctactgagtcaggagtaacataaatggctttattgccaagctggtgtgctgcatgtgacatgatagtgagacagtatgagcggccatgacaattgaataagctgtgtttgattaacggttttggagcaagtgcttgctctgggaccgttttttgagttgtgacggttttatcctgacaaaagggagaatgcgcgctgcttgttttgtaatcagaagaggactaaattttagctgacttgaattcgcttacatttctatttgtttcaacgaattattatgttaagattcatctaatatcagtgtcgaacgaaggagttatgaatttttcagggaatctattgatgagggggagtaggctatgaatcttgatgattttctggagaacgatgaacgtcgggaggttcagttgttgcagttattgctaaaggcgggggctgccggttgcttgtacacaaccgccatcacaacgctgggggtgtcagcaagcacaatgggaacaaccgtcgccgcacttcagcagcggattagaggcttcgatgctgccgctgatattagcgtgactgattcaggcggtcagcgttgtatttgtttgcaaacacgcacacccgttaattttagtgagctctatcggcaattgttagtccaatcgaaaagttatcggattttactaaccttgctgcaaaaaggcaaagtgagtgctgatgaactggcacagttgctatacatcagtaaaccagctgtttttcgtcggatcaaactcttgaatcaggttttggcagcattttcactacagattaagggcggtaccctcattgggccggagattgcgttgcgctatttgtattatcggctgctgctaaatagccatgattacgacaccttagcctcgtttacggaagcgtattcgttacggcagtttatcgcagcgtttgaagctcgggaacatttgaaattttcgatgatcggacgactcaaattaagtatctggttggacattgcactcaagcggcattttgcagcggagcaaaaccgcgttaagaccagcaaagaaccgctgctcagcttggatcacaaccacctttaccgcgggattagaaactggttgtttgatttagcccgccaatatgcacttgtcattgatgaatttgaagtttccagcctttatatctttatgacgagtatggagattctggacctggatgatcgtgatttatcaccggttgctcaatatttggacgaggtaactcctgaaattaaaaaaattcgtgcccagttaatggctcgaattgaattagcttacccagcttttaaacggcgatttacgggcgacacgcaactgcgaattcggtacattttgaaccaaattcagatgcatgcccgctttttttcgggccattttcatctgtttgatggggaacgcattaactatcaagttgatccagcggtgttacaacatttagaaaagatggctggtgaattggcgatgctgacttttaaccatgcacagcagtcacctagccctgagcagctgctgtttttgaagcgccggtatttgaatgtgttgttgttaattcacgtacaaagtgatgcgccgttgtatgttggcatctgcatgcatgacgactggtccatcacagcaggtatggtggcccggttgcgcgttgcattagccggttattatcacgtcatcattgacaatgccgtgaccgatcgcgtgtacgatttattgattacaaactccgcaacggctgctagacagataaaggcaaaagaacgctatttattgacaggtattgaaaatcgttatgatctggaacaaattatggctttattggcaacgattgatcaaaagcggaaacaatgaacgtgtgataacccttcatatttgggtaagtgtccagaattttacatttgacagctaactcttttcaggcgaagaggcttttcggatatgttgcgaagccttttcgcctttttgatatggattatttgcaacgatggctcggctaaaagatgaattcgaccttatgaaataacgtttgtaacagaatgaagtgacggaagaaggccatccgtaaaaagacctgtccgtacaggattaatcaataaaatataatgtaataaataagattaaaataatacaaatgcgattcttagctcaaatcattaaagtttttcgcaaaaatgtgagaattatgagaacaactactcccctagaatggagtccatgtcaatttatattttttagatggatttttaaaaaaggggggtgtccgaagtgccgtcaagatttaaaaaaatgtggcaggtaatcaaaaaaactgccggtattgggttgattggcgtcagtatcttactaacgcttaccgttctcggcggtacccagccggatattaaacgtttctttcatttaaccagcaactctgtgtatgcagccgatgatcaacctgcaaacccacaacgaccacgagctactattaccggtcaagatgcggtgtatacgcttggtgaattttttacgccggagtcacatgctaggctctttaaacaagccactgagcctggtggtctatcgattccatttgcggataaaagaatctgggcagttttgcctgagaagcttaagcaagcgacgcggtcgatggggttacaggaacgttatgcccgatttgacacgatccttgcaaaaacgccggttgatttgacgtttgattctaagttcggggtggcgacgggtaaaggtacagcgcaaacccagtatggagatgcggtgattgccggtgcatctgatcctaagaatggtcgcgatgcaatgggcgctttggttttcattgatcgagatgcagatggtatttctaaagtgatcgcgacatccggtaaaggtaatgacaatgagccaatcgcacctcactttggcaaccgattctatggtagttatgaatatgttcagatgcgggatcatcaaagtattaatctgagctatttcaatatcaatgacgcagttgccaatgggactactcgcaaacaagactttttgaatcagtggggacttaaccgggttcagcaggcaagaatgggggatatcatcaaggtctgcaatgctgaaggaaaaatcagctttgcacgtgactctaaggtgtatcaactgaaaaaagaaaactttccgaatattgatcaggccatctttttccaaatgacgccggctggatttgtaccgttacatgtgaaccagctgaaaacccgtccagtcgatgtgccgcagaacgcaacggatgcagaattagacgctgcgtttcctaaagccttgaacttgcgggataacatcattgcagaatgttttgctggacggccggatgtgagcaagccaggtaaaacgaaagccgttgtacgggcaattgaaaaattgtatgacggcaagtatgccaagtttgattatgaagtggaactgaatgtgattccggcaggcgagttgaccgtcaaatctgggcaatatgtattaggcgagcgctgggggatgcaaagtattgagcgtatgttcactcaggcgcaacagcgagatggtacaccggttttgtggggggataagcagctttatccattgaaagcccccgatgttgagaaacatttacaaccgggtacccagcggattgacgagttgtttaaagatgcagctgccccaattcagtttgattccaaaaccggacatctaactgcacggccaaccgcgacagcaaattatggtgatgcgatcattttaaaaggctatgaattgcattcaggacgcgatgccgggggtgcatttgccttgattcatgatgacggcctgaaagtagttgccactgcaggcgggtcaaaagacaatcaacctattcataaccgattcccgagcgagccgtacttgggcatcacccacgttcctatgaaagatgaaaaagttaaaaacttatccgaggtggcggtgaaatgggcgtctggtgatttaggtaagcaagacttccttaatttatggggtaaagatcgggttcagcctgtgcaagcaggcgatattatcaaagtcgtcaacgttgaaagaaagattaggtatacccatgattcacaagagcagcccctcaacgatttggccaacaagaatgaactttattttgaaattacggatcaaggctaccaattgttgcgggtgaatcaattagtaccacaaaaagccaatattccaattaatgcttcagcagcggaaatggatttgcgactatcgcagttctttaaattatcggataaatcaacctataagattaaaggttttaaaaaacgaccagatgtttcaaaacttggggataccacggctacagtgacggtttcccagaagtatggcaaagataaaacaatcgaagctgactatgatgttccagtggccgtggtgaaacgcgcaacattttcgacccaatcgcaaactttgaagttaggtgaagtcgttacaacggatactttaggcaacatgctaaaagacgcgcttgagtacgatgatcgccgcattcaatggggggataaagcgctgagtgtcaccatgcctgacaagttggctaagctcttacgcaaagatacaaagcgattgacaaagatcagcaaaccaattgacgtgaccatgaagtttgaggccagcactggcacggtgttatcaacgagtccggtgctgaccgactatggcgatgcacttgttttcaacggttacgaactattcacgcgtaatgccggtggtgccttggcgttggtgaaggaaggcaacgactggttgatcgtggctactgatggcgcagaagatgacaatcgcaatgtccacgatgtttttgccggtgaaccgtatttaagcgtgagtctgtacgaagcagctggtgatgtgcttaacctgcaggatccaaagcaacaagtcacgagcatggcagcccagggtgatacccctaagcagcaattgcttgatcaatggggagacaagcgcgtggtcaaagccaaactcggggatgtcgtggtggtgaatcatcgtgaagataaggtaagtgtggcgcatgcaggcaaacgcgaacccttgaaaaagcgcgccaacaaaagagagtccctgtttgaggtgacggcttcgggttacaagtttttgacactgaatcaggtcagcttcaaatctttaaccatcgaaaacaacagtgacccgcagcccattcgtgaagcggtgacgaataccgtcaaaaagcaacagccacatttgaaagtggaaaatattaagtttcccgatttgaaaaccgtggggcataaaaccgttacggcaactgttagccaaccaagtttgacagaagctaataagcacatcagttatgactaccagatccctttggaagtcactgaaggcaccttgagttttacccaagcaccggcagcgctcaattttggcaccgttaagattgatggccagacgctagaagttcctcgaattggcgatacgccgatgacgattcggattaaggacggccgcagtcaaaagaagccatggcaacttttgattcaacaaagtcagccgtttaccgatcgtcatcagcatgaattaaaacaagaattactctttttcagacaagacggccatgactatccgatcaaacttaagcaagatcagcaagttaaggcggttgcgtctcaaacgatccaacacacgtttacgtatgatacgcaagcaggggtactgctcaaaatacctgctaatgactttgactttacggccggtacgtacaattttggtctgcagtggaccctaagcgatgcaccactttaactcaatttagaaattatggaggaatcaactaatgactcgttatggataccaggctttactcgcgactgctgcattatcggcagggctactggcttatggcgcaacaaccgtcagtgctgacgatgcgcgtactgttaccacccaaggaagggttaaaatcatgcaaaccgacaccaaaccggatattttaaacccgttagcgccacaaaacaaaacgccaggaacctttgccggggtggataacacgactcatgctggcggcgaaggtttaacactggactatgtttctcgcttcaattttggaccgttgaaactggatgcggttaatgatgccgtggcatacgccgaagccgatcaatgggtgactaaagacggcaagaaaacagcggcgcctaatcacattcaggtcactgacaagcgacttggtagtgatcgttggaaagtcagtttaaaagcgaccgatctgaagtccgaagaaaaagatcaggccggcaaagtgaccaaaaccgtggtcttaccagacgccgcaatctccttgcttgaaagcagcgttatcgatggccaagccaaagatgcgagtgcgcgtttcggactcaacaaagcgattaaggtctacactggcgatgcgcaagcggttgatattttgagtgttagtgacggtcaaacggctaaaggaaccttcatggatctgtttaatcagaaacaagcagataaaggggttgccttgacggtgccagccaaaagttatgcaacggaagggctcaagtcgggagatttttccaccacgctgacttggacgctgaccagtgcgccgctgtaaaaccgaatgagagcaaatcaaaggctagtgtgggtggcagtcttaattggcattgttgttgcggcaccggcaacgatgacccatgctgacgaaaagacttccgtggctcatgttcgcattctggttgagccgatgagcgatcccaaaattgtgaaggttgtaacgccggattcgccaagcgatgatcggctgcctacctctcgccagaaaccggcaatggccgatacaaacaagaagaaagccactaagcatgcaaaactgccagcgctacaagaatcatcatatctgataactgtcttagcaggcgtctttttctggttgggtctcctacgggcatattatctgtatcaatctcgaaaactaaaacactaagaaaggaagcgccgttgcacgtttgcgtcgatggtgccacacaaaagatgaaaaaaagtatatggatcgttggtctcttggggtgggtcatggtactcttttccggcatgtggcagcaatctgcacaagcggcaggcgaagggtttacggtcaaagctgagttgccggaaaatcagcgggatacaagtgcgagctactttgatttacgggtgagtccgaatcaagcgcagacgttaaacgttgtcattcaaaatcgccaagctgatcccgtgaccgtgctcatcaaggtgaaccccgccttcacaaacgataatggggtggtcgaatacggcgaacaggtggggcgaacggatgcgtcattaaaggttaattttaaaacgttattaaaggcaccaacggaagtgacgatcccggctttaagccaacaaacagtacctttgcaattaaagctgcccgcgcaggcatttgccgggacggttcttggtggcctgcaatttatggctaaaccagatgaaaaagcgacaacgagtggcgcagttgctaatcgttatgtctacgcactcggtgtggtcttaaccgaatctgatcaagtcgtgccaccgaacttgaggttgcgggaagtgaaggcggtcagtgatcatggtcacaacgccattcaagccaatattcagaactttgaaccggcgatgctcaaagacctgactgtggaagggaagatctttgaggcagacggaagcaaagcactgtatcaaacgcacaagcagcaactcaagatggcaccgaactcaaactttaattttaaggttgatctcaatgatgaaccgctaaaaccgggtaaatatcgttttgagggagtcgcaaaggcagccggtagaacatggcacttcaagaaaacatttgtggtcgcgcaaaaagaggccgccgatctgaatgctgccgctgttaaaaaagtacctgcccaagcgaatgcgattgactggcgcttattgattttagcagggttagtcgtactcctcaccattaatgtgattgcgtttaaacgttatgcccggcatcaacgcggtgcttaatttgaagtttttcaagacatctgttctacgttgctaagtgtgatggcaatgcagctatctttgaaaagaaatccgatcctgggttaaacaaaaaagctaatccatcgcgggttagcttttttcgcagctcgattttgcatgaagagaaaaacgactcattgtggcattcaaggcgtactttattaaccgaaatgcgttcaacttctttgtagaccacgactccagtcaacggcaagatacatgatggcgaccatcgcgattgtaaataaagtcaacaagtcgcgggtcacaaacaaataaaagaaaatgaaattaacgattaaaaagcaagttcgacatagcgctcccacttttgatgacgagatgatagtacttgagattcgattaatcgctggattctttctaaataagagcatcgtaattagtatgatagctagggtgccataaaaaaacatgagtattatttattcacatcctttgttttaagagagaggctttcgatgattaaaaattaacagataaacgtatgccggtcaatgattttacgagcggatgtgaactttagtaaattaatagtaattaattataaataaatcttatattttcccttgcttgtcctccgaaagatcgcattcacacatatgcaataaagcaatgacgatctatacaagccagtggacaagcgcatgtcgggctgttaatgttagcactagcatgataaagtcagtatcagggcttgacggtttgactcaccaagatgcaaatcggtctttggcctgactgacaaaatgttttgatctggttataatagttatagatagttgaaaggaatgaacgcaatatgcaagaacgccgtgttgtaaacgaggccggcttgacgcagttcttctcccgcatctacaccttgatggggagcgggctggttgtgacggcgctcgtaagttatttactaggagttacccttaagaatgattacatcaattttgtgggtgctcatccaattatcttttggattatgacagcattgccgctgatcctgtccttctttgtgactggacggcgggcccaagcaagtccgggttatgcaactttaatgttttatctgatgtctgcaagttttggtttcacttttgcttccgttgcgatggttgcaaagacatctaaccttgcagttgcattggcaacaacggcggtagtctttctcgtcatgtccatggttggccattttggcaagcgtgacctgagtaaggcgggaaatatcgcgatgtcagcattgtttggcgtcatcatcatgatgttcgttaacatgtttatgggttcaagcggcatgcagatgttgatttcttatgcgatcttgatcatcttcatcgtgttgaccgcttgggacactcagcgcctgaagaacttatacttgacggctggcagcgatggacaagcaactatttccaccagttcattagccgttgtcggggcgcttatgctttatcttgatttcttaaacctattcaccgccatcttgcagattctaggcgttggcgacaacaacaattaataaaagcaaaagccggtcagaaactggcttttttttatgtgagcgcgagccggcgcggttagaagtcggagtgtaagcggccttaagcgtgatggcccggtcttggccattgcgcttaaggttcttacacgcagacttctgcgccggggagcgcgttatggaaagtaggcgcgagccggcgcgattagggaccggagtgtaagcggccttgggcgtgatggccgggttttggccattgcgaccaaggtccttacacgcaggcccctgcgccggggagcgcgttatagaaagtgagtgtcaaggactcagagtgtaagcggccttaagcatgatggtccggtctttgccattgcgttcaatgtccttacacgtaagcttttgcacgaagaaacgtgtatcaatggacggccaccgcccactgcaacctatcaaaccgcaacggctgagagatgatcccccttaactaggaacgtgccgtcacaagggcaaagaatttggtacaataatgatgacaattaactcatgtcatcgatagcggtggtttgagaagaaaaggaagctcatatatgacgagtcaaactaaattattgttgattgacggcaactcgattgcatttcgtgctttttttgccttgtacaatcaactcgatcgtttcaccaatcaagatgggctgcacaccaatgccatctacgcatttaacaatatgctcgagattgttttaaagtcggttaaaccggacgctgctttggtggcgtttgatgccggaaaaacaacttttcgaacggcaaaatacgcggattataaaagcggtcgggcgaagacgccaagcgagttgttagagcagctgccgtatatcaaggaactactcgatgatatgggcattcagcattatgaactcaaggattatgaagctgatgacattatcggaacgatggctaagcgtgctgatgatgcagggtggcagacaacgattgtgactggcgatcgtgatttaacccaattaacgacggatcaaacaacggtgcaggtcacggtcaaaggcgttaatgaacttgaggcgtacacgccggaacacgttaaagaaaagcttggcattacccccactcagattattgatctaaaggggttaatgggtgatacgtcagacaattatccaggggtcaccaaggttggcgaaaaaacggccttaaaactgctaaagcaatacggcagtatcgaaaacctttacgctaacattgatgcgatgaagacttccaaaatgaaggaaaatctcatcaatgacaaagacaaagcgtacctgagcaagcagttagccacaattgaccgcgatgcacctgtgaccatcgatcttgcagacgtaaagtataacggtcccgatttggcgaagttacgcgatttctatactaagatgaatatgaattccttgttgaagaaaattggcggggatgtcgcaaaaccgtcacaaccggtacattattccgttttggatgaccaatcaattttggcgctcacgaaaacaaccgaaccgttaacctttgagattgaaatgttagcggataattatcataccgctgaacaagtgggctttttcatcggaaccaaagaagaaacctatgttagtacagatgtgtcattgttgacgattccggaagttgctaagtggcttggtgattcaaaccgcgacttaacggtgtttgatggtaaacgcaatattgtcgccgctcatcgtcttggcttgcatctgcctgacattgccttcgatgttttgttggcctcgtatctgattaatccagatgaaaatagcaatgatctgggtaaaattgcagaagaccatgattatcatgacttgcctcgcgatgaagatgtatatggtaaaggtgctaagcgtcaagtgcctgaagataaactgctgtttgaacaattcgctcgtaagtctcaggccttattcgccttgcgtcctgatttaaccgaagatttggctaagcaggaacagacggatcttttcacggacatggaaatgccactggcgcgggttttggcggaaatggaaattcaaggtatcacgttgaatgcccaaaccttaaaggatatgggaaccgaattttcgcaaagcattaaggtgttggaagaaaaaatttatggtgaagccggcgttaaatttaatctgaattcgccgaagcaattaggcgaagtgttattcgaaaagctgaatttaccagtgattaaaaagaccaaaaccggttattccaccagtgtcgatgttttaaacgaattgaaatcggctagtccaattgttcaggatattctggattatcgcggctgggccaaactaaactcgacttatgtggtgggcttgttgaaagcacaaatgccggatcataaaattcacacccgttatttacagacactgacgcaaaccgggcgtctgagttccgttgacccgaatatgcaaaatattccagcacgggatgaagggaagattatccggaaagcctttgtcccttctcatccggattggcagatttttagctcggattattcgcaaatcgaattacgcgtgttatcgcatatctcgggtgatgagaatatgcaacaagcctttaaacacggcgttgatattcacgcgaataccgccatgaaaatttttggcctcgattctcctgatgaagtcacgccggatatgcgccgccaagccaaggccacgaactttgggattgtttacggcatcagcgattatgggttggcgcaaaatatcgggatttccaggaagcaggctaaggcgtttattgacggttattttgaacagtacccgaaagtccacgattacatggaaaatatggtcaagaaagcgcgtgaagatggctatgttgaaacgctcttccaccgccgtcgttatctgccccagattcactcccgcaatttcaacttgcgcaagtttgcggaacgaacggcgatgaatacgccgatccaagggagtgccgcagatatcattaaagtcgcgatgattcgcatgcaaaaggcgttggatgaggcccatctgcaggcgaaaatgttgctgcaggtacacgatgaactgatttttgaagctccgactgctgaaatggcgcaacttggacaattagtgcctaagattatggactcggctgtttcgctggcggtacctttgaaagtcgaaagtcattatggaccgacctggtttgatgcgaaataaggagatcttatgcctgaattacctgaagttgaaacggttcgccgttccttgttaccgttagtcaaagataaaaaaatcaccgcgattagcacaaactgggagaaaatcctcatcaatggtttgacagcttttcaaaaacaggtcgtgggcgctgccgtcaccacgattgatcgccgcggtaagtatttactgattcggcttaacaacggcatggcgattgtcagtcatttgcgcatggaaggccgctattacgttgtttcggatgccaaaacgccgctggataagcatgatcatgtgacgtttacctttcaggatggcagccagttgcgttaccgcgatctgcgcaagtttggccggatgcggctgattcacacgggtcaggagcaattggtgccagcgctggccaagctaggaccggagccgactgctgctacttttagcgaaaatgacttttcccagaaactaaaacggcatcataaagccattaaatcggttttgctggatcaaactgttgtggccggaatcggcaatatttatgctgatgaggtcttatggctcagcaagctcaatcccctgcagccagctaataccttaaccaaggcggaggttcacacgttacatgatgcgattatcaaggaattggacgacgccattgccgctggcgggaccagtgcccatacttacgttgatgctgaaggcaatcgcggttcgtttcaggatgctttgcatgtctatgatcgtgaagggacgccttgtgatcgttgcggcaccacgattgtcaaaatcaaagtcggtcaacgcggcacgtattattgcccgcattgccagccgctacatcgaagggggcaactggcatgacctttttgttagggctgacaggcggcatcgcgtcaggcaaatcaacggtaagccggacatttaaagcggctgggtttccggtggtggatgccgatgtgattgcccggcgcattgttgaaccgggtcaaccggtgcttgcgcgaattgtccaagcgtttgggccgggggtcttacgcaaagacgggacgcttgaccgggccaaactgggcgacattgtgttttcgcagccgggacgtatggaagcattgaaccaaattaatcgcccgtatttgcgtgcagcgattaatcaagcgcttgctcaagccaaagcaggcggtgctgccatcgttgttggggatatcccgcttttgtatgaagctgactatgccgatgcgtttgatggcgttgcggtggtaacggttgatcctgaagtgcaattggcgcggttgatgacgcgcgatggcttaaccaaagaagctgcccaagaacgcatcgcttctcaaataccgttatccaaaaaagcggcaatggctgattttgtgatcgataacaacgggacacaagcagcgacgattgaccaggcaaaagccttgattcaccggcttgagcaactatcataagcggcttgcacgtgctataataagctatcaaactttgattaagaaggtggagtcgtgcaatgtccccattgccatcataatagttcgcgggttgtcgattcgcgtcccacagacggcggtcgggcaatccggcgtcggcgtgagtgcgagaactgcgggtttcgttttacaacttttgaacgcgttgaacagaccccgttattggtcatcaaaaagaatggcacgcgggaagaatttaaccgcgagaagattctcaaaggactcatccgggctgctgaaaaacggccggtgaccatggaacaaatgcaagggatcgtggattcggttgaaaatcaactgcgcgcgatcggtgaaaatgaagtttccagtcaagcaattggcgaatatgtcatgtcgaaattagcggatgtcgatgatgtcgcttatattcgctttgccagtgtttaccgccaatttaaggatatgtccgtcttcatgcaagagcttcaggatatgatgaagaaggaaaagactaagaagtaaacgtaattgaagcaatcaacaaaacggacctgaggcgattgtctcaggtccgttgtctgaaaagaggtgaaagtcatgcagcgccctgatacgtttattccgcaagccgggtttgtgttgaccaaagcaggttattttagtgactttgacgaaaaagtggcagtttcgctttatcaacccttagttggcccggttccgatggcgctttacctgagcttatggcaagaagtcaaagaccgcgccttggtcacggatcggcggccgcaactttggttgctggatcttttggatattgacattgagcagctgtttgttgcgcgcgtgaaattggaagcagtggggttattacgcacttattcgcaagttgactcattgggccgttattatgcgtatgaactttacccaccggtgagtcccgatgcctttttcaaagatgacctgttaggactcctgctgtatgacaaagtgggcgagaatcgctacgatgaattggtagccaagtttagcttgaaaccggtgcggcgtccggaatggcaagagattaccgccagcttcttggatgtgtttcgctttgaccatgatctcagccaggaaccaccggctgttgtggccgctaaagaagccgtgacccaaaagccggcaagtcgtccacggttgggaagcggggatggctacgattgggacttattaaaatcgttgttggccaatagcaatctgcaaaccggacaactgactaaacatcaagcggcactatatcaggtagcggcattttacggcttgcaaccgcctgattttgcccgcctgatcagtcgcgcaaccgatgttatgacgggaaaaatcgatttgaatcaactgcgccggctagccgaacaaagctatacgcgccagcagccacatgccaaaccgcaaactccaacccagacgccaaaagtagcaagtgctgatgaggcattgcttaagcgggccaaaagtatgccaccgcggcagtttttaactgcggcgaaacaggctaaaaacgcgcgcatgtatccggctaacaacgaactgcgcgccattcagcaattgagtgagcgcaatgtttttgacgcaccgacgattaatattctgattgattatattctcagaaccaacgacagtattaatcaggcgttgttggatgcgattgccaacagctggttaaaagccaatgtaaccagcccggaagctgccttaaaccagatccatgcgtttgagcagcaaaaggcgactgaccaaaaacgtcgtcaaactcaaacaaaaggcacgcggcaagaaaagctaccggattgggctaaggaaggttatcagccaaagaaaaagaaggtcagtgaagctgatcggcaaaccttggctgcccaattggagaaacttcggcagcttggtgataaaggaggtaagaactaatggaagatatgcgtaagcgtctggccatgttgatggattcccgacagtggcgggagcggtattttaagatggtcaaagaagcattgcaggatccggaagtccagactttcctgaagcagcatgaagcggatttagccaatgatgccattgaccgcggaactgccaagatttatgaatttgtcagtgagcgtaacaagattgcccgaggcgaattaccattggcgcctggctatcaacccaaacttgtcgtggcaaatggtttgattgatgtggcgtatgaaccgactgatgcgaaagtagcggcagacgaagaggccaagcaagcctcattggtgacctctgtgaacatgcctaaagatattcgcgatgcaagcttggacagttatgatccaaccgatgaccgacttgatgcacttttggccgcaaaccggtttgttttagcggttgttgccgatcctaaggcgtttcatcagggattatatttaagtgggccgtttggggttggcaagacatacttgttaggtgcgattgccaacgatttagcaagcaaaggcggcattgcaaccacattaattcatgtaccgacatttgtcgttgaaatgaagaatgcaatcggcaataacagcgtgttgaaaaagattgatagcgtgaagcgggcaccgattttaatgcttgatgatattggcgccgaaagcatcagtccatgggttcgggatgacgtactgggcattattctgcaatatcgcatgcaggagaaaatgccgacgctgttcagttcaaacaagagtatggccgaattaaccgagtcattggcagggacggaccggggcaactcggaaatgttaaaagccaaacgcattatggagcgggtacggttcttggcaaaagaaattaccgttgacggtgaaaatcgccggaaccctttggcagattgatcaagatcatgacaagccggtatgaaacgatcgagccggcaaaactattttctgaaacttgcttgcaccaaagcggacattgtggttcaatgtagctatcgaagacggaagcaataaaggatcatctactagagagtaaggccgtggctgaaagccttgcaagatctgatccgaaccacttctcgagattgccctaatggccctgttgcgcaggttacgcgctaatgaagtggcccgcagcaagactgtcggcaatctgggtggaaccgcgatcacaaatcgtccctgatgtctcttaggagatatcagggattttttgtgagcgcgatccggcgcgcttaggaatcggagtgtaagtggccttgagcgtgttggccgggctttggccattgcgttcaaggtccttacacgcagattcctgcgccggggagcgcgttatagaaagtaagcgcgagccagcgcgattttcctccccaagtcagaagtggcactcggtaaaatggtttcttcgaaaaaacgacaaaggagtcttacttatggcattagatattacgtttccagatggcagtgtcaaacaatttcctgatggtacaacggtaaaagccatcacggaaggcattagcaatagtctggcaaaaaaggctgttgctggtaaattagacgatgaattgattgcatacaatgaaccgattgcccattccggcaaactgcagattatgaccaaagatgatgcagaagggctcacggttttgcggcagacggcggcatttgttttagcagcagcactcaaagcattgtaccctgatatccattttggcaagggccaggccatagaagacggtttttactatgataccgatcgtgcggatggacaagtcagtgttgatgatttaccgacagtccaaaagaaaatggaagaaatcattaaggctaacgctgccttggagccagtggagctcagtcgggcagaggcttttgaccgttttaaggacgatccgttcaaaaagcaactggtcgaagctgccggcgatccgattaagggttataagctaggcgattttgttgattttgaagaaaaagtcttgcttcctagtcttaaggatttgaagcatttcaagctgctgtcggttgccggcgcctattggcaaggtaagagcagcaacccgatgctacagcggatttacgggaccgcttattggagcgaaaaaggccttgaagatgatgctaagcggcgtaaggaagcggctgaacgtgatcaccgggttatcggccgcgacttggatcttttcttcgttgatcctaaagtcggcgctgggttgccgtactggatgccaaatggcgcaacgattcggcgggtcattgaacgctacatcattgacaaagaaattgccgatggttacgaacatgtttacacccccgtgcttgccaaccttgacttgtacaagacgtccggccactgggatcattatcgtgaagacatgttcccgccgatggacatgggcgatggcgaaatgctcgaattacgtccgatgaactgcccaagccatattcagatttataaccatcacatccggtcttatcgagaattaccactgcggattgctgaactagggatgatgcatcggtatgaaaaatcaggtgctttgtctggtttgcaacgtgttcgcgaaatgactttaaacgatggccacacattcgttgcgttggatcaagtccaagaagaattcaaaaagattctgcgcctgatcatggatgtttatgaagacttcaacattaccgattacagcttccggctttcttatcgtgatcctaagaataccgaaaagtattttgatgatgacgaaatgtggacccgtagccagagcatgttgaaaggcgctatggatgacttgcacctagactattacgaagccgagggtgaagcagccttttatggtccaaagctggatatccagactaagaccgcgcttggcaacgatgaaaccatgtcaacgattcagttagacttcatgttgccggaacgcttcaacttgacttatgtcggcaaggatggcgaggaacatcggccagtcatgattcaccgtgggattgtcggcacgatggaacgattcatcgcatacttgaccgaaatttataagggtgctttcccaacctggctggcaccaacacaggccgttttgattccggttaacaatgatctgcacttagactatgtcaaccgcatcaaacgccagatgcaggcagccgggttgcgcgtcaaagtcgatgaccgcaatgaaaagatgggttataagattcgcgaagcccaaaccaagaagattccgtacacggtcgttgtcggggacaaagaactcaacgatgcggcggtatccgtacggcggtatggcgatgaacatactgaagaagaagcaggtaatatgttcattgatgcgatggtagctgaggttaagaactacagtcgcgacggcaaaaccaagccgggcgaagctaataaggttttaggtgactaattcatttagctccaacgaaaagatctgggcaatttagctcagatctttttaattgccgttgaaggattagcgcaatcttaggataaagatctcgcggtttcacgacattttgtgatgtatgatacactaaactcatttaaaacccacatcaaagaaagggtgactaggtgtttattgcgttatgggcttcttggcttgtcttgttcttcgttaccaaaatattagcagcggtcttgtacttcgctgtcttgctgatctatatgaaactgccgtggcgcacccctaatcaacgcggctactggctaatcgctcatcgtggccgcggattattgatgatcatgggattcgtgatgttgttaaccgcggttgtcgcatatgggattgcaaattggtggttcggcaagatcgaattccagccccaaggcgttgcggttttcggtagtgtcgggatcgtcttattgtcctggctacttggattgcctaagaaattacgcgcttttcgagaaaaaattaacgcggatcaacagcaggataaaggagatgaccatgatgagtgatgaaccacaagttaaaaatccccaattgattcacctgatgcatttattacgtgcagatcaaaatgatgaaccccgcgcagctttttacgcggggttaaaaacagctaaatttatgttaccggttggcacggcgcggacaggggatccgactgtggtgttgttgacggatgatagcggtcgtgattttctgcctatttttaccgaccaggccagttttgcccagagccctgatcatgaccattttgcggttgcaaccattgacgattgtgcaaattttctctatgaagaccacgatattcacggcgttgtaatcaatccgtatggcgaaaacatggtcttaacccgcgccaacctgttttatgttgctaaaccggatcaagccgaacatggcgaggctgttcgtctttctgaaccgcctaaagaagcggctgatcttgtttcacgtctgcaaacgtacttgccgaaaatggcaacgattcatgctgcatatttagcaaccatgattcgagccaacgatgccaagagtttattgttggtagtggatactgacgaaaacgccgacttgcatgcgcttgttgcttttgcagaagcctatttaccagagacgctgcaatttcatgtcagtccggctgataatgagcttggccggtatgtgagtggtgaatttgaaccgttttatcaacgttaagatgccaaaatcagcgttaatgtgggcattttagccgacagggccgctattgcttttttaaccttgaaacttatcataaattgactctataataaagcccgacaaaattggcgcctgtcagtcattgagctgatcgataacaatcgtgagtgacttgtgacccttggccagtcgaatgaatggaggtggaactagtgcagagtaatcaacggatagcagcgctaatggcacaactgatgggtggcatgaccatccgctcagttgatattcaaaaaaatatgcgatcagccgccggacttgtcaacgcgaccttgcacatatcagagcggcgttagaagattcttctgccggtcaactcgtcgaacatcaaggcacttaccgactagaaccgccaaccacccctttgaacggtcaaatcgtattagccatcagtaatatcctgctgggcagtcgcgcattattaccgagtgagttggatgctgcgctcaattacttgttttcgggactgtctcccgttaagcaagtagaagtgcgtcaacagctccgcattgctcgcggcagctacacaccgttatctcagcccaaacttttattgagtcgcttagctgaagtcgcagcttatatcgccaatcatcggcgcttgacgttcacttatctcagcagccaggcaacagaaccaacaccgctgattcatcatgcccagccagtggcgttgttttttgaagtgcattatttttatgttgccatgttgagtcagactcgtggtggttactggctataccgactggaccggatcggtgagatcaaggctgtgagcgaaggagacaagctggattacgccaccagattctcattacaagaccaccggcgtcagacctatttattggattctggtgatttaatgcaaattcagtttgtttatcgctactatccgcagactgctttggatcaatttcccggctcgcgggtgattcgtcacaacgcagatgggagcgtggtcattgaagccttcgccagattagacggcgccttactttggttattaagccaaggcgctgcactaaaagtaatttcgccaccgtctttgatcaaacgcatgcgtgaagaattaatggctgcacttaatcaatacaagcaatgaatcgcaattgcaggagcatcaaaattcgatgtgtcctgtttttttttggcaattttcggctgccaagtgagttaatgtcatattgtgtcgctatcattcgttaaactaagttgttgttagctgatgacaaagtaaccggcacctgagcaacagtggtgccagctatttgggcagaaacatgaacgaatgaggtattcatttttttgccattttttcagccaaatttagcgaatggaggaactaacaaatggacaataagccaaaatttggactaggtgcacaaccaggccagaagccaaaattagccgaatctgcggcttcaaaagaccaacccaaacaggcctttgggattaacgccaaaccgaacactgcgactccccaaggtccaaagtttggtaccgaagccgccccaaaaaacacgttgtcaaagggcgaccagttcaagcgtatttttaccatgcaaccgataaagttttggatcatccaatacgcattcggcgtggccggcttgctactagggatggccatggggttgccgttgatgctgtcggtgatcaacttgatcttgtatccgttcaccgtcaccattctgcaatcgatcggccaaaggcgggacaagcgaagcacgttaggtgactttttcttcggcttctcagtcgcgatgatcggcgagtcactgtggtggatcctcatctatggggcgtttcggttcatcattttcatgctaaagttcacgttcagtttcctgttggggacaatcggcttggtttacatatgggcacaagccaaaaaaatcaacgggtaatcgtaacaacaggtcagacctatggggtcaggcctgttgttgcttgcatcaaaaagcaaaggagtgatgcgtatgcgtcatgcaatcagtgttggcatggggttcggcaagacaagtttcgatgatgccgtgataaaggcggaagaaggcgatgtcgtggtcattgaccctggggagtataagtcagtcgatggcgttcaatgtggcacgcttgaaattcatggagccggtcagtcgccgacagacgtcgtgatctacacagaatttgacgttaaagaagggggcatgttgaagcttcaaaatgtcaccctgattaacacaaaacctaaaagcaacgtggtttatgtggataaaggcggtcagatgattgccacaagcgttgccttttacaatcgtgtcgcagccgactatcctgtcgtctacgtcagtggaacggtcagcctgaccgcgtgcgagctggcgcatgaaacacgctatgccaacgacggtttagcgggtaccggtttatacttggttgacggtgcttacggtctgatctcacagtgtgatattgtggacattgatgtcaatggttcaaagctggacgcacagcgtaatcagatccacgaaaatattcatttggaagacaacagcgaattcaatgcggatacgttgtacctgacggatcggcgcaggaattatttcatgattagtgccagtaatggatcggtcctgcaggtggatgagctggtggtgccggaaggccaaagcgatgccaatgttgaccatagtcgcatgcgggtgacccggtcgaacatcgacccgttacacacattgaatatcttggttgaagacgatgcagacgttgatgtgcctggggcagcgatcagccagcctcaagttgccaccagtaatggaacccctgaggaacaaccggcccaagccgagccgcctgcagatgataaaccggttgaaacgccggccgcaccgcccgcgaaggccccgagtgcacctgcgcaaccacccgccgaaaaaccggcgattgaccagttacacgagatgatcggtttgaccaagctgaagaaacaagttgatacgttcatcaaggtcgccagcttcaatcaaaaacgcgcggctcaaggcagcaaagccacggcccagtcgctgcactcgctgtttcttggcaatcccggcaccggtaagacgacggtggcccgactggtcggcaaaatcatgtatgaaaacggagtgttgccatcgaataactatgtcgaagtctcacgcgaagacctcgtgtcacagaatgttggcggcactgcggtgcaaacgaaaaaagtcctagaatcagcaaccggtggcgtgctcttcattgacgaggcctataccctgtatcaagaaggcggctctgtcaactgggggcaagaggcaatcgacaccattctcaagtatatggaagaccatcgcgatgacctgatgattatttttgccggctacaccaagcaaatgcaggatttcatgaacatgaaccctggtctgacctcccgggcgccgaatgtctttgagtttgaggattacacccctgccgaaatcgcgcaaattggcctgatggacctgcaccgccaagactacaaagtcgataaggatcattacacccaagccgtcaccaaggccttcatcggcaacgtcgaccacagcaacggccgctgggtccgcaattacaacgaaaaattaattcagaccttcgtcgttagtctccctgaagattcccaaaacttgttcacgattcctaattcgatcatcgaccagctggccggtggtgaccgtcaagaaaaggcagccgcagttgatgcgttgcttggccaactcaatgggatggtcggactgaattccgtcaaagcgtttgttaacgatttggttaagcaggttaaggttgatcaggcactgcaagacaagctgcctgatgccacgaagccgacctatcacatggtgttcgctggcccgcccggaaccggtaagaccacagttgcgcggctgattgcccaactattttacaatcttggcattctgccgaaggataccgtcagcgaggttgctcgtccggacctcgttggccagtacatcggccaaaccgctcagaaaaccggtaaggcaattcgtgacgcgatgggcggtgtactatttgtcgatgaggcttaccagctcagtcagggatcggaaaacgattttggcaaagaggccatcgaaacgttcatcaccgaacttgagaataaccgtgacaagtttattgccatttttgctggttacaccaatgacatgaacgatttcctcgaagcaaacccgggcctgcgttcacgcgtcccgctgacgttggagtttgaggcctacactcctgacgaaattgcccaaatcgtcgaaaatatcgtcaccaagcactggaccatcaacaccgagctcctgcacacagttgtcgtcaaaaactacaaacagctgcctgccaacaaacaaagcaacggtcgctgggcccgcaacttcgccgataaactgatttcccaacacaagttgtggctggctgaccatctcgacaaagaaccaaatctcgatgttcatcatatttcagacgctcttttggttgacagttcctcgtggtcgtaattgtcgcaaaggacccctgatgatgaaaaaattagggtctacactttctagtgttggaggatatccaacattgaaactgtaggcctttttagatcaacccatgccgcttcgccgagggaatcgcctcagtcaaaaatcaatttgcccacccaccttggcccaaactcaccttgacggcatagcacaacccatctttctcaccatgataagattggctctgctatgccgctgtcggcaatcaccgcggtgccacatacgcaattgggcaaagacataatgtgggcattttaaccgacaggagcttgacgccgtgttgttactcctgtatagttgtctacgttgagaaaaagcagaagttcccgcttctcgcccaagtctttagacctctaggcttattagttcggtatttaatgaacagcggggcctttgtggctacgctgtttttgttttttctctgaaattcacacggaggtgaacaaccatagcaagagatctgatagtcaatgacagtattcgcgcacgtgaagttcgattgatctcccagaccggtgaacagctcggcgttaagagtacgcgtgacgccttggccattgccgaggatgcaaacttagatgttgtcctagtatcgcctaatgccaagccaccggtagcccgcatcatggactacgggaagttccggttcgagctgcagaagaaagagcgcgatgctcggaagaaacaaaagactgtcaccatcaaggaaatccgcctgagcccaactattggtgaagcagatttcaatacccgtttgaagaacgcgactaagttcctgaataaaggcgacaaagtcaaagtcagcgttcggttccgtggacgggcaatcacgcataaggatcttggtcgcaaggttcttgagcagatggcggatgccgttaaggatatcgctgctgttgaaacccatccgaaaatggacggacgcagcatgttcttgatgcttgcaccgcgagccgaaaagtaattactgatcggttaatgatacaaaggcgtgcacagccctaaccggctgtgcgcgcgttgatgtttagaggaggaaaaagacatgccaaaattcaagacccaccgcgcttctgcaaagcgttttaagaaaaccgcatcaggtgcccttaagcgcggtcacgcgtatacgtcacaccgtttccacggcaagacgaagaaacagcgtcgtcaattgcgcaagtcagcattggtatcccactcagatatgaagcggatccgccagatgctcagccagatgaaataatcagcaatcggatttgatttgaggaggaattctaatgccacgtgttaaaggtggaacagttactcgtaagcgtcgtaagaaggtactgaagctcgctaagggttatcgtggtgccaagcatttgctgtttaaggcagctaatgcccaagttatggtttcataccgttatgctttccgcgatcgtcgcgctcgcaagcgtgacttccggcgtctatggattgcccggattaacgcagcagcacggatgaacgatatttcctacagcaagctgatgcacggcttgaaagtggctaatgtcgacatgaaccgtaagatgcttgccgatcttgcagtcagcgatccagatggtttcaaagcattagcagacactgctaagaaggctttggcctaagtatttaaaaagcacgtcgtttcattctttgtgaatggaacggcgtgctttttgtatcaagttgaaatggcattcaagaaccagctgctaatggtattgacgaacgcccagtggctgatagttggcaatgaagctgctgattgtcggcaaatccgacgagaacaatacattatcaaaggcgtcctgatcaaagaagccctgagttaccgcagtttgatacatttgctgtaacggacggtaataatcattttggttaaataggatcgtcgggctagcgtttaatccgatccgtgaaaacgagatcgcttcggtaatttcctcaagcgtaccgggaccgccgggaagggcaatgtcagcatccgctaacgcaatcatgcgtgctttgcgcgtgcccatatcttcgacgacttctaattgggtcagattcggtagagccagaccgcgatctgccagcacttgagggatgatgccaatcactttgccaccatgtttcaaggcgctttgagcaactgcgcccattaacccgagtttgccaccgccataaatcagggtatcaccacgttgggcaatccatgcacctacacgtgttgcggcttgtacgaatgcgccatcgacaccacgattagcaccacaatatactgcaattttcatatcgtcccgcctttccagtcacgcgcttatcatacggcgcagattggcgagtcgcaagcagtttttaagtgctagttaaaggtgattgatttcttttcgaaccgggtgcgtcacatgccgctcttgcatgacgactagcttgcccggcgcatgatgggtctctaacatttcatggccggcaatgaccccggcgacagtgaaggggaaggtctgggcaacgcgaacttgcagcccccatttttgcgcgacgtcaacgagataagcaaagccatcgtggactgagtaggtcttggatggatttaactgcagatgttcaacggttggtttggtgctgagatcaacgtcggcataggcagtcgtcacatactgcccgtcagccttgaccagcttcaatgcggcaccgtgatctgctgcgccaaaaaccgcattgaccacagcatcggccgtattctcaggcagttcatcggtataactgaaaatttgatcggcgcctaattgacgtagatactcgcgatgctgctcacccgctacggcaatcaccttgagtttctcgaatttggcgagttgtaccaaaatcgctccgacaccgccgctggcaccgacaatccccaacgtttgcccaggcttaagcgccaacatgtaatgcaaaatattaaatgcggctaacccgacttggggaagcgctgctgcatcaaggaaactcaaggcagtgggctttttatagatcttagaagttgatgccgtgacaaattcactgtaaccgccaatgggtcgataattcataactaaatcgccaactgcaaactcactaacgccttcgccaagcttagtgatgcggccaagcacatccgtacccggaacgaccggaaacttaaccttgcgaaaagccgcctgttcaccacggcgcaacgaagcgtcataagggttaaggccaaagcccaacacttgcaactgcacctgaccggcttttggctccgggacaggcgcctcaatgctttcaaagacacttgggttaccatattgttcaaacccaaaacgttccatctggctcacctccgttgccaatcctgcaatcggccgctattagccaaccaggacttggcatttgctaactctgcttcattcaaattatggctctgatcatggcggaaaatggtgacctcggcgccttgttcttcaagataagtatctaacaccttgaagttttgcgccggcacaatcggatcttgatcgccatgggacatccaaaccttgacatcacttaaatcctgtttggaatcaacggttgaaagcgccatgggatggaaaaagattccggtgtgaaaagtgtcactgcgagttaaaagggctcgggctgctacattcgcgccgtttgaatagcccaccacaataaaccgctcataatcgatattgaatttctggcaaagctcatttaataccttaaacagccaagtggtttcctgttcaagattattcagatcgaagccgccgttttcggaatgcttgaaataccggttcatcccttgttcctgaacgcgcccacgaatggaaagcatcggactattgggtgagagatacttaccaatcggcagcagatcattttcatcgccaccttgaccatgcagtaacaataatggtgacacactgggatcgcctttgacaaatgtataatttacgttttcttctgccatcataacctccgttgcttagcggccgcgccaatcggttttaaccggggtcagaccgcgttcgatttccgcacgtttgctttccaaaaatggcggcaattcaagatgaataccggcttcatcgtaagtttcatcctgtaagaagccgggaccggttgttgccagttcaaacaggacttgcggcgcggcccgaaagtattcggacttaaagtagaagcgatcgacataacctgattgtggcagacgatattgcttaatccgatcaatccaggtgcccaaagtctcacgattatcagtagaaaaagcggcgtgatgaatgttgccaaacccttcaacagaaattggcagatcctcgcgatgctctagaatcacttgcgcaccatgaccaccatcaccaacttcatagagcgaccagttaccatcttcggcaatctgtttgtagcccatgatttcggtcagcacatactgcatatggccgaggttaaaaatcgtgacggtgactgggccgagaccggtgattgcgaattcttcaggaacatcattatgcttccatggcgttccaccagccaccccatggttgtgttcgtccgaaattaattgatattgttgatcatcctggtcgtggaaattgatgattttcgcgtcaaattgggtgttaatcccgtcatttgctacccctttgtcagcaaaccgtttcaaccagtagtccaaagcggcgtcactgggaacccggaagctggcgcgcgagatcatgttggtgccttttttgcctttttcctgattagggaaggtgaagaaggtcatgtcggtgccggccgtgccttggtcatcggtgaaataaaaatgataggtgtccaaggcgtcttggttgaccgttttcttaattaaatgcaggcctaacgttttactcataaaatcaaaaatcgcttgtgggtcacttgccatagcagttacgtggttcatacctaataatggatgttcaatcatggaaatccactcctttagttttgaaataagtttcgatttcggcgcgccggtcttcaaatttcggtggtaaaccaaggcgctcacccaaatgttccagcggctcatctaaagtgaagcccggcgcttgagttgcaaattcgattcggttatcggccggatcacgcacgtacaggctcttaaaccagccgcggtcggcgaattcctcgatttcgtaaccatgttgagcggcaatggtgcccaatcgcggtaatgcttcttcatggtcaaccgtcagcgcaaaatgatccatgctcccgcggccaaaacgcttagtcccagccgtcaaacttgggcggatggtcagggtgttgccagcggccagcttaaattgatgctgctccggcgcctgtcccaacatcgtttcaaaaaaggcttcttcggcatcacgatctgcaacagggatatcaacgttaattaagccagtgatctgctggcttcccggaacatcattgggaaccgttagcgcatccggcaaagtccgttggtaggggatgagtcgaaccggggtatccgcggggtcaaccaacgcaagccaattagcgattttcgtcaccacacaacccgcttgttgcaaccgctcatgccaaaatgctaacgactcagtaggaatcgacaaatcaatcccgcctaattgatttggcccatcataacgatgccccagtcgatcaatggcaaagaaggtcacgacactgccgggtgttccctgataatcaccgaaaaataagtgccgtacatgaatattttcctgattgacggtatttttgaccaatcgcaatcccaaaacatcggtatagaatcggatcgttgcggcagcatcgccagtcagcaacgatacatggtgcaaacgagtcatgatgagcctccttctttataacacttactaaaaataagtataacaggcttaatatcggaatgcgagcgtttgctatcaaattcatcctaccctgtttattctgataacgcgattatttcgccttttaaagataacgtttacatttttggcactgccaatgcgaaggctgttacttagctgcaacttggtggccgattttggggcttgagatttgggtgggccgcggttgccataagcatatttaccggcgtaggagtctgcgtgtaagggcattgagcgtaatggccaagaccgagccgttatgtctaagggcactagttcgcttttactcccataacgcgctccccagcgcaggagtctgcgtgtaaggaccttaaacgcaatggccaagaccgggccatcacgtttaaggccgcttacactccgactcctaaccgcgctggctcgcgctcaccagttttttccgttataatataaggatatgaacaaccggagaggggacaggatttgtggcagtttttgagccgacttggctggtaacgaatatttttagcctgacgcctgctagtctaaagcagcaaggtattaaagcggtgttgaccgatttagacaacacgctgatggcatgggatcacccagaaggtacggctaagctgacccagtggctttctgatttacgtaacggcggcatccaggtggttgttgtgtcaaataacaacgccaatcgtatccataaagcgatggcaaagctgcaagtggcttatgttgcccgggcattaaaacctttgccagtcgggattaccaaagcgcgcaaagaattagggctgacgcgttctgaagttgtcatggtaggggatcagctgctgacagatatctgggccggtaatcttgccggcgtgcggaccatcttaactcagccgttggtgcaaagtgacgcctggaacacgcggataaatcgcttttttgagggctttgtttttaaagccttagccaagaaaaggcaactgaattatcaggaggatattcatggacatcatcaatgatgaaacagagcgccgctgcataggctgtggcgctattttgcagacaaccgatcctaaaaagccaggctatctgccagccgcgacattagcaaaagccgaggctgacgatgacatttattgccaacgctgctttcgactgcggcattacaatgaaattgcacccgtcacgttaactgacgatgattttttacgcctcctgaatgcgatcggtgaaagtaacgcattgattgtgaatgtcattgatatttttgattttaatggcagtgtgattcccggattgcatcgttttgtcggggataatcccgtcattttggtcgggaataaggcagatgtcttgcctaaatcgttgaatcccaataaattaaaaaactggctgcagcagcaagctaaagcgcagggattacggccggtaacaaccttgctggccagtgccaaaaaaggatttggggttgacgagttactcaccgctatcgagaagtatcgcgaacatcgcgatgtgtacgttgtcggggtgaccaatactggcaagtcaacgttaatcaaccgcattattaagcaattaaccggtgtcgaggatctcattacaacatcgcgcttcccgggaaccacgcttgatcgcattatgattccgttagatgatgggcagtcgctaattgacacgccaggcatcattcatcgccaccagatggcacattttgtcggctccaaggatttgaaactggtatccccgacttcggtgattaaaccggcgacttatcagttgaatgaaggccagaccatctttctcggcggactggcacggttcgattatcttcgcggcggccgccaaagctttgtcatttacgccgatacgcaattgccgctgcaccggacaaaattgatcaacgctgatgagttttatcagaagcatgtcgggggtcttctagcgccgccacaagctgatgaagtcagagattttccgccgctggttcgctttgaattcacgccgaaagaaaaatcggatctggtttttgccggtctcggctggattacggtaccggctggcgtcaccattgcaggttatgcccctaaaggcgtggatgttttattacgtaaagcatttatttaaacgagccgcagccaacccgcagcgacccaaaagctgcacgggtggtggaaaggcggcacaactgaatcagaggagcgttaaaaacatgttaactggtaaacaaaaacgttatttacgcagtttggcaatgacgaccaaaccgttaattcaagttggcaaaaatgggctaggcgatgcttttgtcgctggcgtaaaggatgccatcgaaacccgtgaattagtcaagatcagcctgttaccgactgctgacgatacaccgcaagaagttgcggatacgttacaggcagcgattgccggtttggaagtggcgcagattattgggcgcaccgtgatcgtttataagcaggctgaaaagtcggaacatcgtcgcatcagtcttgaagtcaatgcgcggtaggagttgtgatgaaaaagatgcagaatgtcacgttgacgcaaccggttatttctgttgcgatgcgcgaacagattctgggaacgcatcgtcgcaagcaggttggtttgttcggtgggaccttcaatccgattcataacggtcatctgattatggcagaagcggcaggcactgaattaggcttggagaaagtttatttcatgcccgataatatgccaccgcatgttgatacaaaaacggccatttctgctcggcaccgggtgaatatggtacaattagcgattgccgataatccactttttgggttggaaggcattgaaattcggcgtgggggcattagttacacgtatcaaaccatgcaggagttgcaccgacttcatccggatacggattactactttatcatcggtgccgacatggttgactacttaccaaaatgggcgcacattgatgaactggtaaaattagtaaccttcgtcggcgttaagcggcgcgggtatacaccggctagccgctatccgattttatgggttgacgcgccgctgatcgatatcagttcgacagcggtgcgggatcgcgttcaagcggggcgcagcttgaagtatttggtgcctgacccagtgattgactatattcaaaaagagggattatatcgtgaatgaacatcaatatccagcaagtttaacgcatggcttgagtcgaaaagaaattctgaatcgcctacgtaatcgccttgatcagcctcgctatgaacattgtttgcgggttgaagcaacggctatcgaattggcaaagcgttttgaccaagatgtggatcgagcaggtttggcgggcttactgcatgattatggtaaagaaatctcggttgaaacatataaacgcgtgattatcgaagacggctttgaccccaagttactgcagtatggccgtggtgtgtggcatggcgttgtcgggattcattttattcaaaccgaagtcggcattaccgataaacaagtgctgacggctattgcgcggcatacaaccggtgatccggaaatgaccaagctggatgaatgtgtgtttgtcggtgactttattgaaccccaacggtcattgccggttgaggccaaagcacgcaaggcagccgaaactaacttggaagaagccagccgcattgagcttgaaaacaccctgacctatctaatcggggcgcgtcaattggtttatccgaaaacactgttaacctacaatgcatttttatcaaaggagtaatttatgatcgacgcaaaaaccatgttggaaattgctgttaaagccggtgattcgaagcgagccgaagacattgttgcattggacatgcgcggtgtgagtctgttggccgattattttgttatcatgagcggcacttcggatcgtcaggttcaggcaattgttgatgaaatcgaagaaaaagaagaagcggccggcgttgagattcgccggattgagggacaaaaagggtccaagtggatgctgattgacttaaacgatgtggtggttcatgtctttatgccagaagagcgacaattctacaacctggaaaagttatggcaagatgcaccgctggttaaagtggatcagtgggttgaggcatgatctacacgacctttgccgaagtttacgaccaattgatggatcagtcattgtatcaacggtggcgtgattatgtggtcaagcgagtgaagccgagtcatcagccattgcttgagttggctggcggttccggctttttggccgtgctattggctcagtcaggttatcaagtcacggattttgatttatctgaagaaatgttgaccttggcagaggaaaaagctgatgctgcaggggtggcattaaccctgcttcaaggcgatatgcgtgatctggaaacgctaccggaatttccaattgttacttgttttgacgattcgatttgctatatgcagaatctggatgaggtgcaacaggtctttacgcaggtagcgtcaaagttgccgactggtggcgactttctttttgatgctcactcgctttatcaaatggatcaggtctttccgggttatatgtacaactatcaaacggatgactttgcgttcttatggaatagttttattggtgagcatccacatagcattgaacatgacctcaccttttttatgtacgacgaagccttggatgcctataagcctttgacagaaacacacaaggaacgcacttatccgttggctgattatttgcgggccttacagaatgccgggttcgaaaaaattgaggttaccgacgattttggcaacgagccggtgggacctgaaagtacgcgctggtttttccacgcgcgcaaaaaatagtcgtgatgagccaaatgaataagcaaatttattaggaggcgtctatgcaagcggtcggtatgattgcagagtttaatccatttcatgctggtcacgcatatgcactggcacaagcccgaaaattaacgcaagctgatgttgtcgttgtggtgatgtcgggaaactatgtccagcgtggcgaacccgcgatttttgataagtgggtgcgggcgcgggcggcgttggatcatggcgccgatattgtcattgagctgccggtaaccggagcggtgcaagcggcggatcaatttgcggaagccggggttgcgacgttagcggcgttacgcgtgaccgcactggcatttggaaccgaacaccccgaacttgcctatctggaccttgcccgacaattagaaaaagcccctttgacggatccgggattttcggattatacccagacttatgcgacccagcttaatgccgcttatgcaaaagcagccggcatcacgcaaacagacccgaatttcatgttggggttgagctatgcaaaagcggttttggcgttgcaagtgccgatgcagctttatccgttcggtcgacaaggcgtggcccatgacgcgctccagttgacagctaatctggccagtgcgtcagcgattcgtcagcgattgcgcagaggtgaatcgctcgcgaagattgttcctgcagatctgattccggtttattctaagcagcaacaatatgggtggtcgcaatattttccatggttgaaatatcgtctacagacagcagatttggcgcagttgcggcaggttgccacgatggcggaagggctggaatatcgtttcacccagcagattgatgacgctattgatatgacgagctttttaaagcgggttaagtccaagcggtatacctacgccagactgcggcgattagctttagcaatcacgctgaatatgacaatagcggcggtggaaaaggctcggcacttgccgcagctgcatgtgctcgggtttacgccagccggtcagcaatacttgcgccaggttaaacaccaagttggctggcccttgctcactcgcgttagtgctgatatgcttgcaccgaatgggatccttgcgatgacccatcgtgcggatcgattaatcaccacgattagcggtgttgaacaaaattatggccgccgaccgttgatgtgaaacgcgctcataactccatcttaaggttagtgtgcgcgtctaaaggaggcaaaataacatgttgaaatggacgattcaggaattaatgaaacacgatcaggaaccgttgcattttagtaccacgttggatgtcaaggcagatttgcaggatcgtgatccagaggttcttgatgtcagtcccatccaggtaaacggcgatattgtttatgatcgcggcgattttctggttagtgtcaacttaaagggtactttggtagttccctcgacgcgcagtttgaccccagtcacgctgccacaggatttcacgtttagcgagatctatctgaccgatgacggccatgccgatcaatatgaagacggcgaaattctgatgccgcttgaggatccggagctggatttgttgccggcagtggaggatcatttgttgttaagcatccccatgcaagtgctaacgccagaagaagccgccagtggcgagatgccttcaggcgaggactgggaagtcatggctgaagaagattttgataaagccgttaaaaaagagaagcaggcagataacccttttacgaaattaaaagggatgttcccggatgatgatcagtcgtgatgatatagcgagttgatttattggaaaacggcaccttcgcgatggcatttagaaggggctgtttttttctgttaacaaaaaatggtttatccgccaagcttgtttcgccactagaaagatgacttcaaaaaattagatcaaattgagctgtgataacccgtctgccgactgttaaagcgcggcggtttctgctaacataaaagtcgtaaatgatgaaatgaatgaggaggtccatgttaatggataaaccacaaattggtgttgtcggcatggcggttatgggcaagaatcttgccttgaatatcgaaagccgcggcaataccgttgcaatctacaatcgtaccggaagtaaaaccaaggcggttgtagaagaacatccggacaagaaattggtcccgagctataaaatcgaggactttgttgcttcattagagaagcctcgccggattatcatgatggttaaagccggtgccggtaccgatgccgtgattaaagaattattgccgctgttagataaaggtgacgttttgattgatggcgggaacaccttctttgaagacactatgcggcgcagtgccgaactggataaatccgggatcaatttcattggtatgggcgtttccggtggcgaacttggcgcactacacggaccatccttaatgccaggcggccaaaaagaggcttatgacttggtagcaccgattctggaggctatttcggcaaaagcggatgacggtgcaccttgtgtgacttacattgggccaaacggtgccggccattatgtcaaaatggttcataacggcatcgaatacggcgatatggaattaattgctgaaagttacaacttgatgcgtcatttgcttggtttggacgtagaagaaatcgccggtatttttagtgactggaataaaggcgaactggactcctacctcatcgacatcacggcagacattctgacccgtaaagacgatcttggcagcgacaagccgatcgttgatgtgattttggatcgcgctggcaacaaagggaccggcaaatggtcttcacaatctgctcttgagctaggtgttccgcaaagtgtgattaccgaatccgtctatgcgcgttacattagtgcgatgaagcaggagcgggttgcggcaagtaaagttctgccaaagccggttggcaatgtgacgattgacaaaaaagaagctatcgagatgatccgtaaggcgttatacttcagcaagttgatgtcttatgctcaaggctttgaacaaatgcgcgttgcatcggacaactacgactggaacctgcaatacggtgaattggccaagatttggcgtgcaggttgcatcattcgcgcacgcttcttgcaaaatatcaccgatgcctatgataagaagccggatttacagaacttgttgttagacgattacttcctgaatattgctaagaactatcaggaaagtgtccgtgacttggtcggcttggctgttaaagccggcgttccggtgccgggcttctcagcggcgatcagttactacgactcttatcgtgcccctgttctgccggccaacctgactcaggctcagcgtgactactttggtgcccacacatatgaacgtactgatcgtgatggcattttccattacacgtggtacgacgaagcttaattcattgaagtttaagtctaaaccaattcacctgcgattaagtgtcgcatgtgaattggtttttttaatctatccttgtcacaaaggctttgacaatcagacttaaaaaatggtatatgtttcgtaaagacagattagaaagtatcgcgggttattatgagaattagccgaattgaaaaatgagagccttgattaataggcatttccattagcattgatgcctattaacgcggggctgatagtcaaaatgagaaaactgtgctaaactatcctagcgtatgtttttatgagaaactaaaaatagattcagattgtgtgttcatgcaccgaaagtataaggagacgctaatgagtaaaatattaattattgaagacgaaaaaaatcttgcccgctttgttgaacttgaactaaagcatgaaggttacgaaaccgaagttcactttaatggccgtaccggtttggaagcagccctagcagaagattgggatgctatcttgctggacctcatgttgccggaactgaacggattggaagtctgccggcgtgttcgtcaggtgaagaatacgccgattatcatgatgacggcgcgtgattcggtgattgatcgggtcagcggcttggatcatggggcagatgactatattgttaagccgtttgccattgaggagctgctggcacggttacgcgccttactacgtcgaattagtattgagggcgaaaacaacactgccaagcaaacgaccatcaagtatcgcgatcttgtcatcgaaaaggaaaatcgcgttgtgcggcgtggcgatgacatcatcgaattgaccaagcgtgaatacgaattgcttttaactttaatggaaaatgtcaacgttgttctagcacgtgatgttttgctgtctaaagtctggggttataattccgatgttgaaacgaatgtcgttgatgtttatgtccgctacattcgaaataaaattgatcggcccggtgaacctagttatattcagacggttcggggaaccggctatgttatgcggtcataatgcatatcaagcaaaccagtactaagcaaaagaagaatccccgcatctcgttgaaggtcaaatgggccgtcacagttggtgtcgggatttttgtcacttttgtcactttttcaatgatcctttatggtgcgatgcggcagattctgattaatcaggagcgtcgaaccgtcaccgatacccttaacacagtcgtccaacggctttccccagtcagtggcgatttgaccatggcccaggtggttccgcgattggaagggacaacgccgtccgatcagtcgtcactacctactcccagcgagtcacacacgcggattttttctgattccgttattcagaaattggctcaggcagacgttagcgtgtcggtgttttcgcgtgatcggacgacaatttttcagtcgcgcgacaccccgatcacgttgggtaaggttcatggatttgaagttcaggaaagtcatatcggtgattttaacggactggtcggaactgcacctatttattcggctgagagttcaaatttgattggttacgttcaggtgacgaacaaactgacagcgtttcatgcgaccatgcatgaaattaccttgttaattattggtttaagttttgctgccattctcatttcaattctaattggctatgtgctggcaacccgattcttaagtccgattaagctgattactaatgccattgatgttgtcaatgaggagccgcaaagcacggttcggattccggcattgaagcgcaatgacgagcttggcgatttggtgctggaatttaacggtatgctggatcggattcaacgttacattgaccagcaaggtgaatttgtacaggatgtttcgcatgagctacgaaccccagtagctattttggaagggcatttacaactgctcaatcgctggggtaaggatgatccggaagtgcttgacgaatcgctggctgcttcacttcaagaaatcacccgtatgaagagcctgattcaggaaatgctggatctgacgcgcgcggatcaggtggatgttcagtttcccaatgcggttgtggatgtccacaaagtcatccagcaggtcgttgccgattttcgcatgattcatccggagtttacgttcacgctagacgatgacttggagcagacaacttttgtccgcatgtaccgcaatcatctggagcaagtgatgattatcctcctcgataacgccgtcaagtattcgactgatcgcaaggaaattcatgtctcaatggcccaaaacagtggtaatggcgttgcagttgccgttcaggactttggtgaaggtattgccgaaaaggatcggcgtcgcgtgttcaatcgcttttatcgcgttgataaggctcgcagtcgcgaaaaaggcggcaatgggctggggctatctatcgctcagcaactgatcgaaagctatcatggtcaaattgaagtagactccgctttaggtcatgggtcgatcttccggattgatttgccaacgatttcggcggacaaagccaaagcacttcaacgccaagaagcagcaaagcaggctgctgcgccgaaaagtgatacgtcaattaaaagcaatttgtagtcggaacacaatcaataaatgaaccggtttcggagtgtgagcattcttgttaactctgaaaccggtttttggcgtgtggccatatttttgcgctgccagtaggagactttgccaattgtaagcagaggcgtgtacaccacttttgtgtttatagagaattcaaatttcgacaaacaaaaaagccgcctaataaagacgacttcaatgtgttggtaatttacttacgtggccgttgttgtttgccggcgtttcgtttgcgtaattgttgatgatcaatggcatctggatctactggttgctggcggctttgagttccagtcgatccggcagtggccgtgacggcaccccagtcatcaaaggtatgttcattaacgacttcaacaggcggattttcttccatttcggcatcaagccgtttccggatgttaggcgtcacaatataagtcacgatggcttgctggatgatgagaataatcccaccggcaccaaaatacagacccaatccggcgttgtacatcatacagaacacaaatgtcatgatcgggctcaggaaagccgttgcctgcatagcttttcgctgctctggcgggacgccttgaagcatgatcaggctgacaataatgtatggcaacgtggctaaaatggtgacaataaaactggaatgccccagctgaatgccaaagaaagttgcgtgtgaaatttcaggtgaataagcaatagcttgatacaaacctgagaaaattggaaattgaatgagcattggcaagcaacccattgacgggatcatgctggtgccattagcagaataaattttccgcatgtaattattcgcagccatttgttgttctggcgtttttgcgcgcttaacggcatcctgaacaatttttaattgcggttggagaatcttctgcttttcctgataagccgtcatggttcgttgttggcgcagcatgagtggcaacacgattaggcgaaccaacaaggtaatgacgataatggcaatgccgtaactgctggtcgacccaacgaatccggcaatccattccatcaaatgctgcaacggcaacccgattatcttatagaaagtaccgaaaaatggatctgtcggcggcttgagtgtgacgccttgtttcgttggcgaacacgctgataataatagcggcagaatgcctaccgctcctagtgcaaatatttttttcgacttgtgcatgaataatttcccttcaaaatgtcatcgggtttaactatactgtatggaccaagcggattcaaccggttacacgaaaaccgttgaagtccggcacgttttcaagcggcttttcttcaaaagtcgacacgttagcgtaaggattcggaccggctttgacctgtgcaatgaatttggctagattgagcggttcaccggctgcttgaatgaaaaccgagccgtcagcgcgattttcgatggtgccactaatattgagattatccgcaatcatcttcgtggcccagcgaaaaccaacgccttgaacccgtccccgaacgacgatttgtttagcgagtttgaccaaaaagacacttcctttcgtgcagaagatttgggtcgaaaggtgatgaaaacatcttcatctttgctttctccacagtccatactagtgtagcataaggtatatagaaaacgcgacaagaggctaaagtcggatttttgtttgtgaactggcgattggttaatgctggctcatgctcatcataacgcgttcaccagcccagaaacctgcacataaggaccttggtcgcaatgaccaaacccgggtcatcacgcccaaggccacttatgctccggtttctaaccgggctggctcgcgctcactttttaaaaggagatttttatggaatatatttcatcacccaaaaatgaccgcattaaaacggccaagaaattaacggttaagaaacatcaaaaggatgctgggcgctacttgctagaagggcggcacttggttcaagaggcgctggcgagtgggcagacgccttatgatatttatgctaccgaaaagtatgttgatgatcgtgcgcttaagccgttttatgacaaaatgacgcagatttcggagtcggtttccgagcatcttagtgacaccgaaacgccacagggaatttttgcggttatgccacgtcaggccgggcaattgccagatcctttaagtgggcagtttttaatgttggatgcgattcaggatcccggtaatgttggaaccttggtgcggacggcggatgctgcgggcattaaaaccgtcatttttggtaatggaacagccgacgcttttggtccgaaagttttgcgggcgatgcaaggcagccaatttcacgtgcgcatcgtatcggcaaaattgatgcctgttattaaagccttgcaacgggcagggattcccgtttatggctcggagcttaatgataaagctaaaagttatcgcagtattcaaccgagcgcacagttcggactcgttgtcggcaatgaaggcaatggcatggatcctgttcttttaaagcaaaccgatacgaacctgtatattccgattcggggacaagcagaatctttgaatgtcgctgtcgcagcggctatcatgatgtttcacttagtcggtgattaagaatgtgttacgaacgtgctttttagggtgggaagctgttatactatgggtgtgttcatcaaaccacaaaaggagcagatgtcttgagcaaaaaacgcgattggcaatcggatgctgagtacgttgggtatgtggctgatttattggctaagcctgaggtccagcgactggcagaacacccacaacaccattattcgaaccgattggaacattcaattagtgtttcctatcagagttatttgattgggaagcgcctgcatttgaatgttcgtgcgatcgcccgagccggcttattgcacgatctgttttactatgattggcgcaaaaccaagtttgacttgggaacgcatgcctttatccatccccggattgctttacggaatgctgagaagttaaccgaattgtcaccgatggaaaaagacattatcatcaagcacatgtggggggcaacagttggcttgccgaagtataaggaaagttttgttgtttctctagttgatgattatgctgcgatggatgaggtcgttgtaccctggatgcacaagctccggcatccgattcacactcacttaaaagctttaaattaggatcgtgattgacggcagctcattgttattgtcgtcatattagagtcgtgggcggtgtcccgcggctcttttttgacgggtatattttcccccacgagccgacattaattgtgagagcaaaattcaactttggatgcagtgccacgctttgaaaacggattgtgagtttttttcgtttattttagacgcatcaattagcttttgagttgctgatgataagcatgacttgtaatattttgggagtgtgttatgctaacactatctaaatgtaagtaagcgggtatgatgaggtgagtagagtggatgcaacagtaaccagtaaaaccgaatgtcaaagtcaacaagtcgctctttgtcctaagtttcagcacacatttgaaattttgggtaagaagtggaacggtttgattctggaagttttgttaaacaatggcaattctcggtttaaagatattgcgcaactgattccccggtgttcggatcgggttttggtcgaacgcttgaaggaacttgaaggcgagggtttgattgatcgtctgacgcacaaggactcggatttaattgaatacgccctgacagataagggccgggctttgaattcagtcatggccgctgcacacgcctggggtgatgcatgggttaccgatgaagagtgccatgccaatgaaaaacaaaaaaacgcgtaagagacgcgtttttttcttatgccattgttgatcattagccggaacacatctgagaggccctaagtaaaaagagcctaactacctaactattagccatcagctcttgacgtctgcgctgaatttgctaagcttgtcttatcaaaaaaatgtaaaaacaatgacgaaagcccaaacaggctggtaaatcagggaatgacgttcacgagactgcaagacgtctgttaccaaaatgtttgtcttcactttctgagttgacttttgaggtggcaacacttagaaagctccggcctggccgttaccttgttgagtgcatgaggttttttaatcatgaacaagggtggtaccgcgatgcttcgtcccttttttgagaagggactttttttatgccttcaaacgtatcaacggcggacttctcaggttagcagtcaaggaggaagaacatggatcttcaaacgaaacttgaacaactttttcagcaaaataatgaggtgataaaaaagatcacctcgttggacgaattaaatcagattcgcgttcagttgttagggaaaaaaggccccatcaccagcgttttgcgcggcatgaaggatttatcagcagatgaacggccaaaagtcggtgcctttgccaataaagtccgggatgaactgagtacggtgattgagacgcgtaaatctcaactggagcaggcagtcatcaacgaaaaattgaagtctgaaaccgtggacgtcacattaccaggcgatccggtaacggcgggcacaccgcatattattattcagattatggatgaccttgaaagcttctttatgggcatgggctatcaagtgctaaccggtccggaagtggaagaggatcattacaactttgaaatgatgaacatccccaaggaccatccggcgcgggatatgcaggaaactttttatattaccaatgagttgctgatgcgttcccaaaccagcccgatgcaggcacggacgatggagaaacatgattttactaagggcccgctgaaaatgatcagtccgggcgtggtttatcggcgtgatgatgatgatgccacacatagccaccagttccatcagatggaaggtctggtgatcgacaagcatattacaatggctgatcttaaggggacgttactcgccatgtgtcagcatgtgtttggcgctgatcggacgattcgcctgcgcccgagctattttccgtttacagaaccgtctgtagaagtggacgtttcctgcttccgctgcggtggcaagggttgccctgtttgcaagtataccggctggattgaagttctcggtgccggcatggtgcatccgaatgttttgcgtgcggctaatattgacgccgatgtatatggcggctttgcgtttggtcttggcccggatcggtttgccatgctgaaatacggcattgacgatattcgcagtttttacacagacgacttgcgcttccttacgcagttcagtcaggagggttaagatggacgtttcatatgattggttaaaagagcttgtcaacatcccggtatcaccggaagaattggccgataaagtgtcacgaaccggaattgaagtggacgatgttaaacatcccgatgccggattgaaaaagattgtcgttggtaaggtattggcgatcaaacctcatccaaactctgatcacctcaacctttgtcaggtagatgtgggtgaagatgaaccgcgccagattgtttgcggtgctcccaatgttgcggctggccaaacggtgatcgttgcgcttccgggagcacggattgccgataacgtcaaaatcaaaaaaggcaaaatgcgtggcgaagaaagccttgggatgatttgtgctttgcaagaaatcggctttaatgaaaatgtcgttcccaaagcttatttaaacggtatttacgtttttaatgaaccgctagaaccaggcagtgatgcgttggccgcgctcgggatgcatgatgccgtgttggattttgagattacgccaaatcgcgctgatgctttaggcatgcgcggagttgcttgggaagtgggcgcgacttatgatgaaaagccgcactttgaagaaaagctgctgacagaaggtgatcgtccagtggcggattatctcagtgtcgaagttaaagacgctcaggatgccccgagttatcagttacgggtgattgaccacgtcaccgttaaagagagcccgctttggttgcaacggcggttatggaatgctggcgtgcgtccgattaacaacatcgtggatatcactaatttcatcatgttggcatatggtcagcctttgcatgcgtttgactatgctaaactcggtagtcagcacattgaggttcggcgggcgcgcaatggggaaccgttgaccacactggatggtggcgaacacgaactagatgacagcgatatcgtgattacaaatggtcaggtgccagttgcgttagccggcgtgatgggcggcttggattcagagatctcggaaaccacgaccacggttgtcgttgaggctgccagttttaatccggttaacgttcgtaaaacagcgctgaagtacaatttgcgctcagaggcatcatcgcggtttgaaaaagggattaacttagctgatattaatcgcgctttagatgcagcagttgcctggatgagcgacttgggtggcggacaggctgccaagggaaccgtaagtccgactgcggttgacgcaaaagatgtcgtggttgatatttcgctggatcatattaatcacgtgttaggcacgacattaagccaagaccaggtgacacgaattttccaacaactaggttttggcgttgaagttgctgatggtttatttgcggttgcgattccacctcggcgttgggatattcatatcaaagcggatttggttgaagaagtcgcccgtatttatggctttgacaatttaccaagtacacttccgactactacgatgacgattggcgagtatacaccagcgcaaaagcgaattcgccgtacccgccatctcctggaagggttgggtcttaatcaagcgattacttatggcctgacgactgagcaagcggcaaccagatttaagttgcaacccggcgagccaacgcaggttgattcaccgatgaccaaagaccatgccgtactacgaatgaatatggtgacaggtttattagatgtcattaaatataatcaggcgcgtaaagaaacagatgttgccatttacgaacagggacggatctttaccaaaaccggtgatcaggtacggccaactgaaatcgagtatttaggcggtgctatcactggccacgtagccgccaaaaattggcatcaagccgcacgcagcgttgatttcttctatgtcaaaggcattgtgatgcacttgctggaggattattcattggctgaaccggtgcactttgcagtgactcaggcggtgagtgaacttcatccgggtcaggcagctgatattttggtcgggacacaacgagtcggcttcttgggccgtttgcacccggcgtttgaacatgaacagcatctacctgcaacctttgtctttgagcttgaccttgatgccttatttgcggcgccgcgtcaggagaagattgcccagcctgcaccgaagttcccggctgtgacgcgcgatattgcactgcaagttgccgataccgttactaatgccgaagtgatgcagatcttccagcaacacggcggcgcatatctcaaagacgttaccttgtttgatgtttatgcaggttcgcatatggcgccgggccaaaagagtctggcttatacgctcacttatcggcgcgatgaccaaacattaaccgaagaagaagttacgcaggcttttgatcgagtcaaagcagcacttgaatctgatttaggggcaaccattcgttaatcgttggtcgcattttagccggtggttcggtatgatagtcactggcaacggtcagtggactcagtaacattcagactgtatcgcgtcaccgtcaagcatgatctgacggtgacgttgctacataatggcgttgtcatagctttgtctgttatgccgggcggttatttgtgtacaagcataacggatgaggttaacgttggcatgagaaaaaggaggcatctttttggacaagcgatccccggacgtggcgggtaaacgacgccagcggcaacatgagaaaaaagcatcgcaaaaaatcgtcggttgggttctcggtattttatttgctgtgcttgtgattgttggactgatgggctaccggtatgtcaattccgccttacagccagtcgaccctaatggcaaaacaagcattaatgtgacagtcccggctggctctagcacgaaacaaattgcgagcagattagaagccaagcatgtgattaaaagtgccatggtcttcaactattacgtgaagtttcacaatattgccgattttcaggcaggacgctatcaactaacgcaacgtgacaatatggatcaggtgattcaaaagttgcgtgtaggcggtacttcagcagccgcggcgggacagttgctggtaaaagaaggcgcaacggttgagcaaattgcgacttccgttaataaattggctaaatccaatcaaaatctgacgagcaaaaaattcctggccttgatgaaagaccaaacctttttcaaccagctggctaagaaatatcctaagttacttagcgctgcagcctcggctaaaggggtacggtatcgtctggaagggtatcttttcccagccacttatagcatgagcgccggtgaaaccaccaaggatctggttgaggcaatggtggcaaaaactgatagcgtgatgcaaagttattacaagagcgttaagaaacaaggttattctgttcaggaagtgatgaccttggcttcgttggttgagcgtgaaggggtaacccaagaagatcgtcgtaccattgcgggcgtcttcttgaaccggattgatgccggtatgccactgcagtccgacatctctgttatgtatgccttgaatacgcataagacgcatttaaccaacaaagacactagcgttgattcaccgtacaacctttatgtgcacaccggttacggccccggaccatttgattcaccgagcgaacaaagcattgctgctgttctcagtccgaatgcccgcagcaaggattatctgtactttgttgcaaatctgaagacgggtgaagtgctgtatgcaacgactcgcgagcaacatgatgctaatacagctaagtttgcaagcgataatgccgctgccgataaataagcgcaaccgttgatgaaggcatcgcgatcatcaaaccaatccaatcaacaacgtgacgttctgacagcgcagcaggcagccaactttggatatgataaaatcatgtccggaagctaaatcaaatttcaggttaagcggccttggaagcagtgtccaaccagcggacgttatttccaaggctgtgttatgcgcagatcttatatactgagtgaggaaggctaaaatgcaacagaagaaagctattgtgattggtgtgacaggtggctcagccagtggcaaaaccagtgtcagtcgggctatttttaatcatttttccggtcattccttgctcttgctggcacaggatgcgtattataagaaaagtgacaaaccgttttcagagcggaagaagatcaattacgaccacccgttagcatttgacacgccgctactcaaacatcatctggagcaactcattcatcgacatgccgttgatcagccggtgtatgattacaagattcataatcgctcggataaaacggttcaccttgagccaaaagacgtgatcattctcgaaggtatcttgattcttgatgacgaagcgctgcgcaacatgatggacattaaagtgtttgtggatacggatgacgatattcgggtgattcgtcgtattcgccgggatatggtgtcacgtggtcgcacgctggaatccattattaatcaatatttaaaaaccgtgaagccaatgtatcatcagtttgttgaaccaacgaaacgctatgcagatctgattgtcccagaaggcggtcagaatcaggtcgccatcgatttgctggtcacaaagatcaaaagtattttggcagagcgcggtttagaagagtagccattgacaaatggttgctggcttaataaagtgactaaagaaaataagaagtgaggtaagtattttatggcagacaaaagctatccgatgacagcagaaggtaaaaagaaacttgaaaacgaattagaggaattaaaaaccaagaagcggccagaagtgatcgaacgcatcaaagtcgcgcgtggttttggcgatttatccgaaaactccgaatatgaagcagctaaggatgagcaatcaacccttgagaatcggattgttacgattcaaacgatgttgcgctatgccgaaatcattgatgctaaggcagtcgcaaaaaatgaagtgtcaatcggtaaaaaagtcacctttgaagaagacggcgatgaggaaacttatgaaattgtcggtgcggcagaagcagacgccttcaacggcaaaatcagcaacgaaagcccgatcgctcaaggactgatcggacgtaaagttggcgatcaagtcaccattaacacgcccggtggtgaaatgaccgttaagattaccaaggttgaaggataagcgagtttttgacgatttgtatgcttcagttttgtaagtaaggcaaaagcggcaatcacgctcaaatgcaagagcagtgattgccgtttttttgtgcttggccgcgcacaatgacgtccacctgtatcagttttcgtgccagtttccaatgaatatcagccttacgccctaagcgagttgtgttccgattcgttataataattcgtgaatagtagcaggctttttcggatagtgtgctctaagttcacaacgatttttagataaggagggatcgcaatgcgccgctggcaactgtttttaggaattgaatttgcgttgatcctctggctggggtttcagatcatcaccaatccaatggcgttgacaacgatcctatttggcgttctttttctctttttaggcgcgcgttggcatcgaatgcgtgcgttcaatgtgacatttggtggtatcctgttggtactgggaatctttattaatccggcagtctggttgattctcatggtagcaggcgtgttcctaatcatggtgttaaccaagccggggatgggtttttcaatgtgggaccgcaaacaatacgttgcaccggtcacgcaggagcctgggaaaaaagcgggtcgccgcacagttcattcatggggcaaccggcaaaccattgcaccgagttacgactgggacgacatcaatatggtcgttcctgctggcgataccattattgacttaggggatactttcctgcctaaaggcgacagtgttattatgattcgcaaaggctttggtaaaaccagaattctggttcccattggcgttggcgttgcggttgaacatgcgacattttacgggcggctccattttgaaaatgcggactcgatgctgcatagtcaaagcgtaacgatgtattcgcagaattatgacgatgcaccacggcgtatccatatcattacgaatgtagtggtaggtgacttggaggtgctggcggtatgaggcgacgaatgttagtcggtttttttatgatcttgctggtctggacacttctagtcgaggcctgtttggtttttatgctggcaaaagttactcagcacgattttctacgccttttattagccaatgtattgtcggcgccactgctggtttatttgctcattggcgcgttattgattagttctggtgtcacggtgattgtgctttggcgccagcgggtcgtgcgtagtcagttggatagtcgtttagcccaattaaacgctggacagtatcaggcaccgatatttaatcgatcgcaacaagctgaagcggcattgggaaaacaaccggctgccttgcttgaagcattacggcaaaaaatgatacgcttgcaacgtgaaatcgaacgttatagtaacacaccggtgcgattttccggcgagacgcgggaagccattttaaccggcgaacgccaccgattagcgcgtgaattacacgattctgtttcccagcaactctttgctgccatgatgatgctgtcggcgttacgcagtgtggcagcccgcgatccgaaacaagaagctttgaataagcaactggatacgattcaaaaagtgattaatgaggcccaggcagagatgcgcgccttattgctgcatttgcgtccgacgaatcttgaaggaaagtcacttaagcaaggcattatccagttgctgaaggaattacaaactaagatcaccatcaaaatcacttggcaactggacgatattcagttgaatgcagcagcggaggacaatcttttccgaattgttcaggaactcttaagcaacacgttgcggcatgcaaaagctgatagtcttgaagtctatctgaagcggttgcaagatatggtcattttgcgtatggttgatgatggtgtcgggtttgatccaaaagaaaccagtagtaatggcaattatggactggctaatattaaagaacgcgcggcagccatgggtggtacggcaaaggtcgttagcgtggtcggtcaaggaaccagtgttgaagtcagagtaccgttatcaaaggatgttgcgcatgattaaagtattgatcgttgatgatcacgaaatggttcgactggggctgtccacctatattggcgtccaacccgatttagaggtcgttgatcaagccgagaatggtcaagaaggggtcgaaatggccctgaaagatcgcccggatattattttgatggatttggtgatgccggttaaagatggcattgaggcgacaaaagaaattctaaaagcatggccgcaagctcggatcatcattttgacaagttttatcgatgatgccaaagtctatcctgccatggaagccggcgcggccagttatattttgaaaaccgcaacggccgaagaaattgccaaggctatccgtcagactgccagcggggaacgggtacttgagccgcaagtcaccacgaagatgatgaatcggatgaatcatccgcagccacagtatgacgagctgacgaaccgcgaacgcgaggtattacagcttattgctcaaggcaagtcgaatcaggaaattgcgaccgagctctttattacattgaaaaccgttaaaacgcatgtctcaaacatattggccaaattggatgtcgaagatcggacgcaagcagcgatttacgcgcttaagcatggtctggtaaaaaatgatcaaggagatgatggggttgcaactcgcgatcactgataaagctagtcaatggtttcaccgcgaattagatttgcctgctgaaggtgccggcattcgattctttggcaaggcttacggtaaaacccaggtgcatgatggttttagcgtgggcatgacgcgcgatgaccaccctgaccagccaattatggcggttaaaaaagatggcgtgacttatttcgttaacccgacagatgcgtggttttttgagaatctgatcatgacggttgactatgatgcacatcttgacgagcctaagtacgaatttaaagaagaataataaagtccgctgccagcgaattgtcgttgtttcactggtggcggacttttaattataagttggtacctaccaactcgcggacactttattttccaattatggtacggcgttttgcttcaataattcccgttctttttttgcgagatgtcacgagccaccagcaaaacgtcagcagtacaccggcgatggtgatcaagctgccccagcctaacaagggtggtcgatagcgcatggtaatatggtaatggccgggttttaacggaagcgccatgaaaatacctaaactggttttgggtttcaccggttgtccgttgaccttgacttgccagccaggtgcagtgggaatagtggtttgcaacatctggttttgcttgtgaatggtgatattggcggcaagtgtggtggcagtcacacgggttacgtgccagccgcctgtttgcagctgcttaaggtcctggatcagctgctccgtatccgcttgatacagaccgatattttcaaaccaggcttcttttttgttgagtcgaaaagttaacgtttggacttctgccgcgtttgcgggggtgacgttaacggtgatggtatcattaaaactttctggtaacgtgaccgttttcccattttgtttcaaggtgaccaaatgattggcaaaatgacttccgagggtgagtacataatttttgccagtttgcggttgaaattgatatgtcaccgtgtgcggaccggaaccgcttttggcaaaagttgggtttgtacccgtggtgacgcgacggacgccagttaaagtcggtgaaggaagtggcaaagcagcaaaataaggcgttgtgttcttacccagtgcggcttgcaaaatgaaggactggtttgcaagcggggtgtcgctgtaaagctgctgatttaataacgctttgtccgccgcaaaacccagttgttgggcaaacggggattttagcacctgccacggaccgacttttcgcagctgttgataccactttaaatcaggtcgttgtccggcatcaggtaaggcagcggaagtatgagtcggcgttaaaaaatatttaatgccgagcaagttgtcggtaatcaatgtcccgttagtgtatgcgaccgagccatcgtcttccggttgcccgatttggccgaagaattgaggtgtggccggctcaagtagcgagttgaattgatcggcgccgcggtaattgcctgtcattggatcgttacgggtgcgaatcgttgttttgccaatacgaaaaaagccgttatctgtttgattgatggtgcgtgcgccttggataagggccgcggcgtaatcatggtaagcatgatgatcaagatacgccaattgatttagcgttaaaattaaactgccgctcatatcgaccaacacaatggcaaaaccgaaccaaaacggacggcggtgatcaaggcttagccagaccaagacgagcaacaaggtgccaatgccaaagatcaggtggccgatggttagaaagttgtaatggttaaggtgaagcgcaacatccccatctatgagcccgaatacgattaataaaataactagcgtccgaaatgaaagcgccgattgatgcttctgcagggtgctgatgccgagactgagtaaccaaaagcataagataaacgtaaagcgatacgggtaccaaaccgggaattgaaagccatgccacattaagtcaagcggctcaaacatgcacgaaagcactaggaatgcggtcaccaaagcagcagccattttttggcgccatgtctggtgtcgtgatataaagaaaagaatggctaaaacaaagcctaaagcaccgatataaaaattagggtatcctgaaggcatctgatcaaaattgaagcttccgggcagcattttgctaagcagttgatccggcgcgtattcgaaccgccattggatggttttgacggtataggtgcctttggattgggcgagttgaaaccaggtcggcagcaacacgactgcgctgttcataccggccaagatgctagcccaggcaaagcgcagacctgcatgtgctgtctgccgccaagaaacggcatggctgcccagccagtaaccggtataaagcaccaagaaaatagcgatcatataccccgtgtagaagttgacaatgaaagctgcggttaaccaaccgatataagcaaaaacgcgcccgccgttgagcagcgtctccagactttggatgattaacggcaacaaaatggccgcatcaagccacatcaaattaaaactattggccaacatccagccgcttaaggcataagccagcccaaatgtagggatcattaaacccgtaatcgcatgacatttggcataccaccccatcgtcaagcccgccgtactgattttcaagatcatgatgacaaaaacggcgacatccagcagatcggcagggaacagcacaactaacaggttgaagggactcaataagtaataggcaaaaaccccgaacatatcaccgcctaggcctttattgaaggcataaaaaagttgtccgggattgcctagtaaggtttggcgcaagtaggcaaagaaatcaatgtattgctggccgagatcaacggttaagacgctactggacccaaatggaaaagcaccacgaatggcaaagtaaaaagccaccaatagtcccggtaatagaaaactcagtattaacggatactttttcgaccagacttgtcgcacatgccctcaccaacttctaaattaaaattaattccagcttatttttaagctgttactgtgaatcaagcatatcataagacacatagcgttttggcgggttctttgctacactttaaaagatagaaatttcgaaggagcaattttaggtgaagtacattcgtacaccgcagccgaagcggaataagagtcgcattccgtttcgcttaaacttattatttttcattgcgtttcttttgctagcggccttagttgcccaactggcttatttgcagattttaaatggcccgcgattagctgccgaagtcgatcgaacgaataaaaccgtggtgaccgggaatgtgccgcggggcttgatttttgatagtaaaggccgcgcattggtgaccaataaagccaataatgcgattacttataccaaaagtgtgggtaccaaatcgcagcagatgtacgagatcgccaatcaactggccaagttaatcgacaagccggccgagaatctgactaagcgtgattacattgattactatttggcgcgaaccaagattgccaagcaggtgacgaagcagttacctaaaaaaattcaggatctaccttcatcaaagtccgatgaattgtataaatatcaagtcgcctatgtccgcaaacatatgccaacattgaccccaattgaaaaagaggcagccggtctttacaagattatgaacggtgccacccaactatcgactgtctatcttaaaaaccagaatgtaacggcacatgaagttgcagttgtgggtgaacgtctgacgcaaatgccaggggttaatttaggcaccgattgggaacgcgcttatcccaacggtacgtcaatgacctctatcattggccgggtatccaatgaaaaaagcgggttgccggctgacgagttgcaggcttatctggctaacggatacgcacgtaatgatcgcgttggaaccagttatctggaaaaggcctacgagaatgttttaaaggggtcaaagagtcagacccaagttgaaattggcaatgacaatcagattgttcaatcagtgtcgaaattcaaggggcaacaaggcgctaacctgaatctgacaattgattccgaatatcaaaagaaggtcgaaaaagcgcttgaagacaccttcagttcgattcgttcggctggcgcaggcggattatccgatggggcttatgcggtagcgatggatcctaacaccggtcggattctagcgatggccgggcaacatcaggatgttaagaccaaaaaagttgaagacgatgcactgggggttattaaccgcgcttttgttgtcgggtcagcggtcaaaggggcaactgtgctaggggcacttcaagatggcgttattagcgtagagcataatacccaggaagataccccgatttatctgcctgcaaccccagtgaagaagtcagtttatccagttggcactttcagctcactggatgctgcctcggccttggaagtttccagtaacatttatatgatgtggctggctatgaaagaaggtcactatgcctattcgccgaacaattatctgaaaatggacgacaacattttcaccaaaatgcgcggttatttcagtcagtttggcttaggtatcaagaccggaattgatcttcccggtgaaattgccgggttggaagggaaaacccatgattcttcgggtaatttgctggtcgggtcggctttggacttgtcatacggaaactacgataactatacattgattcaaatgctgcaatatatcagcgcaatcgccaataacggttatcggatgcggccttatttggttaacagtatcagccaaacgttaagcgatggcagcaaagggccggtgctgagttccacacagccatcggtgacctcgaaaatcgaaaatacgcaggcccaaattgacttggtcaagcaaggtatgtggcaggttgtccatggtacgaacggttggaccaccgcgacttccttaaatacgcttaatccaggcgttgccggtaagaccggtactgcgcaaggctttgcgcgcgaatcagacgactcggcattaaccgaaaccattactgaaagttttgttggttatgccccggccaagaaccctaaaatcgcgattgctgtcattattccaaacctaaaggcggaaacaaccacgccgtaccagttacaaattgctaaggaaatgtttagcgacttctacaagatgaatgacattaaagaagataagggctactcgattcaccaaaagacagtcaacggttaacgctgttggcagcgtgtgcaaaaaatgctaaactactacaagacatgaccaaagaagattgatggtcagcggtggcggggaaaaacaacaggttcacctgttgtttttttagcgatataagccaactattcggcagtcagaaacgcacttgctgctattgcagtgaagttagaaaggaatttaatgaattacgcaaactggcgctctcgctttcaaaattcagcctatgtgacgaacggcattttggcggttaccattttggtcttcattctagagacactttcgggtggcagcactaacaatgctgttttggtggcatatggggcgcgggccaatccgctgattttgtacggccaatggtggcgcttgatcacgccggtatttgtgcatatcggcttgacgcacattttaatgaatggattctcgttatacttcctaggccaaatgacagaaaggttatttggtcactggcgctttttcttgctgtatttcattgccggatttgccggtaatgttgcgagctttgcgttcagtcccaatacgttggcagctggcgccagtacagcaattttcggcttgttaggtgcgtgcttgatgttaggggatacttaccgggagaatccggttattcgtcagctggcacggcagtttttgctgctcgtggttttgaacctggcgtttaatttgttttcaagcggcgtcgatatttatgggcacatcggcggcttgcttggcgggttcttggctgccgggatgttaggcgcgccagcattgggtcgcatgggcaccggccggcgactggcctctacgataaccttgatctttggattggttgctttgcttttatttggaattcagcgcggaatcgtatgaaaacttactatgatgtcttgcaattattaaaaggttttggcacgtatatccatgttggtaaacgtgtttgggatattgaacttgcggcacttgaattagaccgcttgcatcaggcaaaattgattgatgataaggtgtatctgaatgcaaaaattgtgctgcgtcatgcacatgaacaggaagaacgggatcctttaaatcatgaattgccgttgcattcggatcaacggaggaatgatcaacatgaatgaccaaaaattgattggcgtcgacttaggcgggacgaccgtaaaatttgccattttaacgcagggtggcgagattcaacaaaggtggagtattgacaccaacattttggatgaaggcagccatattttaccggacattgttacatctattaacgaacatctggatttatacaagatgaccccggctgattttgtcggcattggcatgggttcgcctggatcggtggacagtgaggcgggcacaatcatcggtgcttacaacctaaattggaaaaccttgcagcaagccagaaaagtaatcgaatcagggaccggcattccgtttagcgtggataatgacgccaatgttgcggcgttaggtgagcgctggaaaggcgccggtgaaaacgatcctgatgtcacgtttgtcacgctgggtaccggtgttggcggcgggattattgccaatggcgagcttttgcacggtgttgccggttccggtggtgagctaggccatgtcaccgttgatccggttaatggctatctttgcacctgtggtaaacgcggttgccttgaaacagttgccagtgcgaccggcgtagttcgggttgcacgtgacatggcagaagaatttgccggtgactctaagttaaaagaaaccttggacgatggcgatgagatttcgagcaaaattgttttcgacttggccaaggaaggcgatcgtctggcgttgatgattgtggatcgggtttctttttacctcggtttggctttggccaatgtcggcaatcttttgaatccgaaattcatcgttatcggcggcggtgtctccgcggcgggtgaattcttgctgacgcgagtcgacaagtatttcaaagaaaacaccttcccgaatgttcgtgaaaccaccagtttgcggttggcgacacttgggaatacagctggcgttatcggtgccgcaagcttggcattgaagtaagcggaagaaggagtcagagacgtgttaacttatttactgatcattgttggattattcttaatttactggggctttagctggctgtggagttactaccaaaagtcgaagtttaaagcaatcggcggcgaaattagtccggaaaccttcgaacacaccatgcgtaaggctcagattattgatttgcgcgaacgtaacgaattcaaagccggccatattctgggggcacgcgatttgccatacacccaactgcgggaacggctaggtgaaatgcgcaaagatctgccggtttatctatacgacaagacgggtgtactgtcgttgcgagcagcacgccgattacgtaaaaacggctttgaaaaaatcagctggttaaaaggcggctatgataattggtcaggcaaaatcaaaaaaagtccgactaattattagtccgtacatagacagcaaaaaaagcaatcgctcaagtcgattgcttttttggtaaaaatgatcaatcaatggtttagccttggtgggccgaaaaacgtttacgattggctttgcgccgattttcgttgatttcgtcaaccttggtttcaacaggttcgatataatttttcttgaaggcgaaaacactgccggcaacagcgccaatagtcatgagcgtgccgacgaaaaagccacgtgcaaatttatgtttcatgaaaatcccccctgattggtgatctgtgatactactgtaattatactatactcatggagcttaatgaaatggataaaccggctaaccgcattgtgatgattgttggaccgaccgcagtaggtaaaagcgatcttggcatctacttggcccaacaactgcaaggcgaagtcattaatggtgatgcgtatcaaatttatcggcatatgaatatcggcactgccaagatcatgcctgatgaaatggacggtattccgcaccatcttcttgatattgtggatccgcagatggcctattcagttgccaaatttaaagccgcagctgaggcagccatcacggacgtcagcagtcggcgccacctgccgattttagttgggggcaccggcttttatcttaacagtttgcgcctgaatttaccgctgggtggcaaggcaccgccgactgcagtccgtcagcgttggcaggcagcattggcagaaaatggcgaacactggttgtgggagcagttgcagcagcaagatccggtggcagctaaccaaattgaatcggcaaatacgcgccgggtgattcgggccttagaagtcatcgaattgacaggtacgcgcttttccgagcagccgcagccgcaaccacgctatgagacgttggtgatcggtttgacgacagcacgccctgttttgtacgaccggattaatacgcgcgtggatactatgatggcagcaggcctagaaaatgaagtcgccaacctgctaaaaacagttcccccggatgcgcaggcgctgcaggcaattggctacaaagaattgatcccgtactttcgcgggcaagctgatttagcaacctgtgtggccttgattaaacagcattcacgtcattttgccaagcgccaactgacctattttcgcaaccagatgccaacacattggtttgacttggttgcccatccagaagaaaagactgctgtcgttgctttggttcgtgattggctaaagcaaccggctaaaggagaaaaacatgagttggacagataaatttgatcctgcattattaaaaatggttaaagaagtcgatacgcaaattgcaccgcaactggccgcaattgatgcccgtattttagaaaatcaggacaaggttcttaccagtttccaaaaacaccatgttgctgagagctatctaaccggttcgaccggctatgggcacaacgatgagggccgtgatgtgcttgaagagatttacgcggatgtattaggtggtgaagatgctttagtccgtccccagttggtttctggcactcatgccattggggtagctttgctggggttggtgcgtcccggtgacgagattctctatattaccggcaaaccttatgatacgttgcaagaagtacttgggctggcaggcaatggcatcgggagtcctaaagaatacgggattggcgttgattatgtcgatcttttgccagatggtgcggttgataacgaggcggttaaatcccggcttaatgcgaaaaccaaggtagtggcgattcagcgttcacgcggctatgcaactcgggattcgtttacggttgaccaaatcgcagcgatgatcaaggtggttcgcagtgtgttgccaaatgtctggatttttgtcgacaatgcgtatggtgagttctcggaaaccaaggaaccgcttgaggtcggcgccgacgttatggcgggatcgctattcaagaatgctggcgggggcatggccaaaaccggtggctatattgtcggcaagcaagatttgattgagcgcatcagctaccggttcacggtgccaggcctcggcggtgcagaaggtgcaacggttggcgcgctggctgacatgtatcaaggctttttcatttcgccgcaaaccaccggcaatgccattaaaggcgctatttttgaagcagctttgtttgccaagcttggcctagacgtctcaccaaaatgggatgctccgcggacggatttaattcaaaccgttaatttcggcaatcgtgacgacatgatcaagtttgccaaggcggttcaggccaattcgccggtagacagtttcgtcaccccgattcctgagaaaatggctggttatgaagatgaagtcatcatggctggcggtacatttgttgcgggctcgacaatcgaattttccggtgatggcccactgcgaccaccatacacgctttatctgcaaggcgggttaacctacgcccacattaaacttgcaacgatgggcgcggctcaatcgaccttctttgacaaagctgactaatgtaaaacacaggacactaaaaaacgattccagccttgcaataaattgcgtaggctggaatcgtttttttttgactagatgctgctattgcgactcgtgcgattgacaagcggttattctttgtccgcaacgacctgcacatagggttcgccgtttttgcctgtgacaaccccttgaatttcaggcgtaaatcctgggaagcgtttgatcccggcaaataaggtttcgaaatactggattgcttctggtcgccaacgttcaccagggacgacgacaaaaattcccggaggataaggtaaggccccggcaactgcgatccgtccagccgcagcttgcaacggaatggtctcaaactggccgcgaacgaagcagcgatcagcagcctgcgccgtcatggccgttggaatgttgttggtcgcactgaaaaggagttgctgctgcttggctaaccccgcttggcggaaaaagtcagacattttctgaccgagtgttcgcaaagtcaggtttgtgtaggcttgaccagtttccgccaccagttttggcaatgtctcggcaaccgttttgtttgcaaaataatctgcttcaaactgacgtaatacttggcgcaaccgttgccaatcagccttggcagaaccgggcgtcaccagaaacaacaaactgttcagatctgctttttcgggaacaatgccatgatcaagcagatagcgatcaactagccagccactcacgcctaattccgctgattctgggagcaagaccgttactttgccgggatcaagaaacgcttgatcgggttgtaagcgtggaagctgatgccaggaagcgccaggggtcatggcccacgcgtcactggtggttagtgcagcggttggcggtgtttttgctaactgcggattctcataggctgaaaataatcgggagtcagttagggagcgccgaaattcgagcgaggccgtgatcgcatcggcccaaatttttttgccacgcgggccttgattgatcgcggtattggtcaccagtgacgcatagagcggataggaataactggtggtgacgtgtttgaggtaggcgtgattgaactgctcatgactgacgtagcgggcttgacctttgatgtgggcgtcttttttatggatttgggaagcctgaccaaagccggattgctgtttatgcacactttgcgtcacgatgataccgggatctgctgggccaagttgcaactgtagcgggtccattgctttcatagccgggataaacggttcatacccgccccaagcagcgtcaaatgcaatgtaatcaactagcgggccaattagatcaagcagttgccgcacgtttggcacaataccatcgaaggtctccaactcgagaatcgccaggcgaaatggtcgaggttcgcttgcttttttggggtcaacggttgccgcgagttgccgtagtcgctcgccggtaatgccggttagatcgaccggaccaatcaagccacgttgcgtccgcagtgtgtccaaataaaccggacgggcgtcattttggactaaagccgcgttgtaaaaggacttatgattattgcgatcgaataagaccagatcaccgggtgtcaacaacgcgctggccacaatgttgttcgatccggtggtgccattggtcacaaagtaggtttcatcagcatggtataggcacgcggtggcctgctctgctgctaacggggtccccccatgtgttagcatatcgccaagtgcggtgaccacatcactggtgtcactggcaaagaaggtttcgccatacgcttggtgcaatagataaccggctggcgcaagttcgtcataatgaccgctatgatggcccggcgttgcaaaacttgtggggtcagccgcagcataggcgagtaagtcgcgtaaaaatccgggaaccatggcagactcatactcggttgcagcggtctgaatctgagccagactcgcagtatctaaccgctcgatttgggtgatttttaattgactttcaggagtgtactcgagatgaccgatcacaaaaacaggcaaagggagcgcgctggcatttaactgtgctagcgcctgatgatcggtagcccgtaaaacgacagcagcaaatgccgcaagtgggtgcgaggcaaatggaagccaatcagccggtatgtccggggatgataagctggcggtataaccaacgtgaagatgtaacgtcatggaagtaacttcctttcaagaatgatcagactatagttatcatactttccgagaccaaaaatacctagaggctggcccaaaaaaatttaactaaggtactgatagcgaacttacctcgcacgtgcttaaatattttagcggaaaaagggaagttttatcgcgttgacatttcgctattggtctataactgattaaaaagaaaaataaaaatataccgaatttaaccataaatgtaagaaaaccttacatgtggcgttgacaggtgttaagtggtttgataagctgacatcgttgtaaaggaggatgcctatggctgagatcgctgatctgagaacgcgatcggtcttgccgattggtacagttatgttgttgactgatttgaccgcccgtcagattcgttattatgaaactcaagggttggtcaaaccacaacgcaacgccggtaatcaccgaacatactcgctaaatgatgttgacgaattacttgagattcgcagtcaaatggctgacggttttacgttggctgatgtcaagcggctaaaacatccgcgtcaccgtgaagatagtgatgcagaagttcggaaagtgttgcgggacgaactgctgaatcaaagccgactgaatcaaagcccggatccaggacccgtcattggcttccgacaatcacactaaagataggagttcacgtatatggcaagaaaagcaattaccgctgatgagatccgccagacagttaaggacgaaaatgttttgttcttacgcctgatgtttaccgacattaacgggatcattaagaacgtcgaggtgccgatttcacaattggaaaaggtgctcaataacaagatcacctttgatggttcctcgatcgacggttttgttcgaatcgaagaaagcgatatgctgctttacccggatcttaacacctggctgttgttcccttgggagaatgatcacggtaagattgctcgcctgatctgctctgtacaccgtccggatggcacaccttttggcggcgatccgcggaataacttgattcgggtcgttaatgaaatgaaagatgccgggttcacagcctttaatattggccctgaaccagaattcttcttgtttaaattagatgaagacggcaatccgacaacgcacttgaatgatcgtggttcatactttgattttgccccgttagatatgggtgaaaattgccggcgtgatattgtccttgaattggaaaagatgggctttgaagtcgaagcatctcatcacgaagttgcgcctggtcagcatgaaattgatttcaagtatgccgatgcacttgaagcagctgataatattcagaccttcaaactggtcgttaaaacgattgcccgcaaacacggtttgtatgcaaccttcatgccaaaaccgcttcatggtatcaacggtagcgggatgcatatcaacatgagtcttttccacgacaaaggcaatgcattctttgacccggatacaggcgatcaattgagtgagacggcgatgcattttcttgccggtgtgttgcggcatgcctatgcgttaactgctatcaataatccaacggttaactcctacaagcggttagtccctgggtttgaagcaccggtttatgttgcctggtctggcaagaaccggtcacctctcattcgggtaccgcaatcacgtggcttatcaacccggttggaattgcgctcggttgatccgactgccaatccatacttagcgatcgctgccattcttcaagctggtcttgacggggttaagaaccagttgaagccggaagaagcggtagaccgtaacatttatcggatgcaagatgacgaacgtaaagcgaaccatattcaagacctgccatcaacgctgcacaatgccttgaaagcattggcggccgatgacgtggtcaaggctgccctgggtaaacatttgtatcaaagctttatggattcaaagaacctcgaatggtctgcttatcgtcagcaggtttctgaatgggaacggcaacaatacctggaattatattaatttcagccacccaaaagctgttgttgacacccgaactgctggctagctaaaacagtcaagcatttaacaatattgagaaggcttcagacagaaaaacacgtctgaagccttcttttgcatttaatttaaaatatttttagagttgaaaacactaaatgagatggctacactgtgtttatcacatttctctcatcttacgctgttataacttggtgctttgtcaagttcatacacgtgctgagtcgcgctcaccataacgcgctccccagcgcaggagcctgggtgtaaggaccttggtcgcacactggccaaagcccggccatcacgcccaaggcaacttacactccggcccctgaacgcgctggctcgcgctcactctcataaagaacttgtcagtaatttaaatatacgaggaaggttttcacatgaaattaaaccagtttgctcggttaacgcctgatattgatcaacaattaaaggaactcgcacgcattgggttacccgccgatccgcaagcaccctttgcggatactgcagctgcgatgtacgcagcctttttccctgaggcatatcaacccgcggcgcaacaggataagtttgctcaagttgcggttaattcacaccaaaatcttgctgagtggttggcgacaaagcccactcacatgaagcgggcagacttttacaatgttgcgctacagctcttgggctttgaggcgttttcggactttgatttaagcgatccgatttcatttatgactgtaacaaaactaccgagtgttgcgcatgatttgctacatactgctgatttgcttcaggccagctacctgttactgaccacgcgcaccaagcacttggttagctttctggatgatttagccaatcgcggtttttttaaggattttcaggctcaaagttcgcaaccggctcatttgctctttaatggcaaggtgcaacaggtgtttgatgcgcgtcaagctgttcgggaggttgtctggatcgaatcagatgtagattctgaccacgacggccaacgtgatctgcttgaggcaacgatttatcgccccaaagccaccgatcgcgggctgaaagttccggtgctttttaccgctaacccttactttcatggaaccaacgatgtcaccgcggcgacgcatgttccggaaacggtcttggcggttaaaccacatggcgcttcgaaagcggaagtcaccgcagcgccggcttccaaaccaaaactgccagcgcgaccggtgacaggtgagacgaaacaggcagcggcatacgctgaggaaaatagtccatatgccttcaatgattattttctggcgcgaggatttgcggttgtttattcagctggtgtcgggacgcgttattcggatggctttcgcacaattggcggaccggaagaaacagatggggcagttgccgtgattgaatggctgacgggtaaacgccgggcttttaccaatcgcacggatggcgttgcaattaaggcgtggtggtcgagtggcaaagtggctatgaccggtaagtcttatctggcgacactggccattgcagcggcaaccaccggcgttgaaggtttgaaaacaattgttgctgatgccgggatttcgagttggtatgattactatcgcgaaaatggtctcgttgtggcaccgggtggctatcaaggtgaagatgccgacgtattggcggttgatactttttcacggcaaaaatccggtggcgatatgattcgccttaaaaaggcctgggagcagcatctggcgcaaatgactcgggatcaggatcggacaacgggcgcttatactgcttggtgggacgcgcggaattaccgaaaaaacgcggctaatgtcaaggcggatgtggtcctgattcacgggctaaatgattggaatgttaaaccaaagaacgccattcggttctggcaggcaattgcggatttaccgattcaaaagaagttgatcctgcatcaaggtcagcatgtctacgtgcacaatgttcgttccttggactttctggacatgatgaatctttggctgactcacgaattgttaggagttgccaatcaggcagagcaggttttgccgaatgtgttggttcaggataacgtgacaccgcagacatggtcagcttattcggactttgcgaacccagctgcagagcatgtgacaaccacggctaatttgaaaactgattttgaaagcgcaaccgatcaattttcggatcatgcgacagcaacattcacggcccaacacgatacgagtgcaagttttgaaaaagcaattattacgcctaatagcgcctatgttaacagtcgtctgtggttgactcagccggtcctagagcatgatcgggtcttagaaggcattccgcatcttgagttaacgctagccgttgatgcgccaaccggcattctcagtgtgcggctggttgatttaggcaaggccaagcgttttgaggaaaatgccgcaacggtgggggcaagtggcttgcagctgggatttgattttaagaccacggatattgttgaatttaaaccggccaataaggaaacgccaagcaaattgatcacgctgggtcatattaatttgcaaaacccaaagaatgcgtatgaagttcaaaccatcacccccggacagtttttccatgtgagtctcgatttgcagccaacgcattatcacttaccggctgggcggcaactggcactgattattcatggtgctgatatggcgcaaacgattcggccaacaaaagtcacccattatcagctggatttggccaaaagtaccttgaccctgccgtttcgcatttaagcaacacgattaaaagttgcgagttgccgattgaagttactaaaggacaaggatgtgaactgaatggcggatcatcacgcacaacggattggtgtgcgttgggttatcaaacaattaccgtttccattgatggtagtgctggtgatcgttggcattgtgagtacgtttgagccaatattaaacggctgggtgttcggccagttggttaaaatcgatttccataatatggggactgttggccgttacgtgttaatggcaacaggggcctattttgtgacttatgtttcgctgtatctttatttgcgtatcaaacaacgcgttgttaggatattgaatcaggcactgaaaaccgtctactttaccacgtcaatggctgaagctggcaccaaggtaaccgaggtttcagacacaatcaatcaagtcaccaacgtcggcaagcaaattgagcaaaattattttgttgcgcttatggatatggttcaagaaattattggtgtgattgtagtggttatctttattgtgaagatcaatgcgattttaagcttgatttatgtgcttatttcggcgttgtcgctgctaccgagtcactttggtcgcaaccggttagctaaaaattcagaaaagtggtcggctgcaaatgcggcgttggtcctgaatatgaaagatctatttcaaggacgaacggatattttgaactttaaagcatggccagcgtttttcgctcgttttcgtcagcatctgaccaaagaagaacaagattacgagcggttgaatgactttcaatattcaatgcagtttatttcctggatgtttgcgattgcatcatttttatttccgatgttcattggactttggtttatggcgcagggatggtttggtgtcaccacgagtgtcattgtaacgctgacaatgacagctgactcagtgatagggggcgttcgtcggctgagcgggtatcaaagccagattgtcgggacgagccaactacgcgagttgccggtcgttaaagcatttgccgcaccgattgcagatgaaaaaccagtaacgctagctgaacctgaaagcgttaaaggccatttaacaatcaaaaatctcaccgttgtccgtgatcagcacttaattttggacgcggtcaatttgaaccttaaaccggatgctaagattctggtaaccgggccttctggagtggggaaatcaacgcttttaaaagccatcactggtcagctcactgcgcagggaacggttttatttaacaataagccgctgcatgccggtgactttgtgttggtttcacagagcgtttggctgtttagtggtacgttgcgggataatgtcaccttgtatcaggattacagcgatgaagccgttttacgggtcttgcaggtggtgagcctggataaggaactgggtactggcattcttgactttgaaattgttgataacggcagcaatttatccggcggccaggcacaacgaatcgggattgcccgcggcctcttgcgacaaagtccggtctttttactagacgaaatttctgccagccttgatcaggcaaatgccgacaagattcataagcttatttatgccttgccggtgacggtgatcgaggttgctcatcattataatgcggaactggcgcaggcgtttggagttgaaacttacgagttggttgatcatacgttgcagttgaaaaaatgacaaaaaagcaccggttgtataccttatgtcgcagggtgtacagcgatcttgtgacagtcttgtgacagaatggccgattttagccgactttttaagcctcgctgtcacgacactgtcacaaaatttttttctgctttctccgacgtaaaaaaagcctgattcttcaggcttttttgtcttagcttttcccgttttaccttaataatgtaccagccgggattcgaacccgggacaaacggtttagaagaccgttgctctatccaactgagctactggtacaaagcactattaagtatacgagaaccgggatagaccgtcaacgggtccttgcattttgccatgaagcgataagccgataatcaggtcatttctttgtatttgattggacgctgatgggcaatagcatgatacgatccatgtagtgcgggcgtttccagaacgagccttcttcgcgataggctttggcaccactttcaaaaataagggccagctggctgtcatccgcgtttagactaatttcttccaccgaattaggaacgttaataattttgtctccggatttcggcgtggcaaaggtcagcttagaccaacttttatcaaggggaatacgaatccagattttgccgggcttggcaccatttgattgactgacaaaggtgaggccggtcttggcaatggcaataccttgaatgcgatcccagcctgcattgacggaattgatgatcttgtcatccatgagcttcttagaaatgatttggaaactttgggtatcgtttttaccttcaagttgcgggataaggtcacgaatcaagcggttaaattgtgcttcggtaatggcagcagggaggttgtcatcgttcactggtaaagcaatgagcgaccgattaatggcgttcttgccatacttgacgaaaacaagttggtgatcataaagcgtgatggccgatgtccggttagccaagtgcagtgggatgcgtgtggaatcaagaggcgctttttcaacctgagcttgatacgcatcaagtgctcgttgagaggcataactaatcccggcgccaccgagtttggagttgtcgtctgaccataacagccgctttttttcgcgatcataggtgatgccgccgacgtgtgctttggactttaaaataaacgacttacggtaacgaccggtttttttgttgatttccaagatcagcgaatttaacttgtgatcgccatcgtatagactgacgaacaggctgtcttttgactgggtaacgccttgagggacccagtttgtgccaaagccggcgcgtttggttttggcgttaattgaccaggcgccacgcagaccgggaatgacaaccaactttgtccccttggcgatccgattgcctaactgtgccgactgggggatttctttgattcgcttaacggcggtttgttcagattgcagtgggcgtgggtcggcttcccattttttaacgtcagcaggctgatcaactagttgctgataatgaaaatggtcataaagccaccatccaccgatgcccacaacaattaaaacgattagcccgccgattgaaccccagatccattttttcaaaatttccacgcccctaaaaataaaaatattgataatccgctatcactgactaaactataaaaagctttaatccattaatgccatagccagaaggtcaagtcaatgaaaccgcccggccggttggacttttaggttaaattcaaacccggatgtcatcataacgagaccctgattgctaatgggttgttttgaagttggatggcttgacttactgattaaaagtgagtagcatgacggtattcgctaccaaaggccattcacatctttaagaatggagggattcagatggcatatcgaatccaacttaatatgaaaacgcaagagtttatcgccattgatccgaaaaatgccaaacatgttggcaaaggcgatacgattgaaaaagcattacaacagttgaaacgttgactcatcaccgctgattttttaatgatcagcggcttttctttatctactttcaggggataaggggcaggcatgtgaagcttggcgctgatgtttcacttccttgaggcatgtttaaggtcactaagatattgttttttagcccctgcctttttaaatatttgctggttacattggcgccttttatgctatattaggtatcttggcaggggcaggctcagattcgttctgggcctttttctatgcaacaaaacgcctgaggtcagatttcaaggttttcttgttgaaaccggcacgcttggctataatgcttgcaggaggtggcgcgtatgattattttgctcgatattctcattttattagtcaccggggcgttgctaatcacggtgaccacgcaactgatagaaccggttaactggattatcgacggaattttatatgttgggttactgttaggtaacgcagctttcggtgggtggctcacgttatttactattatttatgcactctatatgccagccctcatttgcggaatctgggtttatcgtaaacggcatttggcatcgtaaagcatttctgtttaggcagatggcattgggagtcctgatatttggattggatcgcgaagccattagataaaatgaacttgtttacttacttacatagacgcttgcaacttaccccagtctctggtagtattaatccgttgtatttggcacccctcctatgcaaccgcacatcgttaggttttaagcgcaagcacctaacttggcgagtcttcaggggaaaagccgagaggcaaaacaggaggtgcacacagtgtacgcaattattaaaactggcggcaagcaatataaagcagaagtcggcgaagctatttatgtcgaaaaacttgatgccgaagaaggcaaacaggtgacttttgacgaagtgattatggttgctggcgaaggcgatgccaagattggcacaccaaccgttgccggcgcaaccgtaaccggtaaagtcgaaaaacaagggcgcgagaaaaaggttgttacttacaagtacaagcctaagaagcactctcatcagaagaaaggccaccgtcagccttacacaaaagtcgttattgacgcgattaacgcataagaggttaggctatgatcaaggcaatttttcatcgcgacgagcatggcgatattgtcagttttgagctgactggtcatgccgatgccggtaaaaccggtcaggatatcgtctgcgctgctgtttcagctgttagtatcggtgcggttaacggtgttgaagccttagcgggattcaagccggatgtcattgcagatgaggtccatggtggccacttgcaaatgaagctcaaatccgttattaccggtgaacagttgcatattagtcaaattttgttggaaaatttattgcttgaacttcaaagcatccaagatcaataccctgatcgcttaatgattacgacaaaacaattagagcaaaattaattctcggaggtgtacgttatgttaaagatgaatctgcaattcttctctcaccataaaggtggcggttcaacatccaacggccgtaactcagctggtcggcgcttaggcagcaaacgtgccgatggccaattcgtcaaggcaggcaacatcttgtatcgtcaacgcggtaccaagatccaccctggtgaaaacgttggtcgcggcggcgatgataccttatttgcaaccgctgatggcgttgttaagttcgaacgcttcggccgtgataagaagaaggtttcagtttatccggcagcagctgctgaataaagattgatgacgtcccggtaaaacggggcgtctttttttcaaagtttggacaaacgtcaaaaaggagcgatttggatggatcgaatgacagcattgcaggcacggattctggataagaaactggatggcttttttgttaccgatgccgccaacgtcacttatttgaccggctttaccggcgatgaaagtgctttgctggtgacaccggaaaaagcttattttattactgattcgcggtttaccgaacaatttaaacagcaggtgcaacacgccgaattggttttgcatcaagatgggttgtttaaggcagcgggaaaattggccaatcggttgcaattaacgcacattggttttgaagccgttcatctcaactatgcagattatgaagcgtttgacttgttgacccaagggaccttggtgccaactcgcgatttcgttgagagccagcgtgaagttaaagacgatgatgaattggctctcattaaacaggctgttgccattgcggaaaaaggctatcaacatgtgctggcgaccattaaacccggtatgcgggagattgatattgccaatgatttggacttttatatgcgcaaactcggtgccagcaatgtctcgttcgaaacgattgtggcctcaggtgcccgctcggcgatgcctcatggtgcggcaaccgaaaagaaaattgctaagggtgatgtggtcacgctcgattggggctgcatttatcatggctatatgtctgatcttacccgcacttttgcagtcggccagccagatcctaagctgaagacgatttacaagattgtttacgaaactaaccaaaaagtgcaacaagcgctgaaaccgggtgtgctcggacggacgattaacgatttggcgcatcacaccattgatgatgcaggttacggtcagtactttggccacggaacgggtcacggaatcggtttatcgattcatgaaggtccgggtgcttgggggccatatcttgatgtgccagccgcaaaaggtaatgttgtcacagacgaaccaggcatctatattccagagcttggtggtgtccgcattgaagatgatctggtggtaacggctgacggtaatcaatcactcagccagccagcaccggctgatttgttggtactttaacatttgaaagtgtcgccggttgctactgagatagtcaaaggcataactgataagaatattgaatagcgttgcggtcgcagtttattcgaccgctttttcgaacctatctctggtatgggtggttatatcaaggcaaaattcgtatcgagacggttgctttgtgtggtgatgcattgcagatcattggggttagttcgccggtggctgttgcaagcgtctccgctgcttgctagaataggtttagtttatgactgaatgtatggaggaagttcatgatatctgttaatgattttaaaaatggtttgacgatcgaggtcgatggtgacctttggcggatcgttgaatttcagcatgttaagccgggtaagggatcggcatttgtccgttcgactttgaagaacctgcgaaccggtgccgttcaggaaaaaaccttccgttcgactgaaaaagttgaaaaagcccagattgatagcaaaaacatgcaatatctttatgccgatggcgacaactatgtattcatggacaccgatacttatgatcagctgacactcccaggtgacgaaattcgggatcagttgaattatttaaaagaaaacatgaatgttaaaattatcatgcacggtaatgaaacgctaggtattgagctgccaaaaacagttgatctggcagttaaagaaaccgaaccgggtattcgtggcaataccagtagcggcggttcaaaaccggcaaccatggaaaccggtttggttgttcaagtgccatttttcattaataacggtgatgtgttgacgatcaacaccgatgatggcacttatatctcacgtgctaacaactaaggctaggaggatctcataatggctgaagaaaccaatatcatattagcaaatcggactgatgcacaagggacgattgaaattgttcctgaagttttggaggtcattttgggcatcgctgccagtcaagtggacggggtctaccaaatgcgtggcacattaggatcttccattaatgcctggtttggccgggctaatcacggtaaaggtgtgagtgtgacagttgccgatgataagattacggctgatgtgtacgtctatttggattatggtgtttcggtacccaaggttgcattggcgatgcaagagcagttacgcgagcaattgctgttcatgaccgatcttactttggatgaagtaaatgttcatgtcgttggtgtgattcccgaaaagaccgagccagtcaatccggaagacctgttcaaggatgacgacacagatgacacggatgatgcagcgacaacaagcggacaggatgacgaataagatggaatcacgacatgcaatccgtgaagctgcctttcgggcgctctttgccttggcaacgaatccggaagctgataaaaatgcggtgtacgccgaagttttacctaaagatacagaagtaccgtcatatttaacggcattagttgaaggcgttttggcaaatcaagcagccttagacgcagctttgacgccgcaactaaaaaaaggctggacgctgagtcggttaacgaaaccagatttaatcattttacgtctgggcttatatgaaattcgttatgaagaagcaatgccggaagctgcagcgattaatgaggccattaatctggctaaacgttacagcgacgagcagtcggcgaagtttgtcaatggcattttggcaaacttcatcgaagcggcgccaaaagcgtaagttaaccggtcaaaggcaattactttgaccggttttaatttatccgcgaatcgttaacgatcaaggtaacaaacaacattgggcgcctgctgcgagcagcgtcaaaaatgaggagtggtttttgtggcaacgcgattagatggccgggtagtgtcaaagaaaatacttggtgaacttaaacagacggtagcaaaattggcacaacaagacgtcacgcctacgttggccgttgttttagttggttcggatcctgctagcgaagtctatgttcgtaacaaacagcggcgggctgaagaaattggcgttcgctcgttgatgtatcgattgccagaagacacttctcagatgacattgttagctaaggtggccgagttgaatcaggatcctgatgtggatgctattttggtacagcttccgttacctgctggcttagacgaacgcgcggttattgatgcgattgatcctaataaagatgttgatggctttagtccggttagtgtcggacggttgtggacgaatgagccaaccgttgtggcctcaactccttatggcattatggcgctgttggatgcttatgatattgatgttgccgggcagcgggttgtcattgtcgggcgctcgaatattgtgggacggccactggctggattaatggttaatcatgatgcgacggttaccatcgctcacagcaaaacccgaaacctcaaacagttgacgcgggaagcggatattttagtggttgctgtcggacggccacattttatcggcgctgatgccgtcaaacccggcgcaacggtgattgacgtgggaatttcgcgcggtgccgatggaaaactgcatggggatgttgacgatgatacggtcgcaccgattgcaggcgccttgaccccagtacccggtggcgtggggccgatgacgattgcatcgctcatggcccaaacggtggctttggcgaagaggcggttacatggttgagacaagtcaatatttaaccgttaccgcactgacgcagtatttaaaaagaaaattcgatgccgatccgtatttagccaaagtttatctgaccggtgaaatttccaactaccgcaaacgcgtgggcaatcaatatttttcactcaaagatgatcatgccaaaatcggggctctcatgtttcgtaacgcattcagcaaacttcaatttaaccttgaagaaggcatgaaggtgttggtggttggccgtgttagcctgtatgaacccagtggcgagtatcgactgattgtggagcgattagagccggatggcgttggtgccttgtaccaggcgtttgaacaattaaagaaaaaactggctgcggaagggttatttgaacgccatcagcggccactgccacttttccctcaacgcgtggcggtggtgaccagcccaagtggcgcggttattcaagatattatcaccactgtggcccggcgatacccgatattgcagttgatcttatttccggctatcgtgcaaggggatcaggcggccgattcgattgtgaaacagttgaaccggattaagacaatgtccggatttgatgcggtgatcattggtcgtggcggcgggtcaattgaagatttatggccgttcaatgaagaaaaggtagcgcgggcactagctgagatgccaatgccgattgtgagctcggttggtcacgaaaccgacacaacgattgcggactttgtggctgatcgccgcgctgctaccccgaccgcagctgcagaaattgttacgccagtcacgttggtggatgccttgaatcgcatctcagaagatcaggtgcgactggtaaacgccatgcataaccgcttgaaaaatgcagcaacacgcttacaacgatccgctcaaagcgttgtcttaacccaaccggatcggctttacgatcaatatgttcagcgtgtcgatcaactacggcaacggctccagcagagtatcaacaatcagttacgcgaaaatgagcatcggttagcaatggcgactgcccaactggatggtcggcagttgctggtaaaagtcgccaacctgcagcgacagcaggtggatgatcggcgtcggctggatcgggcaatgatcgcacttgtgaccgctaagcatcaagcggtggccaatgcggcacttggtttggatcatttaagtccgttgaaaatattgggccgcggctttgcgtttgtcaccgatgatgcagggaaaatgttgaaaacgaccgcggattatcaagtggatgccgcgattcatattcacgttgcggatgggcaaattggcgctcgcgtgacgacaaaggagaataaacatggctgaaccaacgtttgaagaaaaactcgcacaacttgaaggcattgtgaatcaattagaacaaggcgatgtaccgcttgaaaaagccctagatcaatttaaagtcggggtcaaattgagtcaggaactcgaaaaaacgctgaaatcagcagaaaagacggtgacggaaatggtgagcgatgatggtaccacccaaccatttcagcccaaagaaggccaacaatgagtccaacgctaaccgactggcaaacagcaattaatcatgctttagacgaacaactggcaactgtggccaatcctcatttgcgtgcggcgatggcttattcggttgatgcaggcggcaagcggttgcggccgttgctgttattgagcatcgttgctatgtatgatggcgtggttgccgaagcattacccgctgcaaccgcacttgaatttgtgcacacctattcattgattcacgatgatttaccggccatggataatgatgatcttcgccgcggtcagcccacgaatcacaagcaatttggcgaagcgctcgcgattttggctggggatgcgttgttaactgacgcatttgctatcttaagccagcactatccggaaaaaggcgctgcacttgttcaaatcctggcagaagcggccggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagttgccttagccgattttgcggctgcttttggtctgggttttcaaatcaaagatgatatcaatgatgtgactaaaaccaccgcggaattaggtaaaaccgccgataaggatgtggccgaacacaaaaatacatttcccgaactgctgggattagccggtgccaaacaagcattggcgacccagtttcagcaagccactgctgcgttaaacagcctgaccgttgatgcagccgacttaaaatcgattttggcggtgttacaagcatgacaaaagtaaaaaaagaacgggtcgatgtactgcttgtggagcaaggcttatttgagtcacgcgaacaggccaagcgttcggtgatggctggcgaagtctatgatcagaacaatcaacgtttggataagccgggggtcaaaatccccggcgatgccattttgcatgtgaaaggcaaaaaaatgccgtatgtaagtcgtggtgggcttaaactggctaaagcactgaaagtatttgcgcttgatttgacgggtaaaaccgtacttgacattggcgcatcaactggcggctttaccgatgttgctttacaaaatggtgccaagatgagctatgccttggatgtcggctataatcaactggcttggaagcttcgtgaggatccgcgcgtgaaagtgatggaacgggtgaattttcgttatagcaagcctgaagattttaccgatggccccgtggaatttgccatgaccgatgttagttttatttcgttgaaactcattttgccgccgctaaaagccatcttaatgccgcacggtcacgcggtggcactcattaagccgcaatttgaagccgggcctgcgcatgttgggaagcatggcattgtccgcgatcctcaggttcatcgggatgtgttgaagatgatcgtcaactttgccagtgccaccggctataacgttttagggttggcgtacagtccaatcaaaggcggcgaaggcaatattgaatttttaattcatttgcaaaatgctgaccaaacccctggagaaatcgcaccaactgttgatatcgagcgaacccttagtgatgcttatgctgcattaaaacgcccttaattgaatatttatgcaaaaatttggtaagcctagtgcgtctgcgctatgctatgggtaaagcattttttcacgttaaaaatgcattcatgacagaggtgagcacatgcgaaagcgcgaacgacaagcgacaattcaacgcttaattcaaagtgagccgatagaacggcaggaagatttggtggcccgtttgaccgagatgaaaattccggtcactcaggcgacgatttcccgggatattaaagaaatgcaattggttaagattccggcaggtgaaggacattatcgctacagtatgcccgcggaaaagcagctgcccgctacggataaactgcggcggacattggttaccgcgatgaagtggggcgaagcaatggataattttgtccatttggcgcttttgccagggacggcagccgcggttgagacactgatcgaacaattggacgaccggcgaatttttgcgacgattagcggggatgcatccattctcattatttgtcgctcggcacagtatgcaaccgatgtattggcggaacttgaggccatggtggggtgaaaagatgttacaggagttagcaattcatgattttgccatcattgataacttggcgttgagctttcagtcagggatgacggcgctcactggtgagaccggggccggcaagtcaattattattgatgcggtgggtttgttggctggtgggcgcggatcggttgatttcatccgaaccggggcatccaaggcaagcttggaaggtttgtttgacgcgcaggcaaatccattgacggaagccaaactccaggctttcggggtgatggatccggaccaaaacgacaccgtcttgttacagcgcgaattattccgcagcggccggaacgtttgtcgcgttaacggtcatctggtcaacaccgccaccttgaaagcgattggcgaaacgttggtggatattcacggccagaatgaacatcagcagctgatgcattcggaaacgcatctaggtttattggatgcctttgccggtgatgatctgctgaaaattcgccaccaatatgcagaagtttatcaaaattatcagcgtaccttacaagcagtgaagcaaaaacaggcaaatgaacaggaatgggcgcaacgactggatatgttgaaattccaggtgagcgaaattcaaagcgccgatctgcaaccgcatgaagatactgatttaagtaccgaacgcgatcggttggcaaactttcaaagaatcaatgctgctttgcaagaaagctatgccttgttgagtgatgaggaagtcaatgcacttgatcaaattggtcaagcaatgtcgagtatgcaaagcattgccgatttggatccggattttgcggcaattgccgacaacttgcagagtgcgtattatagtttgcaagatgtccaaaatgatttatcgaaagaactcgatgatcaggaatttgacgaaggccgcctagatgaagtcgaaaaacggctcgacttatttaatcagctcaaacgcaaatacggcgaaacccttgatgaagtgatcgcttatggcaaacgggcagcggcggaattgaatcagatggaacaagccgaaacatcggttgaagatctagacagcaacctaaaagaatctcaagcccagcttcagaaactcggtgcggcactttcaaaacgccggcacgctgctgccaaacaactgaccaaagcgatccacgagcagctggcgtcactgtacatggataaaacggttttttcggttcattttactaaggccaaagattttcgggcagacgggttagacgaagcggtcttttatattcagactaatccgggtgaagaagccaagccgttagccaaaattgcgtcaggtggggaattatcgcggctgatgcttgcgatgaaaaccatttttgcgcgctcggaaggggtcacggcgatcattttcgatgaggttgataccggcgtttccggacgggttgcgcaagcgattgccaataaaattagcttaatcgccaaaaggtcgcaggtgttgtgtattacgcacctgccgcaagtggctgccatggccgatcatgagtatgtcatcagcaaggcggttcatgacggtcggacaacgacccaagtcaataaactaacccataaagcgcgggtagaggaaattgcgcggatgctggccggcgaaaaaatcactaagctgacgattgaacatgccgaagaactattaagaatggccgatgagtttaaacatggcaaagtgtcatcgtagtcaggtgaactggtgacggtattgaatgcgccaaaaattcaatgttcgtagattttttccggcataacaaaaagcgattcaaggagacatcggtcttacttgaatcgctttttgcttggtcacaggagccgtattcagaaaaagctatttgaatcgtttaatataattgacactggtgctggtcatgatgcggaaaatgttgctgtggtatcctttaaccaggaagcgtttttcaccaagtggtcggacaatgtggcccacaaatggcgcggtttcatggttaaaatacagtgcaatttggtaatgtcgttgcatcgcctgatcaatgaaaagatccacttgatgggcgggcatttgcatcgtgggtgctgccagatcgaataattcccggtatgaagctacaaggtgatgggtcacattttgcagtgctgacgatttattttccatgatcgcgcctccgaacgtttgtttgtaacttcattatacgaacatgtgttcaaacttgcaactactttttgaaatttattcgacctgtaacaacggcaagctcgtgacagaattggaggtggcaaagttggtattggcagttgtttttggtggcggggcggcgcatggtgcttatcaagccggtgtctggagcgtgctgggtccgcgactggtgcctgcgtttgtcatcggttcttcaatcggtgccattaacgctgctgctacggttcacatggcgccgcaacaactggcgcattggtggcagtctttgaccagcttaaagacgcggggaccgatctttgccagacgtaactttgtcccattacttgagcagatgttgcggtcgccaaaacgcgatcaacgggcggttttagccgtcaccacgcgcttacccgacttacgtgcccatgtgacgcgcatagatggactttcggttgctgatgccagagagtggttgttagcctccagcgcaatgccggggatttttacaccgattgaccggcatggcaccagttttgttgatggtggcgtggttaatgatctgcccgttgacattgcaagagatattggcgctgattttgttgtggccatcagtggcacggggattggccggatcgggtctgatcacggcgatgtttatctgaaacctagtcagccactgcctcgtctcttcaactttcgtcccgcagcgattgccgaaatgatggccttggggaaaaaagatgccgagatgaccttacgccatatgacgttttcattaccgcggtcttgaagcagttgaaatcggcggtgaaaaagtgcaaaatgtttagtaatacttaacgaaagaggttcacacatgcacgaacggggaatgctgattgttttgtctggtcccagcggcgtaggcaaaggaacggtccgacaagccatgcttgaaggcaactaccgggattttcaatattctatttcaatgacgacgcgccaaatgcgtcctggcgaggttgatggcgttgattattacttcagaaccaaagcacagtttgagcacgaaatcgcgacaggtggtatgcttgagtatgcgaagtatgtcgacaactactacggtacgccactgaaatacgttaatgaaacgcttgagtccgggcgtgatgtgttacttgagatcgaagtcaatggtgcaatgcaggtgcgcaagaagtgtcccaatggggtgtttatcttcctgacgccaccggatttaagtgaattacgccatcgattgaaaggtcgcggtacggatgacgacgagaccatcgataagcgcattcgcaaggcggcttccgaaattaccatgatggaaaattatgattatgccgtggttaacgacaaagtggatttggccgtcaagcggattgagcgcatcatcgaaagtgaacatttacgtgttccgcgtgtcattgaccgctacaaaggtatgttggcgagtgccgatttagctagataatagagcgccaacttgcgacttggcaaattggcgattatgaaaaaaggagtctcatcacatgattatttatccttcaattgacaagttattggaaaaggtgccctcacgttattcacttgctgttttggcagccaagcgtgcacatgaacttgaagcgggcgatttgaaaatgttatccgattataaatcagataagagtgtcggcaaagcgcttgaagaaattgctgctggcgacgtgattattgatccaaaatcaaagatgcttgaacgggatgccgaaaaactcgatcacaaagattaaggattaaaagacaaaccattgaagtaaggggcaacggtaagcagaacaaccggttgctctttttttatggcaatatttttgggaccattaatggatatgcgtttgccgagttggtttaatcgccatgaccggaaacttggctcacgtttgctataataaagctactacgaaatgtaagaggggtgcctcatgaaaaagcaacatattgccttgtttgttactggcgggattgcggcatataaaataccactgttggtgcgcgcgttagtcaaagccgggtatgacgtccgagttgcgatgacggccagtgcgcagaagttcgtgactcctgaaacgttggccattgttagtaaacatgctgtgttgacggacggacatgagtttgatcatccggaacacgtggcgcatgttgctttagcacactgggcggatttgggggtcgttgtgccggcaaccgccaataccttggcaaagctagcggccggtttagctgacaacgttgttaccacgacgctgctagcaatgactgcccctaaattaatggtcccggctatgaacgatcaaatgtggcaaaatccacaaacgcagcgtaatattgcgcggctgattagcagacaaggctatcgtctgctgccacctgctaccggacaattggctgagggttataccggagtcggacggatgcctgaaccggatcagattgcgctgtttcttgaaaaccttgccgagccgcggttaaaaggccggcgtatcattgtctcggccggtgggacaaaagaacgactagatccggtgcgctatttaacgaatgactcatcaggtaaaatgggcaccgccattgccaacgccgcggctggtgctggtgcagcggtgactttagtgaccactagagagctgcctgttgtccctggggtgaccgtgaagccggtgaccagtgcccaatcaatggccgatgcaattttggcggattttccggatgccgatgcagttattatggcggcggcggttgcagattatcgcgcgccgacgattagcgaccacaaaataaaaaaagtcgatgctaacagcggcttgacgttgaccttggtccagaatccggatattctggcgacattggggcaaaagaaaacccatcaggtagtcatcggttttgccgcagaaaccaatgatttgttagccaatgcccaaaccaaactgacgaaaaaaaaggccgacatgatcgttgccaatccagtcgatgcgacccatgggtttaatgccgatacggatacggtcacttttttgcggcctgatcagccaccggtgacgctgccggaaatgacgaagcaaaaagtcgccgtggctttaattgagcaattaacaaggatgttaccgaaacaaaaggggtgagcgcttggcaaccattgccaaagtgattgtggatgttccgaccatgcaaacagaccggccatttgattatcttgtgccaccacgactcgatggcgcgcttcaacccgggatgcgtgtttgggttcagtttggaaaaggagcgcggaaagtcagcgggatggttgtcgcactttccgatcaaagcgagtatgccggtgaactcaagccgctgctggatgttttagatcccgcgccggtcttgaatcaggaaatgctggcgctatcgaaatggctggcagaaaccacttattctttttggattgcctgcatgcaaaccatgttaccaaccatgttaaaaattgatgcggttaaaattgccgaaccgattgcattgtcggctgaggagcaagcccgctattttggtcaggcggatagcgtcgccttcaacacgctttctgatgaggatcaggttgctttgatgaaactggcacaggctgaaaaagtggccatttcttacgttaaaaaagatcgcgcccgggttaaacaggttttctacctcattccccaattgtcagctgagcaagttgccgcagaaaagcaacaaacacgcaaaaatgccgtgaaacaattgcaattgcttgacctgatcggaacctgggcggccaaacatgaacgaccattgctgacggatgtggaacatcacactaagttaacaaaagcaacgattaatcaggccgcggcgaaaggctggttgaaattagaagcccatgaaacctaccgcgatccttatccgcaacttcggcatcaaccgttaacgcaacccttaccattaacggccgatcaaaaaaagattgtggacacgatcaatcaagccgtgaaagcaaaagagccgaaaactttcttacttgaaggggtgacgggatcaggtaaaaccgaagtctatctacaggtgattgcgcaggtgctggcggcggggcaaaccgcgctcatgctggtgcccgaaattgctttgacgccccagatggttgatcgggttaagggacgcttcgggatgcatgttgccgtcatgcattccggcctgtctgatggcgaaaaatatgatgaatggcgacgcattgcccgtggcgaggcgcaagtggttgtcggtgcgcgttcagctgcgtttgcaccgctcaggcatatcggcgtgttcatcatggacgaggaacacgaaaccagctataagcaggattcggtaccgcgttaccatgctcgcgatgtcttactgaagcgcgcacagattcatcacgcgccggttgtattaggatcggccacgccatcgttggaatcccgtgcgcgggcggaaaaaggcgtatacacgcttttacgtttgccgcagcggattaacgatcagccattgccaccggtgcacattgtcgatatgcgtgaagcgtttgcgcagggggctcaagaagacttttcggcgccgttgttagatgcgttgaaggtgcgtctggagcggcatgaacaaagcgtcttgctgctaaatcggcgcggatactccagttttgtaatgtgtcgcgattgcggttacgttgcaaagtgtcctaactgtgacatcagtctaacgttgcacatggatacgcacacgctaaaatgtcactactgcggccatgaagaagcaattccgcatcgctgtccgcagtgtggatcggacaagattcgctattatggcaccggcacccaaaaagtcgaggcccaattgcagacgttactcccaaacgcacgcattttacgtatggatgttgataccacgcggcgaaaagggggacatgcccgaattttgaatgcatttggcgctcatcaagccgatattttactcggcactcagatgattgctaaagggttggactttcctgatgtcactttggttggcgtcattaatgccgatacgtcactgggattaccggacttccgagccagtgaaaagacgttccaattgctgactcaggtaagtggccgagctgggcgggccgataaacccggcgaagtgtttgtgcagacgtttaatccggatcattacgccattcagtacgccaaacgtcaggattacgaaggcttctttcgccaggagatggcggtgcgccaccaaggcaactatccaccatatttcttttcaactaagattggagttagtcatccagatgaaacgcaggcagcgaaggcaattttttccttggccaaagaactgcgcgcacagttgtctgatcaggtaatcatgcttggaccaacgcccggaccgattgcacgcttgaagaatcgctatatttatcagatcgttttaaaatataaacatgaaccggccttagccaaaaccttgcaacatattcttgaagaaacgcaacaaagcagccggcaaggatttcaggtaaccattgatcccgaaccgctatcatttgtttgaagttgttgtcaacgaagggtatcacgcatcatatcgaatcgatcgtttggaggaaaacatgacttcagtaatttttctaggaacacctgattttgccgtcccgatccttgaaggcctcattgcccagcattatgacgtggtggcagtgatgacgcagccggatcgtaaagtcggccgtaagcagaaactggccgcaagcccggtcaagcaagcagctgtcgctcataacattccggttttacagccagaaaagcttagcggcagtcctgagctggcgcaggcgattgccttagcgccggatcttattgtgacggcggcgtacgggcaatttttgccgaccaaatttttacaagcagccaaaattgctgctgtgaatgtccatggttcgttgctgccgaagtatcgcggtggggcaccgattcagtacagcattatcaacggggatgctgaaaccggcgtcaccattatcgaaatggttaagaagatggatgctggcgatatgtttgcgcaggcgaagttgccgttaacccgccaagacgatactggcactgtgtttgcaaagttatctttattgggccgtgatttgttattggcaaccttgccgaagattattgaccaaaccgccatccgtacaccacaggatcccgagaaagtcacgtttgccccgaccatcaccaaagagcaggagcaccttgatattcacttgtcggcgcgagcattggatcaatgggtacgtggtttgcggccagaagtcggcgggtatgtttatatgaacggccaacgaaccaagctttgggccatcacaccattaactgcgaccacaaacttgcctgctggcagcgtggtcgcacgcagcaagcatcaactcgtcatcgcggcgggcaaacagagtacctttcaaattgatgagctccagccagccgggaaaagcaaacagcatattgcggactatttgaacggccctggccgcgatttaaccgtgggacagcaggtgatcaccgatgaccccgaataatccgcgactgttagccgttcaaaccttaacccgcgtcatgggtaaaggcggctattccaacctgacgctcgatcacgtgatcaccaaatatcagctggattcgcgtgacgccggtttactgacaaacattgtctatggcgtgattcagcaccaattgacgctggattatcttttggcgccgtttgttaaaacacgacaattagatacttgggtgcgttgtctgttgcagacgtcagtgtatcagctgcagtatttagataaggtgccggcacgagcggttttctttgacagtacggaaatcgctaaaaaattaggccatcaaggggtggctaaatttgtgaccggtgttttacggcaggcacagcgcagtggttaccccgatccgatgacaattgctgatccgattcaacgcttggcgattaccagcagtacgccggtttggctggtaaaaaagctgcaagcacagctaggcgagacaaagaccgccaagattctagcagccattaaccagccggcccatgcttcgattcgcgtcaacacaacgaaaacaacggcggcagctttgttgaaggcgttgcagcctcaatttccagcgttaaaagaaagtccgctcacgccagttggcctagttgcgccgggcggtcatttagctggcacccgggaatttgcggacggtctgtataccatgcaggatgaaagctcgatgcttgtggcgccgagtctggatgtacaaccaggcgatcaggttcttgatgcgtgtgcagctcctggcggcaaaaccacgcacattgcccagtatctggatcctgaccaaggcgggcgggtcactgccttggatctgcacgccaataaagtccgcttgattcaacaaaatgctaagcggttagaccttgatgatcgcgtggcggcacaggtgatggatgcgcgtcaggttgcggctaactttgctgctgagtctttcgataaaattttagtagatgcaccttgttccgggttagggctcattcggcgtaaacccgagatcaagtacacaaaacagcctgaagacttgcaacacctgcaaaaaattcagttggcgattctcgatagtgttgcacctactttaaaaatcggtggccgcttgacgtatagtacatgtacaatggtaaaagaggaaaatcaggatgtggtggcccacttcttagcaacgcatcccgagttcgaacaggtacctgttttgacgctaaaaccacttgccaaaacgcatggcgcaccagctttgcaattatttcccgacgattatgataccgatggctttttcatcgccagtctgattcgccgtaaatgaggggtatgtatggagtttgcttatcgcaccgatattggtcggcgccggccaaataaccaggattatgttggcatctttaagaatcagtctgaggccacgcttgctttagtggctgatggaatgggaggccatcgcggcggggacgtggcgagtgaaatggccgtctcccatctcggctatgcttttgaaaaaaccgacactgccgagattgagtccatcgtccgctggcttatttttgagttgcagcaggaaaatgacatgattctgcaaaaggctaaacaatatactgacttatctggtatgggtacaacggttgtagcagtgatcattagcggtacccgttttgtcgttgccaatatcggggattcgcgcgggtatttatatcgcaacgggcatctggttcagattaccgaggatcatagtttggttaacgaattggtcaaacatggtgaattaacccctgaagaagccaaacgttttccccaacgcaacgtgatcacccgttcgctgggagttagcagcgatgttgacgcagatgtgacaatttatgatatggaatttgatgattatttgctgctgtgctcggatgggttaacgaatatggtcgataatgaagccattgcggcagttttacgtcaggatatgccaattggaagcaaggcccaggagctaattctacgggctaatgctgccgggggtccggacaatatcactgctttgatcattcatcaggatcggagggaaccgtcatgatcgagccggggacgattttaaatgaacgctataagctcatcaaaacgttaggcgaaggcggtatggccaacgtttatttggcacgcgatctgatccttgaccgtgatgttgcggtcaaagttttacggcttgatcttcaaaatgacccggatacggtgcgccgatttcagcgtgaagccatggcgacaagtgaattggtccatcccaatattgtgtcgatttatgatgtgggtgaaagtcacggccagcagtttttggtgatggagtatgtcaaaggctctgatttgaaacactatatcgttgaacacttcccgattccttatcaacgcgttgtcgatatgatggaacagatcttgtcagccgttcagaccgcgcatgaccacaatattatccatcgtgatttaaaaccgcaaaatattttgattgatccggatggtaacgccaagattaccgattttggcattgcggtagcgttatcggaaaattcaatgacgatgaccaactctctgttaggctctgtccattacttatcaccggagcaggcacgcggcagtatgcccacacggcaaagcgatatttatgcacttggtattattttatttgaaatgttaaccggttcggtgccgtttgaaggcgactcggcggtttcgattgcgttgaaacattttcaagaagaaattccatccgtgcgcgcttttgatccccatattcctcaggcactggagaatgttgtttttaaagccacggcgaagaatccggctaatcggtatacaagtgccgatgccatggcaagcgatctcagcacggcactcagtcctgcccgggctcacgaagccaagtatgtgattccaaaagatgatttggatgagacgcgcattgtaccggtcattcccaacggccccaagccaccgcatgatgatgacgatcacgcaaaccaacctgctgaacaccactcaccagatggccaggctaagaagaaacgacggcgatggttgatgatcggcctgagcgccttgatcgtgatgttaatactggtaggaattggattggtgacggccaatcaaaaagccgatgtgacggtacctgatttgcgcgggatgaccaagacgcaagccaaaacggcactaaccagttcgcgattgaaggtcggaaagtatcgctatacttactcaaccaaagtcgatagggatctggttatagactctagtcctaagcggcaggtcagtgtcaaagaaggatcggcggttgatctgatactgagtcgcggacagccgcgcattaccttggataattatgtcggtcaggattatacggatgcaaaatccgatttgcaaaaacgcggtgttaccgtcaaggaaaaagtggttcgaacaaattcggtcgcagccggaaaaatcacggcacaaagcattaaacccggcaaaaaagtcattgcaagtaaaaccacgattacgtttgatgttgcagagccgattaagaaagtcaatacggcctttgcactgcgggatcttaccggttatacggaaaagagtctgcgtgactacgcaaatgaggtcggacttaagattgtgattgctcagagtcattccgacaccgttgataccggcatggtaattagccagaatccggctgctggcacgcaggttcacgcaggcgatacggtcaatgtgacgatttctcaaggcccggatcctgatgaactcaaaaccgttaccaaaaccatttcaattccttatcaggcgccagcatcatctagcacaaccagtggcagcggaagcagtagtggcagtgctagcagcagtggaccgacgccaaacggggttcaggtgttcatcggcgataagacacataacattgactcggttgacaagacgtttaatattaccgcggataatcaggtcaccattaccttgcaagtcaacaagacgtatccgggtagttatcgggtggtacgagatggcaccgttgtcgcacaggagtacaatattacacaatgagtgaagaattaaccggaagaattatcaaacaaatcagcgggtattatgatcttgcagttgatggtgcaatttatcgcactcgtggtcgcggaagcctgcggaatgacaagatcacgccactagttggcgattttgccgtatttcagccgggtcaaggtgatgatgaaggctatttgttgcggctgctgccacggcacaatgcgttggtgcgcccaccagtagccaatgtggatcaggctttgttgattgtctcagccgttgaaccggatttttcgttgaatctgctcgatcggtttttggtttatctggaagggcatgcgattcatgccgaaatttacctcaccaaaaccgacttggcgcctgatcggctgttgaagcaaattgaagaagctttagccggttatcaggctattggatatgcggttttcatgcccgaagcagcctttgatcctgccacgttgaatcaagttcaggctagttttgctgacaagctgactatttttacgggtcaaaccggtgcagggaagtcgaccttgatcaatcatttggtgccggggttggatttggctaccggaaccattagtcgggcgttaaatcgcggtaagcataccacgcgcacaaccgatctatatccgattcatggcgggctagttgctgacacgccggggttttcctcactcggtttgttggacgtgacgcttgatgacttgcgggatcgctttcctgaatttgttgccttggccccgcactgtaaattccggggctgtcagcatgtcagcgagccgcaatgtgccgtcaaagccgcattggatgccggaaagatcatggccagtcgctatgaaaattatttacagtttcgagaagaattaagtggcaagcgcccagtgtataagaaaaagtagttcatcttttaaaatggagggattctcatgaaaattgccccgtcgattctaagcgccgactttgctcatttagcccgtgatgttgaaaaagtggagcaggcaggtgccgacttgctgcatgttgatgttatggacggtcattttgtcgctaatctgacatttggtccattagtcgtgcaggcattacgcccggttaccaacttaccgttagaggttcatctaatggtcagtgatccagcagcgtgggcgcctgcctttgccgaagccggagccgatacgattttggtgcatgaggaagcgactgatcacttatatggcgttcttcagcatatcgcagcgaccggggttcgtgcgggggtcgtggtgaatccgggcacgcctttaagcagtttggaagaagttttaccgcttgtcgatcaggtattggtcatgaccgttaatccgggatttggcggccagaagtttttgactgccatggtggataaagttgcccgattgcatcaattgcgccaggatcgcgggttgcattttgatattgaagtagacggcggcattaatgccaaaaccgtgaaagctgcagcagatgcggggaccgatatttttgtggccggttcatacgtctttagtgccagtgatgtcggtgcggccatctcgtctttacgtgaggcggttcaatgacaactatcaatatcatggctggcggcccgcatgatgatttaccgactgactggcaacagttgctgggggtatggattggcgtcgatcggggaaccttgcatcttgttgaagcgggcattcagccggatctggcagttggcgattttgactcattaaccttgagcgagttacgcgacgtccgtgaacacgtcaagaaaattcagcaagtcccttcagaaaaagatgataccgacacagagctcgccgtcaaagctgctttacaatgtttttcgactggtgacgtgatcatactgggggcaaccggtgggcgactggatcatttcttgtccaatttgtttttgccgctccagtcgcgatttctacccgcgattgaacgcattcaccttttggatgtgcagaatcgggtcgattactatgccccgggtgtccatgaaattcaaccgctgccaggttatcgctatgtggcagttgtcaatttaacccctatcaccgacttgacgattactggcgccaagtacccgttaaaggcgtgggacaatgcttcgccattttcgtgggcttccaatgaatttgtcgggactaaaccatttacggtgagctggacaaagggtgtcgttgcgattgtctatagccgcgatcgccgcggacaaaaagtcgataattaacgcggtaaggtcggaaaaaagagcagattgagctgttgttttaagcctgtcaagtatttttactttgcaaaacttcttgcattcaccgcgggcctatgataagttagttgagtgaaaaattcgagggtgaccttgaaaaaaaggaggtcatattgtggctaaagatgttattactggtcgtcataccacgtttggcaacaagcgttctcacgctttgaattcaagccggcgccaatggaaagccaacctgcacaaggttcggatccttgttgatggtaaaccaaagcgggtatgggtttctgcacgtgcccttaaatcaggtaaagtgacccgggtttgatcccataacgattaaaaagatcctgacaatgaatgtgatgcatccttcattgtcaggatctttttgtgtcaggtcatcagggaagcaatgacaggcagcatgattagcttagtcgaccgtggtttcgaatcgtgcgcgcttttaatgacttcttccctatgctaaactatctgttagaattgtatgcggtgaaaatagcatcgtgaatggctaggaggatacagcatggcggtcaagatcaaaaccaaatatgggattatcgacatttccaatagtgtcattgcaacagtggttggcggtgcggcaacgtcaatctatggcattgtcgggatggccagtcgtaaccagatccgggataatctcaatgatattttgaagcgcgagaattatgcgcgcggtgttgtggtacgccaaaccgacaatggcgtgaaaatcgaagtgaatatcattgtcagttatggcaccaaaatatccgaagtttgccgaaatgtccaagacaaagtaaaatacaacctcgaaacgatgttgggggtcacaaccgatgaagtgaccgtcatcgtccaaggcgtcaaggtattaggcgactgacgttaacgcaccgttttgcgacggtgatcagataatgaagttcttcgaggaggatgtttcgtggcagtaaccgaaattacggcgactaaattccaggacatgatccgggtagccgcacatcgtattaataaaaatgctgaatttgtgaattcactaaacgtttttccggttccggatggtgataccggaactaacatgaatctgacttttcagaccggtgccaaagcagtattggagtcaaatgaagacgctgtcggtgcgctggctaaacgtctcgggaaaggcttgctgatgggtgctcgtggtaattcgggcgtgatcagttcgcagcttttccgaggattcgccaaaagcgttgaaggtaagaagaatctgagcgcacaggatttggccgatgcttttgcccacggggtggagactgcctacaaagcggtcatgaagccggtcgaaggcacgatcttgacggttgcgcgtgaagcagccaaagcggggctgaaggcggctaacggctcggacgatgctttagtcgtgatgaccgcggtggttaaaggcgccaaacgtgctttagccaaaactcccgatcttcttgcggtattaaaagaagtcggggtggttgattcaggcggtcaaggattggttttcatttatgaaggtttccgtgaaggcttgtccggtgaaatcagttcagatgtacatgatgtgaccgatgaagaaatgacggaaatgatcaacgccgtgcatcatcaaagcgctcagacccaacttgatccggctgatatcgtgtacggctactgtaccgaaatgatggtcgagctaggtcatggcgatcagtttaaacactttgattacgaaccattccgtaattacctgaatactttgggtgattcaacgctggtcgtggccgatgaagaagtcgttaaagtgcatgtccataccgaacatccaggaacggtttttcgatacgggcaacagtttggcgatctgttaaagatcaaagtcgataacatgcgtttgcaacaagaaagtatcatcgaacgtgaaggggctttggatgctaaggccgatacgcaaccgttagctgaaatgggcgtggttgccattgcagccggacaggggcttggtgagctattcaagagtttaggcgtcacgtatgtgcttaacggtggtcagacaatgaatccaagcaccaatgatattttggatgcggtcaagtcagcccatgccaagcatgttatcgtgctaccgaataacggtaatattttcatggccgctgaagccgcagccaaggccgccacagatgttgaagtggccgttgtcaaaagtaagacgattaaccaaggcatgaccgcgatgcttggctataatccggatgccgatttggcgacgaatcaaagtgaaatgaccgcgcaattgccaaatgttgtcagtggttccatcacccaggctattcgggatacgaccatcaatggacttgctattaagaaccacgactggatgggtatcattgacggaacgatcagtgtgaccgatcagaatcgtgaagttgcggcgattgcgatggtgaataagatgattaacgctgacagtgaaatcgtcaccattattgttggggcagatgccagccaaagcgaagccaaagcaattgcggctgcggtgggcgatcagcacccagaccttgaatttgaaattcatcaaggggatcaaccggtttatccttattttgtttcggttgaataaagcgtttgcctcacttgtcaaggtgtcccgcatgcggggcacttttttacgagactgacagaaaatctatgccgtgatgaggtcaaggcatcaacgcgaaaggaggtagaagatggcgctcacggatccggttcgggttttacctggtgtagggccaaaacgagaagaaggattggccagtctcggtattcataccgtgggcgacgtccttttttattttccgtttcgctacgacgatcttaaagtcaaagatcttgctgaggcagctgatcaggaaaaactgacgattaaaggtgtcgtggtggctgatccggttatcagccgctttggtccgcatcgcagccgggtgaacgttaaattgcaagtcgaacgcagcgtgattttggtgaccttctataatcagccatggttaaaagatcggttccaaatgggcgatgaagctgcggtttttggtaagtgggatgctcagcggcgcagtcttaccgggatgaagattctggcgactcagtctcaggatcaaccgtcaatggcggcgatttatacggtgaataaaaatgttcgtatgggcaccttgctggagctaatcaaggcggcgtgggcacgggatcatcaaaatatccatgacttgattccggctagtatccgcgcgcactatcgtctgatgtctgacgaacaactggtccatggcatgcattttccggatacgcagcaggaagccaaagcagcccggcgcagcggtgttttccgggagttcttcctgtttcagctacagattcaggcgttgaaacagttgaacgacaatgccaataacggcctggcgattccgtatgataaccaggcgttgcgggcgttgattgcaaccttgccattttcgctgacgaatgcccaaaagcgtgtggttaacgaaatctgtgccgatatgcgccgacccaatcacatgaatcgcctattacaaggagatgtcggtagcgggaaaaccattgttgccgccatcgttttatacgctgcggtgactgcgggctatcaagcagcactgatggtacccactgaagtgcttgcagaacagcattttgccaaactggaggcattatttgctgattttcctgtcaagttgggattgctaacaggatcgaccacggcaaaaaaacggcgggaaatgttggcagaattgcgcgatggcaccttgaatttaatcattggcacgcatgctttgattcaaaaaggcgttgattttaaagcgcttggcttagttgtcattgatgaacagcaccgttttggggttaaccaacgaaaaattctgcaggagaaagggcaaaagccggatctcctgtcaatgacagcgacgcccattccgcgaacgttagcaatcacggcttatggtgaaatggacgtttcaacgattgacgaactacccgccggacggaagccgattacgaccacttggctgcgtaagaatcaggtaggacaggtttatcgactgattcgcagtcaggtgcaagccggcagtcaggtttttgccatcacgccgctgattgccgaatctgaaaaggtcgatttgcaaaacgccgagcagctctttgcggatatgcaaaaagccgtgggggatgtggggcaagttgccttgcttcacggcaaaatgaagccggatgagaaagatcaaatcatgcgcgcttttagccatggcgacattgcagtgttagtttccacaaccgttgtcgaagtgggcgtggatgtgccgaacgcaacggtgatggcgatttttgacgctgatcgttttggcttatcccaactgcatcagctcaggggtcgagtagggcgtggcaataaggccgcccaatgtttgttgattgccgatccaaaaaatgaacaggggattgcacgaatgcaaatcatgaccaagaccaatgacggctttttattagctcaaaaagacttggaaatgcgtggttccggtgatatttttggtgataagcaatcaggcttgccggaatttaaagtggccgatccggtcggagactttccgactctggaagtggctcaacagattgttgctaaaatttttaaaactgatcctcacttgctggcaccggagcatcaaccgttagcggcatacttagctgcgagtcgcatgatgcaaggcagtttggattaaactcgaaaggaccgataaactccatgaaaattgcagtagatgcaatgggcggcgatcatgcccccgaagttgtgattgccggcgttgaaaaagcgcgtgaccatgatgccaatttagaattcctgctttacggtgatgaagctaagattaagccgctgattcacaatcaagatcggctaacgattattcacactgccgaaaaaatcaatagtgatgatgaaccggtgcgcgccattcgccgaaagaaacaagcctcgatggtgctggcagctcaggcagtcaaacaaggtgaagcagcggcgatggtttcgctcggatccaccggggcgctgcttgcagccggactgtttatcatcggtcgaatccgcgccattgaacgtccgggcttgctgccaacgctgccgacagtcgatggaaaaggctttgtcatgctcgatgttggcgccaatgccgaaaaccgtccgtatcatctattgcaatatgccattatgggtagctactatgccaaagacgtgcggggcgtggccaatccgcgcgttggcctgctcaataacggtacggaggcaaacaaaggcgataagttgcatcaggaggcgcatgatcttttggccgccgctccggggattaactttgtcgggaatgttgaatccagtaacattttgaacggcccggctgacgtggtggtgaccgatggctttactggaaatgcgaccttaaaagcgatcgaaggcaccgtacgcacggtcatgcatatgctaaagggcgcgatttatgacggcggcgtttccggcaaattaggcggtttgttcctgaaaaacaatctgaaatccatggccaaaacatttgatatttcgtcatatggaggggcagttttgctgggtctcaaagcacccttaattaaagcccatggcgctgctgatgccgacaccgtctactacacgttattgcaaacagcaacgatggttaaaaacggcaccgttgctaaacttgccgattactttgatgcccacccggaaattgtcgaagcgaaaactactgagaaagcgtagacattctttgagcaaacaagtaaactgaattggcagatgaatggaggagcagtatgagtgaagacgaaatttatcaaaagattgccggcttgattcaggatcactttcaactaagtcctgataagatcagcccgagtttgaactttaaagaagatcttgatgcagattcgattgacattgtggaattcgttttggaactagaggatgcctttggttcagaaattccggatgacgatgcagaaaatatcaagacagttcaagatgccgtcgattatatcaaggcgcatcaaaaataatgtacaaagagctgtcattcatggcggcttttttattttgcctgaaggcgttccaaaactgcaaaatgagcctttaaaatgacttctaagccttttttcttttcgtcaagcaagcatgttcttgtaagcaaaacatgaaggggcttttcgggagaattcacggataaatcgcgcaggaacgcaattttcgcttgcataactactataatttctttatacttagagacaattatttcgaaaatctcatcttgttttaatcttgcgtttagggcgcaaaggaggagttcgcttggataaacctgaagacttattattggatgtgcaacatttgcacaccggattcagacttggagatgctttttacgatgctgtcgatgatgtcagcatcacgttacgaaaagatgagattttggcgatcgtaggtgagtcgggttctggtaagagtaccttggcaaccagtatcattggcctgcatgatccacgtaacacaaaggtcactggtgatattttgtacaataacctaaacctagttggcttaaacgaaacgctttttgatcgaattcgtggtaaagatattggcatgattttccaggatcccttggctgctttgaacccattgatgcgtattggcgagcagattgaagagacgcttgtctaccacaccaagatgaacaaggaacaacgcgaacaacgggttttggaattgctgagtcaagtcggcattcctaatccggagcggacagcacgctcctatccgcatgaactgtccggcgggatgcgtcagcggattgtcattgcaattgcgattgcctgcaagccgccgattatcattgctgatgaaccaaccaccgcattggacgtgacgattcaggctcaaattcttgatctgcttgaagatattcagcgggaaatgcattcaggcattattttaattacccatgatttaggtgtggtggcagaaacggctgatcgagttgccgtgatgtatgccgggcagattgtcgaaagcggctcggtgatggatgttttcaagcacccgactcacccgtatacgcgcagtcttttgcgctccatgcctcaagcggattctgatgatgacgaattgcacgtgatccaaggcgtggtgccgtcactgaagaatatgcagatggaaggatgccgctttgctcctcgaattccatggattccggaatcggcacacgaagaacatccgaccatgcatgaagtcgcaccggatcattttgttcagtgtacttgctacaaggacttctatttcccggatgacaaacaagcggctggaaaaggtgagtaataatggcaatgattgaggtaaaaaatttaaaaatccactatccgatccgttcgggtttttttaatcgtgtaactgatcatgtgttagccgttgatggtatcaatttcgatattgagcaaggcgaaacatatggcttaatcggcgaatcgggctcgggtaagtcaaccactggtaaagcgattgtcgggcttgaaccggttacttccggatcgattatctacaaaggtgaagatattaccaaacgcagcgtgcgaaaacggctgcaatataataaagacgtgcagatgatttttcaggactccttgtctagtttaaatccgcgcaaacgaattgaggacattatcgccgagccgattcgtaatttccagaatttgactaaagatgaggaacggcatcgggttcaggaactacttgatattgtcggcatgccaagcgatgcattgtataaataccctcatgagttttctggtggacagcggcaacgaatcggtgttgctcgggcgatggcaacgaatcctaagctgattattgccgatgaaccggtatcagcgctagatttgtcggttcaagctcaagttctcaacttcatgaagcggattcaggaagaatataatatttcttacttgttcatttcccatgacttaggcgttgttaagcatatgtgtaagaagatggcgattatgcatcgtggtcgctttgtcgaaatcggtactcgggaagacatttatcagcacccgcaacatatttataccaagcgtcttttgtcagccattccggatgttaatcctgatgatcgtgcgcaaaacaaggaacatcgccgggaagtggaacgcattttcaaagaagaagaatctaaatattattccaaagaaggccgcgttttggatctccagaagatttccgatacacattacgttgcgctgccagattcatccatgaagggagtgcatgattaatgtggaaaacaattctacgccggatcttaatcatgatcccgcagttgattttactgagtgtgttagtctttgtcctatccaaaatgatgccgggcgatccattggcaggtaatttttcgcaaggacaaagtgctgctcagatggcggcattacggcaacagtatggattaaatgatccatggtacattcagtatgtgaagtggatcggtaatatgttccatggtgatttaggtcaaagttttgtttacaaacgttcggtgactggtttgatcggcgaacgtgcggcgaacacgttttggctggctttgttatcaaccgtcattctatacgtcattgcaatccctgcaggcgtgattgcaggtcgttatgaaggaagcaaacgcgactctgctatctcgattgcttccttcatcttgatggcggttccgccgtttgttttctatcttttgggccttattttcttcgggttcttccttcagtggttcccgaccggtggtagcgtgtcgtccacttataatcccggtactttgggctatgtctgggatcggatatatcatatgattttacctgcgctggtttccgggattatcacgacatcgagtacgattcagtatctgcggaccggcgttattgataacacccatcaggattttgttcgaaccgcaagatcaaaaggggttccagaccgcgttatcttcaataaacatattttgcgtaattccttattgccgattgcggcgtttatgggtaaccaaatcacgatgttacttggcgggtcggttattttggaaacggtctttagttatccgggaatgggacagctttttgtatcatctatgaccagccgtgactatccggtcgttatatcgttagtgttgctattcggattcttgacgttacttggtaatttgttatctgatatcatcatgagtatcgtggatccgcggattcggattgaatagaaggtggggaaagcttatgcaaaataatgcgaatgaggtggcgacagataccaccaaaattgaacaatcaccttctaacttcaaggtgattctgaatgaattccgaaaagataaagttgctgtggtttcgctttttctcgctgtaacgattatacttgctgcgtttattggctcgatgctctttaatgttggtggcgctactgaggtcaacattttggatcggtacatggctccggggacaggcggctatattctcggtaccgatgaaggcggacgcgatatgttcaaatatcttttcttcgctgcccgtaactcgattaccatcgggatttcggttgctttgattattgagtttgtcggggttgtgctgggaacaatctccgggtactttggcggcctggttgatgctgtcatcatgcggtttgttgactttatgatgatcattccatctttattggtcatcattgttttggttactattattccgcaatacaacgtcatcaccattattctcatcatggcggccttttattggatgacgacaacgcgattaatgcggtcactagtgttgtctgaagcgcgaagtgaatatgttatggcgtcaaaaacgtcagggacatcgaatcttaaaattatgtttaccggtgtcttgccaaatatcagttctttgattattacggacttgacgctgacaattgccagttccatcgggatcgaaacggcgttgtctttcttgggctttggtttgcccatggaaactcctagtttagggacactgattggatacgcgtcaaacccggatttgatttttaatcgctggtgggtttggtttccagcagtattggttctgttaactttgtcgttatcaattaattttgtcggtcaagcgatgcgacgggcagccgattcgcggcaacggcgtggttgaaacattgacaatttcctgaaaataatgaagagctactcagagaaatcagagtggctcttttttttgaagaaaaaatgtaaaaaatatgacgaaacattggttattttgttctaattatgctatcatttaactcacatgaagcgttgcttcgctacatatcgcgatgacgacgcggaagggggaaaaagtatgaaaaagcgttctgtgctcggaatgatcacgctcgctaccgctttatcaatcaccttggtagcctgtggcaataagagctcgaactccagctcaagtacagctaataagagtgtgaagttcccagtttcttataataacactgcaaaggcaatcaaaggcggtaatgtcaatgtggctgtcgtcaatgactctccatttaagggggtctttaacgaagagttgtacactgatcaatacgattatgattacatgacacctgcagctgagtctttgtttggcaccaacagtacctttaagtttaacaatcagggtgctgcgactctcaagcaagataacagtgcgaaaacaatcacggtgactatcaaaccaaatgttaagtggtcggatggtcagccggttgttgcccgtgatttggtttatgcttatgaaatcatggctaacaaagcgactaagagtcagcggtacaccgagtcgcttcagaatattgaggggttgaccgagtatcatgacggcaaagcggatactatttctggtttaacgatgcctaagggtgataatggtaataccatggtgattcactttaagcagatgaagccgtcatttaacacttctgggaacgggtacttccttgaaagtgctgcgccatatcattacttacatgatgttgcgtttgacaaactggaatccagtgataaggttcgtaaacaaccattgttctttggtccttataagatcagtaaagttgtcgctggacaaagcgttgaatacacaccgaaccaatactattggaagggcaagccgagtctttcaaagattacatttgaaaatgtttcatctgcttcaatcacctcagctttaaagaaccacaagtatgatatcgtttatggcatgccttccgacagttatagtgactggaagaacattagtggttacacgaatctgggtcatcaaagccttgcttataattaccttggtttcaaactcggtaaatgggatgataagaagagcgaaaacgtttatgatccaaattcgaagatggccaacaagagtcttcgtcaggcaatgggctatgcgttgaacaacgatcaagtcgcggccaagttctataacggtacgcggtctcgtgcaacgacattgatcccacctgtttttggtaaagatgttcacgctgatatcgatggctatgatttgaacattgacaaggctaatagcttgctggataaagcaggttataagaagggcaaagatggctatcgaaccgatcctaaaggcaagaagttaacgatttactttgcaaccatggctggcggttcaacggcgcaaccattggcacaggattatatccagcagtggaagaagatcggtctgcgcgtcaagctgacaaccggtcgtccaatcgagtttaattccttctatgacaaggttcaaaatgattccaagggtattgatgtttatgctgctgcttggagcctctcttctgatccttcaccaatggacttgttctcacagaaagcaccgtttaactacactcggttcgtttctgctaaaaacaccaagttgctgaatgatattgatagtcaaaaagcaatggatcctgcctaccgtgctaaggctttgaaggcatggcagaaatatgctaacgatgaagcatttgtcatccctacgctttatcgtcaggaaatcttccctgttaataaacgtgtgaagaatgcgagtgttgactatgcttcagcgaagtacctgaactggagtaaaatgacggttacaagtaatagccgtgcaacaaagtaattcggtttaaaagttaaaccattaaggcatctgcaatcgcaggtgtcttttttggtgcgctctagtataattagatagtgcgataaaaaggagggctcttcatggttgcctcagagtttgtgagcgaattgcgtcaacgctatgggattgagtttcatgatctcagcttactggatgaagcattcacgcattcttcgtatgtcaatgaacataaagaattaggactaaaagataacgaacgacttgaatttttaggtgatgccgtgctcgaattaacggtttcagactatttatatcgcaaatttccggataaaccggaaggcgacttgacccgaatccgagcagcagcagttcaaaccgcggcattttccgctttttcaaaagaagctcattttgatcgttatattaaattaggtaaaggcgaggaaaaagccggtgcccgacaacggttgacgctgcttgaggatttgtttgaagcttttaacggcgccttgtacctcgatcaagggcgggaagctaatattaagtttgccaagcagattattttccctaaaatcgatgcgggtgagttttcggccgatcaggatcataaaacagccttgcaggaaactttgcagcaaaatggtgacgtcgcgattgtttatcacctgttagacgaaaaaggacccgcgcatgagcgtcaatttcacgttgatgttgaagttgaaggccgcgttttgggcacggggtttggcaagaacaaaaaagcagcggaacaagctgcagctaaggcggctttggcccgtcttaaaaagtgagatttagaatggagtcatcatggaattaaagcgtttgatcattaatggcttcaaatcatttgcagataaaaccgaaattgattttgtttccggcttaaccggaattgtcgggccaaatggaagcgggaaaagtaacatcaccgaggcgattcgctgggcgctgggtgaacagagtgccaagagtttgcgaggcgaacgaatgggtgatgttatctttgcaggtacggatagtcggcctgctttaaatcgggcagcagtcacaatgacttttgacaacagtgacggttatcttaaaaatcaaccggcagaagtttcagtgacgcggcgactataccgcgacggcacttcggagtttttattaaataaccaggatgtgcgcctgaaagacattgtggatctgtttatggattccggcttgggacgcgaaagtttttcatttatttcgcaaggccgggttgaagccatttttaatagtaaaccagaagaacgccggggcatcattgaagaagccgctggcgtttataaatataagcagcaaaaaaccaaagcagagcgcgagttagctaacaatgacgacaatctggcgcggatcaacgatattattgtcgagttgaaacatcaggttgaaccgttgcgggaacaagcctcgttggccaaggattaccaacagcaatcagctgattatcaccggatccatcaaaccttgttggcacttgaaattgagcagctggcggctgaacaggagaaaacgcaaggtgaggccaaggttaccaaagcaacaattgcggcattgacggctaaggttaaggacttggagcatcaatccgaacagctgagtgcggttgatcaccagtatgaagaacagctgaatcaccttaacgatcaagtcttaagtcggtcgatgaaactggagaatctcagcggtgaggctaatttatccagtgaacggtcggctaatgcagcaacgactctggctgatttgaaagaacgtctggcccatacgcagcaatcgttaaccgaagccaaccagcggctagcggatttggctaagcaagccaagacggctcaagccaaacaacttgagctcaaaacgcaattggcccaacaaaagcaagccagccaagatccggcagccattaatcggcaattggaaacggtgcagaatcattacattgatttgttaaaagcccaggcggataacaaaaatgcgcaggccgctttacaaaaagatcagcaactggcagcgagtcaaaatgccgcgcatgatcgccggatttatgagctgagtaaacaggctcaggatcaggaagccaaagttaatatactattgaatcaacagcagcagcttcaaaccaaagtcgatcaacaacaagcggcggcagaagaagccaaagacaagctgacacaaattcaaaaagtacgaactgatcagcagcagacttatcaagatgagatggcgacttatcagcgcgcgcgggctcgatatgaaaccttgtccgaattaaatgaagattatgccggtttttataatggtgtgcgggtggtgttgaaacataaagcttccttaccaggtgtcatcggggcggtcgcggaattacttgaggtgccatctgcttaccagcaagcgtttgatttagcgttaggcagtaatttacaagccattgtgacgcgtgatgaggcagctgcacaacgcgctatcagtcttttgaaacaacagcgtgctggtcgggcaaccttcctgccggctgcggtgatgcggccgcgggaattgccaagtgcggttttgcagttagttgaaggtgcagacggctttttaggaacagggttgcaactggcacagtatccagctgatttgaaagccgtgatggcgaacttgctgggtagtgtgttaattgtggacaccttgccacatgcgattgtcattgccaatacaacgcatcatcggtatcgcatcgtcacaaccgctggggatattttaaacccaggcggctcgctgacgggtggccaggttaagcaaggccggcaagcctcaccactggcgcgtaatcaagaagcgcgccacctcaaaacgcaattgcaggatctggttgcagatttgaagcaaaagcaagcggatttgacgaccttgaccaaacaggaaaacgcggcgcaggaagcctggcaaactgctactgctcaagcgcaagcattagcagccgatcttactgccattaccagtcagcataatgcccaagccgagacattgcggcaggcgcagcggcaattggcagccgcacaacaggccaataccgcgcaggctgatttgagtaccaagttggctgatttacatcaagcaggtcaaaagattgccaaagaaattgccgatgcacaggccaagattgagcagcttaaggaagccgctgttgctgcagctgactcgagttctaagcaagcagcagccgttaatggtttaaagaccaagttagccgtcatcgcgaatgatctgcaaacgctccacgatcagcagcagcaatggcaggcgcaagcgaccgatgcgcaaacccagtcaactgagcttcaacaacgaattgcgcacattacggcaaccgccaaggaaactgccgcggaaaaggaaagccggaccgcaacaattgccagcttgaaaaaagaactgacgcagcttaaagccgatcaaactaagctgacgcaggaaaaagcggctaatcgcggaaaattaagcgacatctcagccaggatcacgaccacttatgatcagcagcatcaggcgatggcgacttctgaacagcaagcggttgcgcttaatcgcgtgaaactggggctggatgcgcggctgaatactttggctgaagattatcagttaacttatgaagcagctaaagcagcagttgcggcggatcatgccccgattcctgagcttaagagcaaattgaaactgttgaagcgaggaatagatgaattaggtccggttaatttaaatgcgattgaccaatttaaagaagttaatgaacggtacgaatttctcaccaagcagcaggatgatcttttagcggctaaacaacagctagtcgctacgatgcatgaattggatgaaacggtcaagaccagattcaaagccatgtttgatcagacaaatagtgcatttgaagctatcttcccgcagatgtttggtggcggtcacgcgcatttaagcctgaccaatccggatgatctgttgacgacgggcattgagatttctgcacagccgcctggcaagaagttaacccgcctatcgctgttgtctggaggcgaacgggcattgacggcaatcgtgttgttatttgcgattctcaaagtgcggccggtgccattttccattctggatgaagttgaagcctcactggatgacgttaatgtgaaccggtttggcgaattcctacgccattatgccagtgcaactcagtttattgtcattactcaccgtcatggtacgatggttgcagccaatgtcttatatggggtgaccatgcaggagtcgggtgtgagtcgaattatggccgttagtttggaccaatcacagaaagaggcgacaagttaatgggactttttgatgcgattaaaaaagcgttcaccggtactgagccggagacgcctgaagaaaataaatacgatgaaggcctggaaaaaagccgtagtagttttggtgaaaagctgaatgcactgtttgccaactttcgcacggttgatgaagattttttcgatgatcttgaagaaatgctgatcgaatccgatgtcgggtttgaaacggcggtgcggcttagtgatgagttgcgcgaagaagtgaaactcaaaaatgctaaagatcccaaggcggtttcgcgggtgatcgtcgaaaagttggtcgatatgtatggtgaagcaggcaaaggtgaggacaatcagctgcattttgccgaagaagggccaaccgttttcctatttgtcggtgtcaacggtgcgggtaaaaccacaacagtcggcaaattggctcatcaactcaaagaagaaggtaaacgcgttttgttagtggctgctgatacttttcgtgccggtgccatccaacagttgcaggaatggggccgccgggttgaagtgccggttgtggcaacgaatccaggcggtgatccagccgcagttgtctttgacggggttaaacgggctaaagatgaaggttatgatgttgtgctggtagacactgccggccgcttgcaaaacaaagtcaacttaatgaacgagctaaacaagatcaagcgggtgattgtccgcgagttgcctgatgcaccgcaggaagtcttgctggttctggacgcaacgacagggcaaaatgcgttgaatcaggccaaggagttcaatcaaacaacccaaattaccggtatcgttttgaccaagctagatggttctggtaaaggcggcattgtgcttgcgatccggaatgagttgcatgttccggtcaagctggtcggcttaggtgaaaagatggatgatttacaagcctttgatccgactaaatttgtcgctgggctttttaagggtttaattcaaattgatgcctaaatggcgtgcatataaaaatcgtcacacctaggtctaaggtgtgacgatttttgcgtttcgtgaaccaatgattaagctgtctggacttgcttttcccggccaagtacgacctgcaagacaatcaagacaaggtaaccgatcagcaggtaagtaaaccatgcagatggctgaaccttacttgcaaaccagtattgctgccatgcggtgttactcatgatccatgcgaacaaccagcccaaaaggccaaagatggcattgataatagcaaagaaccataagttgccgttttcgtggttgctcaggtaaacacatgagaaaaccaaactccacaatccccaagcagcaagaacagcaaacacggcccagtaaataaaggttgcgaccatattcttccctccaatttttcacatgttcagtgtaccacgaaataggggaaaactggaaatcgcgaattattggattgttacgtattccttgatcaacgccaacttgtcggcatcactttggtggtaagccaactcttgagcaaaagcaatcgccaagaatccgtacccggtttgatcaagcttctgcgttactgctgcgattaggtcatcaatattttgtgaatctgagcttgttaaggttagtgttgtttttggcataaaggttgctcctttttaaaggtataatagcatatgatggaatcggtttcatagtttagcgagtatgcgcctgattagatttcctacaagtcacctttttgcacggcacttataaaaagcaagagctggcggagcggtagcgggttcagttgccacgacatgcacgctataacgcgttccccggcgcagaagcctgcgtgtaaggacctcagccgcaatggccaaagcccggccattacgtccgaggtcacttacactccgacttctaagcgcgccggctcacgctcacaaaataaaaacgttaattgaccatttcaaatgataccggtatccttatacaaggaccatgttcgagtggccgggtagttgatagaccggcaatcatgggattaaaggaatgacatcatggaaatcgaaaaaaattatcgaatgaactcgttgtttgagttttatggcccgttattgactgataaacagcatgcttatcttgccttgtactatggtgatgattattcgctaggcgagattgccacggagtttaacgtgtcacgtcaggcggtgtatgacaatattcgccgcacggaagccagtttggaagagtatgagcagaaactgcatctttttgccaactaccaggcacaaaatgaggcggtggatgccctggtcggctatgtccgcacgcattatccaagtgacaagaatttaagtacattattagaacgagtcgcggatcaaactgcgaaataacagggggatactatggcatttgaaggattatcagaacggttacaaaaagcctttagcggactgagacgtaaaggcaaggtcagtgaaagcgatgtgcgcgatgccatgcgtgagatccgactggcattgctggaagccgatgtcaattttgatgtggtcaaaaccttcatcaagaatgttcggaccaaggcagtcggctcggaagtgcttgaaagtctgacgccggcgcaacagattataaaaattgttaatgatgagttagtcaaaacgatgggcgaggcggcagttccgctcaacaaggcaccgcacattccgaccgttatcatgatggccgggttgcaaggggccgggaaaaccaccacagtcggcaagctttccaagtatttgatggagaatgaaaaggcgcggccgttgctcatcgcggctgacgtctaccggcctgccgccattgatcagttgcaaaccattggtaaacaactcaatgttccggtttttgaaatgggcacggacacggatcccgttgaaattgtgcgtcaagggctggcgactgccaaagaaaacaaaaacgattatgtcctgattgatactgcgggccggttgcaaattgatgaaaaactcatgaccgagctgaaaaacatcaaagaacttgcgcacccaaatgatatcttactcgtggttgacgcaatgaccggtcaagccgcagttgatgtggccaaagggttcaatgagcagcttgatattaccggtgttgttttaaccaaattagacggcgatacccgtggtggggcggcgctgtcaattcgcgcggtaacgggtaaaccgattaagttcattgggcaaggcgaaaagatggacgccttagatgtcttttatcccgaccgcatggcgaaccgtattcttggcatgggtgacatgctgacgctgattgacaaggcgcaaaagacctacgatgagaaacaagctcaggaaatggctgagaaaatccgcgaaaattcgtttgacttcaacgactttctcgatcaaatggatcagatcagcaaaatgggcccgctggaagacatcatgaagatgattcccggaatggccaataacaaggccttagcaaacgtcaaaatggatcccaaagatattgcgcatatgaaggctattgtttattccatgacccccaaagagcgcgaagatcccgatctgctcaatcccagtcgtcggcgccggattgctgctggttccggtcgtccggttgttgaagttaaccgcatgattaaacagttcaaccaaagtaagcaaatgatgaaccaaatgagcaaaggcaatatgaagggccttgatggacttatgggtggcggtgtttccggcaaactaggcaaaatggccatgaattccatggttcgcaagcaaaagcggaacaagaaaaaacggcttaaaaaggccaagcgattccattcataatcagaacaatttcctgtgtaaagaaaaaaggctttacagcttaaaatatttttgctatgctatcaaggttgataaatgagcaggaggtggacttagtggcagttaaaattcgtttaaagcggatgggttcaaagcgtaagcctttctaccggatcgttgtagcagactcacgttcgccgcgtgacggtcgtttcatcgaggccgtgggctattacaacccgttgactaatccagtcgatttaaagttaaatgaagaagatattttgaactggcttcaaaaaggcgcacagccttcagatactgtacgtaacttgcttggtagcaagggcatcatgcagaagtatcacgaagcgcgctttgccaagaaataaaggcggttattaatggtggatatcggcagcttaattaaagccatcgttaccccgttggttaccaaaccagaagccgtggcggtgacggcacacgaaacagacgagtatatggccttcgatttggctgttgcgcctgaagatgtcggccgcgtcatcggtaaacaggggcgagttgcccaggcaattcgaaccattgtatacagtgtaaaaagcccgtatagcaaacgggtgcggctcaatattttggacgcgccgcatgcaaaataaaaagactggcgcatattgcgctggtctttttattttgaaagaaacgacagcacacagaggtgagaaaatgccagattactatgatattggtacgattgtaaatacgcacggcattcggggtgaggtccgcgtattggtgacgactgattttccggaacagcggtttaaagttggcaacaaggtctatgttgcaaccacgccgaagacagccttgacgattaactcggttcgccagcataaaggactcacgatgctgacgtttaaagactataccgatattaatcaggtgttaccgtttaaaggcaagaagttacaagtgaccgaggcggcattgaagccacttgaagaaggcagttactattataaggacattattgggttaacggtgattgatgaacatggccagacgttaggcaaagtcagcgaaatcttaagtcccggccctaatgatgtttgggtgattccgcgtcctggcaaaagtgagttgcttttaccattcctaaaatcagtggtacaaacaattgaccttgagcaaaaagaggcacatgtcatcgtaccggaagggttgattgacgatgcagattgacgttttaagcctatttccgaatatgtttgaaccattgcgggaaagcatgattggtaaagcacttgaacgccatctgcttgattttgatgtggttgattatcgcagctatagtcacgataaacaccaccatgttgatgataccccttatggcggcggggccggaatgttgttgaagccggaaccgctttttgaggcgatggatggcgttaatcagcggcatcccggaccaaagcgggtgattctcatggatccggctggcaagaagtttgatcagcaagccgcacgggaactttcgcaagcagagcatcttgtatttatttgtgggcattatgaagggtatgatgagcggattcgcaccttggtgaccgatgaatattcacttggcgactatgtcttgacgggtggcgagctgccagcgatggtgatgattgatgccatcgtgcgcctgctgccgggagttttaggtaacgacgaaagtgcccataccgacagttttgagaatggcttgttggaatacccgcagtacacgcgaccacctgaatatcgcgggatgaaggtgccagaagtgttgcaaaacggcaatcatcaactcattgcccgctggcggttaaaggaaagtctgcgccgaacttatttgcggcgacccgatcttttacaagctgcccaccttgatcaggatgcgatgcgcttgttacgtgaagtcaagacggaagaagcgacaaaagctgcggaagagcggttaaaaggaacaataagcaatcaagacgttgattaaggagtggcgtgtctttagccaataaaaagagtgaaggttgataaggcagccatttctttgcgatcgatactttgcgagtaggtaaagaattttacctttacacgccaagacggacatgctaaacttattgattgtgatacgtcacatatcaacggcattccgctggtcgggatgattatgaatgtcggcaaaggagaaagaccaatgaacccattgattcaagaaattactaagaaacagttacgcgacgacattcctgattttcgcgcaggtgacaatgtccgtgttcacgccaagatcgttgaaggcgaacgcgaacgtattcagttgttcgaaggcgttgttatcaagcgtcacggtgttggcatttcagctacttacaccgtccgtaagatctctaacggtgtcggcgtcgaacgaaccttcccgttacactcaccacgggtcgaaaagatcgaagtaacccgtcacggccaagttcgtcgggcaaaactctactacctacgcgcactccgcggcaaagcagcacgtatccgcgaaaagcgtcgttaatatggaaaaggccggaaacggtctttttttttgggaagcgcgaaccagcccgtttagaaaccggagcataagcggccttggtcgcaatggcccgcttttggccattgcgaccaaggcccttatgtgcaggtttctgggctggtgagcgcgttatgggagtatcacaggatccccccccggttcagctggaatgtagggcgcggccattggggttctaggtccttacatgcaagctcccgcgctggtgaaacacaaataaactcgcctgaacaccttttcaaactcccatcattcaagccacccagctacagactcgaggtgaaggcttatggatgatcaatggatatacgttgtctactatgcggatcagtcagcgccgattgagttgttaaaagccttctcatcccagcggcgtgccgcagaatatgttgcgatgttgcaaaatgcgccttatcctaatcatgaggccgcacattatcactacaccgcggttcaactgaactaagcaggatgcaccaaaactgatgatcgaacgttttaccggtcggaaatacgcagatagtgtcgaggccaaagtccggcaattaattcagtgctaatttctaatagtaccggttgccgtttagacgtttataggaggtagcacgatggcagaacaaccaaaagaacgattggatcgaattaatgaactcgccaaaaaagatcggagcgtgggtttgacgcctgaagaaaaaatcgagcggcaaaaattgcgtgaagcttatttaaaagattttcgcgcgggcttacgtgatcaaatcgagcatacccaggtctttgataaaaaaggccatgagatcacgagcaaaaaggttcaaaaaattcaacgcgaacacggttggcgcgaagattagtcttttcaacatcgaagcgctttagtacaatgagaaatgaaacttgaaggaggccgcacattgttagtcacaatacttgtggggatcattgcgttactggtcggcttagcaggcggattcttcggcgcacgggcatatatgaagaagtattttcaagataatccgcctgtgaacgaagagatgctgcgtaccatgatgatgcaaatgggacaaaaaccatctgctaagaaactcaaccagatgatggcgcaaatgaaacaagcccaacgtaatgctaagtaattactaagaaaacgcgatgacagaattcttttttgtcgtcgcgttttcgcgtcctagcgatgtttgtgctatcatgagaagatgttcattattaccgaagcttatgagaaattgtaagccatttatttcataaacagctgatccggttcgttaaacccggatcaaaacgttgatttaaggagcaagtgttgtgggaattttcaaaaaattagggtggtattttaagcaggaatggcggcgatatttgctaggtgtgacttttctgctgttagttgcattggttaatttgattccgccaaaagtgattggtgatttagttgatgcgatgagcaaatcgcgattaactagcagtcacttagcacttatgttgggtttattgctcttttccgggatttcgcagtatctgtttcgctacggttggcgtaacgctatttggggcggagcggccaagctggagcggacgttgcgtacccggctgttttggcattttatgaaaatggatgccaccttctatcaaaaacaccgtactggcgatttaatggcgcatgcgactaacgatttaaatgcggtccaaaatgtcgcgggcgccggcattttgactttatttgattcgtttattactggcggtaccacgattattgccatgattttggtagtggactggcgcttgacgttgattgccattttgccgatgccattgttggcggtgatggctcgtaaactgggaacgcggttgcatgctgcgttttcggagtcgcaggctgctttttcgcggttaaatgataaaacccaagaaagtgtcagtggcatcaaggtcattaagacatttgggcaagaggctgaggacacggctgatttcaatcgcattgtcgatcatacggttcagattaatcggcgggttaactttattgatgcgttatttgatccgacgaccagtttgatcatgggactgacttacgtgattacgattatttatggcggttggcaagtggtgcacagccaaatttcgatcgggcagttggtttcgtttgtgacgtacgtttccgctctggtgtggccgatgtttgcaattggccgactatttaatattcttgaacgtggtaatgccagctatgatcgcgtggacgacttgcttaaagaacgttccacgattttggaagccaaagatgccattacgacaccggcgcatggtgatattcggtatcagattaacaaattcagctaccctaatgatcagcaagtggccttgagccgcgtgcattttaccttattagaaggcaatacgctgggcattgtgggtaaagtcggtgccggtaaaagcacgatttttaagcttttgttgcgggaattcgataactatgacggcttcatcgagtttggcggtcacaacatcaaagattactcgctggatgcattgctggattcaattgggtacgtaccgcaggataattttcttttttcaaccacggtcgcggacaacatccgcttttcggcgtttgaaaaggggcagccggaagtggaaaaggcggccaaggaaagtgccgtgcacgatgatattcagaaatttacagccggctatgaaacgctggtcggagaaaaaggggtcagtttatccggcgggcaaaagcagcggttggcaattgcacgggcggtcattaatgcacctgaattgttgattttggatgatgcgctgtcggcggtcgatgccaaaaccgaagaagagatcctcgccaacatgaaacgtgaccgggcgcacaaaaccacgatcattgcagctcaccgcttgagctccgtgatgcatgctgacgaaattattgtgttggaaaatggccaagtgatcgaacgcggcactcatgcacagttattagccaagcatggctggtatgcggaaatgtgggctaagcaggaaatggaagcagcggaagaaggtgaaatgcgtggcaagtaaaggatacgaaagcgcttggtcaaaaagcattccggttcggcaacagctaaaaattatgcggcggttgatgggttatacgcggccgtataagcgtcaatttatcggcgcaattgtcgcagccgcgttactggcagggatgaatgttctgttgccaaagattctgcaggttttcatggatcgttatttggcaaatcaaagtgcaacggttcagattctgctgctgtttgcggtgctttatgcatttggtactctggttaaggccgtatttcagttcttccaaaccttcttgttcaacatgggcgctgaacgtggactggaagatgcgcgccggcaactgtttgctaaattgcacacattggggatgcgttatttcgatcaaacgccggctggctcgatcgtatcacgggttaccaacgataccatgactttttccgacttttggaatgtgattttggccgtcattgtcgggttattctcggtcatcagcagctttgcgattatgtttgcggctaatcctaaaattgccttgttggttgcggcgttcttaccgattctgttagtagtggtctggtattacagcacttatagttccaaggtataccgccacatgcgtgaaaaattgtctgagctgaatacccaactgaatgaatcgattgaaggcattgcgattattcagcaatttcggcaggagaatcgcattagtcgggaatttgaagcaacgaatcaggagtatctcgatgcccgcaaagcgatgatccgcgtaaactcgctgttgctgtcctcggtgattaaccttttatattcactagcgctgattgcggttttgtgggcatttggcctgatttccatgcatagctatgtcgaggccggcttggtgtatgcgttcaccacttacactgccaatttcttcaatcccatggttaacatgatggataacctgtcgtttctgcaggatggcgttgttgccggcagtcgcattttccggattcttgatagcaaggaatacgcgcccgcacaacatccggatgcacatgccgtcattcagcaaggcaaaatcgaatttcgccatgtcagttttgcctatgatggtgaacatgacatcttgcacgatattagctttgtggccaatcctggcgaaacggtggcgttagtcggtcataccggttccgggaaaagctcgattatcaatgtgatgatgcgtttttacgagtttggtcaaggacagattttgattgacgatgtagatattcgcgattatccgatgccggagttgcgcaaaaagctcggcttagtcttgcaggattcgtttatgttttacggcgatatcagcagcaacattcgcctatttaatgatcagattaccgatcatcaagtcaaagcagcggcggaatttgtacaggctgatcgcttcatcaataaattgcccgacacttatcacgcgcgggttattgaaggcggaagtgaattctcgagtggtgagcgccaactgatttcatttgcccgcacagtggtcaccgatcctaaaattctggtgcttgatgaagcaacggcaaacattgataccgaaaccgaatccgtgatccaggaagggctgcggcggattcgtcaaggtcgtaccaccatcgccattgcccaccgattgtccacgattcaggatgccaatttgattttggtcttagatgccggtcgcattgtcgagcgcggcacacatgaatcgctacttgcacagcatgggcggtattacgaaatgtatcacctgcaagttggcgagggtgaggaagcatcgcggtaatggcagcttagatataaaagaacatccgctactttttggcttttgcaaaaagtagcggatgttctatttttttatcttcgtgtcaagttgcgtacggtttgcctcgtcttggctggctttaagtaaggccagctgctgccgcgtttcgctaagctgattgaccatttcgcctaacacttcgacggttaggcgctggctttcgaacagattaggattatcgtcagcaatgatatgatccaattttgaatgcaacagacgaatttcttcttcggacttaagattcacatggtaatcgtttttggcttccaggcgatcatactctgctgcccgattttggctcatcatgattaacggtgcttgtaaggccgcgaccatactcaaaaataagtttaacagaataaacgggaacggatcaaaccgtttaccgaaaatcccgactgtattgagaatcatccagacaatcataaaactggaaaagataatgatgaatggccatgaaccggcatatttggcaaccgcatcggcaatccgttcgccaaatgtgatcgtggactccatattgtcgtaaacatcagtcagctgaaaatcatctttaaccaaagcttgcgacattttacgattaatcttttcatgcgcccgttcatcctgtcgttgttgccggcgcatgcgctcaaggcggtaatttaataggtgcgcattgcaaatgaagctgtttttggtcgcgcgcggatagtcgtttttaatgatattgaccagtttggtttcaagatcgcttaagaaaaggccatcactgatcgcgtaaacttgaccatcaacaaggcaggttgccgtttgattattgaccactgttcattatcctttctttaacgtttaccggattttggcttcagacacgtgaccgtgacgaatgccgtagctgaaatagatgactaatccaaacgcaaaccaagccagactcatcagccacgtctcggcgcttagttgggtcatcagcaacaggcaaaagagaaatgagacaattggcgtcaccggatagccgggaacctgaaagccctgattgttaatggcttcgtggcgacgaagggggatgatgccgattgaaacaaacgcaaaggcaattaacgttccaatattaactaagttgacaagctgatttagcggcaccaaaccacccatcaaagcaatcaccgtaaccactgtccacagcgcattttccggtaaatgcccactgacatggccgaaccagcgtggcaacaagccgtcacgcccgatcgcataaatcaggcgggatgagctataaatcatggtgaccatcatagtgaacatgccagccagcgcgcctaccgaaatgaacccgccgagaccgcgtagatgaacaacgccgagcgcaaaggcaactggatcggctacgtccagtttggtaaacggcaccatgcctgtcaagacaatggcgaccaaaacatacaaaattgtcgcgatgattaaggtgccgatgatgccacggggtaacgttttctgcggctgtttaacctcaggtgccgaggccgataccgcatcaaagccgagataagcaaagaaaaccaaggccgctccggcaagaaccccttttgccccgaacggcatataagggtgccaattggcgggctgcacataaaagaacccaacgacaacgaaaattaggatgataagcaatttgaccagtaccattaaccggttaatcgccattgatgactgcatgccgcgcgagagcatcatgccaatcagcaaaacaacgatcaccgcaatgagattaatgtacgtaccgtgactaggtgaaaatggaccagcaatagcagtcggcagcgtgatgtgaaatccggaaagcaaactggcaaaataagctgagaaactagtcgagacagcagctactgccaacatatattcaagaatcaatgcccagccgataatccagccgaatacctgaccaaacacaatattgccatatgcataagccgaacctgcaacaggcagcgccgaagcaaattcggcataacacatggcagccagtgagcatacgatggcggccaaaataaaggcaatcgtgattgccgggccactggtggttgcggccacggtgccgggtaaaataaaaataccggtactaataacggcgccaatgccaagtgcaatcaaatcgcgggttgtcaggctgcgggtcaacaagtcatcggctttaagagcagcttgcaaatccggtttgcgggtcatttgtttccaaagcttcattaacttactcgctttcttttatttggtaacaaaggaaaaaggctcgacaagcgaaccttatacttctccgtgttctttttcttctagatactttttcttatcaggaacgtatttgtaatggggattaatcgcatgatccaaagcagcaaaattttcctgtagctcgtcgctgaaagcagcaagcgcttcatcagtcagccttccttttggcggatcaacaggtttgccgaaccgaacgataatcggtttgcgtttaaacagagaccaaaacgtcccgggaccttgataaactgctggaacaatcggtgcctttgccagtttggcgattaaaattgcgccgcctttcatatctgccgaataacgcgaaccggttggaaagatcatcaacgctttgccttcctgtttcagtgcgcgaaccggaaccttgatcgcactcggcccgggatgcgcccgatcaaccggaaaggccccgactttcaccaacagccagcggagcaatggatttttaaacagttcacttttagccataaatgaaaaatggtgcggccaagcggctagtgcgaggaaaaccggatcgagccaggaacgatgtggcgcgaccagaacaaacggcccatccggcaattcctgtttctcctgggtttgagagtgtccgtttatgagccagattaacccggcaacgacgtaacgcagaaaactataaaacatggcttattcttccttcgtggttaaacttttgatgtagattataccattaatcggttagcattggcttcctcccgttttataatggagcgcgaaccaccagactgaaaagctgtagctagtggcggtttttgtgtgctatgatttcatctgttatcgcgattcacggaaggctgtttgccgaattttagctttttaggaaaaaggtgttggagatgtcattattgcctggtgagcgggttgatgtgcttgctagtcggcacattaaaattattcaaagcggggccgttttttctttttcattggatgcggtgctgttggcaaattttgcccagattaaacggcacagtcgggtggttgacttggctgccggcaatggtgcggtagggcttttcttggcgcgtaaaacggataaccgcgtgaccatggttgagttgcagccgcggctggccgacatggcgcgtcgcagtgtggcattgaatgcattggctaatgttgacgtccacgaaggtgatttggcggacactaccaagtttgtggccaaggattcagtggatgtagtgacctgtaatccgccatatttcaagatcagtgctcggagtataacgaatcctaatgatcatctggccatcgcgcgccatgagttgacgacagattttgcaacggtggcgagagtaagcgctgatttgttgaaatatcaagggaaagcctactttgtgcatcgtccggatcggctggctgagctattggcaacgctgaccgcggtcgggttggcacctaaacagctgcaattcattcatccgcgtgaagaccgggaagccaatatggtcttgattgctgcgattaaagccggtcgtccggatggtttgcggattatgccaccgctgattgttcatgaagctgatggcggttatacgccgtttgtcaggaggctgttacatggcgactaaaccgtattacttttatgttttactatgtgcggatgggacgttttatggcgggtttacggatgacgtggcagcccgggtggcaacacataacgctggcaaaggggccaagtatacagcttctcgccgccccgtgcgcttactgtatcatgaagcgtttgcggacaaacacgaagcgctgtcggcggaatggcattttaaacatcagagccgccgtcgtaaagaactttttttgtcggcgcatcatgtcaagtggcagggcttgtcaaagtgatgaaaagtcggtatactttatcgagtgcggtatgcacaaaccacattgactgactgatcgtgagtggggtgcttctgttgaagtccatctgcgaggcgacgtcgtcaagaggaataaaaccaaatggaggaacaaacacatggcagtattaagcatgaaacagcttcttgaagctggtgtacatttcgggcatcaaacccgtcgttggaaccctaagatgaagccatatatctttacggaaagaaacggtatctacatcatcgatctgcaaaagaccgttaagatgattgacgatgcttacaatttcgttaaagaagaagcacaaaacggcggggttttcctgttcgttgggaccaagaaacaggctcaggatgcgattgccgaagaagcaacccgtgccggccaattttacgtcaaccatcgctggcttggcggcactttgaccaactggaacacgattcagactcgaatcaagcggcttaaagacatcaagaagatggcaaccgatggcacttttgatgtccttcctaagaaagaagtttctcttctgaagaagcaacaagacaagcttgagaagttccttggcgggattgaagatatgccacggattcctgacgtattgttcattgttgacccacgcaaagaaaagattgccgttcaggaagcccaaaagctgaacattccgatcgttgcgatggttgataccaacaccgatcctgatgacattgacgtgattatcccttcaaacgatgacgcgattcgtgccgttcgtttgattacttccaagatggcagatgcgattattgaaggtaaccaaggcgaagatcaagaagatgatcaggaacaacaacctgctgccgacaagaaggctgattccatggaagatatcgtggaagctgtcgaaggcgacaacaagcgcgctaactaattaattaaacattaagctgtctgagggtttcgcatactgcaagatctgcaggcagcttttttacaatcaaggaggatcagatccatggctcaaattactgctgcacaagttaaagaattacgtgatcgtacccaagtcggcatgatggatgctaagaaggcattggttgcagctgatggcgatatggataaggcaattgatgtcttacgtgaaaaaggcttggcaaaagcggctaagaagagtggcaacatcgccgctgaaggcttagcggaaatcgcagttgacggcaatactgccgcaattgttgaagttaactctgagaccgattttgttgcttcaaacgatcaattcaaagactatgttaacaaggtagctgctgcgattgctgctaataagccagctgatcttgatgctgccaaggccaccaagatgagcgacggccagaccattgatgaaggtgccatcgccttgaccagtgttattggtgaaaagatcagcttgcgacgcttccagattgtgaccaagaccgacaatgaacattttggtgcttacttgcataatggcggccaaattgcagcgctgacggttttggatggcgccgatgatgccactgccaaagacgttgctatgcatgttgctgcgatcaatcctgaatatttggatcgtagtaaagtgccggctgatgaattgcaacatcagaccgatattttcactgaagaaaccaaaaacgaaggcaagccggaaaaaattgttccgcggatcgttgaaggtcgcgttaacaagtggttgagtgaaatctcactggttgatcaggaattcgttaaggatccggatcagacagttgccaagtacgttgcggctaaaggcggcaaggttaaaggctacgttcgttatgaagtcggcgaaggcattgaaaagaaacaagaaaacttcgcagatgaagtcatggaccagatcaaaggttaatgacaagaaaagggcactgtctctgtggcagcgtcttttttttgctgagcgcgagccggcgtggttagaagtcggagtgtaagcggcctcaggcgtgatggctgggctttggccattgcaactgagggtccttacacgcagacttctgcgtcgggggagcgcgttatgtgaggacgaatagccagctcagaatattagaatttacctatagagtaaaactgagaaaaagttgacagtgacagtctatgaatgtttttgatgttcagccgaattgccggtaaaacttagcggctagcaacagcttcttgccgcagaaactctgcgactatggtaaaatagtgccagcaaccaacggaggtataagatacatggtcaaatataaacggatcattttaaagatcagcggtgaggcattggcaggtgaggctgggtttggcattaagccaccagtcattgccaaaattgcccaacagatcaaagaggtgcacgaactgggtgtacaaattgccattgtgtgcggtggcggcaacatctggcgcggtgaaaccaacgccgagatgggaatggaacgcgcccaagccgactatatggggatgctggctacggtaatgaatgcgttggctttgcaagataacctggagagccaaggtgtaccgactcgggttcagacgtcaattgagatgcggcaaatcgccgaaccttatattcggcgtaaagccattcgccatctggagaaagggcgcgtcgttattttcgctggcggcaccggtaacccatacttcagcactgacacgactgcagcgttacgggcagcagaaatcggcgctgaagttatcctgatggcaaagaataacgttgacggcgtttattcagccgatccaaacaaggacaccaatgctgtcaaatatgagagtctgacacacatggacatcatcaacaaggatctaaaagtcatggactcgactgccagcaccttgtcaatggacaacgatatcgacttagttgtctttaacttaaacgagcccggcaatatcaaacgggttgtggaaggtcaaaaaatcggcaccacaatcgaagggagaagctaatggcaaatcaaattattgaacaagcaaaagtcaatatgggtaaaaccgaagaatcattacagcgtgaactaggcaacatccgtgcaggccgtgctaatgccagcttgcttaatcagattacggtcgattattatggtgcgccaacgccattgaaccaaatggcggcaatcacggttccggaagcacgtgttttgcagattagtccatatgacaaatcatcacttaagaacatcgaaacggctatcaacgccagtgatcttggcattaaccctgccaatgacggcgatgtgattcgtttggtcattcctcagctgacgggtgaacggcgtaaggaaattgccaaagaagtcggcaagttctctgaaaacgccaaaatcgcaattcgtaatatccgccgtgaaggacttgataagttaaagcgacaggaaaaagacggtgacatcaccgaagacgaattgcatcgacttgaaaaagatatgcaaaaagccactgacgatgcaaccaaacgcatcgatgaaattgctgcagctaaggaaaaggaaattaccgaagtttagcgtggtattttagttggtgaatgaaaacctcagagtatatctggggtttttctggtttaataaactttttggcaccatgcagtcatgcgatcaaatgaaactagtggtaaaagtcgtcctgttagatggttgcattagttttgcaacttcacttctaactgcgcttggcctcggttttaaaacgcgcgaataggcgcagaaacctgcgtgtaaggaccttaaagcaaaatgaccaaagcccggtcatttcacttttaggccgcttacactctggtttctaaccgcgcctattcgcgctctgcctttttttctgctacaatcgttaaagacatttggtgcatgaggcaccgtagacgttgtgaggaggcgccagtttggccatagccaagggttcgaaagtgaaacttgatccggcacggattcccgcgcatattgcgattatcatggacggtaacggtcggtgggcaaagcggcggttgttgccgcgggttgccggacacaaacaaggcatgcaaaatgttaaaacgattaccaaggcagcaagtcgtctcggggttaaagttttgactttgtatgctttttcaactgaaaattggaagcgccccggttctgaggtgaattacctcatgcgcttaccggttgacttttttaacgattttatgcctgatttaatcaaagaaaatgttaaagttgaagttatgggtgagttaaccgacttacctgagccgacacgcaaggcgagtgaaaaagctatggcggatacggccaacaacaccggcatgattcttaactttgcgctgaattatggtggtcgtgacgaactggttcacgctgcccgaaaactggcaagcgcggtgcgtgatggtcaattagatcctgaagatattgatgatcagcgcttttctgatgcactgatgacggggttccttggtgatttagccgatccggatttattgattcgtacaagtggtgagttacggatttccaactttttgctctggcagatcgcttatagtgagctggtgtttgtcgatgattattggccggatttctcgcctgctgcattggaggcggcgatcgcaacctatcaggctagagaccggcgttttggcggtttaaaaaaataatcaactaaataaatggtgatggaggatttgttatcatgaaacaacgggtcataacggctgtcgttgctttggcaatttttattccaattctaattgccggtggcggttggatcgatacagccggagcagtcttagcgctaattgcgttatcagaagtgtatatcatgcggaagcgcatcattctttcgccagattttctgattgcatcgcttggtatcttggcggtggttttgccgaatagctttttccgttggctgcctgcctttttagggcggattgatctgatttacattgcggttgctttgttgctttgtataaccgtgacaaccaagaatcgcacgacgtttgatgatattggtgtatcggtgttgtcattcttttatatcggtacagggtttcattatttgatcagtgtgcgcaacgatgcggggctggatacgttgatgtttgcgctgctgattgtctggttgacggataccggtgcctatatgatcggtcgcaaacttggccgccataaattgtggccggcgatcagcccgaacaaaaccatcgaaggcagtgtcggtggggttgtacttgccttagtaacggctgcgatttacttaatgttcttcccgcaatattatactttttggccaatgatggggatcgccttgtgcctgtcggttatcggccaaatcggtgacctaatcgaatccgctttgaagcgattttacggggttaaggattccggtaaaattctgccagggcacggcggtattttagatcggtttgacagtttactactggtattgccaatgctgcatttgtttggcattgtctgaccattaaggagcacatatgaccacaatcattgcctttattgttatcttctgcattcttgtggtggttcacgagtttggccatttttattttgccaagcgcagcggaatattagtacgtgagttttcgattggcatggggcctaagctatgggcgtcacataagaataatacgacctataccttgcgcttgttgccactgggcggatatgtacgtatggctggctggcaagatgaggaagatgaaatcaagcccgggaccatgctgagtattatcctgaatgatgccggtaaagtgacgcggattaatgccagtgataaaacgacgctggcaggtggcatgccggtacaagtaagccgcgtagacctcgttaaagacttggtgattgaaggctaccctaatggcgacgaagagaaactggagcgttggtcggttgaccatgatgccacgattattgaagaagatggcaccgaagttcaaattgcgccagaagatgtccaatttcaaaatgccccggtttggcggcgtctaattgttaactttgccggtccgatgaataattttattcttgccattttgacctttattatttacggtttgatgtttggcgtgcaggtcttaaataccaatcaaatcggaacggtactgcccggttatcctgctgctcaagccgggcttaagtccaatgccacaattcaggcgattgatggtgaaaaaatccattcttttactgatctttccagcaaagtcagcaaacaggccggtaagtcggtgacgtttacagttaaagagcatggcaaaacgcaaaatgtggtcatcaagcctaacaaggatggcaagatcggcgtggaagcactcatcgaaaaatcaccggcacgggcgtttacgtatggtttcacccaaacctgggatttagctgtgcgcacttgggatgtcctcaaatccatggtaactggcggcttttcgcttaataagctagccgggccggtcggaatttatactatgaccagtcaaagtgctaaaggcggattgcagggattgctattctttatgggatacttaagtctcggcttgggaatcagcaatttgttgccaatcccggttctggatggtggtaaaattttactgaatctcattgaactgattcggcgcaaacccttgaagcctgaaacagaaggtgttgtcaccatggttggcctcgggttgatggtgctcctgatgctcgccgtgacgattaatgatattatgcgttacttttaaataatctagctttggaggctgacatgaaacaatcacggatgtttattcctacagaaaaagaagtacccagtccagcagaggcgaagtcacataaaatgatgttgcgctctggctttgtgcgtcaggtgcaagccggtgtttatgcctatttaccactagcagaacgcgtcttgagtcgaatcgaagcgatcattgacgatgaaatgacgaagattgatgcggttaagatgaagatgccggcgttattgccagccgagctctgggaagaatccggacggtatgaaacttacggacccaatttatttaagttgaaaaatcgtcaggatcgtaaaatgatcttgggccctactcatgaagaaacctttacggatctggttcgcaatgaattgaaatcttacaagcggatgccgttagtgttgtatcaaatccaggataaattccgtgatgaagatcggccacgctatggtgttttacgtgggcgtgagttcattatgcaggatgcttattcatttaccagtaatgatcaggatctcaataccatttatcggcaaatggaacatgcctacaccaatatttttgatcgtctaggcctgcgttatcggacgattatcggtgatggcggcgcgatgggcggaaaagactcgaaagaattttccgctattgcgtcaattggtgaagataccattgtttattccgatagttccgactatgccgctaacttagagatggcgacaagcatggcgctgccgaagcaaggcgttgaagcccaagcggaattaaccccggtggataccaaagatgcaaaaacgatcgctgaagttgctgctttgttgaaaattccggaacaaaagttaattaaagccgttttatttatggcagatggtgctccggtgctggcactggtgcgtggtgattatgaaatcaatgataccaagcttaagaacatcttaggcgctgacttcctcgaaatggcgactcctgaacaggttgaatcggtcatgcacgcagaagtcggtaatatcggcccggtaaacgtcgataaagatgtgcggattattgcggataatagtctgagcggcttgacgaatttggtggcaggtgccaataaagcgcacacacatttactgaacgtgaactttgagcgcgatgtgaatccggaaacttttgccgatattcgttttgttaaggaaggcgaagtgtcaccggatggccagggtgtgcttaagtttacgcgcgggatcgaaattggccatattttcaaactcggtacccgttattctgaaaccatgggcgcagatttccttgatgaaaatggccgtagtcagccgattatcatgggatcatatggtattggcgtatcgcgactgctttcggcaattgctgaacagcaggcagacgatcacggcttgatttggccgaccacgatcgctccttttgacattcatctgattccggttaatctgaagcgtgaggaacaaaagacgctgactgctgcgattggcacgatgcttgaagatgccggctacagtgtgctggtggatgaccgtaacgaacggccgggtgtgaaatttgccgattccgatttaatcgggattccgttgcgcgtgacggttggtaaaaaagcggtcgatgagattgttgagcttaagttacgtaagactggcgaaaccattgaagtcaagaaagaagagttgatcagttcgatcaagatcctcatggcccagttgcataaacaagaacaggcaaaagcataattgataactaaggcgctggggcaaaattgctaatcccatcctctttttggctgcgagtttgtggtctgaagagttggcagcattttgtcccagtttctgccatctaagaggggtgcacgatttggctttatcccaacatgagatgtttgaaaaattaatggatcagctcgatttaccagcagatgtgcgacatgatccatcactggcagatgggtcggttcaggaagtcacgattcatgagcagtcacaacgctatgacttcaccttggcgtttccgacgattttgccatttcagatttttaataccgtcgccacgcaactgccaattgcgttcaagcaaattgcggcgacgcgattgaccattgcggttgctcagccgacgattactgacgaactattggcgcaatattggcaatatgtggtgcaaaattcagaaatcggtactgggatcgttcgtgaactgtgcgaaaaacaggtaccgacgctggtgaataatcgcgcggtgataacagcggaaaatgaacaaattcggcaatacctggttaatcaaggattaggcaaacttgaagaaacctatcagcaagttggcttttccggattacggatgcaggcccaagtagacgaagagcaagcggcgcagtctgtggcggcatttgaagcgcaaaaagcagcgcaaacggcgaagatggcccaagcagctgctgaagtggtgaagcggcaagcggctaagcaaaagcaagagcctacgaatggcccggttcaaatgggtcggcagttgaaaatgagtgatccgccgcagcaaatggtcacgattacccaagaagaacgttcagtgaccgttgaaggctatgtgtttgatgtcgaagtacgggaattacgctcgaaacggcaattactgattttcaaaataaccgattacagctccagttttattgccaagaaattcagcaatggtgctgacgatgaggcgatgtttgcccgcattaaaaaaggccagtggttgcgtgtacgcggcagtgtgcaagaggacaactattcgcgcgaactcacgatcaatgcacaagatattcaaaccgtttcccatcctgatccaaccgatgacgttgaaggcgaaaaacgggttgagctgcatctgcatacaaacatgagccagatggatgcgaccaactcaattaccgatttcgtgaaccgcgctaaagcttggggacacaaggcgatcgctgtaaccgatcatgctgggctgcaagcttatccagaagcccatactgctgctgataaagctggtttaaaaatgctatacggtgtcgaaatcaatttagtcgatgatgggaccccagtcgcttatcgagctgaagagccgcgcgtgttggcagacgcggaatatgttgtttttgacgtggaaacaaccggtctttcagcagtctacgataaggtcatcgagttagctgccgttaaaatgaaagacggtcaggtgattgatcagtttgaagaaatgatcgatcccggttttccgctgtcagaattaaccattaacctcacgcatatcaccgacgacatggttcacggttccaagtctgaagaagaagtgtttcggcttttccagcagttctgtgacggtgcgatcatggtcggacataatgtcacgtttgatgtgggcttcttggataatggttatgagcggaacgggctggctgatattgataatccggtcattgatacgcttgagttatcgcgcatgctccatcccgaacgcaaaaatcacaaactggataccttggctaagcaatacaaagttagcctggaacaccatcaccgcgccaacgcggatgctgaggcgaccggttatttgctatacgccttggaaaaagaagctgctaagatgtacaacatgaccaaactcaaccaattaaatgatcgcgtgggtgccggtgaggcttataaggctgcccgcccgagtcatgcgattgtatttgccaaaacgcaagccggcttgaagaatcttttcaagctggtgtccttgtcaaatgtcaaatacttctatcgggtgccgcgagtaccacgcagtcagttgcagaaattgcgagaaggtttgctcgtcggttcggcttgctcaagcggcgaagttttcaccgctatgatgcaaaagggtgaggctgaagcgcgcgccaaggcagcattttatgattatctcgaaattcaaccgccagccgtttaccagccattactagaagccgatcttattaaaggcgagtcgcatttaaaagatattttgcaaaaaattgtcaaaatcggtgatgatctagagaaaccggttgtcgttaccggtgatgttcattatctggatcaacacgatgcgatttatcgaaagattctcattcacagtcaaggtggggccaatccgcttaatcgtcatagtctgcctgatgttcattttcgctcaacccgggaaatgctggatgattttagctggttaggcgcagaaaaggcgcagaaactggtcgtcaccaactcgaatttaattgccgacttgattgatgatgatatcacaccggttaaagataagctttacacgccggaagtgcccggggtggaagaaaagctcaaacatgatgtgatggcgacggcctatgagctttacggcaatccgttgccagaaatcgtcgcacaacgcttggataaagaacttaaaagtattatcgggaatggattctcagtcatttataacattgcgcaacggctggtattaaagtcgaacaaagacgggtacttggttggttcccgagggtcggttggttcgagtttagctgcgacgatggccgagattaccgaggtgaacccattgccgccacattatcggtgtccgaaatgccagtacagtgaattctttacgcatggcgaagtcggatcgggctttgatcttccggataagacctgcccgaaatgtggaaccgagctgcataaagacggccatgacattccatttgagacgttcttaggcttccacggcgataaggtgccggatattgacttgaacttttccggtgactatcagcctgtggcgcataactatatcaaagtgatgttcggcgaagatcatagtttccgtgccgggacaattggaacggtggccgataaaaccgcttatggttatgtgaaagcttacgagcgcgacaccggtcaacagttgcgcggtgctgaaattgatcgactggcacaaggcgatactggcgttaaacgtaccactggtcagcatccggcggggatcttgattgtcccggcagatatggatatttatgatttcacaccgattcaatacccggcggatgatcaaaatgctgcttggatgaccacccactttgatttccattcaattcacgacaatattttgaaaatggatgtactgggccatgatgacccaacgatgattcgtatgttgcaggacttgtcaggggttgagccgaaatcaattccaactgacgatcccggagtcatggcgcttttttccggaaccgagagtttaggtgtgacgcctgaacaaatcaattccaaaatgggcacgcttggcattcccgaatttgggacccgttttgtccgcggcatgcttgaagaaaccaagccaacgaccttcagcgaattattacagatttccggattgtctcacgggacggatgtgtggttaggcaatgcggaagagttaatcaagcaaggcattgtcaccttgaaggaagtcatcggttgtcgtgataacatcatgatggacttgattcactgggggatggacgattccatggcgtttaatatcatggaacacgttcgtaaaggccggggtatcccggatgactggcaaaaagcgatgcgcgaaaatgaaaatgtgccggattggtatattgattcctgcctgaagattaaatacatgttccctaaagcccatgcgacggcgtatattctgatggcattgcggatcgcctggttcaaggtccattatccgctggtgtattacactgcttacttttccgtgcgggccgaagattttgatttagctgccatgagtcacggcaaagaagccgttaaagccgcaatgaaggagattacggacaagggcatggatgcttccgctaaagaaaagcaattgttaaccgttttggaaattgctaacgaatgcctggaacgtggctttaagatcaaaatgattgatgtcaccaagtcagattcccatgatttcctgattcaggatgatcacaccattctagcgccattccgtgcggttcctggtttgggcgataacgttgccaagcagattgtcgctgcccgtgaagaaaaaccattcttatcaaaagaagacctggctaatcgcggaaaggtttctaaaactttgattgattacatgacgaccaaccatgttttagatgatcttccagatgaaaaccaattatcactttttgatggcttattttaattcggccacagaaatgtttttgcttgatgcttatcgtgcagagatattaaatggccggtaagcctattaccacactgacctgcttgtttgcaagtggtgcctatctatggtattgtaacaatagtaaagtaaggttctggcggtgagtgagcagcgatgctcactctttttattggcgaacgtcatttctggcgtccgtttagcgtgccgtcagaatctatagtcttgaatgaacaataaaggaggcggtggcttgagtacgcaatcggttgttgaaaccgtgaccgctttggttaaaccgattttggacgaccatcatttttacctcacggatgtcgaatttgtgaaggaaggcggcggctggtatctgcgggtgtatattgacaagccaggcggcattacattagatgaatgtgtgctggttagcgaagcgttgtccgagcaattggacgctatcaatccggatcccattccgcaacaatatttccttgaggtctccagtcctggagctgaacggccgttaaaacgcgagaccgattatgaacaggcaatcggcgactacattcatgtctcgttatttaagaagctggatggtaagaaagttttcgaaggtactttgaaagatttgaagcctgaccagctgacattaacggtcaaagataaaagccgcaagttcgatcaggtcattgaccgaaaattgatcgcttctgcacggttggcgatcgagttttagtggaggtaagaaaagcatgtcaaaggaaatgatccaagcacttgatgcccttgagcaagaaaagggggttaagaaagaggttgtgattgaagccttggaagccgcactggtttctgcttataagcgtaattacaaccaggcccaaaatgtcgatgtggaatttgatcctaaacaaggcgacattcatgtttatgcggtcaaagaagtgacggatgaagtttttgattcgcgtctggaagtcagtctcaaagacgccttggcgatcaataaagcttatgaaatcggcgatcaaatcaagtttgaagtgacgcccaaagacttcggccgtattgctgcccagaccgcaaaacaagtcattatgcaacgagtgcgtgaagctgaacgcagtatcgtttatgacgaatactcacagtacgaagatgagattcttcaaggtgtcgttgagcgtcgggacaatcggttcatctacgtcaacttaggcaagatcgaagcggtattaggccgtcaagatcagatgccaaatgaaaagtatgaagctcacgatcgcattaaggtttatgtcaccaaagtcgaaaataccagcaaaggcccgcaagtgtttgtgagtcggacccatcctggtttagtaaagcgcctgtttgaacaggaagttccggaaattttcgatggcacggtggaaattgtcaacattgcgcgtgaagccggtgatcggacgaagatcgcggtgcgggcaaccaacgatgcggttgatgctgtcggtacaacagtgggtccgcgaggtgcacgggtacaggcagtggtcaatgagctttctggcgagaatatggatgtggtacagtgggaagaagatccggctgattacatcgctaatgccttaaatccggcacaagtgatcgcggttcagtttaatgatgaagacaacgatcgttcggcgacagtcattgttcctgattatcaactgtcactggcaattggtaaaaaaggccaaaatgcgcgccttgcagcgaagttgaccggttacaagatcgacatcaagccggaatcagaagtcgaattcgttgacgatgatgaattatccgaagcagaggttgaggcagccgcagccgcagcagcagatgaccaggacaacgccagtcaagcacctagcgatagtgctgaggttgatcaggcaaatgatgaagccgatgaaacccctgtgacgccaagcacccacgaccagccacaggcataaggaggcgagccatgaaaaagcgtaagataccaatgcgcaaggacttgctgagcaacacgatgatgccaaaaaaagaacttgtccgaatcgttaagaacaaggaagatgtggtcgcaatcgatcctaccggtaaagctgcaggacgaggcgcgtatgtagcgcttgatcctgatgcggttaaacgggcaaaaggtaaaaaattgattgacgccgcgtttggcattacgattgatccggccttttatgatgacctttttgcttatgtagatcatcaaaaggcacgtcaagaattattcggcaagtaaccatgcaaaaacaagccgtattgaatttattgggattggcccgccgcgctagtcgtctcaccactggggatcagttggtgttaagtgcgattcgctcaggcgaggcaaaactggtctttgttgccagtgatgcaagtgccaatacccgcaagaagttttccgataaaagcagctactatcaagttcctttggtcacaatgttttccaaaatggacttatcgcaagccatcggcagtgatcgcgcgatgattgccgtaaccgatgcaggcttcgctaagaagatgcaagagctgctcacctaaattgcagggagcgtgaagaaatgggcaaaaaacgcgtttatgaatttgccaaagaaatgcacgttgataataaagacgtgctcgatattgccaagaatttgggtatcgaagtaaaaaaccatatgtcctcgatcgatcaggatcaggaagctaagatcaaaggggtgctgggcaagtctgccgcagctaaggcacctgcaacatcagcagcggcaaaaccagccaaatcaaaggcggcaagtgcaaaagatcatgctcagaaccaatccgaaaagccggtcaagcatgaaaacaagcctgctaagtctaacaaaactgctgatggaaaaatcattttaagtaagtcaacgattttacgtccacggggcactcagaccgcgcataaggctggtaaccacagcaatcagcagactgcaaacgctaatgccggtaaccgtaacaataaccgcggcaataataacaatcgctccgccaataacaatagtaatcgctcaaacgatcgtaatcggcgggatcgtaaccggcgttttgacaatcagcgtgtgactggcccgatgccgcgtgctgggcgtccgaccgctgccaatggcaatccgcgtccggtagccggaaatggtggcaagtttgttaaaccggaatccgagcgccagcaacctaagcgtcaacagacggctaaaccagctgcagcgagtaaacgttcggaatctactgaacagcgcccgcaagcgactcgtgcccaacaacgtccgcaaaccgaacagaaaccagcgcggactgagcagcggccacgaaccgagcagcctgctgcacaaaccaatcaacgctttacaaaaccggctgtggccaacacgacagctaaaccagccagtgccggtagccaagacaaccgtaatagccggcgtggcggcgggaataacaattttggccgtggcaacagctttgggaatcgtaacgggtttaaccgcaacagcaaccggcgcaacaagaagaacaagcgtcgccagcagagccaaccgaaaaaagagatgccacagcgtaaagagcggccattaccggaagttctgaactatgaagtagggatgaacgctcaggagctgggtaagattctgcatcgcgaaccagcagagttaattaagaaactcttcatgttaggcgtcatggttaaccaaaaccagagtctggataaagatacgattgagcttctggcaacggattatggtattgatgctaaagaaaaggttcacgaagatatttccgatctggacaaagtgttcgaggaagaaaataagaatcaggataacttgcagccacggccgccagttgtcaccatcatgggtcacgttgaccatggtaaaaccactttactggacaagttgcggcatacgcacgtgactgaaggtgaagccggcggaattacacagcatatcggggcgtatcaggttaaattgcgcgatcgtttgattacgttcctcgatacccctgggcacgccgcctttaccaacatgcgggcgcgcggtgccgatattactgatatcgttgtactggtagttgctgctgatgacggcgtaatgccacagaccattgaagcgattcaccatgcgcaggcggccaaggctccgatcattgttgctgtcaacaagattgataagccgggtgctaatccggaacacgtgatggaacagttgactgaatatggtctcatccctgaagactggggtggcgacactattttcgttaaaatctcggctaagtttggcaagaatatcgatgaattattggaaatgatcttgctggaagcagatgtgcttgaattgaaggccaacccggatcaacgtgcagtcggtactgttattgaagcacgtttggataagggcaaaggtccggtcgcaacggttctggttcaacaagggacgctgcatacgggggatccgattgttgtcgggaacacctttggccgggttcgggctatgaccaacgatcatggccgccgcgttaaggatgccttaccatccatgccagttgagattactgggttaaatgatgtgccgcaatctgcagataagtttgtcgtctttgcggatgaacggacagcacgggcagccggtgaagagcgggcaaaacgtgctcaggaagaagaacgtaagaacacgacgcacgttacgttagacaacctctttgaaacgatgaaagaaggtcagcttaaagaagttgacgtcatcatcaaggccgatgttcaaggctctgtcgaagcactggcaggcagccttaagaagatcgaagtcaaaggggttcgcgtgaatattattcatcaggcagtaggggcgattaacgaaagtgatgttaccctagctgcagcaagtaacgcgatcattatcggcttcaatgttcgtccgactgcgatggctaaagcgcaagcagaacaagacgatgtcgacattcgtttgcacagtgtcatctataaggcaatcgaagaagttgaagctgcgatgaagggtatgttggaaccgacttatgaagagaaggtcattggaaccgtcaccgtgcgtgaaacgattccggtctcaaaagtcgggacggttgtcggcggctatgtcgattccggttatattacccgtgatgcaggtgttcgcctgattcgtgatggcattgttaagtatgaaggcaagcttggttcattacgccggtttaaggatgatgtcaagcaggttcgtcaagggtttgagcttggtttaaccattgagaactacaatgacattaaagttggtgacgaaatcgaagccttcacgatggaagaagtgccagttaagtagttttagtgcgtttgccggttcatcagtgggctggtttacgctcacattaacgcgttcgctggcgcagaagtctgcgtgtaagaacctcagccgcaatggccaaagagcggtcatcacgtctgaggccgcttacacttcgacttctaagcgcgccagctcacgctcatattaacgcgttcgctggcgcagaagtctgcgtgtaaggacctcagccgcaatggccaaagagcggccatcacgtctgaggccgcttacactccgacttctaagcgcgctagctcacgctcatattaacgcgttcgccagcccagaaacctgcgtgtaaggaccttggtcgcaatggccaaagagcggccatcacgcccaaggccgcttacactccggtttctacccgggctggctcacgctcacattaacgcgttcgctggcgcagaagtctgcgtgtaaggacctcagccgcaatggccaaagcccggccatcacgtctgaggccgcttacactccgacttctaagcgcgccagctcacgctcacaggaggttagtgcagatgaaacatcgtatcggtcgagttgagactcagatccaacgggaagttgacgatattttgctgaaagatgtcaatgatcctcgggttaaaggcgtgacgattaccggagtcaaactgaccggtgatctgcagcatgccaccattttctatagcattctcgatgatgcgcctgataaagtcgaagcagcgcaaactggtttggataaagccagcgggttgattcggcgtgaggttgggcagcgtattcggttgtttaaagtaccggaaattgagtttgctcaggacaaatccgtccaatatggtgcgcggattgatcagttgattaatgaagtacgccgtaagaatctcgaatagtagtgttaaagaatccccgtctcaagtgatgggggttcttttttttgacgaatttaatccgaaaatttaccgcattctttttaagaggctactttttgctagcttcctttcttctcaacacctttagctttcccatttagaacggtataatgataaccattgagaaaggaaggattacgatcgcgtttctaggtgacttatacgggccatttttttccgcgcacaattggcagtcagcattttcgattggcgggctgatgacgattttcagtttaattcttctggaatgtatgttgtcggttgataatgcggtggttctagccgcgcagaccgagcagcttaaagtagaatcggaacgtaagaaagccttaatgtacggaatgggtggcgcgtacttgtttcggttcatcgccattggactcggaacttacttactgcagttttggccgattaaagcagtcggagctttgtatcttgtttggatgagcggcagttatttttatgcagtgcgtcaccctaaaagcaatacggccactcacaagcacaaaacgcatggtttatggggaaccattttgcaaattgaaagtctggacattgtgttttcagttgattcgattttagctgctttagctgtatcgcctaacccggtgattgtcttgatcggaggttgcttgggtattctggcgatgcggatcgttgcacaggtgattaccactttcattgaccgagttccggagctggaaacggcggcttatgtgttggttgggttaattgccatcaaacttggattgagccttcccatgatccatgttgaaactcctgactggctgttttcggttctggtagtggtgatctttatctgggcggggtggcggcatgccgttcacgccaggcatcatcacagtatgtacaccaaaccgaagtcgtgaaactgatggattgcggctaagcgatcgtcacgcacggttgtctcttaattttaaaatttgaaaggagccgggttcatgaacggcattcttccgttatataaaccagtcggcatgaccagcgcggatgctgtctatcatgcgcgcaagattctgcacatcaaaaaaatcgggcattcaggcacgcttgatccaagtgttgatggggtgttgccactggcgattggtgcggcaaccaaagcagtcccacaattgatggccagtggaaaggtctataccggcgaaattacactcggctttgcgacaacaaccgaagatcttgacggcgatgtggtaacgcgcacacctttagctaacccgattacgcaagcagaacttgaccaagcattgaggcaatggacaggcgaaattacccagataccgccaatgttttcggcagtcaaagttaatggcaaacggttgtacgagtatgcccggagaggggaaaccgttgagcgtccaaaacgacaagtgacagttaagcaattcaaacgaaccagtgagccaatattcgatccaaagcagggaacgcagcgatttaaatttgaggctgcggtttcaaaagggacttacattcgcactttagccgttgatgttggccgcacgctgggagtcgctgccgtgatgagtcagttgacgcggattaaaagtggcggcttcaccctcgcgcaggcagtgagtcttgcggatctggaacaacacgcaaaaatcgggacactgtctgctgttattcaaccgattgacatcgcatttgcggcgttaccgcaagtagatttgacgccggagcaatacgaagatgtgacgcatggtcggtttttaacgcttaaattgcaagccccacggattcggttgcattatgccggggttttaaaggcgatttatcgcttggatcacgatcagtatcgacctgatatgatgtttttaacgaatgaaaagaatgagtgataattgaatgaaagtcattgatattcaaccgccactgcaggcatcagcggcaccaccgcagcccattgtcctaacactgggcttctttgacggggtccatcgtggccatcaagcggtgattcaagcgggtaaacgagttgcccttgcaaaaaaactgccacttgctgtgatgacatttgatatgcatccggcgatcgtgtaccgtggcgttgccaaaacggcgattcggtatttatcgacccgggaagaaaaaattgccttaatgcagcaatttggcgtggatctattgtattttgtccactttacaccagcatttgctgctttatcgccgcaagcatttgttgatgattatttggtcgggctaaaagcggctgcggttgtggccggttttgactatacgtatggcaaacgcgctgtggccaatatggcattattgccggaatatgcgcgcggtcgctttgaagtcgtcagtgtccctaagctggctgaggacggcaagaagatcagttcgacccgtattcgcgatgcattagaccgtggcgatattgacaccgccaacgaattattaggttatgtctatctgacaacaggcaaggtagttcatggtgaggcgcgtggccgcttgcttggtttcccgacgattaatttaaccacattgggccaacagcggcttccaggtattggcatctatgctgtgaccgtcaaagttgatgatacttggtacttaggaatggcttcaattggccgcaatgtcacatttggagatgatcgggcggtaacgcttgaaattaacctgcttgattttaaccagatgatctatggtaaaacggttcaagtccgttggtaccactacttacgcggtgaggtcaagtttgccggtgccgatgctttgattgcgcagttaaagacagatgaacaaaccgttcgccaatattttcgggtgaggaaggattaacatggcaggcgcatatatccacataccgttttgcgagcatatttgttactattgcgattttaataaggtgtttattgaaggtcagccggtcgatgattatgtcgccatgttgctcaaagaaatgcgcatggtgatggcagagcatccagaagaaaaaattgaaacggtttatgttggcggtggcaccccaacaacgctgacaccgcaacagcttgccgttttgtgccaaggtattcgcgatattcttcattttgatcacggtgaatttacctttgaagccaatcccaatgacttactgaccaccgacaagttacaggtcttacacgactttggggttaaccggttgtcgattggcgtgcaatcgtttaatgatgacgtcttgaagcgcattggtcggattcaccgagcaaaagatgtttatacagcgatcggcaatgctagaaaagtcgggtttgacaacttatcgattgatttgatttttcgcctgcctgatcaaagccgcgatgactttttgaacagccttcaaaaagctttggcattggacttgccacattactcgacctattcattgatcctggagcgcaagacgattttttataatctcatgcgtcaaggaaagctgcggttgccgacgcaagacgttgaagctgatatgtaccaagatgccatcgacttaatggaagctcacggacggcatcaatatgagattagtaattttgccaaaacagggtatcaatgtcggcacaatctactttattggcaaaatgataaatattttggcttcggggcaggcgcatttggctatctcggtcgtgaccggtatcataattatgggccgatcaaacagtatctggcaccgttgcatgccgaccatttaccggttctggcccatcatttagtaccggtttctgagcaaattgaggaagaaatgtttcttggcttacgcaccatggcaggcgtcaatgaagatcgtttttatcgccgctatcatatgacggtcgatgcggtttacggcgagacggttccggagctggaaagccaagggttaatcgagcgccaaaatggctatatccgactgacgaatcgcggcaaatttttgggaaatgaggttttccaacaattcctacttgatgagccactggtctaatgatgaatcatgcttcggatatgacaaaagatctaaccgcagttggctgttgatggaacattttagcaatcctaccttgactttgctaacggcgcttggtatattatttagtgtattagcactcatgtgaaacgagtgctaaaggtgaggtgagaaaatgttgacgaaacggcaattgctcgtcttaaaagaaatcatccgcctgtttactgaaagtgggcagccggtcggttccaagacgttaatgcaggaactgccggttcatgtcagttccgccacgatccgcaatgatatggcatcgctggaagacgccggtttgatcaccaagacccatagcagttccggtcgagtaccctcgactcaaggctatcgctactatcttgatcatctggtcgagccagtgcgtgtttcccaccgtgaactagccacgatcaagcaagcattcggtcaacgctacaataagatggatgaaattgtggcgcaaagtgcgcagattttatccaatctgaccagttacacggcgatcagcttagggccagaagtgaataacattaaattgaccggatttcgacttgtaccgttgggcaatcaccaagttatggcgattttagtgacgaacaacggcaatgttgaaaatcaggttttcaccgttcctgaaagcatctcatctgacgagctggaaaaggcgattcgcattgtcaatgatcagctggtcggtttgccgcttattcaagttgctcagcggctaaagactgatgttccgtcgatgctgatgcagtatctgaccagtcctgaaggcttcctggatatcttcggtaatgtcttaaagtccgccgcttcagagcgtttctatgtgggtgggcgcttaaatttaatggactatctcggcgactcggatattcacgagttgaaaaagattatgtccttgattgatgctgatcacggtgatcttaccgaactgcttggcggaccggttcgccaaacaccggtcacggttcgtctaggtccggagttaaagccaattgatctggccaatctcagcttgattaccgccagttatgatgtcggtgaccacggcacgggaatgattgccttattagggccaacccagatgccgtattccaagatgatcggactgttggatgttttccgagaggagctggctaaacggttgacggactattacgccaactttgatcaatgatagatgataacaagcatctgttaacgttaaccaattgcgcgaatagatgtggttaaaagggaggataccatggcagaacaaaaagcaaagcaaactgctgcagataccgccaaagacgccaagcacgctgctgacacgcctgagacttcgctaaaagaagaaattctgcaggaaagcattgctgatcttaatgagcaattgaaaaccagcaagcatgatggtgaacaactgaagcaagagcgtgatgcattcgaagacaagtatttgcgcgcggctgcagagattcaaaacatgaatgcgcggtttgaaaaagagcagcaaaaaatgttgaagtacgacggccagaagttagccaaggcgattttgccggtagttgacaatttagagcgtgcgcttgcaaccgaagccaaagatgacagtgcggcctcactcaaaaaaggtgtgcagatggtttacgatcatctggaacgcgccttgaaggaaaatggcatcactgcgattgatggtgctggcgacaagttcgatccgaatacccaacaggcagtacaaaccgtggcggcggatgaccaacatcccgctgacacggtcgcgcaggtactacaaaaagggtattatctcaaggatcgggttctgcgccctgctatggtcgttgtcgctaaataattaatctgaaataaagaaggtataaaaatatgagtaaagttattggtattgacttaggaaccaccaactctgcagttgcggttttggaaggcaatcagccaaaaatcatcaccaacccggaaggcaatcgcaccacgccatctgttgtcgcatttaaagatggtgaaatccaagtcggtgaagtggcaaaacgccaggcaatcactaacccggataccatcgtgtcaattaagcgtcacatgggcgaagctaactataaggttaaggttggcgataaagaatacaccccgcaagaaatttcagcgatgattctacagtacatcaagaaattttctgaagactatctgggcgaaccggttaaagatgcggttatcacagttccggcttactttaacgacagtcagcgtcaggcaaccaaggatgccggtaagatcgctggtttgaatgttcaacggattatcaacgaaccaaccgcgtcagccttggcttatggtctggataaaggtgacaaagacgaaaagattttggtttacgaccttggcggcgggacatttgatgtttccatcctgcagttaggtgatggggtcttcgaagtgctgtcaaccaatggcgatactcatttaggcggggatgattttgataacaagatcatcgactggcttgtttccgaattcaaaaaggataacaacattgacctgtctaaagacaaaatggcaatgcaacgcctgaaggatgcagccgaaaaagccaagaaggatctttccggtgtgacccagacgcaaatcagcttgccatttatttctgccggccccaacggcccattgcacttggaacgcactttaacccgtgcacaatttgacgaaatgaccgccgacttggttgctaagaccaaggtgccagttgaaaatgcgctgaaagatgctaaattgacgaatgcagatattgacaaagtaatcttaaatggtggttcaacacggatccctgctgttcaacaagcagttaaggaatggactggcaaagatccggaccacagcatcaacccagacgaagcggttgcgctaggtgctgccgttcagggtggtgtcatttccggtgacgtgaaggatgttgttttgctggatgttacgccgctatcattagggattgaaaccatgggcggtgtcttcaccaagctgatcgaccgcaacaccaccattccaacctctaagagtcaggtattctcaactgctgcggacaatcaaccagctgtcgatattcacgtacttcaaggtgaacgtccaatggcggcagatgacaagacgcttggtcgctttgaactaaccgacattccgccagcaccacgtggcgttccgcaaatcgaagtcaagtttgacattgataagaacgggatcgttcaggtatcggcaaaggaccttggcactggcaagtcacaaaacatcacgatcaagagttccagcggcttgtctgacgaagaaatcgagcgcatgaagaaggaagctgaagaaaatgctgaagccgacgagaagcgcaaagaagaagtcgatttgaagaacgatgtcgaccaattactcttccagacagataagaccctgaaggatgttgacggcaaggttccggaagaggatgtcaagaaagtcaaggatgcgcaagaagcactgaagaaggcgcaacaggaaaacaatcttgatgacatgaagcaaaagcgggacgacttgaacaagctggttcaggatatgaccgttaagttgtatgaaaatgcccaaaagaatcaacaagcccagggtggcgcaacgagtggcgcagcccaaggtacggctgatgacaagaagtcggatgatgacaccattaatggtgactacaaggatgtttccgacgacgataagaaataaggcatcagttcattagcaaaaagccgaagccgcggcgcggttttggctttttgtttgaattatgctatgctaagttggcattttcagtcacgatctgaatcgaggaggaactatggcggatcagaaagattattatgagacgctcggtgtgagcagggatgccgatgatgatacaattcgtaaagcgtttcgcaagctttcaaaaaaatatcatcccgatcttaatcacgcacccggtgccgagcaaaagtttaaggaagtcaatgaagcctatcaggtcctgtctgatccccaaaagcgtgccgcatatgaccaatatgggtctgctgatggtccgcagggattcggcaatggtggtcaagccggcgggtttagtgacttcggtggcggtcaaggcggtttcggcggctttgacgacattttcagtcaattctttggcggcgctggcggtggtgcacaggcgaatccttctgcaccgcggcaaggagccgatttacagtatcggatggatttgacttttgaagaagcgatttttggaaaagataccaagatttcctatgatcgtgaagctgtttgtcatacttgtcatggtagtggtgccaaaccgggaaccagtccggtaacctgccacaagtgtcatggtagcggttatattcaggtacaacgcaatacggcatttggcgcaatgatgacccgccaagtttgtgatgtctgcggtggaaccggtaaagaaattaaagaaaagtgcccaacctgccatggtactggtcacgaacaggaacggcatacgattgatgtcaaagttccggccggcgttgaagacggtcagcaaatgcgcttgcaacaagctggcgaagcaggcaccaatggcggaccatacggggacttgtacatcgttttccgggtcgcgccaagcaagaagtatcaacgtgatggcgccgagatctacctgacgattccgttaagttttgctcaggcagctttgggtgatgaaatcaaagttgacacggttcacggaccggttgagttaaaaattccagccggcacgcaaagtcaaaccaaattccgactccgcggcaagggtgctccacgtctgcgcggtaacggtaccggtgatgaaattgtgaccgttgagattcaaacgccaaagcacttaaacgaaaagcaaaaagctgctttgatgcaatttgcagcagctagcggtgaagatgtcacgccacacaacgggacgctgtttgaccgtgttaaagaagcgtttaagggcggcaagtaggttagacgcttagtcactaccaattgcacaaaacttgatccaaatatcgaaaaatcggtcttagaagttaaggccgatttttttaatgtggtgagaacttttgacgtatcagggtttaagtgaaccttataacgatgccaacttaaacggctaggcttgcaagtgcatgaggccttaaccgcttgattcgttaaataccagcttctacccgtgtccgatacgctctgctataataagaaccaaacgatcgcttagaaagtaggcactatttatatgaatcatgaagaaatgctggaacggcaaaagcatatccgcaatttttcaattattgcccatattgatcatggcaaatccacgcttgcggatcgcattctggagttgacagacaccattgccaagcgggatatgcaggcgcaagttctggacgatatggcacttgagcgggaacgcgggattacgattaagctcaatgcggtcgaactgcactataaagctaaaaatggcgaaacgtatattttccatttgattgatacgccggggcatgtcgattttagttatgaggttagtcgcagtcttgctgcctgtgaaggggccttgcttgtggtggatgccacgcaaggtgttgaagctcagacgcttgctaatgtgtacttggcgattgatgacgaccttgaaatcattccggtgatcaataaggttgacttgcctagtgcccagcctgatgttgttaaagaagagattgaagagatgatcggcttagacgcttctgacgccattttggccagtggtaaaaccggcttgggagttcctgaaattcttgagcgcatcgtctcagacattccggctccttctggcgatgttaacgcgccgttgcaagcgttgatctttgattcggtctatgatgattatcgcggtgttgtccttgatgttcgggttaaagaaggacaagttaaggtcggcgatacgatccagctgatgagcaatggcaagcagtttcaggttactgaagtcggcgtgatgtcacctaaagcagtgaaacgcgattttctaatggtcggggatgtcggttatatcacggcctcaattaagacgattcaggatacgcgcttgggggacacggtgacgctggcagaccgcccggcagcagccccgctgaaagggtatcgtaaaatcacgccaatggtctattcaggcctgtttccagtagataacgcgaaattcaatgacttgcgcgaggcattggaaaagttgcaactcaacgatgctgcgcttgaatttgagccggaaacgtcccaagcgctcggttttgggttccgttgtggattcttgggcctcttgcatatggatgtggttcaggaacggctggaacgcgattacggcctcgatttgatcatgaccgcaccgagcgtggattatcaggtagcgttaacagatggttcggaaaaaacgatcgacaacccggctgaaatgcccgatgcaagtgaaattaaagagatccgcgaaccttatgtgaaagcatcaatcatggtacctaacgattatgtcggaccggttatggagctgtcacaacgtaaacggggcgaatttgtgacaatggattatttagacaagtatcgcgtgaatgtcatctacgaattgccattgtccgaaattatttacgatttctttgatgatctaaaaagcagtaccaaaggctatgcaagtctcgattatgagatcatcgggtatcggcaaagtgatctggttaaaatggacattttactgaatggtgatccagttgatgcattaagcaccattgttcataaagatttcgcctttgaacgcggcaaagcgattgttgcgcgcctgaaaactaccattccgcggcaacagtttgaaatcccgatccaggctgctatcgggaataaaattatcgcccgtagtacggttaaagcttatcgtaaaaacgtcttggccaagtgttacggtggcgatatcacccggaagcgcaagttactcgagaagcaaaaggccggtaagaagcggatgaaggcggttggttctgtcgaggttccacaagaggcctttatgagcattcttaaaatgaacgacgaagaaagtcgcggtaaatagcgctatcgagaagctttgactagtgaaattttaatcatcagcggcttcttgccaacatgagctttaaatgtaggcagttttacatctaaattgttattttatggtgaatattccacttgctacaaaacaggcactcaagagacaaaatagtcagtctcttgggtgcctgtttctgattgggttgcctggctcaatttttgcgatgctcctgaaccatgtcctttgctttgtgggcgagttggcgctcaggcttaaacagttgatatgcgccataagagaccagcccgccaattgcggtgagaccaaaaacgaggacatagatggtggcatctagtgtcggatgcggaatgtcttcgagttttccggttactttcttttcagctaatgttgttcgttgtttgagccgcatgcttgtcacctcgtttgaacaaccggataaacggtatgaaattcttcgataacgaccatcgaggattcgggatcgaattgaaggccatttgcctgatattcacggcggaagaaggcttcatgggcgcggcgccaacttgctaacgactgggagccttcaccttcacgtttggcaatgacagcatcgactttttcaaatggcgtgacaaagacattatccgtgaaagtcagcgccactggtcgatcatgacgatcaaggataatgttgtagacgccggctatcggtaatgggtcctgctcgatggtataaagctcaaacccacttgaagtcgcagttttcttgcccgctttaaccaggtcagcaagttcatctgccaattcaggactgccaagttgataggcatcctcgtaagtggccgcgggtaaatccaatgccgctttcgccgtcgcaaaaaaatcgtcaagtacttgttggtcagccatggcttccacgtcctttctttatcatcattatcacataattagtacgtgtctgcatggttgtcacactaaaaaaattaacctggcttggttaggtgctttttggaggcaattgatgtcatggacacaaagactgctgctgctagcaaacaagcaagctaaaataaaaaatcgacactgataaacagcgccgattttttagaatttgctttagaaaacctgttcatcgactttgcgcatgacaatctttggaacagtcaagccaagttcatttgctaaggtcttcattgcttcttcacgggttttaattttatccatatcccagatgatgttggcaatgcggccattttcataatcaaaaggttcctcgtagaagtagtcatcgtctttgtcttggtgcagtttagcggaaaccttttttgacaatgcccgcgtataatcgcgatcgatcatttccggaacgtctttttcggttacatagccaacctgttcaatttttttggcggccttatcgacagcctcatcggaaactgtaatcttcttgcccgccttttcattgaattggtcttgagattttgccatggtacttcctccttaagtcgttatcgcgaaaaagagctaatccaccatgaccggtcacagtcaagcggactaagatcacacggtaacgctttgtctaataacggcaatacagcggtaactgcttgcctgtttgaagtcgctgactggagttgggcttgttaacaacttaattatatcacgcttttgatgacctgaacgggttggttagcggaaacggctgccctttttgctaagttgacgaaaacttggcgcaagcggttaattcaaacgggtttgtttggtatactgaatcggttagaaaggaacgaaaacatatgacgcagtatcaatggcaacttgcagaacaaccggatccggcaacgacacaacaattgagccagacattggcagtcccgccgtttctggcgacgttgttgtggcaacgtggcattaaaaataagccagactatgaggcctttgtgcacccggacattagtcggttgcacgatccgtttgccttacacgatatggacaaggcggttgccaggattttggaagcaattgagcaagatcaaaaaattacgatttatggtgactatgacgttgatggcttaaccagcagctcgatcatgttggagacactgcaaagcttgggcgccgagcctgatgtttttattccggatcggtttactgacgggtatggtcccaatgcggaagtttacacctacttgcaaaaaaccggcacgcaattggtcattacagtcgataacggggttgccggtgcagccgtcattgatcctgcccaagcagccggcatggatgttgtggttacggatcaccatgagttgcctgaaacgcttccgcatgccgtagcggtcgtccatccccgccatcccgagggccactatccgtttggcgatctttcgggtgcaggcgttgctttcaaagtggcaacggccttacttggcgagccgccgctagagagcattgatctggcagcattaggcacgattgccgatttggttaagctaaccgatgagaatcggatcattgcccagttagggttgaaaatgatccaaacacaaccgcgcgtcggactcgccgccattttaaaagaagccggcgtggcaccggaaacagtcaatgaaaccacggttggctttgtgattggtccgcggctgaatgctttgggacgaatgggtgatgcgaatcccggggtgacattgttgactacctttgaagaggatgtcgctgccgaattggcgcaacaagtcggcaagttaaatcaggagcggcaagggttggtcagcaaaattgcccaagaggccctcaccatggcccagacgccggaaaatcaagcggccaaaacgctgctgcttgccagtaagggatggcatgaaggggttgttgggatcgttgccagtaaagtggtggaagctaccggtaaaccaactttgattatgaacattgccgataatggcgtcacggctaaaggttctggccgttcgattgaagcgtatcacttgtttaacgcgctagaaccggctaaagacaaaatggttcattttggcgggcatcatatggcagttgggttaacggctaaaaccgctgaactatcagccatccatgcgcaaatggaagcagccgcgtcaaccatgctcaagaccgtgcctaagccagcgcttccgattgctgcgcgcctggaagttggcgacttaacgctagagcattatgaattaattcgccagctagcaccatttggacaaggtaatccggaaccgactttttccgtgcggccccaagtggttcagaatgtgaagccgatcggtaaggaaaatgcccatcttagatttcaaattgatcaaggcgtcaatgtcatcgggtttggttttgggtctgcagcggcaacattagctgaggctcaagctattaaattagccgttcaactggatcagaacacctggcaaggcaataccagcttacaactcatgctgaaggattatgcgttcaagcagcctcaagtcgttgactggcggatgccgacagttgatgggagccaattcaaggcgcaacggaattacgtcttctttgatgcaaaggtcaaacaacaattcgaacatcaattttcgtttggtgggccgaccatgctagctgagcaagtcacaacgtcactggctgatgcggttttggttgacttgcctaaagatcgtggccaattggtgacggttatgcagcacattcaactgccggtgacggtcatgttttatggtgcacccagtcggttagtggcaatgccgacgcgaagtgaatttggtgctgttctgcattttctaaaagcacatcccggcttcgataagcatcatattccggcgattgccaaggccgtccatttgactgtccatcaagtgatcttggcgattcaggtgtttttcgagcttgattttgttacaatagagggtgcttttatttctcccgtcacggcaccggctaaaaagccattgcaaaccgccaaagcttatgttgcgcgcgaggcatttttaacgcttgctcgccaactgcaaaccatgccgcgggttcagcttgaaacgatgttggtgacagagcattcagacagtgaggtaggatcatgaccatcaattttaaagattacatcgccagtgtgaaagattttccggaaccggggattattttccgcgatatttcgcctttgatggctgacggtaaagcttatgcggctgcgacagacgaaattgccgcctatgcccaagacaaaggggtcgaaatgattgtcggcccggaagcccgcggatttattgttggttgtcctgtggcgtataagctgggaatcggctttgcaccggcacgtaaaaaaggcaaattaccgcggccaaccgttaaagccagctatgatcttgaatatggtgaggccacactttacttacacaaggacgccattaaaccgggacaacgggtactggtatgcgatgacttactggcaactggcggcacgattgcagcaacaattcgcctagtcgagcaattaggcggcgtcgtggtcgggacagcctttttgatcgagctcagcgatttgcatgggcgcgacaagatcaaagattatgatatgttcacgttaatgtcttacaccggcgcatgatggtggcattttcgcaagccttgttctagacttttaagtgaaagcgtctgaatggaaatttcgtaaggagggatcgcaatggctaaacatcataagacagataaaaccttggtcgaaaaaatgttggacaaagcgggtattgcctatgtgccttatgaatttccgactgaagaagttggcgatgtggcgcagttgacggttgatcatcttgatgttccggaacaccagatttataaaaccctggtactaacggggaacaagacgggaccggtgattggcgttgtgccgttagatcggcatgttgattataaaaagctgagtaaggtttccggcaatcgcaaagtcggcatggtaccgctgaaagatctcatgaaaacgacagggtatgaacacggcgccaacacacctattggcattcatgagcgtcacaagtatccgatttacatcagtcaagaagccgaaagtcagtcgtcaatcattgtgtcagccggtaaaatcggtcgttccgttggcgttgatcctaaggttttagcaaagtttgttgatgctgagtttgcggatattgccacgcaggactgaagaaaggagtcgcatatgtttgcagcaaatcatagtcgattcgcgacttttggcgttatttcaaacctgccgggcgagatcatcgacagtatttggctcatcattgatcgcaacttacaaggcgtcgttccgctcaataatttgttgcgttttgatcttcagaaccatcaaggcaaactgacgattcatttcagtgaagaaggcgctcaaaccgagatgtccgtggatttaccgtttccatatgatcccagttttccggatacggttatggcctacgatgatggggagagtcagacgatccttttgcctgaagaagggcatcgtgaatcttaactttaattggcgggtgacactcgtcaagaaaaaaagaaagtcagcatcggaccgtggttgttcggtgctgtttttatgcggtagtggtagtcatgatggcacctgcgaggttgtcacagaggtgaaggcagtcaaatgatcggactgttttaaaaggagccgaggtagatggatattagcaaccagttttataccgtgctgaattcggagcaacattctccagtcgtgattagtttgcctcacagcggaacctggctaccggtggcgatgaaaaaagctttgttgccaaatgccgttttagccaacacggattggtttttaccggaattgtatgactttttgcctgctgccggattgacgactttaatcaatcatgttaaccggtatgtcgctgatccaaatcgggcggtgacttatgatccgcagcatgactatcgctcggcaaccgtttatcagcgtaacacgtttgatcatgacctgtatgcacagccactgacgattccccaaatacaggcgcgggttcgctcgtattatcggccttatcgtcaaatgttgacgaccttgctgaaccagaaaaaagctgaatttgggtatgcgtatttagttgatttacacagctttgcccaatacccttattatccgaacgtgaagcccaagacgattgttctcggcaatgatcatgatcggacggctagcaaaagatttcgcttggcgttggcggatcagttcatgacatatggttggacggttgaagacaattttccttttcgtggtggtgacattacccgctactatggtcataagcaaggtgtcaccgcgatccagattgagttgcgctatgaccaatatattgcccaccgatcttttggcgaagaagcgctgacaacgtatcaatcagaggtgttcaagcaggcacagcagaaattgcagtttttgacggcgtttttaggtcgcttgcgctgagccacggcatggtacattcggcattttaaggggattgagtcgcagttattaagcatcaccaaaaggaaatcttctgtgaacgggtcaaaataatagctgccaatttaatgattatgcgatactctacttgcgattgtacttgaaacattttcaaaacgagtgggggaaagcttcatgaacttttttgggaagaaacaaggaagtccttcaggggatgaagtgattgcggatgggacgaatgacattagattcgatgacgctaaaaacgattatctttatctggatttgttgccagaagaaatgcctgatgaacaatgggctaagatcaaagtgatgatgaacttcttcaaaactaaccatcacagtcccgctgttataaccggcgatcttgaacttgatgccacggcgcgattcttgaattaccgcgacaagaagcagctatttttggcaccgacatcctatcataacttttatgatgaactgcatcaccgtggaagtggtaacagttcccacgcgaatctggcaagtcaactacaagcacacttaacggccaaaacagttcctggcagcaagaacacccgctacatggatgccgagaatcaagttgtgttaaaaatcgagcgtgatcggaaaaagcgggttcggcaaatcagctattttaaagatggtcggttaacgcgcgaagatcagtatgatgatcatgagcgcttattcgtatcggactattatgcgcaaatgccaaatctgcaacgcatgaccttgactgaaccgctttttcaaacgacgagcattcagggactgatcctaaatcgaagcggtgtcgccgttgttaacggattaccgttgacgcaacaatattggttaaacaattctgcgggcgagccaatcaaactttttacagatatgaatgagatcctagtttggtggctggttaacaattttgtgcataccgaccgcaaactttacgtcgatgtttcaagtgagatctttcctgccttagtgcaactacctgaaatgcaatctcaccttataccgattgtccatgatggcgcagatgcaaaagcgttgcagacaatgagcaccagcgcgttcttaataagccaacaattttcaagtgttgccaagcagttgcaacaatcgcgagacgttaaggttattgaaagctggtatcaattcatgagttaagcatcattagttaacaaaacagcctgttatcattaaaaaagcagtatcgtgatgcatggcatattggttaacgttttaagaaaaatgatcgatttgataattgtcacaagccttaatcccgtaaattaaggattcgggctttttgtttgtcattagtttaccccttctttggttatcataaagttgaatttatgttcaataaaaattttacagcaagagagtctttaataagtagatggagttaattggttgattataaaggaggaaataaaactgaaactattatattagaacattatagatgctaaaaaagtttaagactggtgaactttaattgtactcgatttattataaactattttagaaaaaatgatataatggttattttaataccttattagtacgaagcccaaagctaatgttaccgttttaaagaccggtataaagggattgtcattatttagaaaataatttaataaaagtgtgggcttgttataacaatcatcatgatatatatttagaatcaattcgaggaccattttaatgcctatcataaaattggtacttcgagttaataatatcacttttaatcataagggggatgacaagggaataacgagcttataacatttgtcggcatagtactgctaatccggcaaaaaagtttttgcgacagttgatgctatcagcacccagcatcaaaaaatgatgagcaaagtatcgttagtttattttttctctttaaatggggtgaacacatgggaaagttcattaagaaaaaaccatcgactaaaacggctaatttcaagatgtataaagctgggaaacactggcttttcaccttcagtaccttaacgtttcttgccggtggtgccggatttgtcttttccgggaatcaggccgttcatgccgattcaaatgacaatcaacgggtaattgatgctgccagtgcacaaacggccgcgtcgattcatactgctccaacagcacctagtacagcttcaagttcagcaactaccgcaacaccggccactgccgccgcgacggttactaatgctacgccggctgaaacgaccataacaacacagccaaaggtagaaaagcaacagcagacacaacaagcggttgcgtccgcggaaataccggttgccaagactgaagcgagcagttctgccacaaactcagttgtttcgtctgcagcgccatcaagtgcggcaccagttgctaaggcagcggttcagtccagcaatgcgactacttcggcagctgccggtattaccgttgcagcaagcagttctactagtagtgccacttcaattgctgtaactcaagctgctgcgcctgcaagctccgaaaccgaaaacaaccacaccaaaaacgtggttgtatcaaaaacacttgctgcgatgccagtggtggatgatgcgggaacgcctagcaccgttgtttttacgaaaacaaatcctcgcggtacagctacagttacggcgcccaatgtttccatttttgctggggatacttccattgataaagttgtcgattcaaactttaccgcatttggtaatggtagtttggcaacctttacacttgcacctaattgggtcattacgggtagtaccgcggcaaataatattgactatacgcatccacttaatccttttgcctctgatggtcttttaggacctttcttgaccttccaaaacagtgccgggacggtcggcgatatgctcgccagtcaagttggcagacccaatgatgcgaatgttccaatctggatcgcaggctcttcgtataaaacaccaggcgtttacgctgtccaatacagtattaatacgaatcagacaaaacccttagttggacctttcaatgggacactattttcgtatttcctggtaacggtaaagtccgcgctcaatcctgattccgatgctgctattgctgccagtgcggctgttactgccagtggcgcattaacaaaggcgaattccgccagcagtatcgccagctcagcaagcggtgctgctaatggcgcaagtgatcaagttgccagtcttgctacggcaaatcctgacaaccaatcacttgcatatctttcaaaaaccgcctctagtgcaacggcagtagcctcaagttatgcagttgctgcaagttcagatgctgcctttgccaaacaggccgttgcgactgtcaatgctgccaacacaactgcgtcttcagcagcggccgccgccaaagctgccagtgctgcaggaaaaaccgatgaagcaacctcacttgccaagcaggctgctgatgctgccgctaccgccagtcaacaagcaccaattgcaaactccgccgctgataaagcgctatctgaagcaaacgctgcctcttcagcagcagaagacgctttaaatgcggcaaaatcagcggcaacgattgctggctcaaccagtagcactgcagctgcaaagagtaatgccagtctagctgcggacacaggaagcaaggcatatgacaaagctaaccttgcatcgacggttgccaatagcgccagtgccattgcaagcactgcaattgagaccgcaacttcggccaaagccgtggttgacaaagctgcaagtgcttatccaacaaacgaatcgcttgcaaagctttctgcaaccgcttcgactgcaacatcgatgaccgctagttacgctgcatctgcttttgctagcaactcacaagcaagtgacttagcaggtaaagtaaaatcggcaaatgatacggtcatttcagcggttgcgcagactaatgctgctctggccgcgaagaatttaccagatgccagttcttacgctacgatcgcctctagtgctgcatcattggcaagtcaactagcagaccaaacgagtactgcagcatccaatgcattagcatcagcacttgcagctagtgaaaatgccaaaattgtcacctcggcagcaagtgaagctgccaaactctccgcaagtttaggcacgactaccggcagcactgcagctgacagtaaaaatgccagcctggcttatacagcagcaacgtcggcttcgactgaagcaaataatgctagtgcaatagccaaaacagccagcacgactgcaagttctgctaatgctgcggcttccggttttgcatcttcattccctgataatgcttctcttgctagtttggcagttaaagtaggacaggcagctagcttaacttcaagctttgctacatctgccagtgcttttgcaagtcaggctagcgatcttgcaacccgagtaagtgatgcaaactcacaagcacaggaagcagcgaataaggtaactagcgctgccaatgccggtgatgccgctggcgttgctttgtactcggggcaagcatcaacagcagcttcgaacgcgacagatttggcaaaccagacaaaatcagctgctagttcagcaatgtcctatgcattgcaggcaaaatctcaggcagccattgcctctgacgcagcaactgttgcttcagggattgctggcaacttgaagtctgccgcagcaggtgatgcgggagtgggtagtaccgtcgcacggtcagcatcggttgtcgcaagcactgcatcgactgttgctaacaatgccagcaccattgcaagtaatgccagtgccgtagcgctttctgctaaaaatttaacttcaagtgctgcaagtagtttcccacaagacagctcgttggcggctttatcgacaacggcttctagcgcacaagctgttgcttcggattacgctgcaaaagccagttcggctgcttttgccgcaagtagttacgcaggccaaacaagttctgccaatgaaggtgccaaacgtgctgcttccttagcaaatgaagcgctaacggcagggcaaaatgatgctgccgcaaggtttggtagccaggcaaaagatgctggaaatttggctagctcactggcagacaatgcaaatacagcggcaagtcttgcccaaagcgaggccttacaagctaagtctgcagctgacgaagcttctaaagccgcactttcagctcaaggtcgggttgcaacgctggcgtcagacacaactaaagatacaagtgcagccagtgacaaggccagcgcggcaagtgtggcggcaaaatctgcttcaactgttgctaataatgcaagcaccgttgcaagtaccgccatcagtgtggctagttcagcaaacaatgtaaccgcttcgttaaccgccacctatcctaaagatccgtcattgaccagcctttctgcagtggcttcaagtgcaaatagcacaaccgctggatttgccaaaagtgcagcagctgatgccgctgccgcaagcagtttggctcaaaaagtagtcgcggcaaacaaagaggcgagcttggcagcttcacaggcgaacagtgccattgccggtggtgatttacaagccgcatcaagctttaaagcacaagctgtgactgctgcgtctagtgcagctgatcttgccagtcaagcaaacggtttggctaatcaggcttcgacagaggcagatcaggctaattcgactgctgcgattgcttcacaagctgcaagtagtgcgattgaattagccgggagccttgccaaagccacatccgatacagccgaaaaagcttctagtgttgccacttcagcctctgttgttgcaagcgctgcatcaatcacggctaattcggctaagtcaattgcagtcgctgcgtcaaataaagcaaagtctgctggtgacgttgcggctagtgttgcaacacgcttcccgaaggatcagtcagttgcctctctagcgacagcagctggcaatgcggttagcttggcttccagttatgcggcaggcgcaattgaagatgcctcattggcaagtagttatgccactgccgcttcacaagcaaatggcgttgcaagtgaaactgcatcccttgcaaatagtgcctatgtgaatggcaatatttcggaagcttcgtcatatgcagcaagtgcttcaaaggccgctacagaggcttcttctgccgctgacaaaggtaaaaatgcggctaccaaagcattgagtgaggcatacgcagccagttctgcggccaatgacgctgcaagcattgcagttgcagctagcaccgcggcttcgagtcttgcttcatccattaccagcggcaatactgcggctagtgataaagcgagtgcagccagtgatgcagcgcggtcggcgtcggtcgtggcaagtacagcctctgttaaagcaaactcggccaatgctatcgccagcactgcaagtagtgtcgcagcatccggctatcaagatgcttcaaacattgcaacacgttatcctggcaatccttcactaaccagtcttgccaccgtggcatcttctgcaaatagtgaaactgctgacttagctaaatcagcaagttcggatgcatctgctgcaagtagttatgcagcgattgccagtgcggcgaacagtaaagctgcttctgcggcttcaagagctaatactgcgcttgatgctggcgacctttccaatgcctcaagtttagcggaccaagcatcgattgcaggcgtgacagcttcttcggcggctgacaaggcaaactcggctgcagatcaagcactaaatgaagcaaacttggcaagtgaaaaagcaaaagttgccgttagtgctgctgccacggcgcgtgatgtcgcttctaaagctgatgccagtgcaactgcttatactgccagctctgcaaccgcgattgcgaacaatgcaagcgcaatcgccagcaatgcaagtagtgtcgctgattctgcttatcaagaagcctcggctaaagcaagtaactatccgtcaaacaactcattagcctcactggctaaaactgcttcagacgctaatagtgttgccgcgagttatgctttgacggctagcgctgatgcatctgcggcaagtagctttgccgatcaagtcagttcagcaaatgccactgccaaaacagccgctgctcaggcaacggcagccagtcaacgtggtgatcatacggctgcccaaaacctgaataatcaagcatctgccgcagctgacattgcttcagaatacgcggacaaggcaaatgatgccgccggtaaagcattaagtgaagcaaacaaagcagactccgcagccagccaagccgtaagcgcaaataatcgggcaaagcagattgcggatacggtttccgcagccaatgatcaagcttcatctaaagctagtcaggccagcgaaagtgctttatctgcttctgtcgtagctcaagaagcttccgccactgcaaataatgccagcgctattgccagtgctgcttctgacacggctaagtctgcaaatgcaattgcttcaagtgctgccagccggttccctggcaatgattctctggccagccttgcaaagactgccaatgatgcaacgattcaagcatcaagctatgccactcaagcctcagctactgccggctctgctgtcagtctggcgaaagtaacaagtagtgccaatcttgctgccagcaaagctgcttcccaagctaacagcgctattgtagctggcaatatgtctcaagcttcgacctttgcaaatcaggcttcaaactttgccaaaattgctagctcagccgccgatgctgcaagtagtacagctgatgacgccatgagcgctgcactacaggctaagggtcaagcagctatcgcctcaagcgctgcagatgattcaaaacgtttggcgggcaacatcgcaacactaggtgatcgacttgtcagtgatgcgaccaaagccgctgatcgggcaaaagcaagcggcgatatcgctgaatcagctgcagtcaaatatccaagtgacacagccattacgagtgcaaataatgtcgctaatcaagcagctgacgaggcttcagacagtgcagacagtgctaagtcggctgcacaaagcggtgacattccggctgcatcaagtgccgctgccgaagctaagagtcatgctagtcaggcaagtattgcggctgacttggcatcaagcttagcggtggttcatgacaaagacgctaagagctatgcagcgaatgccgttaaatcggctagtttagctagttccagtgctgatgttgcaacggcagtgggcagtcaatatcctgatgatccgacaatttctcgtgccagttccgtagcccaacaagctgcaaaagatgcatcacttgcagcagatgcggcagaagatgctgccgctcgcggtgatgacgcaagtgcctcaagtgccgctgatattgccaaatctgccgctgaccaagcggatgctgctgccaaaacagcacttaaaacagcagatagtatcgcggccgcaaagaaagcggcggcaactagttttgctggtgatgctgcacaagcggctagtcaggcaagctcaagtgcagatgttgctacttctgcggcaaccaaatatccggatgagccagaaattcaaactgcaacagatagtgcatctgcagcagcggctaaagcttcaagtgctgcagatacagccagaagtgcagctcgaaccggtgatgatattgcggcttctgttgctgcttctaatgccaaaaccgcagctaccgaagccagcaccgcggctgctaagacaagcgctgctgcaaaagcgaaaagcacggctgcaagcagttatgccaatgaagcaactaaggctgccagtcaagcgggctccagtgctaatgtagctggaaaagcagcaacgaagtacccgaatgactcatcaattggcgcggcaactgaattggctaagtcagcagcagatacggcttcgagtgcagctacagatgctaagcgtgccacccaagccggcgatgatgtgactgcttcacaagctgcagatagcgccaagagtgccgcgatagttgccagtcaggctgcttcacaagcgagtgacgcggctaaagcaaaagcaacggctgcatcaagttttgccgatgatgctgtcaaggccgctggtcaggcgggctccagcgctgatggtgccgtatctgttgctactaagtatcctaatgatccaaacatcaaagccaatacggatgttgctacgtctgcagccgatattgccaagagtgctgcaactgacgctaagagtgctgcacaagccggcgatgatgccaaagcgtcttctgccgctgcaacagctaagagcgcagcaattgttgccagcaccgctgctgccaaaacaagcgatgcagccaaggcaaaaaatgtcgcagcatcaaactatgctactgatgctgctcaatctgcaagtttagcaaactcaagcgctcagttagctgaaagtgctggggcaaactatcctgaagatgctggcattgcagcagcaaccagtctttcaagatctgctgcttcaacagcaacaagcgccgccaatgatgccaagtatgcggcgttagacggtcaagatgacgcggcgaagtctgcagcagaagtagcaaagtcagctgcaaccgttgctagcgatgctgccgcaaaagtgattgcagcagcaaaagctaaaggcgatgccgcatcaagctatgccagtgcagctgatcaatcagctaagcaagccagctccagtgccgatcaagcgggttctgcggcagcgaagtatccggaagatccggcaatcaagagttcagctgacctagcgaagtctgctgctgatgacgcggctaaatccgcggcagcagccaaggacgcagctaagtcaggtgatgattcacgggcatccagtgccgctgccggtgcgaagagttctgctgatttggcaagctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagctaagtcaggtgatgattcacgggcatccagtgccgctgccggtgcgaagagttctgctgatttggcaagctctgctgcagcaaaagcggctggagatgcgaaggctaaggacgatgccaaagctcaagctgacgccaaagctaaaggtgaagcagcctcaagctatgctagtgcagctgatcaatcagccaagcaggccagctccagtgctgatcaagcgggttctgcggcaacgaagtatccagaagatccggcaattaagagtgctaccgacctagcgaagtccgctgctgatgacgcggccaaatccgcggcagcagccaaggatgcagctaagtcaggtgatgattcacgggcatccagtgccgctgccggtgcgaagagttctgctgatttggcaagctctgctgcagcaaaagcagctggtgatgcgaaggctaaggatgatgctaaagcccaagctgacgccaaagctaaaggtgaagccgcctcaagctatgctagtgcagctgatcaatcagccaagcaggccagctccagtgctgatcaagcaggttctgccgcaacgaagtatccggaagatccggcaatcaagagctcggcagatctagcgaagtccgctgctgatgacgcggctaagtctgcggcagcagccaaggatgcagcgaagtcaggtgatgattcacgggcatccagtgccgctgccggtgcgaagagctcagccgatctggcaagttctgctgcagcaaaggcagctggagatgcgaaggctaaagatgatgccaaagcccaagctgacgccaaagctaaaggtgaagcagcctcaagctatgctactgcagctgatcagtcagccaagcaagccagctccagtgctgatcaagcgggttctgccgcaacgaagtatccagaagatcctgcaatcaagagcgcggctgacctagcgaagtccgctgctgatgacgcggccaaatccgcggcagcagccaaggatgtagctaagtcaggtgacgattcacgggcatccagtgccgctgccggtgctaagagctcagccgatctggcaagttctgctgcagcaaaggcagctggagatgcgaaggctaaagatgatgccaaagcccaagctgaagcaaaagctaaaggcgatgccgcatcaagttatgccagtgcagctgaccagtcagccaagcaagccagctccagtgccgatcaagcaagttctgccgcaacgaagtatccagaagatcctgcaatcaagagcgcggcagatctagcgaagtccgctgctgatgacgctgccaagtctgccgcagcagctaaggatgcagcgaagtcgggtgacgactcacgggcgtccagtgccgctgccggtgcgaagagttctgcagatttggcaaagtcagctgctgataaagctaaaactgctgctgcagcgcacacgccaggttctgatactgcgaaaccgactcaaggcgattttgcaagcacggctcatgccgcaacgaccgcagccgacttagctgcttcagttgcagctaaagcggccagtgaaacggcaagttttgctgatggtaaacctaagaattcttcgttagcttacttgaagtccgacgcgattaacgcggcgaacattgctgccagtgcggctaaagacgctgcttcctttgcggcactcagtaaggctgcgcaagagcttgcacacgattatgttgatccgaataaagcagctcaagcactttcctacgctgcacaatatgcttcatcagcgactgcggcggcggataaggccaagagtgctgctacccgggcacaaactgatcgtgatcttgccgaacagattgccagtcacgatgtggataccaagggtgttaaagatgttgacggaacgtctaaaaatccaaaaggccaagacgtaggacgccaagacgtaggacattctgaactaggtgcaaactcaggcagccaggacaacaccgttcatacagttgctactgacaccagcgttggggataaaatcaatcctggtacaactgctgacatcatcgctaaaaacggaagtgggcaaactaaagatggaagtggacacacacttccgcaaactggtgaaaccgaagaagctgccttgcttgcactagcaggtattgtactgatggggacactagcagccatgggcaaaaagaagcatcgcgaagattaattaactgaaaggaagccattaatatgaagactaatcaacatccaacccgtgcagcgccttagggtgttgctaagaaaacttttgccaacttgatcgttaacaaaggggagcgctggaaaatgctccaatcaaaaaattgtcgaacggtttttgatttggaaatattgcgcaaagtaacaagtttgatctttgctacaggagcatcgtcaattcaccaattctagagacaaccggctaaagcgattttctgggtgatacgcgtttggctaatacaactaaagattaatcgagtcattttttggaattcgtgaaggtgacatcaagatgatgcagatgtagatgaaaaaggggtgttttaatttgaaaagcaatcaaggaagtgggcctgataataccaatcggattcagatgaagcgcacacatttccgctcttggaaaaaaggaaaacggtggctctttgcatcatcgcttattgtcacggtcattggtgccggcgccttagaatcgggcaaaactgttaaggctgattcagtcacaccggaaacgattcgagtggcagccgcgattgatcaagtgggaacgcatgaacaaaagccggctgctcaacaagaaccggcacatgctcaagtgagtcaagcgtcggtaagtaagccggtggtggcagctagttcggcggcaacaccagctgtctcacaagcagcacaaccacaatccatcgcgtcagtgcctggcgttcaatcggtcgccaatcgtgaaccgactcagatataccagacagtcactacgtccagtgctgtatcgtcaccatcctcagccaccacgtatgcaccaaccgtctcgcctgctagcgcttcggtcacgacttcaaaagaaacgaaccagaacagcaagcagtcgctacagacgcaagatattcaggttcaggcaaaagaacactttgatccagctgttgctttgcttggtggaactgatagtaaaggtaatgtgctgagccttgatgatattaatcttgttgggacggttaacaccggtatcccgggcacctattatttacgatacgaatacattgacccttacacgcaggaaaagcttggcaagaatgtccgcgttatcgtgaagccaaacacgttagctcagcctctagaaaatcaagttaatcagacctcagcatcgagcctggctgcgaccccgcttgaattgagtgatgccgcatcttcagctccttcactggctttggacgctgctgcgttatccagtgctaaatcggccttgacgtcatttgctaaaactgatcaaggcaggattgcgttaagcgaagcagcaaataaaattacatcgggtgttaatttcctgagtgccgcaacttcacttagcaacgaccccaaagtaaaagcgtttcaggcgcaactttccgaagctgttgccacgtccgatgttgccttgcaaaaatcgctggtttcgtcttttaacgccacagctgaaggtagtgcattggcatcattggcgagttttgaagcttcggttgctagtgatccggcgcttcaatcaatgatgtcatcgctatcgtcaactgcagaggcgaaatctgctgccgatgctagtgcaacttcatcattcatggcaactgcttatggcaaacgactcttggctgatgcatcatctgctgcctttgcaggttcgttggcaagcgcggctgcggtttcatcgtttgcccaaaccgaagatggcaagcaaatgattgctgctttgtcctcgtatgcaacaaattccgaatttgctgcctttaatacggcactatcctctgctgttgccgcttcaaacacaagtcttgctcagtctttggccacatcctttttcgccacttcgcttggatcggcctttgctcaggatatggcacgctttgaagcaacaaattcctataaagccatgcaatcagcaatctcagtggctcaagacagtgtggctaaacagttaaggtcaacgttaatcgcttccgcacaatcagtggttaaagcggacactgggtttagcttaaccggggttttaggtggcattaccaactttatatggaacgcggtttcgtggttagctaccaatattaatccaattcgtttaattcctaatttaaccggacttgggcaagtgggtgaattgattgaatccgtgatcggcggaactgttggtagtgcgttttatggaaccgtcacaacggcggtaggtggctttgcggcatggtttattgctggcgttccggcaacggttctagattcaattgtcgggattatcccgatcgttggttggattgctaacggtggtaacgctgctgaacttggttgggttggtgggattaccggttggctaaccgggattgtcggctcaacagttggtgcttattacggtgcgaccatggcgccaggcctttctaaagatggaaaagttgacgccgttgtcagtggggttgcattagggtcaaccattggcggtcttatcgggcacacgctctcaaactggctgatttcttacaccatcggcatgatcgtcttcggtattgccggcgtcatcgttgttgcggccgggttcctcggactgggacccattgtcaacccgttggaatttatcctccttggttgggtgacgccgttgactgacacgattgccagcttgatcggttcgccaatcggtgctgcaatcggtgggattatcggcggtattgcaggttggttgctccagttagtaggcgtgaaacttaacttacctgacgctgccggtgtcctcaaaggggttgcacaattgccgggtatttccgacttgattgggaccattgctaagatctcttctaaagcagggaaactggtcaccaaaaatcttgtcattcgggctaaacaatcctttgatcctagcgaggcattagtcagtgccacggatggcgatggtaaggcggtcgatatttctgatctttctatcgatggaagcgtgaccgtctcgattccgggaacttatatcctgaagtactacttcaccaatgccgctaataataatgaaatcgttgaacagcaagtatacgtcaccgtgacgaggtaaaaaatatgcatgcaaaaattgaactcaaaaatctgaccctgaggaaaaatgaaagtttccagccagaagcacttcttgttgaggcgactgattcctcaggtcatcaggttccgttagaaaatttccgcatgtcaggtgaagtaaagccttggattccaggcgtttatccaattgtcatcagctttactgatcctgaatccaaccagcaaattgaaaacaaagcattggtcactgttattcaataaggctgatcagttcgtttttctgaagactacaagaggtcaatttttaaagtcgattggcctcttttctacataaaattgtcccaatcgtttttttaaaaacgatcggattcaagacactgaagtctggagggtatggatgatgagtaggcagaaacagttgcagtccgcgttgttgggccgccatggcaaattcaagacagctaaagttcgcggaaaatggatgatggcatcagaggttgttttgtctttttctgttttggtcgcatttagctcactacatcctgtgactgcctccacaacggctaatgaagagcagccagcaacccatacagccacaagttcagttgcatcggatcgtgcttctcccgacatcacctcagtagcttccggcagcaaagattcatcaccaccggctaatagcttcgaagctaacggcgcccagcaaaaaacggttcagcccttggaaaccatgaagacggcgactgcgaataacccagaggcggaagccaaggaaccggtgtcaggtgatcaaaatgaaaagcacgatttaactgcggctgacccaaatacgaatcagtcgcccagtatcgcaacagcacccgttaccatcgcccaaaaatcttcttggacaccggaagaaaattttctgaatgccaatgactcgaacggacaggcagtaccaatcgatgctattcaagtcatcggaaccgttcatccagcgatcgtaggtacctatttcgttcagtatgcttttactgatgccccaaccggcaaagatgtggcgcaattttcttctgtcaccgtgaccaatcaagctagtgcaattgatgaacggcagataggcggggacgtcttgccgccaacaccttcagaaacagtggctgcaatcaagacaaaagacactttgttagctaaaaaatcatcatggacaccggacatcaattttgtgagtgctactaatagcgatggtgcgtcggttcagctcgaagatatttcgataacaggtacggttaatccggcttatgagggaacttatttcatccgctttagttttatggatccaaaactgaaacagctgattgcaaacatggcgagggtaacggttgtcagtagtctgacctcgaaaccgaatccggatgcttcggggatgttaaaggtgaaaaatctatcctcttttttcccgtcaacatccaattatccaagcgctaaaaatgtgtatctgctggatgatccgaacttcaaaccggatgaggctgagattgtcagctactttcatcaatatgtcaatgaattgcgggctttgaacggacagtcggcgttgacactttcggaacgcgatacaagtcgggcacaacaacgcgtgcgggcgattgttgaagattttaatcatgaagccgttagtcacgcaacggagaacatcggtacgaacactggcattacggatcatatgcggtctaatcaggagatcgcatattacatggtgatggcctggtatgacgagaccgataacccggagccgcttggtaacggacattatgggcatcgggcgaatttaatttatggcgggccgtcaatgggcgtgagtttttaccgtccccctgcaggtagcgctgagtttagcgattattatgcctttgaagcgcctatttacaccgacttaggcctttaccttaaagcaaaagcaatggccaactcgttaacgaatcctaccagtataccgctacctaatatttcttttgtgtatgtcaatgcatctttgctagccgaactccgcagctatctgaatgcatcacctttgggacaacttgatgcgactgcgaaaagtaatgcgaaacccagcttatcaatagcatagtcgcagaacgttcctgtaagattaaggtataatgatgcccgcagttctagagattttaacgatgatagtaatcaaatacggtttcttttgataattctcacgaaaaaattgatcgagttaagtatatgcgtgagaggattcttattcgacttatgatctacagaggaggacaacatgggaatttttaatcgaaaagagcaaccggagacgccggatgtgctcaactcattaaatgaacgcctgagcgaaaaccagcaacggcagaaactgggcgggggaaatcaggaacttcagcaggaaaataccggcgatcagcaaaaagacgagcctacaacgggcaaaaccttgtcgccagaacagcttgagcaactcaacagcgcggcctctttagccactgaaattctgaaaccggcaaccggcagcggccgtacttggtccatgaacatctctggcgggactgaattaaattttgccaatgatcaactgactgtttatgtcaaagatgaatcagcttcaacagcgcaactgcaaccagccaccccatctaaagccatcgcaagccagccacaagcagccgctatgccagcccaaccagagccggccgagaaagctgataaagaatcactatcagatcccaaaacggttgtaagtgataatacggatgcagcaacagccagtcaagctgaatcggcaaggcaaacaccagctgcggcaggggcaagtgtatcccagcttcaggcaaaagcaccagccaaagatgacgatgccaatacagcttcacaaatgaatccgccgacagacaacactaacttaacccgcgggccttattacgaagcgcagaaacaaaatagtactttaattacgcaaatagccgtccttcaaaaaatgaacacccgcctggcttctcaaatcgaacaatggcaaacttatcgcacaaaaacgacggcttatttgaaagaactttctgctaaatataaagctgtcctggccgaacatgaaaaagatcagcaggttgtcagcgaattttcgactttgcatcagcagcatgaagaactcaaggctcaaaatgaattgttacagacacaagttgccgatttgtccagtcatctggaagcagcggtgtccgagcgtgataaagcccaagcggcaaaagaagcattgcaaaacgagttaagtaagcaaatcgttgccactcaaattgccgaaacagatcttaagcatgttcaggccgatttagccgcggcaaagcaaacccagcaggagttgcaaacggcattgtctgattctgaagctaaggtggcgcggctatctgaattatctgctagtcagccagttgccgccgatgctgaaacccaaaagaacgtggccgcactagatcaagccggggtgttcccgtcagaagatgcgccggtttttgaaagtgattttccagaggcataaggtacgtatcttggactcaaggtacgaccattaagaaatgggggactattggtgaactattttgtgaatgaaaacattttttcaatgaactcaggaaccgagttttcagcagcgcaacgattacgacttttcaaagatcatgatgtacctgctaaaattttgacgcgcaactataatccgttgttaattgacgatttaaaacgcgttaaattaacccagtcagatgttttgaacatgtatgattattttcaggaagcgacttttgtagaaccgcgtgatattgatattcgctataccgaagtaattgataagtttgattatcatatcgttggggttgatgctaatgaatcccagattgttcatcatggcaaagtcgtaggcaaggcgttggtagcgccagcgacagtcggtttggtgggttcattggagtattacaatgacatgaacgcaaccgtggctaaagatgtttgggatcggcgtggctttaaatcgtcaacgcagtattttcatcctgatggccagctcggaccacagattttttataatccagaaggtgctcctaagcttgagattgtccggatgaatgtgaatgggacgctcatgaataccatgtatcagctgcttgattataaaggccgagcatggcggttcaattcggaaagtgagctctttgttttcttcatgaatgaagtcgtggctgccgagccaagtgtgttaataaatgaccgcccatcgttgattaatgaggtggccgcagtgacgggcgctaatgctaagtggcaatacctgcacagcgttcatactcacaatccggaacaagtcggtggttcaagaaactatgtcgattatctgaagccgctgtttgccacgcacgccaatgattttgacgggattatggtggccactgacgagcaaaagcaagaaattgaaaaattcttccactttaaacatgtcatggtggtgcctgacagttttgcagaagcacatgatttagtgccgattgaaagtcgtgatcgcaataaaattgtctatctcggccgcatctcaccggaaaaagagccacaagaagccattaaaatatttgccaaagcacgtaaaaagcttccggatttgcatctggatttttatggttacgtctctgacgaagcaacaaatgaaagcatggttgcgtatagtaaggaacttggtgtcgataccgcgatccattatcatggttatcaatcagaagacgaactcgctaaagcgcttggaaccgccgccgcgatgttgagtgtctcatcatctgaggcgtttggcatgaatattcttcaggcattgagctatggcgtaccggtcatcggatacaacgtaaaatatgggcctaaactgttggttgaaaatggtgtcaatggttacctggtaccaacaggtgaaagtaaagctgctgccgacagtctggtgaaattgttgacgagcacggaagcaggacacacgtggccggaaatggttcaagcagcttatcgacaatcacaaacatttagtgccgatgctgcctggaaacaatgggaagcgcaacttagcaccgtcccaaatctttttcttcgcttagataggagtgccgaacgatgatattttttattaattccagttttaatcaaagcaactcgggaattgaacatgcccagttgaaacgggctgggttatttcgtgatcacggtgaaccgtttaaaatgatttttcgtgagtggaacccacgactgcacgattatttacaggcaaacggtgtcagcgatgacgaaactttagggatgtttgactatttccaagctgctgaagaagtgccaaccaagattttgcatgccgaggatattgactttggcttggatcagcttagttaccaaaaagaaccggaacaatttcgctatcttgtgctgcgtggtcaacaatttgtggcaagaattaattattatcgtgatgatccaactgaacgggtcagttcggttgagcaattcgatgctttcggcaatctgtaccgggttgatttttacgattttcgcggtttcttgtccttgtcgcaatggtatacacctgataataaagtcggcacggaggtctggtataaggttgacgggcggccggtgcttgaaacctttaacaagtatgatgccaaacagacttttactaaaaccggctggcggctgaccgaagacaatggagcggtgtatctcttttcgaatatcgacgagttgacagttcatttttataatcgtttgaatgagcaatattggaacaataaacgcgccaatatctttattgttgatcgatcgcatcttggtgactggcaactgctgcacttgaggcgtccggcttatactgtcttgcatttacacaattcacatgcaggtgacgcgcaagatccgatgcactcggtcatgaataatttttatgagtatggcttgattcacgctaatgattatgatgcgattatttccgccacagaaaagcaaacacgagacgttcgtgcacgcttccaacctaagagtaaactcttcacaattccggtcggtgtcattccggatgaacagtttgcacgtccaaaaattgccatggcggatcggcagcaaggtaaagtaattgtcacggcccgggttgcaccggaaaagcgaattgatcatattatcgaagcgattggcattgctaaaaaagaggtgcctaatatctcattagatgtttatgggtacgtcgatcaccgcgacaatgatgaggcaatgaccaagatcaatgccgccattgaaaagtatcagctgcaagacgtgattaaactgcatgattatgtaaaggatgttggcgcggtgcaacgcgaaggacaagtgtatgcgctggcgtcggtgatggaaggctttaacttgtcgttgatggaagcgatcagcaatgggctcgttggcgtcacttatgatgtgaactatggccctaatgagctaattgttgatggtgaaaatggctttgttgtgccatttgatgatatcaaggccatggcggctaagtttgtcgacttattcaagcatcctgataagctgcagcagatgtcagatcgctcttatgaactgtcagatcgttattctgaagcaaacgtttggcacgcatgggaagcgttgttagaagatgcaaaaaagaagcccctgccattcactgaagaaatcagtagtggtatcggtgatcagcgggtgaaagataacgcataatttgggtagaaaatcgtgcgttgaagtctggtcgtctcagtttgaccgttagcaataaaaaatagggcctctggaggtgtgtctccggaggccttttgagctttaaacatcagttggaaacttcagccccactaatgttcgtaaatggaatagggtcgtgttcacgtcacgtgccagttccaaccatgtttgatagcgaaggcgattttggggatcgttcggcgtttctagtatttcggcaaaagcaagtgcctcacccgtcaatcggttttcataggtgatcgtgttaagcaagtgattttgacgatctgcatcgtaatgattgatcagccgcagttcggtaatgttgtcgatgacgatcttttcacgtaaaccataaatttcagaaggcatgaacgagtcggtggtgataccaatatgaatggtgatattaaacgccggataagttaagaaaatggtgccaagcccgtctgcaccagtgttgatggcggtggcgaaatagtttccgttactcgggtgaccaaaaagcgaaaacgcagcatacaaaggatacaagcccagcatttgcagggcacctcctgctgactcgggggtaaacccttgaagccgcttgccagccaaaacatcatcataaccgggaaattcctgcatagcggtaaatgttgctccttggatggcaggcagtttgcgcaccgcagtcaggatgttttgaaaattaggcatgtgtaatggatacgcagcctcaaaaaagtgtacttctgggtgagtgcgaagtaactgctcgacttctttgaattcagtcgggttcgtgagcgccggcggttgaacgatgacatttttcccggctaggattgcttgtttaatttggggaaaatggcgcatgttaggcgagcttgaactgatgaagacagttgtgaaatttggacttttgaaaaacgcattaagatcggaaaaaaagacggtttccggatgcttttcccggattgctgccatttctcgcgctgtttctgtgaacgctgcagttaattgccacttttctgaaatgtctgcggcgtcaatgaattccaatgcattctcattacccccgatgatgccgtatttcagcatgctaatctcctccgcgtgttgaattatttctttcattataactagggagtttttgataataaagaaaagagcatcgtttgctgtgataattgcattataagcgaggaaacattgatgtaagtccattttctaatagaaattttggttaatcttgttactcaggaaaacgattgttgattgtaatgattttaaagacatagttcgcagtattatttaggtatatcaactgaaagatttcatagtgttgccaaattagagggctgctccgaagcttgaagaagaaaagctgtttcaaaaaaagccaggtatcttgtatgtcgtgatgggtaaaaaaagaccgaagcagcttgttttttccagataacactgttatgatcgaggcgatcattgagataacactgttattttgaaagaagatgagagaatggccgacagaaaaatcgatacagaccagcgaattatggacaaagctatcagcatgattaacgaacatggggaagaatcactttcattaagaaaattagcacaaggaatcggattaaccacaggtgcattttatacgcacttctctactaaagaagaattacttcaagcggtgacggttcttttatcacgtcaggaacaatcacggatggcaaagaagctgcaaacagttcgtaaacccgaagaacaactgcttactgttgcttcgattttacttcgacaatttaaagatgaacccaatttgatgcattttctatttttcaatccgattgcgcgcaatgtcctgaaagttgatagaggagagtttgcattttacgatcaaatgatgcaaatggtggaagcagtgattcaaaaacgtcacctgagcgtacaacctaaagatttatttattcagttgtgggcatttattcaaggttatggtctgttacttgatagtgatgtaacagaatacgatgcggtattggtgcgcgaaacacttctgcgcttattggaggcataaaaatgtcaaaatttgcaattgtttactgtcatccatatgacaaaagtttcaaccacgcgattttgctggcagtttgtcaaaacttatcgaatcgcgctattggttatacgattctagatttataccatgacggatttcagccaacttatgatcaagaagaactaagcttatttcattctgggcagacacacgatcctctcgttaaaaagtatttgaataccttaaaggaagtcgatggccttatcattgtgacgccagtttggtggaacgatatacccgcgatgctaaaaggctttatcgataaagttatgaaggaaggtccggggttaagtcatgtggttactaagcgtggtgttaagggattgctcaccaatctgaagcatgtttatgtactaacaacgtcaacctcgccaactttttacttgcgccttttttgtggcaatgctttgcaaggggtttttataaaacatactttgagacaactcggaatcaggcgtgctcattggcagaactttggtaatatcacgcattcatcgctaaaacagcgccagaaatacttggaatacgtgactgaggagacgattaaatattgagttttacaaaagacggcttagcattatcaatttgacaagttcacttaaagcactttttgaaaccacaacatcgatacttaaaataattgcttcccaaagtttgttgattttgttatacttgaacttgtgttttggagagttggcagagtggtaatgcaacggactcgaaatccgtcgaaccggctaataccggcgcgcaggttcaaatcctgtactctccttataagataagttcatttttatgcgttacgctgggcttaagtctggcgtaacgctttttaatttcttacttgataaaattacttgttaagaaaatcagagttactaacctttgtataaacaggcgctgtctgtcgtgcaatgatttccgcaaacttgtataatacaggtactgctaaagcaagggatgatcgacacttgaaagtttccattaaaaaagtaccagcactttatgatttactttatggtgcgtttgcacttgtcatgttgattgcggctgtcattacgacattgccaaaggggttttcattcaccggcgtgggagcgacattgatgtcttgggcgaaccatctgtggtggctgacaattccaggtattatttttcatcttttgtcgtatttttccagtcataatcagcgattgttgctagtcggcaatcttgtcggaatctgtgcgtttattgcttttattttaattccgaactacagtgtctttgcgctaatcggtttgcttgttgccatggtgttcgtgctggcaggggcgaatcgcgctcaacgcatgcgtaaagattcggaggtgtcatgatgccttggttgaagcataaaaaggatgacgaacccgaagttggcattggtgaccatgacttcagccagtttgtcaaaaatgctcgtcgtgatccgcaacgatttaaggcggtgcaatccgtttttgatcgacttaagcggagtccgcgcaaagataacaagcgttcaattaaacgttaagctaaagtcttgctgagaagcaggactttttttgagcgcgagccagcccggtttctgggctggcgagcgcgttatggagatgctgccagctttccggcaattgctgacatgaaggccattgtcaccttttgaatgccatctaaatgaaactgatgttattgtgtttttatcttacacacatgacatttttgtcacgaattaagaaaaatataaagacatcacaaattattgagcggttttaattgattcggcataatatgtttaacgaaaaggagtgatgattcgatgaaaaaagtggttggtatagttggcgtactcgtacttattgttattggctttttcggctatcaatattggaatagtacgtacaatggtgttgatgcttatgcggtggtaattgaaggtaaaaaagtggcctcgaaaaatgaagatggctcactttacaaggtcaatgggaagcaatactacacatatgaatacgaattaaaatgggtgacgaagaatggtcagactcggaacttaggctattcatctgaagaatcagctaatcccaaggcgttaacacctggcagttacgtgaaagccaaggtggcacaaaaacgggtactgaccacacctcaaccggtttcggagcaggcacttccgcaaacagttaaggcaaaattaaaatagatcctttgcgtcataaaagaggcggtcaaactgcactttacattgtgcaattttgaccacctctctttttatgcttcagtcggtaatttaagtgcgccgtcttcagcaagcttgcttaaaatgcgataaagcagctcttcggaaaattcgcgtgattctgccagcaaataactgtaagtatcggcaacaccgggatcaggtacccttgccagccacttttgcagtcgttcattgactttatcatcggtgtaaagttcagaaaccagtgcgtcggtttgttggctgatgagtgctcgcaatgccaagttttctgccatgttcagcttcctttctaattgattactattatacctagccacaatttttaggcaaagccttttcgcctctttgcattcggcggcacctaggctaatataataagcatgatattaccttggttagaaacccagtcgacgctagattctgcgcgccaactgttgggcatgaaattaagtttaggcgcttgtagcggtttgattgttgaaaccgaagcttatcttggtgcgcgcgatcaggctgcccacgcatttaaccatcgccataccacgcgtaaccatagcctttttctggcggctggtaccgtttatgtttatcgaatgcgacaatactgcttgttgaacattgtgactcagccggttgatgtcccagagtgtattttaattcgggcactggaaccgatcagtgggctggcgaccatgcagactcgccgcaagcaaataggcatcggcttaaccaacggaccgggcaaattatgccaagcactagcgattgataaacagcttgacggcactgtgttgaatcagagcgggctgagcttggcaccaactgatcatcgcccccgtaacattgccgttggaccgcgaatcggtattcctaacaaggagccgtggacaagcgccccattgcggttttacgttgcaggtaatccgtttgtttcaaaaataccgcggcgtgatcaggatttagaaatgagaggatggcaatcatgagccaaatgaatatgttagatgcaattggtgacaaaatggaccaattagattttgacggcgatcttagcctgaactgggataaggacgcgcatgtgattgaactcgaaatcacaatgacggctgaaagtgaagccggcgttgaagtggaagaccaaacgggaacaaccgttgatgatggcctggttacctatcaagatgccattcttttttatgacgaaacgcggatgcacggcgccgactatgcagatgattatctggctatttttggatttaacggcaaaaaagggattgacgtggcgactgttaatgctttgttcatttatttacaggatctgcttgatgacgggcaaagcgacttgatggatttcgtggatggcacttccgatgacgatacatttgccttgaatttcgatgaagcgcggtatgaagcgatcttggctgaacagcccgatgccgataatcggatctttttgccgtatcctaagtattagtcatttttacgaacgcaaaaagatattgataggttaaaaaacgaagctagctttttattttaattgtattaggagaccatatgaataacgattggactgcattgacagtgacgacttccactgaagcggttgaagctgtgagcaacattttgatggaggctggcgcggtaggcattcagattaaggatgcggccgacttcaaaaaagagacgattgatgcacatggtacttggtttgatccggcgaccgttccgcatttggcaactggtgcacaggtcatcggctattttgaaccggctacgtcactaattgaaaagcgggatcatcttgcgtcacaagttaaagcactggcgcaattcggattggatccgggtgcggcaacagtaacactggctgacgtgcgccaacaggattgggcggacgtttggaaaaagtattatcatccgttgcgtgtttcgcgcttcttaacgattgtgcctaaatgggagcactatacaccgcagcagcctgatgagttggtgttgacactggatccgggaatggcgtttggaaccggcactcacccgactacgcaattaatgttgtcactactggaatcattggtacgcggcggcgaaacaatgattgatgtcggaaccggttcaggcatcttggctattgcggctgaacggttgggtgtcagccagatcctagcaaccgatgtcgatgagattgccgtcaaaaatgcccaagctaacattgccttaaatcccgttagtcacattaccgtgaaggctaacgatttactgcaaggactaacggtttcggctgacttgattgtcgctaacattttggctgaggtcttagtaccattgattccgcaagtaccgtcacggctaaacccgcatggccattttttactggcagggattattgccgagaaggccgacttgattcggcaaacgttgcaggataatggctttaccattgcgcaacggcgggatgcaggcgggtgggtagcatttgatgcggtattgaaagcttaacgataacttgtttgccagcatagaaaaggggagcgtgcgtgcagcgattttttaccgaacatcttttacatagccaacaaaccttcacattggaaccggcgattgctaaacatgcgattaaagtgttgcgttatgatgtcggcgctgtttttgaattggctgatcctaagcaccgggtttatcaggctacggttcagacaacagatccgctgacggttgagattggcccggagattaccaaaaatgtggagttacccatcgcggttgaggttgtttgcggcgtcagcaaaggcgataaaactgagtggattgtccaaaaggcgacggaattaggcgcggccaaaatcggctttttcaatgctcaatggggaactgctcggtggccggctgagcggattgctaaaaaaatggatcggcttgcaacgatcgcccaaaatgcggctgagcaaagtcatcgtaatttagtcccggaagtcacgatgtatgctaagctgagtgatgtaggggacgatgcagccgttaagttagtggcttatgaagaaagtgccaagaaaggcgaacatgcagctttggtttcggctttagtgccgcatcctgcttcattatgtgttgtttttggaccagaaggcggcatatcgccagctgaattagccttattgcaagcacgcgggtttacgccagccggtcttggcccgcggatcttacgtaccgaaacggcgccgctatatttgcttagtgccgtttcggttctcactgagcttgcttaaactaaaactgaattgattataaaggagactagcgctgatgagtcgtgtcatgaattgggttaaagtacctcgcaataaggttgtttgttggagtgtgcttataactttgatcgtcccatgggtatttccattgttccatattagtaccgccgtccgggtaggggttctgttcattttaattaacatgctgagtgctttgtggataggccgaacaattcgacggcatcatttaagctggtggtggctgttcgtcttgccagtgctgtttactttaatggtctttttacgttacaaatggtatgcctacttctttgcaccgatttatcttctgctcggcgtcttggcgatggcaaaggactagcattttgtcagagaatcgttataatttaagggtagtctaagaaaagttgtaccaagctgtgtatcagtcttcttgcgctgagactcagccattatgcgcgaactgacgcgattaatgaagcgtaacgaagcggcgataagcgtgttgtcccgattaagtcggaacagaacgtttatcgcccttctcataatatcagcgcaatatgccgctatgagcggaaaattcaatacgacgcgatcactggcgaagaagtcgattggaaggacttctacccgcgctggctcgcgctcaatcataacgcgcttaccggcgcagaagtctgcgtgtaaggaccttggtcgcaatggctaagagcgggccatcacgcccaaggccgcttacactccgacttctacccgcggcgccggttcgcgctcaatcataacgcgttcgccagcccagaaacctgcatgtaaggaccttggtcgcaatggccaaagcccggccatcacgcccaaggccacttacactccggtttctaaccgggctggctcacgctcaggaggggaataccatggccgaagaagttgaacttacccagccggatgtcatgaagttgtgtaaagcttacatgaaccctgaacacttggcattcgttgaaaaggcctataagtttgccgcttatgttcataaagatcaagttcgcaagtccggcgagccttatattattcatcccattcaggtagcggggattcttgccgaattaaaaatggatcctgaaacagtggcttccggctacctgcatgacgttgtggaagatacaaatatcacgctgggcgatattgaagaagtgtttggccatgatgttgcggtcattgttgatggggtgacgaagcttagcaaagtgacttatgttgcccacaaggatgagttggctgaaaaccatcgaaaaatgttgctggcgatggcaaaagacttacgtgtcatcatggtgaaactggcagaccgcttgcacaatatgcgcacacttcaacatttacgcccggataaacagcggcggattgccaatgaaaccctggagatttatgcgccactagccgaccgcttagggattagcaccatcaaatgggaacttgaagacctatcgctgcgttatcttaacccgcaacagtactatcgaattgcacacttaatgaacagtaagcgcaccgaacgtgaagcttatatccaagaagcaatcgaagaaatcaaaaaggccttagcggatttgcatattaaatatgaaatctatggccgcccaaagcacatctattccatttataaaaaaatgcgcgacaagcataaacagtttgatgagctgtatgatttgttggcaatccgggtcatcaccgaaacgattaaggattgctatgcggttttaggtgcaattcatactaagtggaagccaatgccgggccggtttaaggattacattgcgatgcctaaagccaacttgtatcaaagtattcatacgaccgttatcggaccgatgggcaagcccctagaagtccagattcgcaccgaagaaatgcatcacgtggctgaatacggggttgcagcacactgggcttacaaagaaggccagaccagtaaagtccagtacgataaagccggcaaaaaattggatatcttccgcgaaattctcgagctacaggatgaaagtagcgatgccgccgacttcatggaaagtgttaaaggcgatattttcaccgatcgcgtttacgtctttaccccaaaaggtgatgtctacgagcttccaaaaggcagtaatccgcttgattttggctatttaattcatacggaagtcggcaatcatactgttggcgccaaagtgaatggcaaaattgtgccgcttaattacgtgttaaaaaatggcgacatcgtggaaatgctgacggctagcggtagtgcgcctagccgcgattggatcaaactggtgtacacctcgcgcgcccgtaacaagatcaaacgttattttaagcaagccgataaaagcgaaaacgctgaaaaaggccgtgatatgcttgaacatgagctacaagaggaaggctatgtaccaaaagattttatgaccaaggaaaacatgaccggacttatgcagcgtctgaactttcaaaccgaagacgaattaatgagttcgattggttacggggaatatacgcccaaagtcattgctaaccggctaaccgaaaagttccgtcatgcaaaggctgaaaaggatcgtaaggccaaagaggctgccattttatctaagaaccagaaagtcacaaccgtttccagtgagaaacatcagccacaaacccattccgaagatggtgtggtgattgaaggtgttgacaatctgctggttcatttggctaagtgctgcatgcctgtgcctggggatgcaattgtcggctatgtgacgaaaggccgtggggtcacagttcatcgcgcggattgcccaaacgttcaaagttcacgggaaatgtcgggtcgtttgattgacgtccgctgggaaaatgaagcggtacaaaagcagctctttaatactgaccttgaaatttacggttacaatcgcagtgggctgttaaatgacgttttacaggttcttaatgcccaaactaaggctttaaacaacatcaatggccgggttgaccacgataaaatggctgatatccatgtcaaagtcggcgtccgcaaccttgcccatttggataaattaatggatgctgttaaaaatgttccggatatttatgaagtgaagcgagcaaatgggtgatgaccgttttatttagacagcactggtgatcagaaaggcatagatctcaatgatcacgatcgggtgctgtctttttatgccaacaacattcacaaacaagatttgataaataaaggagaaaagtatatgcgcgcagtggtacaacgcagccttgcagctaaagttacgattgccggtcagacagtcggtgccattgatcatggatttgtggttttacttggtgtcgggcctgaagacacatcagcagatagtgactatctcgccgaaaaaatcagtaaattgcgggttttcagtgatgatgccggcaaaatgaacttggcgctagcagatgtcggcgggcaagtcctatcaatatcgcaattcacactgtatgcagatacacgtcacggtaatcgccccagctttacgggtgcggccaagccggctttaggggaacaactttatgacacctttaatgccaagcttcgtgatttaggcgtgacggtcgcaactggcgaatttggtggcgatatgcaggtgagtcttaccaatgatggtccggtgacgattttatttgatacggaggcgaagtgatgttagttaacgcaatttgggattttgacggcactttgtatgattcttatcccgggatgatgaaggcgttagcggcgttggtaacggctaatggcggtcagattaaaccaaagacgctctatcgccaggtgaaagaaacatcaatcaaacaatttttaaccggctttgggcaacaggtaggccgatccgttgttgatttagaggcggattatcatcagcgggcgcgggcgtatcttcaggatattcatccatatcctgaagcgctggccgtattgaaagccatcaaagcccaaggtggacacaatctgcttttaacgcatcgtgatcgtagtgcctgggaaattttggctcacgatcaagctgacaccttatttcttggcggggtggatgccgatttgaagttaccgcgtaagccagcacctgatgcgattcaatatttacttcgacgcttccaactcaatcccgcggtaacggcgatgataggtgatcgctcgcttgatgtggatgccggtatcaacgctgatgttaaaacgatctactttaatgtggacggcctcaatgcagcaccacaggcagattatcaagtcgatcatttaattgaaattccgccgttgttccgcaagtaaaaaattcaaataaagagccgctcaatcagcaatttttcatgcctgattgagcggctatttatattcgatttgcgctattgccgcggcaaactttccgccgattattgatgatgaccggctttaaagtaagcatttaaaccgttaacaatatcggtcgcaattttagattgatacgttgggtttttaatatacttaaagtctttgtcgttattgatataacccatttcattcaggatggccggctgtttattatcgcgtagaacttcatagttaccaaatgcaaccccacgattttctagtggtaagtcatcaaaagcgttgttaactgccttagccaaggcgagatcctttttgctgctgtagtaataggtggtgaacccggaggcagagtttttggacgggctggagtcaaaatggaaggagataaatgcatcggcatgggcgttgttagcagttgtcggacgtggcgcgaggtcgacaaaggtgtcagtcgttcgcgtcatgataacgttagcaccagcagcccgcaaagcattggcaacgagttcggccgttttcaaggtataggttttttcgtaatcatgattattgttagctggcgcacccgtgtctgtaccaccatgtccgggatccagaacaatcgtggcttcggatagtttcgttgccgctttttgggtttgaccattattcggggcggtgacggtccagctggcaacataacccgatttgccatcaggggcagtgacttgataccaatcgtcttgttgtttggtaacggtcagttcagtgcctttatcgagtttctcgacggatggggcattgatacccgccgcattgcgcaggttagtcatggtattggtggtgactttcaatgcggccccgcttttggcttgcgtcagattggcttgggcaggttgtgccagattagttgtctgaccagtgagctggacactgctgctagtgatccatgccgccgtattgttataggcaatctgggtccaatcgccttcttgatacacaactttgacactatcgccggcattaagcgttcctaactgcttggcatcctggctggcatattcgcgaacgttaaccggttgattcaccgtggcaactttcgcactcgtggttgcggcttcgctttgatcgactaaccatgaagcaacccaaccgattttattgccggcaaggcgcacttgataccaggaatttttggaaccgataatggtcaattcattgccggattttacctgacccatgatgccatatgccaagccgggacctagccgtacattgacgctctcggctttgactgtcatgtattgggtgttggccatcacactggttgttgcggcaccaacgccaaacaatagcgccaataagatcaccagcggccatttcttaagttgtccgatatgtttcatgacaaagccccaccattctgaaaaatcgttatgtttattatagcaaacccgctggcaaaagggtggggaagaaaagcgacctgatgcttaattcgtagttttcaaagcggcggtaatgcgctgacggatcgcatcatgctggctgggctcatattggtactgaggatcacgccaataactcgggtcatacaaccatactggcttggccaaacgttccggcacctccgactggtagcgcgggaagacatgggcatgtaaaaaatgatccgtattgcccagaatgtcgtaattgacgcgtaatggttcacacgccgtcaaaatggcatcgcctaaagttgccatgctttgcaaaaatagactttgttctcttttagacagctcatttaaactgccgacttcgcgttttggcagtaatacgctgtagcccggtagaaactggacatcgccaaaaactgcaaagccaccgggaagttcggccatgaccattgaattttggccatccaaggctgcttgaatgcgatcatcttgccacaaaacgctcactcctcatcaaatactcatgttcttacccataaagtcagcgtacacctgctgatttttgaaaacaatgacaattgtgctctttcaccactaacagcagaaaatcagactttggtaggagcctggattagaacctttgaatgatgataggattattgttagattataatattagagacaggaggttggttcaatgagattatacatagaaaacatccataagcatttcgggaaaaagccagttttaaatggcatgacggcaacgcttgagtcaggtggtgttatcggactcatgggcccaaacggagcgggaaaatcaacgttgcttaaagtattgaccactcagctaaaacccgatgcaggttccatccaacttgatcatgttgatgtggtcacccatcccggaaaattacgccaggtattgggctatttgcctcagcaagtcccttaccaaccaaatgtgaccgcgttggattacctacgttacattgcggctttaaaaggcattaagccccaagacgctgatcagcagataacaaatctgtttgtaactctgcatctggatcctaaaaatccgacacggctgcgggattattccggtggtatgcggcaacgagtgggattgaccgccagtttgctaggtgatccccaaattatcatggttgatgaacccaccgtgggcttagatccggtcgagcggattgcagtacgtaacctgttaagcacattggcccaaaatcgcatcgtcctgatcgcaacccacatcattcaagatgtcgaggccattgcaagtcgcctgctcatcgtcaaagacggccagtttcaatttcagggaacgccggcagattttctccaaaaagcagccggacacgtttgggagtatgttcttccgcgtggtgctgcgttgccgagtagtcctaatatcagcaacatgcaagagcaagctgacggcattcatgtgcggcagatagctaaaacggcgccagtcagcggtgctcaaaatgtcacgccaagtttggaagacgctaccttagccaactttgaagctaaggcggtgaccgatgcatgatgcatatgatcttaaccgactatcggcaacgttcgcgccaattttcttttcggctattggcagtttttgcgttgttttcagcagtgttgcttgcaccccggcaaaccgggagttttcgggttttggttttggatccgcattactttgctcaggcgaataacccgacgtgggcaccggtcggagttgttgcggtcttgacgtttttctttcccttcattggcttggtactggcacggcaaggcatgagtcaggatcgggaaagcggcattttgtcggcttttttaaccggaccgtttaaaaaaatccggtatgtcgccggagagtttctgacaaattgccttttgctgctaacgatcttggttttcgtgatgatgggcacattagctatgatggtcattcaataccctggtcaaggccttcacataagtcaatttatcgcgacttttgccatactcattcccggtgtagggttgatcagtgccttggctgtgatcagtgaaacgattcccggtttacgcggtcggttcggtacaagcattttgattatgctactcttcatcggttatgccatgatgattgaggcaaaatggtatgcacaagtagtcgacttttccggcatcgttttgttacaagcattattcaagcaatcggcacttgaatcgggccaccgtttgacgagcatgatgattttagggggcaatgaccatctgagtcgtgccggcacccatgatttagtctttcagacattgacgctaacctcaacgcaatggttatgtatcggtggttcagtcctattaagtttaatgctggttggtttggctggcttattcttggagcggcggcctttaacacggagaatgacacatcaacattctgcgatgcggattactttgcctgaggcggctgctaatgaagcggattttaatgcggtttcgattcagcacttcagttggccggctttatggcgtcaagcaatgaaacaactgctggcatctcgttcagtcggttggtggttgattcttgctggcttatggggcgccaactggatcgcaccgacttcaagtcttcggagtacgcttttaccaatcacgtatttatgggccttattatttttcagccaattaggatggccggaacagcgaaacggtttagctaactggttgacgaccatcaattttgccaaaaagcgacatttaaacgtgacattgctggtagcggtcggcttttcaattctgttagcgttgccgacctgtatacggcttggggtcacggcctggccgttgttgagttgggcgttgatgttacccgttgtggcgatgttgcttgggtttgttaccaagaccggacagtggacgcaattgatcgtaaccgtgctgttgttctttgtcgtcgcgggtctcagcggtattttaccagtcgcaaccacagcaaccggtattctgaccggtgtcggctatctgatgattggcgctgcaagtttggttgggttagagttagctgtttagtcagtaagttacgaaaagcgttcctgccccgctagaaaaactaaatgcatcacttcgaaaatctaggcgtacgccgttgacaaaactttctgcaaaccgtatgctttaaccaataactaagacctgtgacggagtaggatagatcaattttaagcgacccggagatggtgaaagccgggaccgatcgaaaagacactcctgaggtgatcaagttccggaacgccaccgttatggcaaagtaaaacacaaggtggtaccgtgtccgcacccttcgagcaatcgaggggtgcatttttttagagcgcgaacaggagcgctaagcaatcggagtgtaagtggccttaagcctaaatggctgggctttggccatttaggcttaaggcccttacacggagattgccgcgactgtaagcgcgttttcgcagtagtatcagcggggatgtgtcatacatactcgcctgccgagcccaacaaccaacacaaccacctaccaccaagtttccgagcgctttcaatcaccacccacccatcacagtcttaagactacaggaggcacctcatgaattatcaacgtccaaaaggcacagccgatattttacctggccaaagtgaacgttggcagcaggttgaagctgttgcccgcaaaatttttgcccaataccagtaccgcgaaatccgcaccccgatttttgaaaatgttgatgttttttcgcgcagtgccggcgataccagtgatattgtgaccaaagaaatgtacaccttcgaagacaaaggcgatcgcatgatggcattgcgtccagaaggcactgccggcgtggttcgcgcctatgttgaaaacaaattatacggacctgaatacgcgaagccatacaaggtttactacatgggtccgatgtttcgctatgaacgtccgcaaagtggccgccaacgccaattccaccaaatcggcgtcgaagcttttgggagtgattcgccggttttagatgcagaaacactagcgttagcaaaacagttgctagaagcgttaggcgccaaacaccttaagttcgtgattaattctttgggcgatccggcaacgcgcaaggcttttcatgcggcattggtcgactatctgacgccgtttaaagatgaactttcagaagattccaaagttcggctggttaaaaatccgcttcgtattcttgatagcaaagacaaacatgaccaggaaatagtagcggatgcgccgtcgattcttgattatttgactccggaagcgcaacagcattttgatcgggttaaaagtctgctcacaggtttaggcattgaatttgaagtggatgcgacaatggttcgcggcttggattattacaatcacaccatttttgaagtgatgtcggatgataaggtctttggcggcgggtataccacgatcttggcaggcggacggtataacggcttggttgaggaacttggcgggccggaaacccccgggatcggatttgccatgggggttgagcgcttgatgttactcatgcaaggtgaccagcagccggtacagccggatgcctacatcgtcaccatcgaccaaggtgcggatcaggaagctttacagatgttaaccgcgcttcggcaacaaggctttacaggtgagatggattacatgggccgtaaagccaagggacagttcaaagctgccaacaaagccaacgcgaaattagtgttgacgatcggggaaagcgaacgagaagcgggaaccgtgcaagttaaaaatatggcgaccggccagcagaaggcctttcctcaagccgatgtattggcagactttagtaaaatttatacacaagtaacggaggcaaaataatatgagtaaacgcacctgttatgccggtgacgtcaataccgactatcttgatcaggaagtcacactaaaaggatgggtacaaaagcggcgcagtttaggtagcttgatctttattgacttgcgtgaccgtgaaggcattgttcaactagtcttttccgaagcaattgatcgtgatgcactgacagtagctaattcggtacgttccgaatatgtcgttgaagttcaaggcgtcgtaaaaaagcgtaaaccacaagcggtaaatccggaaatgaagaccggtgatattgaagttgaagtgcacgatatcacaattttgaacaaagccaagacgccgccattttatattgaagacaacgtggccgtgactgaagaaaccaagttaaagtatcgctatcttgatttacgtcgcccggaaatgcaaaagaacattttcacccgcgctcatattatgcggagcgtgcatcactatttggatgacaatggttttattgacgttgagacgccgactttgacggctagcacgccagaaggggcccgggactatctggtgccatcgcgtgtgtacccaggcagtttttacgccttgccgcaatccccacagctgttcaagcaattattgatgggagccggatttgatcggtattatcagattgcgcgctgcttccgggatgaagacttgcgtggcgatcggcaaccggagttcacccaaattgaccttgaaaccagcttcctttccgctgaagaaattcaggatatcacggaaggcttaatcgcgcaggtgatgcatgatgttaaggggattgacgttgacttaccgtttcagcggatcacctggcaagaagcgatggacaagtatggatctgacaagcctgatttgcggtttgacatgcagattcaagatgtttccgattttgtgaaagactcagacttcaaggtgtttgccggagcggttcaaaatggcggccaggttcacgccattgtattgcctggcggggcagccaagtattcgcgcaaaatgatcgacgcccaacaagattacattaagcgttttggtgctaagggtctggcttggttgaaggtaacagacgatggcattagcggaccgattgcgaagttctttggtgatggggcagcattaactcaggctgtgggcgcccacactggcgatttggtcttgtttgtagccgataaagcaaaagtcgtcgctgatgccttgggttatctcagaacccattttggtcacgatctcggcttgattgatgaaaaggaattccgattctgctgggtggttgactggccgttgtttgaatatgatgaaggcattcaacgctgggttccggcgcaccatccatttacgatgccaaatgaagaagacgtgcatctgctcgacaccgatccgcacgcggcacatgcgcaaagttatgatattgtactgaatggttatgaactaggcggtggatcaattcgtattcacaaccgcgacattcaggaaaaaatgctcaaggcacttggcttcacccctgagcgtgcgcaaaagagtttcggcttcctgctcaacgcgcttgattacggttttccgccgcatggtggtttggcaatcgggctggatcggtttaccatgttgctgacgggtcgcgacaatattcgcgatgtcattgcctttccgaagaacagtaaggccagcgaaccaatgacaagtgcaccatctccggtagctgacattcagcttaaagatttagggattgaagttcgccctgatgttgatccggaaaaagaacatgaaggcgacgagaacctaaccgagtaaatcgacacttttaacgtcaaacaatttaattgctgacaatcgaaacatctccggctataatcaatagttgtggaggtgtttttttatgtcagataaaataaatcggccatcaaaagccaaattgaaaaaacagttgtcaccagaagcctacgcggtgacgcaggaagccgcaacggagcgcccatttacggggcaatatgacaacttttatgaagatggcatttatgtagatgttgtgagtggtgaaccgctgttttcttcacaagataaatatgacgccggatgtggctggccctcatttaccaaacccattgccaagttggccgagcatcgagatcaaagcttcggcatggaacgggttgaggttcgaagtccgcaagccgcctcgcacctcggtcacgtgtttacggatggtccggctgcagaaggtgggttacgctactgcattaattcagctgcactgcgctttattccggtggctaagcttgaagaagaaggttacgggaagtatcggcagttatttgataagtaaactttaataatcaataaagcttgtctgaatagtgaggtcaagttccgtctgactttgcaccgattcattggcgtatgccagagcttggaatttgtgtgtcgctcaatggttaagattttgggcgtgggcggttgaaaaacgggctcatagttgcggggaccgcacataaggacttgggaccaaggcctgcctgatactgctgcgaaaacgcgctcacagtcacagaatggagtagcattacctgtccgcccttgttatacttgatcacgatatgattaatgggtgacagggagcggtttttgtaatggaagaaattgatcggctaattcgtcggcatcaaaattggtcgcggttgtctgcggcctttttttacagcatttgtgtggcagttgcgctgaacatgttttgggagccgggtggcgttttcgccagtggtatcaccggtgcggctcagcttttggcaacgattgtgcgtaagtggtttaactttaatatcgcgttaccgtttttttcgctggcaacgactgacttgttttcaactgggacgttactgttcttcctgaatgtgccgctgtttgtgttggcatggaaggccattggacaccggtttaccctgttcactttcttggcggtcatcttttcaaccattatgattcgcgtactaggcgttttgacccctttgacaaaagatccaattgtctgcgggattttcggtgcggttgtcaatggcttagggacaggctttgcgttacgtaataatatttcgactggcgggattgatattctcggcattgtattgcgtaaacggaccggacgcacagtgggaacgattaacattatgtttaacgtcctcattatcttttttgccgggttcgtgaatgactggccacatgctttgtattcagcgctggcaatttttattaatggccgagttatggactcgctgtatactcgtcagcaacggttgcaggtcatgatcgtgacggcgcggccaaaacaggtggtgcgggaaattcaaggctcgttaagacgcggcattacgattgtgcacgatgcagaaggcgcctttcatcacgaagaaaagacgattcttttcaccattatttcccgggccgagatgtacgatttggaacaagcgatgcgtcacagtgatccgtatgcgtttgtttccatcactgattcagttaaaatacttggccatttttacgagcctaaaacggattagcgaacatacacaagattggagtcggcaagatttttgctgaaaactcactttactaggcggaatcaaaatagtaattgattgtaagcatggccgatgttatacagatcggtttgaattcaaggttatcttgattagggaggtcgtttaatgttaatcggtgccaacgtgagtatgaaaggcacgaaaatgttgttaggcgcagttgaagaagctgcaagttatgaggccaacacgctgcaattttataccggtgcgccgcaaaatacgcgtcgtaagccaactagcgagatgagaattcctgaaggcttggcagcgatggctaaagatgatatcagtcacccagtcatccatgccccttatattgtgaatcttgggaacacaaaaaaaccggccaactttgaatttgccgttcaattcatgcaagaagaagttgcccgggctgatgcactacatgcgtatacgatgccgtttcaccccggcgcgcatgttggtgccggtcctgaagcggcaattgctcaaattattaagggtttaaatcgcattattgatcctaaccaacatgtcacgattgcgcttgaaaccatggcgggaaaaggcactgaaattggccgttcatttgaagaactggcggcgattatcgatggtgtgacttataatgaaaagctccgggtcacttttgacacctgtcacacgaacgatgccggctatgacgtaaaggacgattttgatggcgtgttgaatgaatttgatcacatcatcggcattgatcggcttagcgtcattcatgttaatgactccaagaacccgcaaggcagccataaagatcgccatgcaaatattggctttggcaccattggctttgaggccttaaatcgaattgcccaccatccagcacttgaaaagctacccaagatactcgaaaccccgtatgtcggccctgataaaaaacatcaggttccaccatacggggcagaaattaaatggcttaaaacgagtcatttccaaccagaagaattacgcaaattgatggcttaatgcgtctcggtattgtcgaattcatcaagacccatatgctccaaaatcaaggttgctgtctcttcaattgatcggtgtgcggtgttaatcaccatgcagccgatttttttgtatagatcttcagcaaatttaagttcctgattaacctgatcgcgggctgaataggctgtgtccggattcaaaccatattgaatcatccgctgccgccgaaattccattaggaccgatgcatcagtagttaacccgacaatttttttcggatcaacctgccagatttcttcgggaatgtgggcattgggaaccaagggcaaattggcgactttcaagttacgattggccaagaataaggaaagcggggttttgcttgtccgcgaaacccccagcaatacaatatcggcttccagaaaacccttgggatctttaccatcatcatacaaaacggcaaattccatcgccgatatacgatcgaaataacgttcattaagatcatggacggcgccgggaacatggttaggttcttcatgcgtaatcgacttaatgccgctcaaaatcggtgacattacgtcaatcgcaatgaccccttgatctttagcataatgcgttgctagttgggcaaaaccgtccgtaacaaacgtcatgattgccagtgcgttttccttcttggcctcatcaatggcgctataaattttctctttggtgtggataaaaggaaaacggacataatgtgcttcaaattcgggaaactgggctgcaacggcttgggcaagtcgcaatccggtttcaccaaccgaatctgacataatatataaattcagttcttgggtcataatgccacctcgctaccttagataacgctatcatagcataatttatttgcgaacgtgtagctaagcctattaggtaagggcataaacgcttcggtgccattttatcgaaaaagacggctcaccggcgaaacttaagcaataacattggttgtttatataaaaatctgaaatcgcttattgacgcgtggttaacagttttgtatactaataaacgaactattggctatgatatccgtcagtggttacacaagtgtcggagggagggatatcacatggctaagacagttgttaagaaaaacgaatctctcgatgacgctcttcggcgctttaagcgcactgtatccaagtcgggtacactcgctgaataccgcaagcgtgaattctacgagaagcctagcgtacgccgcaagctgaagtcagaagcagcgcgtaaacgcaagaagtattaataaaggacttggtgaatagtggctttaatggatgagcttaatgctcagatgaagcaaagcatgttagccaaggacaaagtgacgttgagcgttgtccggatgttgaagacagccttggtcaatgagaagatcaaactcggccacgacctttcggaagatgaagaaaaaagcgttcttgcaactgaactaaagcagcgcaaggaaagcgtttctgaatttaaaaaaggcggtcgttctgatcttgttgaggcaaccgaagctgaaatcaaggttgtggaacgttttctaccagcccagttgagcaaagatcaggtagccgatatcgttgatgcaaccatcaaagaagtcggtgcaactggcaagcaagactttggtaaggttatgaagacgctgatgcccaaggtcaagggccaagctgatggtgcacttgtcagcagcgtggttaaagaaaaacttagttaacgacaaagccggtgttagcaccggcttttttattgtgtaaccataggcaattctgtcgagagtccggcgtgcagatcaacttttgaagtttaggcatttgaggcaatttgaaccctgttgtttaaagcatgaatggttgtcgttagtaaaattgccaagcagtttgacgccagtttcaacctaaacaaacagatttaacaattttaaatgcagcttgatgttgatggtgttgaagcatcatgagtcaccttgttcgattactaagatagaaagcaagagctggcggagtggtggcgggctcagtggtgaaattggtcttaagcggagtgggcttctccgctttagaccaaggccgagcttcgaaaccgcggtctttgcgggttcgaagtcgtgcccaccacgttccagcccagtcaccgcggagccagctcggagtaacggaaatcacttaattagagtagaaccgagaaaaagttgacacttacgtccgtttaaacgattctgacgctactttaaaaatatgctaaactaagaccatcattcaatgcttaaattatttgttagggggccaatatttggcacaggagacctcagagaaaatttttcggtttagtaatcctgatatggcaattaacctagttgggattaatgacgcgaatttaacgttaattgaagaaggcttgaacgtccggatttcgccgtttggggacgaattacgcatcagcggtgaagccgaagcggtcagcttgacactacagctgcttgaggcggcaactaagttattggcacaaggcatcaaactgtcacctcaggatattgctagtgcggttgcaatggcaaaacggggcacgctcgaatattttgcggatatgtatagtgagaccttgttacgcgacgccaaggggcaaccgattcggattaagaattttggccagcgtcaatatgttgatgccatcaaacataacgacattacttttggcattggcccagccggtaccgggaaaacttttctcgccgtggtgatggcagttgcagccatgaaggccggccaagtcgagcggattattttgacgcgtccggccgtggaagcaggcgaaagtcttggctttctccctggtgatctcaaggaaaaggttgatccttatttgcgtccggtttatgacgctttatatgcagttttggggaaagaacacaccgatcgcctaatggatcgcggcgtcatcgaaattgcgccattagcgtatatgcgtggtcgtacgttggacaatgcgtttgcgattttggatgaagcccagaatacgactcaggcccagatgaaaatgtttctgacgcgcctgggctttggctcgaaaatgattgtcaatggtgatgtgacgcaaattgacttgccgcataatgccaaaagtggcttattgcaagcggaacagttattaaaagggattagtcatattgccttcacgcaattttccgcacaggatgttgtgcgccacccagttgtcgccaagattattgaagcttatggcaaacatgatttacagctgcaaaagcaaacgaaggagtaaacaatggatttagaattttacgatgatgatcacttgctggatgaccagcatcatgagctgatccagaagttggttgctttttgtgggcaacagttggcgttacctaatgataccgaaatgtcgattaccattgttggggatgatgcgattcaaaagattaaccgggaatatcgcgatactgatcgcgcgactgatgtgattagttttgcaattgaagatggcgaggatgacttgcccctgatgcctggcatggcaaaaaatattggcgacttattcattgatcccttgactgttcggcgccatgccaaagaatacggccacagctttgagcgcgagctggggtatacggtggttcacggtttcttgcatctaaacgggtatgatcatattaaaccggaagatgaagccgagatgattccgctgcaaaagaaaattctgactgcttatggccttacccgataagcaaatcggcaaaaacaagcattttattcaaagcgcccgccacgcgctcgatgggctgcgcgtcttttttgtcgatgagaacaatttcaaacgcgaatttgttagtgcaacattggtgataattgccgggatctggttaaaagtgccgccattttcgtggttcgttttgattttggcgattttgttggtatttttaggcgaactgctgaatacgattgttgagaatatggtcgatttcattattggcgagcattacgatctgcgggcaaagaaaattaaagacatgagcgctggtgccgtgttgatcgtttctctgattgcggtagttgccggcatttatgtttttggaccgccgctgctagcgcttttgaggagttggtgaatgttgtcagttttacgtaccgcagccttagccgcacgtgagaatgcctatgttccttattcgcactttgccgtgggtgcagctgttcgcgtgggtgagcggattttttccggggcaaatatcgaaaatgccagttacgggctgagcaattgtgccgagcggagtgcgatttttgcagctgtgagcgccgggtacacccagttggatgagttgttggtcattgccgatacaaaaggaccggtagcgccttgtggggcgtgtcggcaagttatcagtgaattttttgcggccgatgcggttattaccttgaccaatgtgcgcggcgaaacggttcaaacgaccccgcaggcattgttgccaggcgctttttcgaaaggagacttacaggcttgagtgaacaccattctggttttgtcgcgatcatcgggcggccaaacgtcggcaaatcaaccttcatgaaccgtattttaggggaaaagattgccatcatgtcgcctaaagcgcagacaacccgcaacaaaattaacgggatttacactacccctgacgcccaaatcgtttttgtggatacgccgggcattcacaaacctaaaaacgagctggatgattacatggataaggccgcgttatcgacgcttaatcaagtcgatgctattttgttcatggtcgcagcggatgagcaaaaaggggcaggggatgcgtatattctgcgccagcttgctgaagtgaagaagccggtttatttgatattaaataaaatcgacttggttaaaccggatgatttattgccgctgattgaaagctatcagcatgattatcattttgcacaagtcttcccgattagtgccacgatggggaatagtgtggacgagttgctgaattcgctgacgggcacattaccagagggaccgcagtattatccggaagatcagctcacagaccatcctgaatatttcgttgtcggtgagctgatccgggaaaaaatccttgaattaacccgtgatgaggtgccgcatgcagtcgcggtgcaggtagagcgcatgaaggaccgtgaaggcggcaaactgcaaattgaagcgtacattatcgttgaacgtgatagtcaaaaaggcattatcatcggccgcggcggacaaatgctcaaacaaatcggtatccgcgcccgtcgcgatatcgaaaacctgcttggcgataaagttaacttaaaactatgggtccgggttcaaaagaactggcgcgacaacaatgcttatcttaaatcattaggttataacatgaaggatctgcgttaatggtcaaacaaacacaaacctttgaggggctggtgatgtcccgtcaaaattatcgtgaatccgatatgctggtcaaaattttgacggatcagttcggtaaaaaaatgtttctggtaaaccgggcccgcaagcccggttttactttagctgctggcattttgccctttacgcatgcggattatattggtgaggtccgcgattctggactgtcctacttgtccgctataaagagcccgacgcagtatcgacaaatctccaatgatattaccttgaacgcctatgcagcctatatcttcggcttgctcgatttagcctttccagacgggcggccagtcggcttttggttcaaacaagtcaaacaagccttgcatttgattgacaccggccttgacccgcaaattatcgccaatgtggttgaagtgcaaatgcttaaagcttacggtgttgaacccaattggcgcggctgtgtcatcgacggccgcactgatttgccactggatttttcagaaagctatggtggcttattgtgtcagcaacattgggacaaggacccgcatcgactccacgccagtccgcgcgccattttttatctgcgacggttcagtacgcttgatttgagtcaggtcaagcgaattgatgtgaagcccgcgaccaaagccgaactcaagcgaattcttgatgttatttacgcagatatggtcggggtgacgccaaaagctaagcggtttatcgatcaaatgaatcagtggcaggatcggttgccggatcgtacaaagtcagaagattcgtccaataatgatcgtccgcatatttaattgattcaactgattgtttttattcctcgttgtgctaagttataagtaagcggttacagatttgaggtgatgcctcttgcggaaatagtgacaactttaaccgaagacaataatcacttaatcaattttgtgagaggggaattttaataatgggtgaatcactaccaaaagcagtcaaagtttggatggcggcaaatatattagcaatcgagtttgataatgggcaaaccagatacctgcgatcacataatattaaggattatatttcggcttggtcacttaaaaaaggtaaaggcaaacgggttaacttgattttgcctccgacatggcagtggctcggttcaaatgcccgcatcgaaaaggatggttccgtcattctatttgaaaaggatagctatacgccacaagaactttggaataacagtaaggaacgtatcgacttagtgtcgggtgtgaattgatacaagcaaccttaagaccaatctagcaaagaaaattaaattggtgatgagaaaagggtcacattcgttccaaactccggcaagtcaggaaaagtttgagcttgatggaaatggttttggaacgaatgaccaagcgatggagaattcgagcttcctaaataaatggagccgcacagaagcgaccgtacgccaaggagtggtgaacggtcgcatttatgtttaggagccagtcgcgtgcttgatttaagtcaattctagcgtgtaaatgatcgcgctaaaaatttaaccgactgtatacatttattttacacagcagtgataagataaaactattcctatcatgctagcaattaaatgtacgtcaataaaaacgaaataaggttcatgtcaagccggaacacgcatctttaaaagatacaaactccaccgaaaaatttctattattagaggcttactggaccatcatccacgtgtgaaaagaggctttttactttgaaaaccttctttaagataatcatagctattagtatcattgtagacatctttgtcatcgcaaagacgggatttggcagtactgcgacgcttggaacaatgactgtaacactggctattcttttcatcgccaatttctatgacagaagaggctagatctatgaacagcagcaaagggaaacagcatgctaatcatattctgatgctaaaggcactttcggttgagattggccatttttcgcttaaagatgttaacttaagcattaacgctggtgatgttctaggcgtgatcggtagtaatggtgctgggaaaacaacgctattaaaaacgattatcggtattctcaagccaacttcgggaacggtcttcattaaaaaaggcactgcgatttctatggcatttgatgatggttacattccggaaagcttgtcagctaaagacattgactatatttttcccaaaatctttaaacgctgggatcgtgaaaaatatagacaatatatcgataaactaaaaatccccaagcaaactaattttattgatctcctcaattttcaagtcaagtgcaacgatgataacgaattcttgatagtggtctaggctgttacgccatgcatcggtagtaatcgcatgggcgaagatagttcagaatacgtctgggacgatggttcagtgcggattggactgcttgaatttcaaccagggtaactgctctgagagacttccctttcgggaagaattccctaagcagtccattggcgttctcgtttgtgccacgctcccaaggcgagtacggatgtgcgaagtaaatctgggttccaacaatctctgataacttggcaaactcggaaccattgtcaaaagtgatactctcaaattccttggccccgtagtcgtcgatcgtgtcctgcaaggctttaaggcaggtgcccgcatgatagtcaggaatcttgacgatgatctcagtccggctgtaccgttctgtgagcgtcattaatgctggctcatcagctaagcgaatacctttgaccaagtcgccttcccaatgtcccacgcctgtgcggtcattcacggccgcaggacgcaactcgattgagtcgccgtatatcttcttattctttagcactaacaagaataggtcttcatggcctttatggtctagtcgtcagggtgttgcacttgaattgtaaactggggaagttataaaaatggctatggttctgagaacacagtgtttgtgagtctcagagccatttttgtttgtggaagaatacaaataaaagtgataaacgtcatgaacctatttacatctagtttttaaaactatataatatagtcattaaagctgatggaggcgcaacatgaccgaaaaaattgcaattctcgttgattcaggttcggatgttcctaaaagtgtgctggatacgaacccgaatattgcggttgtcccattgaacattacgatgaacgggcataactatttggacgcggttgatattaccccggatgaattttattccgcattggcaacggctgaaaccttgccgaaaacatccagtccttcaccgcatgcagccaaagaagcgctggcagggctgtttgcggcgggttatacgcagattcttgggattacaatttcgagtgcgctgtcagtcacgcaccatgtctttcaactagcggcggaggagtttcccgacaagcagattaccattttggatacgaaaagcatcggcattggcagtggcattcaagttgcctatgcgacctcgctaatcaatgccggcgaatcgtttcagacgctggtggcaaaagttgaagcgtcaattgttaaaagtcggatctatttttacgtgccaacgctgaaatatttgagtgcggggggacgaattggtcgggtagccgggttagtcggctcagtcttacatattaaaccggttatttcatgtgatccggaaggcgtttattatccaatctttaaagcccgctcggaggaaaaggcactgcaaaaactggtcgatcagattaagcaggattgcgtcaacagtgaccattatcgaattggagtcgcgcatggtcagaatccaacgctggtgaagaaactagccgcaaaaatagaagaagctacaggacacccggttgattttatcggtgaagtgtcaccatcgctcggcgttcatactggaccggggttgattggtgctactgtgcaatcgtattaagcgtctatgacgaatggttattttttgcgaatgttaaatgatgaccagtcattaaagttaaaactaattctttgcaaattaaagtcagatagattttcacacataaaggaaaatctatctgacttttcagcaattatcggaaaagattgaagatttatttttgatttaaccataaccgataaaaatgattaacatcgccaatttccataattgttaaatcaccattgatctttcgggcaaagtcgattgtgaaaaaagaagatttaatatcagcgccttgttttttaatgaattgctgatcgtttgcattcaagctttcaaaattcttcccccaataatcaataaccacaaatggatttctttgccaatagaaaacgcgatattcctcaaatgtcggattgtttgataagtaggtgcctgtctgaagtagcggaacaaactcacgtatgacaagaccaccaacaaggttctcgccctgtcgagtaatgaagttatgaatcacttccaaagcttgtgaaaagttttgagcatttggaatgtaaaaggcactataccattcgtgttttctgctcttaacaaaatcctttattgtgactggtccggaaaattggttaagcactcgtatgatatctttatcggataaatcggttgtccaagctgacttgagtgtgttagagtgatgggcccatctaggaagcaaatgggtccctgtataggcgtgggtatcagtaagcatttttgctccagaagctaagattaaactattcattttagaatatgtctctggccgtaacatccatccacgatagataactgttgtttcagaaggaaaagacgtattcaactcaagctgattttgatctaataagcaatcaagattaataagccgaacattagtcatggattttgcaaccgtatattcctcggcgtaatctgggtcgggttgagagactcttaagggatttcccggaaacaacaatgttagtttgctagtgtccatttttagaccccactttgaatgatggtgatgacctagaagagggtagccatagaatgagctttgaattagtttagccagctagttgaattttatcgaaacgacgccttcatgccaaccacttattccgtttcgccatctcaattgcctcaatccgattatgcacccctagcttactaaagatggccgacaagtagttacgcacggtgccttcagatagaaaaagcgaggctgcgatttgtttggaagacaaaccactggcgacttccccgagaacggccaattcgcgctctgtcagggggttgctttcagccgtgaccatgttcgcaactaattccggtgcgtaaactgtttgccccgtcatcactttccggataacggcgattaggtcatcgcttgggctgtctttcaaaagataaccgttcacttgagcagcaatagcgcgttgaaaatacgctttttgcgcgaaggtggtcaggataatgactttggtaggtaaagcgtgcgtgtgaatttgatcagcaacatccaggccggtcattttcggcatttcaatgtcgaggatcgcgacatcaggcggctgcgattgaatggcttgccaagcggtggcgccgtcttgtgcactgccgatgacggttgaatcatcttccaagttgagtaactgcgacagtgccgagtttaacatgctttgatcttcggcaaggtataacgtgatcatcatcaggcctcctttggcaaagtaagtgaaacccgtgtgccttggcgattatggacaatggaaaaagtgccattgaccgcttgcatgcgttgttgcatgccgctaataccatttgacccagcgcgaacatagctttttgaatgaccgtcatcttgaacctcaaccagataagcggtcggggtttgatcgaaggtaatgatggcttggtgagcgtgcgcatgacgaatcacattggtaattgcttcggaaatgacggcactcaattgggcttgaacggttgtcggccattcagtggcttcattttccccgtttgtcagtaaaaccacatccgcttcggcaagatttttaccttgttccaacatcatttcgctgagggactgctgatgaaggtcgttgacaatggcgcggaccaattgtaggttgtcgcggctggttttagcaatatcgtctagttcttgggccacccgttccggcgccttgatgagtaacttttttgccaattcggttttgagcgtgatcattgagaagctttggccaagtgtgtcgtgcaagtcacgtgcgatgcgttcacgctcaccgcggcgaacaaccgcctgcagccgccgattggtttgacttaactggcggcgacggatgactgagcgcgcaaccgcgtatgaaatcaacggcgaggctaatggaaaaataaggtcgccaatattcgcattgtcgagactgatgacgccaggatgaaagtgattataacgccagagtccgatgaacataatcaggtaaaaagcggtggcaaaccagcgaaaatattttcgcgggtaccgggccaagataaatgaaatctgccatccggggtaaataatcatgtagttattgaaggcaaagatcgaaaacaagccggcaatgaagagttctagtggaatcgtcaccgccagccaccgatcgatttcattaacgagaatataaacgaccaggaaaaggacccctaagccgatccacagccagtcaatactggacttggtggggatgaactcgctcataatatatggcagataaagcagccatatataactggtccattccagattacttaaccataatcgaaagctatgcctcacccaatgccacgcctctccgttgttcgtttcgagtcattgccacaacgaccaagccggcaagtaagacccaaacagctatgccaatcaaattggttaagtctactttagcacgtgacgtcagttcatttaagagattgttgacgaaataagtcggcatcagcttgccaatcgcttgaagccaacttggcaacatgctgatgggccaccataagccactgacaagggccatcgggaaagtcagcaagttactggcaagactgagcatttcttctcgatggatatgcgacaacgcaattccgatcatgagcaaaggcagctggccaattaagaccacaactatcagccccaaccattgggtgatttcgagccgaacgccattaaccccaactgcaatcccgcctagcaccacaactgacagcaaactcatcatcaacatccaaaaagtgatggacgtgtaataaggtaaagtgccatgcggagaaagccgcaaaaaagttgtcagtcctttttcacggtcacgtcttaagatagaagcaatgctgaagaaagcctcaattaaaacactgtagacgatcatctggcccaggtaagtgagattgaattgcttgatttctgcagctgatccactcaccatgatcttagtgaaaagtaaataaaatccagctggcatgatgattgaaaagaaaatgaatgaggcgtttcggacgactaatcgcttgccgtcaaaagctaattgtgcaaagaatgttttcattttagctggcctcctgttgggttaactgtaggaaaatatcttccaatgattcacgattcacactcacttggtgtagacggtcaagcagcggtgtcaatgcgcgcaaggtctggtcaccatctgtgctgtgaatgacgagtttatgcttgagatgatcaacgcgatcaactgcaggcaatccgttgaaaatgggcagttgcaggtcagtttcgaatgtaatggtggctccgagatgctgtttttgcagttgctggagggagccgtcaaatgtgaagcgacctttttgcagaatcaacaagcggtccgcaatttgttggatttcctcaagataatggctggtaatcacgatggttttaccttcttggcgcaactgctcgatgttgtcccaaaatgctttacgcgagtttgcgtccatcccgacagtaggttcatcgaggaagagtaagtccggttggttgattaaggcaacggcaaatgtcacccgacgcaattgcccaccggaaagactgccgagtcgctgtgttttaaaaggttctaagcgtaagtccgtgagcaatttattagtgttaagcggatgatcgctttcagccgcagcaagctttagtaaatctgcaatcgtgatgccgggaacaaccatgtcgccttgaagcatcgacccgatccgtgccttgctaatggccgatccgggctgctgttcaaaaacgctgaccgcgccttcacctttaagtagtcctagtaaaatgtttagcagggtggttttacctgcgccgttaacgccgatcaaaccgatgatttcaccggcgtttaccgttaagttaatatcatttaaaacttgttttttaccatagctgaatttcagatgttcagttcgaataattgtgtgcatgtcatccacctccaacatcgatactacgcggccaccatgattgccagtagtcgcgattgtcatgtatgtgatgtgacaaatgtcatgactgacgatttttattgcgctggagaggcacacgaccttttgttgctatgatgatgaatcatcggaagcgtcagatcaaaggagcagcagcatctctattgtgcgaaccgtacttcttgtataatggaaggaatatggacgcggattaaaagaggggaatcaggaagatggcagcgacattatcggagcctttgcgtaatctattattagcaagtcaattaggactgagtgtgcatcatcctttagccggctggtcagtattgacgattctttatcgcgatgctggcagcagcagtgaaccgattaccttgagttatttagcccggaagtacaacaacgattatcttgatggcctcagtggggaaacgcccattgccgatgacgtcttgaaaaaggtgctcgatgtcctcgtgacgcaagcggggttagttgaagtaagcccgcgaaaagtacgcgcccgcatgcgcagcggtcagtaccatatccgccagtcgtatgtttaccggatcacaagcagcggcattgaatacttgaaaatgatgcaaaaagtcatcgatgccgaaagtaccattacggccaacaccaatcggattcaggaatacgtggatctggtcgaaaaactgagtgtaccggttcgttcgggggccgacacccggctttacaatgattttaaaaatatgctcgatgcctatgacgatgtgatgaaaggcattcataaattagaagatgatcttgatgagattgcaaacgatattgcctttaaccatggaagtcaggctgcagcccacttgcagcaaatgttgcgccaagaagcgatcccggcataccggcaaatgttgaatcaggcagcacgtattcaagggttggctgacgaccgtacttttcctgatcagattgcccattcccagcaaggtgagggggacttggatgctgcccatgctgctggccgccaagatgtgttggtaacgcggtttcagcggaacaagcaatgggcacagtcgcagctcaatcggttatcgctaagcatgagtccaacgacgaccgcgattgatagtagtcttgactcgatttatcttgtctttaataccttgttaggcattgtgcgcttacttagccaggaatttgaacatgccaagcgccaaacgatcgacttgaaagtactgtctaagaaaattgatgggttactcgcacattacgtccagctgacgattcctgcccagatcccacggcacttgccggcggatcgtgaagttgatgaccccaatgatttgctagatgcgtctacgatggggccagttcattatttagccaatcccattacaaagcagccggccagtgccgccgacaatccgaccgtcaccgatgatgcgccgagtgagcaggctcaactggcaggactgcgagaatttcggcagacgttgatggtggatgatttccatggccgggttgatcacaatttgacgctcaagacagttaccgcgcgcgatgaaatcgttaaactatttgctgccacctatcacaaagatcttgctgcttttgctccatttggtcgcgcaaccaaatcagtcgaagcattaccggattcgccgccgttacagctgcaagtggcaggcgaagattatgcagttgtgctgccgcatgggttcacgttttcgtttgattaaggagaagaaataagatggcgcaaataactaaacgcgatcaactggtgattaatgaattgttggatcacggggtgtttaccaccacgccgcttgctgccgccacgcaattgagtcgaggtgccattgcggatttaaagaaaccttctgtgcagaaacgaatcggcttttactttaagaatatgttcggcatcatgcccgaaaactttcaagaaaatctgctttttctattgggaaccgagaaactttcgccggtgcaggttcatgttcttttggcaacggttaaaacgatcattaatgagccggaattacagaataatcaagcggaccgggccattgccacccaaaaaatcgtccggcaggtgcatagcgaggttacggagctagatgagcgggaattgttgcgtaccattgatgcactgttcgtaaaacgattcgggttgttcaccccagatcgccttgaagacgactcggaaaatgtaccagctgaaattgatgattattgggaggttcatccggatttcaatgaatttacccagaacctggtgaattatttggtcaatacccaatcccaagaggaagtaagcgagattcaaaaagttaaccgtgttttactgacagaacaatttatgagtcctaaagccaatccgcaactttggtcaacgttggctgtcaacaaacaagagattgccgaacagtgggcgcaaggcgggcggtttgttttagaaatcggggatcgttatgcgctgctactggacacgcaacgccagcctagtgttgccaagccttatctggtcgctttggcagtggcccatcaacttggcgcaggggtggcggctgctgatttaaccgcactcattagaaaaaaagcagtcgccatgggactcacagcgcatacactcaacgatgctcgtgaagatccggcgctgtttgcttactaccggtgggtcatgacgcattgctttcagtctggacaggtcaatgaactgacagcgcggttgatcggcatggcgttcacctctgcaaatgtttttgaaaccgacttaccccaaccattgacgttgaatccttggcaactcacaccgatgctcgactttccgttgaaaaacaaacaggcggtggtcatcgaaaataacggggtgtttgcgttgcttcatcaggaacatccagactggccgttgattttacagtccggcaatgatttcaatgatgtgtatgtgcgactcattcaacgactggaagaacgagggatgcgttatgcatatttaggcgacattgatagtgctggtatccgcatggccgaccgatttgccagtcttttgaagcaaacgccagcagaagcagtggcggccttgcaaacgccaagggatgtccgactttggctggcagaattagggaaacgcaactcggcccggacacgtgcgcttcaagtcacttcgccggttttccaagctgaaatggtctcggtcacaatgtttggaaaatttgtggaacaggaacagctcatgccgatttatacccagcggatcgcggattggttgaagcaggaagattagtaagaaactgagcaagtgtttttaatcaattgcaaaggaaaatagcccaatgtatacgatcgaaaattatcgccccgagctactagaaagttggttgcgttgtcgtgccctagcatatatgcgcagtgggtttcaggatgagatcaccggtgaaaaagaaactgtgacggcagaaaatggcatctcactagtggcaacggttgatagccaagttgttgggatcgctgaagccatctttttaaatcaagaacaggccaaaccggaatcttatggtttgcccgcaaagatgccattgagcacccttgacaccatggcagttcatcctgattttcaacatcaaggaattgctaaggcgttgttggctcagctgaaacggcggttacaaagtcgtggcggtgcgttattgatctatacgctggatgacgaaccagcgaatcaactgtatcgagcagttggcgccaagttgtgttatacagcggcaattgtccatgggcacagttctcataataaagtgccgcagtgggtgaattttcacgtgacagatgatcatcaaatgacgctttatgatgctcaaggtgctgagattccgtacgggcaggatatggagacgtactttgttggtaaaaaggtaaatattgacctgcttaaagatgtcagtaagattgtcacggaacatgtttatgtgttagatatctgatgatcaagtgctgcatttaattagatgttatcttatcaagaaaataatcttaaacgaatcgctaaacgagctttttcacgattagatataaaagagcacagcctgatcctagtcagtgatctgtcccccaaagttttgtgccaactttgggggacagatcactgttttatctcgctcactgggttgctataatgatatttgctgagtaactaagcagactgaacagaaattgtggggaagatattttgattgaagaccaaaccattcaaatcgtacaacaagacttgacgggaatgacgagtcggcaaatcagtacggttttgaatttgatgaatgagggcaatacggttccgtttattgcgcggtatcgtaaagaaatgaccgggagtctggatgaagttcagattcaggcgattgaggaagcctataaacgggtgacggcgctgcaggatcgtaaagctgcggtgatcaagagtattgccgaacaaggggcgctgacacctgagctggagcagcaaatccatgctagtaccaagttgcaggatgttgaggatatttatttaccttataagcaaaagcgtcagaccaaggcaaccattgctaaagcgcgcggacttgaaccttttgcgcagtggattctttctttcccagtaggcgatttgacgtctgaagcggctaaatttgtgaatccggacaaagaggttgcgactgagcaggacgtattggacggtgcccatgaaattcttgcggagaagtttagcgaaatggcgccgatccgcaattgggtgcgcaatttcaccatgcgtactggtacgattaaaacgaccgtcaaaaccaaaggcaaggaactggacgaaaaaggcgtttatcagcaattttacgactttgaagagaccgtcaagaaaatgtcatcgactcggacgctggccattaatcgcggcgaaaaagagaagattttgacagttaaggttcaagttgatcctgcttcggtgatgcaatattgccattttaaattgattgataatcgcccgagtaccgaagcaacagcgtttattgaagcggcgtatcaggatgcctacaaacgcttcattggcccggcgattgaacgggaagtgcgcaatactttaaccgaaagtgctgaggagcagtcgattaaggtctttggtcagaatctgtacaacttgctgatgcaggcaccgattaaaggcaaggtggttctcggatttgatccagcttatcgcaccggctgcaaactagccgtggtggacgaaaatggtaagtttttggacaaagctgtcatttatccgcacaaaccggcgccagagaagaagcgtcaggccgcggcttcggaactgatcgcgctactcgaaaagtatcatgtgacgatgattgcgatcggcaacggcacagcaagtcgggaatcggaacaatttgtggcggaaacgcttaagcagatcaagcgggatatttattatgtcatcgtcaacgaagccggcgcatcggtatattcagccagtcaagaggcgcgggatgagtttccggacctgcatgtcgaacagcgcagcgcaatcagcattgctcgccgcctgcaggatccactggcggaattagtgaagattgatccggaatcgattggtgtggggcagtatcagcacgatttacccgccaaggcgctggcaagtgaagtcgatgcagtcgtggaacgcgcggtcaatcaggttggcgttaacctgaacacagctagttaccaactgttaacccacatttccgggttgtcgaaaacgattgcgactaatattgtgaaataccgcgatgaaaatggccgctataacagccgtgccgaattgaaaaaagtaccacggctgggaccgaaatcatttgaacagtcagttggttttctgcgaatcatcggcggtaagcagccacttgataacaccgatattcacccggaaagttaccccgttgccaaaaagattctggctgcggcggggttatccacggctgatttaggtgatcatgaggcggttgccaaggttgctagtgttgatggtgcgccatttgtcaatgatggcgttggcgttgagacagtgaatgacatcattagcagtctgcaaaatcccggtcgcgatcttcgtgacaacatggcagcaccgcttcttcggcaagatgtccttaccatggaagacctgaagccgggcatgaagctggaaggaactgtccgcaatgtcgtggatttcggcgcgtttgtggacattggcgttaagcacgatggtttagtccatgtctctaaaatgacccgcaagtttgtccgcgatcctaaaacggttgtggcagtcggtgatattgtgacggtctggattgaatcggtggatctcaatcgcgagcggatacagctgacgatgatcgcgccgactgttggttaagcggctagcttgcaataaatagaaaaaatacgagcggtggtttttaatgttggttcaaggaccaatattaggaagccaccgcctattttttttagtttaatgaaggttggatgtatccggtttcgtgtgcttaatgacagtgtcgataaaatcttcagaataaccgtatattaaaacaacggttgaaattaattatagaaagattaaaatacaagaatatctaaaaaaggagctgacagtatgcgaccaatcatcgcacttaccggagattcaatggtcgcgccttcgcctgtcattaatctgaactatgcagacatggcgccaaacatgatcaaaaatgcaattgtaaaagttggcggggcaccgttaattttgccgtatcctgaagatgacgctgcagcagcgtcgttggcagcacaatatgttgatgtttttgacggtttggttttgccaggcggaccggatgttgatccgacattttatcacgaagaacccattcaagcgatggggcgggctacttatcaaaaggatcggttcgaaattgccttaattaaagcaactttgaaggcgaataagccgatttttgcgatttgtcggggcattcagattcttaacgtggcattaggtggcaacctttatcaggatttgccaagccaaaacccgcaagccaccattcgccatgcccaggctgcaccgggacagtggccgacccatcacgttgcgattacgccgggctcccatttagcagcattgttagggacgagtagttatgttaactcccggcaccatcaggcagttaaggatgttgcagcgagtcttaaagtcactgccaaagcgccggatggagtcgttgaagccgttgaaagcaaggagtcgaatctgattctcggcgttcagtggcatccggaaaatatgtggcaacaatttccggaacaactaccattatttgccgatattgttaaacgtgcaggaggtgatggcaatgaataatgttgtgaagaaagaacaaatgggttattggagcatgattttgctggggatcaacggcattatcggttccggaatttttctgttacccaatcaggctgctaagttaattgggtcagctagtatttttgtcttactttttgatgctttgttggtcatcagtattgcactttgttttgctcaagccgcgacctattttgatcgtgatggtggtccgtacttatatgccaaagatgcatttggcgattttgtcggctttgaggtcggctttgtcacttgggcgattcggattatcgcggaggccacgatggcggttgctttcacaactgcattagtcgggacttttccagcgttaaaccagcctattattcgcgattcgattatttcagtcatggtcatcggcttggcgctcatgaatatcgccggtgtccgggtttcaaccgtggtcaacaatgtgattagcgtttcaaaattggttccgctagttttgtttgttgcaatcggcattttcttcatcaaaggcagcaatttcacgccattattcccaggcggcagctataagtccggtagtttcgggcaagccgcggtggtcatgttttatgctttcaccggttttgaaggcttagtcgttgcggcgggcgacatgaaaaatgccaagcgtaatttacccaaagccgttgctaccgtcatgacggtggttgcacttttttacatcctgattcaggttgtcagcaccggtattttgggaaatgcgttggcaaatacagatacaccaattcaaaccgctttcgctaaaatcaccggtggctttggcaatgctttggtggccgccgggacgctgttatcgactgggggactgcttgttgccagttcctttatcaccccgcggtctggagttgccctcgctgaaaatcacatgatgccgcaattattggctaaacgtaatcgggtcaactcaccatatgttgcgatcgtcgtgtccgcaaccattaccttactcatcgcgtattccggcacattcggctacctcgctcaaatcagcgcggtttcaagatttgcccaatacattccaacatgtttggcggtaattgtatttgccaaaaccaagaccaaggataaaagcagtaccttccatctgccgcttggccccgtcattcctgcagtagcaattttagtcagcatctggctattggttcaggttcaggtaagtcagctggtcatcggccttggcgcgttgctcgtggcggtaccgttttatttcttgacatacacgtaccggcagcatgggaaagtttaaccactcaagaaattggaacaagttaacaaaaaccaggtcgggggttagcaatcaaacctataattcggttttttacgtgcaaactggtatgtgcagttcgaatccattagatctgcgagactctgaacgataactgtgttttaggtaatgcgtgacaaaagatatcactttttccccaaatatttgattgattactcttaaccatttagtggttggtgaattaaaaaagtatagggcatacaattacgcccagacatgttttgcggcatagcctactacggtttaaggtgatataatacctctgaggtgcacgcatgaaacaaaacatcatagacttgttttcgggcgcaggaggacttactgaaggctttcggcgccctgaatataatatcttggcgcacgttgaaatgagtgttgatgcctgtcagacactgagattacgagatgactattaccagctgaagaagcgtaacatgcttcagcaatatcgcaatttcctggatggaaaaatttcactttctgaactggaacagcagtgtggattacgccaaaaagctttaacaatcaatgaaacaattgatacgggtactattgacggaatattggcaaagatcgactcgaagctttcgaacagacaagtacatggaattatcggtggaccaccgtgtcaagcttactctacagtgggaaggaagcgtaatgaggctaagaaggaaactgacaagcgaatttatttgtatcgcttctatattcagtttttggagcattacaagccggagtttttcttgttcgagaatgtgcggggacttctttctttcaaagatttagatggtaagcgactgtttccaaagatgaagcaagagttcgaggcaatcactgataaactaggctaccatattgattggaaactaatcgattgttccgaatttggcgtcccccaagaacgaaagcgtattattctttatggacagcgaaatgatctgccgaagttttctttctttgaaagacttgcagatctgcaagaaactcccgggactgttggtgaactcttcagggatttaccaaagctgaaggccggagagacctgtaacaaatattccaaggctcaaccgtgtgcttttgttgtggaaaatcttcgcactcctgcaagtaagctaactcagaacgttgcccggcccaatcgggaattggatctaaaaatctacaagattgcagctgaaaagagagcaaaacataaaattttgcattacaatgacttgcccgaagacctacagactcacaataataaaaaggcatttttagatcgtttcaaagcggtaccggcagatggggtctcacaaacagttgtagctcatattgctaaagacgggcattactacattcatccagatgtggagcaaaatcgttcgattacagtaagagaagcggcacgtattcagacattcccggatgatttctatttcatgggttcacgaacgcaggcctttaagcaaataggcaatgcagttcctccctacctagctaagaaaatggcgcaaacgatattactaaacaaacaatgaggtcagcttagctgacctcattgtttgttattcgttaatgtaagctgagaagaatcctaaattgggctcatccagagtaccaacaaggacgccccgatctaagaacacattacccatttcacaactcgtttccgccacaagcgcacacgcatgacaggcagcaatatttaacgaatcgcgtccttggccagaactatcaatgcaggtggggtcgtagctacaccagcgagctttttctaaggcactggcgagtgttttgaagaaattatctggtataccctggcgaacaagacctcctaacgtgccttcagagtctgcgcttgatgtatagatcaagatgccagccatatcagatttgtctgtttgtcccctagaaaagtacagtcgctcttttaatgcagaagacgaatagccgctagcgaaactgagttcacgtaaaagtatatgagaaaaggtgtgaagcatatagtatgcgggatcgatcaacggtttacggttttctgggacttgaaccgaacgtttacgcacgatattggcgaagatttttgaaccgtcgagtttatttctccaaaggtttagatgttgactgctcagttcaatgaatataccttcacctgaatttttcagagcgacaaaccggttatctgagcgacgcaacgaaacttcattaacaggagcctcgtctgcgaggccagctcgtcctgaacttgcacgttcgatttgttcttgttccagcatcatatccgactcgattggacgaattcgactatagcctttaagaacagaaatgacctcgagttgatttaggagcgtaatgttttggaagacacttgcgagtttcgtatccccaaagtgttcacgaggttgcagtgtcatgtcgaagcgattggtgttacgggcatattccttagcgccagttaaaacgagatattcatctcgtcggtaatccatctgactttgtttttcttctgcgtgagcagcttgccacacgctggaaaagacattaattagtttttccggtgtgagtgagttttcggtttcatcaacaagcgtttccaaaaggggggcgtatctttgagaaagaatcgttttcgcctcgttgagcgttgtagacttcaacacttgtttgagtaaggtctggtaggtaggattctgaactaactgctcctggagtgcagtgtcttcctcgggtatattgacagatccgacaatgtcggaaaagtaaaggttattcgcgttccgcatgagtgcgactggctgtcggtgacattgtttagggtgttcgttcttcttccatccgtaccgaccgtgacaattcacgccaatgcgcaaaagggtggcgccaaatgaatcatcaaacacaccttgcagattacgtttagccgtacacgaacactcgaccacaagatccccaatcgtgccagaaagaaggttatcttttagctttagccgatgagtgccgcggggaaaatcgtttttttctttagaatgtgcccactccatccatggaaagtcttgaatgtgcccatctctgcaagcgcagacaagtcggaccgggattaattcctcccgataacgcttgttagactttgatagttcaaaatgaaacggcttgacattaaatcgcttcagatcagcatcgtttcggaggtcagcacgccactgcgagagtgtccgaagttcgcggttctttggcccgaaataccactgtggaaatgaaactccagtgataaattctttggtaagatcagttgggggagcgataaatcccgctgcattgaggctagattgtaatcgaatgtcaacgatagggtcttcgttacttgtgggttgccagaactgcgagtcacaaatcataaccgattgattgttgatttgggtaagggcgccagtcccaaacggagtaatcagctgtgattggcgaatttggttttctggtgaacggcgctgaccgtcatttgaaattttaccatcgttaaacctagtcatctgtcagactctcctttatggaaatattcccagagttttctatatcgcgcatagagttcatcgcgaaataagcttcgtgatgagcttgtctcatatcaaaacttttaaggaggtaaacggtatctggtgtggcgtctttcttccccgcaaagtataagagatttttgtttgcagtgttgtcacttaacacggcaaattgcaaccagtgttcagagatggcatcaagcttttcacttgctttagctgtgtaaagattttctgaatcgtttcgctgtatgcgatcaagcaaaaatgtttttgcacgtgctagctctggtttgaacttaagaattgagctagcatttttctgggacaagagggcaggattcgtgtgtcgtagcataccaatcaaaacagctgctaaagccttatctaaggcaggttgggagaatggtgttacgctgcttggctctacttgtgcgtacatactctgatgataacttgtgaaagcctcatagtgagaacggtcgcgacttttagtcgagctgtatagtgcaaacaccaaacctaatgtatctcggccaacccgactggtcgcttggatatattcagaggtgagcttaggctgaccgacaacgatcatgctgttcaatcttgaaatgtcgatgcccactgagagcatattagtagcaatcatggtgtcgacagctcgttcatctgaggtatgcgcgtgcgtgagcttctcaattgtgctaacgatttcgctgctagaaacgtgtgaagtaagctcaagattaccgaacgtattaagctgccgcgaagaagcggagccttcaagtttggtgaggcgacgcagctcatcacgcacatcatccatcagtaaagtggaagctttccctaactctctgaggctattgaaataaccgacgactgtccagaaaagatcctgctcttcaggactcagatcaagctcaacaatcgaatgaagaagagccgcaaatagacgaatttctgtcgtcacttgggttttgcctgtgcccatcacgccaacatataggcgaccgtatagattgccaccagcagacggcttgcttgttttgacgaagaagttgtcgtcaacgtctagtccgtccggtggaaactgcataacatctcgatcaaaaagattgcgaacttgttcttgagaatttctgatagtcgctgttgaggcgaggtatttaggccgtgaagctcctgaagacaagatgtaatcgaagctactctcataaagcccgacgatactacctaacggaccagagataaggtgtaattcatcctggatgatgagctgtggtttatagactttgcccgttttgttgttggagcaagaaaacagggccgcggtcttttcgttgatcggcacttgtgcaaacttatcaacggttccaaataagagcgtcggttgatttttgtagatagaatcgtcaataacataaattggcaacttctcatggaaagggcaactgaaattttgacattggagatcaaaaccattgtcattgactagtggggcgtatccccaagcatctatgacaagtttttctgtatcatctgggataatgctgtgcttttgatgacaccaaggacattcaagtacctgaaacggatttgggctgtcatggtttttccgaagattaataaaatccatttttgcttctttacgatgattgggtgttgaccctccgccaacccataaaccaacactaatttcgttgatacccagatcgtcacgatgctgacgcaagaattcaagagcgcagatcattgaagaggcacgttgaaattgttgtgcggtcaacaaacgcaatgtatagcgcatgataactgtgacacctttagcatcagcgtcgccgagacgctgatagagaaccaccaacgcaatggcacacaagtatgcctcagttttgccaccgccagtgcttatccaaatcaaatctaaaacgtcacggaagtcgcttctttcatttatcagtgaatcaatcgttgtgagtataaaggccagttgaaaagggcgccaagcaaaactcgtgtttgggtcgtcttccagattttcataggtgcgagaccgaaaacattgcatcttccgttcgaggtttttacttctttgcagtaagatagcctcgttagctagatcgaaggcgagcagagcagctgggtccttacgcaggacctcaataccttggtgtatgcggttgctgcagattcgacagtctcgaaggttgctattagcaatctcggcgtaacatgggttctccattttgatctcaggtacctgtagctcacgtttagcaatccatgcgtcgtatttcgcagcaaacttggtcaaggattgtatttgtgtctctttaggaacctcaaaaaggtaactgtccgggcggagtatgtccttactaagcccctccaaatcaaaagacatgggtgagagttcataggttgggatatactctgtgaatatggattgaacttcgccagcttgcggtaaccagccaaccgaaataccgtgcccgatagcgaaggttttcttgttgcggtactcaaagcgaattttttgatcttctttactaagctggtctaggtgagtatccatgacatcctcggaagcatagaacttgagtgagcgcgttgcattcaggatgacttgggtttggaaaaaaatcgtcgactttgaagtattctggacgaccaacgtgacggagcaaacttcccctttgttgtcagaaaggggaagttctcgtaccttcgcaaaaatcgataatcccagtggtttgccggatttcataatttctgtagtgaatcttggctttgtcaaatctaaagtgaccttggtggaaatcggacgacgctgataaatttggggttttgccttcttagatttttccgagcggtaattgagattgtaaagccgataaagaaacgcagtggcgtctttcatttccggtttttctttaagctgatcaagtaagtttctaagctgtttttggagacttatcggcttttgagcatagctatcagcatatgcaatttgtttttggtcatcagaaattttcaaaattggttcggttgcttgagcatcagttacaatgtttaaaatcgactcaagaagatccgttggtaaatcaatccaaggattgacagttgtgtcataaaccgatgtgttaatcgtgaaatccaaggtggaagttttcaagcagtaaaacgataagccaatggaactcggcttgaaagtgttatcgacaacgataggctcgctttcggcatcaaagtcgacatcttggtcatctccggaaacgccatctgttgctttgcttgctactttcggataaaggataccagtaatgtaacgattgcggggaggctcggagatgatttcgacgcttgaatctgagacgaaatgttcagaccctggtcctaatattttggcagtgatcgaattcagatagcgactgcgaatggcttcttgctttgactttgaaattctatctgtcatattttacctccgtgtcaatcttctagtaatctgttcgttctgtatctaggtaagtactcggatactggtgtgatagtggcaattgtcataaagctaatgggtgtgtcagtcatgtcgagcttttggccttcaatgcgatcaagtgcttgttgtcgttgatcttgataccagtcacgaaccgtaacgctcgattgccgatacgtttctgcgttttcttcgatgtcgagattattggtgagctgtccgatgatgcggatgaactccagatcttgaggaacaaacttaacgctattcggctgagaccagtaccggaaatatccctgagtgtgatcgagaccgtatcgtaggaatttctgtacaaggtcgttgggtgtcaagtgattagagcgaacgtatttgatgaacacttgtttccattcgaagtctttttgatggtctggatgattttcgaataatttagctaagctttcagtgctatcgaagagctttgcaaagtcattttggtaccatcgctcattttctatgcgctggacataggcaacttcatccatgggtttgaaatcagcaattggcttgtgacgaagaatgccctcgttgtcacgcgtgaggatggttgcagaaggagtgacaaacattttcgcccttttattttccagaaaagccaaccggtacttggctatgacatggttgtcctgcgtggccgttggcgaagtttttgaaagttgttcttttgtttcatcattcaaaatggattcttctcgctctaaagaatcggagtcttcttcgggagtcaattcagagtcttctttttccgatttgcatgttaaagagtttctcaagttagaaatactgtttacaaaagcggaatcataatcgacatcgacgagttgatcagtctgaaggacttgttttagaaaaaaaaggtcattggaaagagaagtggccagctgacgtgcgaagtcctttggtgcgacaattgtgacttctcgggcgatgccagaatacatccagcgacggcgctctgagatctgtggaacgatcataatcaggcgttcggggacataacgcctgtcgattgattgaatgggctcgccatactcaatcacatgagcttttttctttcgaaggttataattcgttctcatctctccggctaatactgagtgagttaaaatgacggtctgattatcaataattaaaccggcaagaagattatctaactgaacagcatagtttccattaaccaaccgagtaagatgttgcaaaagatcttttgcagtatcttcagcgacaatattttgaagttgcagctcatctttcaccaattggaacgcttgagcaacactttgggaatttgaaatcaccgaagaaaacagtgtttgctgaaaacgtcgcaaacttctctcgagatcgaagagttgttgatctctaatacttgccaagaattcggtaatttcggtcgattctgcgtcgattgtggcatcagtctgaataaagtttgcagaaatagtcctcgtcttgaactcatctgctgtcagccaactgtacagagtatccgacgcattcatgaaagttgcaccagcggtcgacacggcggaactaagcatggagagaatgtgcgtctctatcgagtgtctggtgataaaatcacggacattggccaacatgtccttgttcgagtacttccaccaagtatcgcctatcatgtagagcgtgaaacgtttgctgattcgttcgtggagaagggtatttagggtctgaagttttgaaacgaaggtaaccatgggaaccatcgttttcgtcgtaccttttagatgctttgtctttccacctgcagggtaatattcgcttggcacaacagcaccgaagctaagggctcttccttcaattctaaagttcatcttttcaaggcgatcaatgactaccttgtcggtcaaaattacaatgttagattcatccgttcggctgaagtgagaaatgtgaaaaagagcagctacttttgctcttgtgtcggtagttttccttgaggaaaccgattttgcaaggctgactgaggataagaaaatctctcgtgggatcgtcaatagcagtccatcagaatctgaggccattttgcagacgtcatggccattaagtttttctacgccgataaaagtataacttgtttccgcatatactagaggggtcccggatttgattttctctgggtaaaggacttggcgatcggctatgtttgacaatagtgtgcgtagagcagccaatgctgctaacgcggcagggacttgttctgataggtagtaatataaatagccaccgcctgagtcctcggcggctgtgaagtcgcgcaaaactttactaagcatcggatctttgttgaacagttgctttggtaaaaagctgatcatcttttccgtatacttttcaagattcattaccttccccccaaaaaaagaaataaaactaaacgctcaagttaaagcgtttacttatgagtataaactttttttatctgaccgtaaattttaaaaggtgtgaaaaagaaaatgggaagaacggagaaagaaaatacttcaagcaaccttttttggcggcatcaaaattgggctaaatccttgttgcagtttagattcatcacaaaaatagtcgtaaagttaagacagcaacaattaggttgtgccgcttgagcattgagctagaatattacatcacgttaatgcccgaaaaaaacacgcccaagacggacgtgttcgacaattatttgacctactgaactgagtgcacgaaactgcacgcaatagatcgcaacaaacaccgatgtaacagtatttgttgacaaaagtattaaagtttctggttatagtattcaacaaccagtgattcgtcaacttctggttcgagttcgccacgttctggtaagcgaacaagggaaccttccttcttattgtcgtcaaaggttacgtaagctggacgggaaaccgtgttctcgatagcttcattgacaacagcgaggttttgtgagcgttcgcgaagaccgatcacttggccaggctgtacttcataggaaggaatatcaaggcgcttgccatcaactgtgatgtggccgtggttgacaagttggcgcgcttgaggacggctggaagccaagcccaaacggaaaaccaagttatctaaacgggtttcaagcaggatcatgaagttatcaccatgggtaccttctttgatcttaccagcgcgcaggaacaagttctggaattggcgttcgtttaaaccgtacatccaacgcagcttctgcttttcacgcagttgctgaccgtattcggaaatcttacggcggttgttggcaccgtgatcaccgggtgcataaggacgacgagctaattctttaccagtgccggaaagggacaagccgagacgacggctttgcttccagcgaggacctgtataacgagacatatgagtattcctccaagtttttatttggagtaaaataacgaattgcggctttagcacacgggcagtcctgcaaaggttcaccttcgcagccgcggttactactgtcatcggcgtgatgccgaggcaggactggagccgaccatgccggccgctgctgcattattttacacgcgagctagtataccgtgtttagcgcggcggtgtcaaggtgactggcgagtgtttgaccgaactgtgtcaggatctgttcatcattttcgctaaaacggttgagtttcggggagtcaatgtccatgatggcaacggtttcgccattaacgttgatcggtacgacgatttcggcgttgctggctgaatcgcaagcgatgtgaccggcaaattcatggacgttagcaacgcgaatcacgctattttgctgatagctggtcccaacgacccctttgcccggttgaatgtgcatgcaggcaactttgccttggaaagggccgaggtcgagttgtccggttttgccattataaaggtagaaaccagcccagttgagctcggagatgctgtcatttagcagtgcactggcattggcaagtacggtgatggggttggtttcgcctgtaagtaggccatcaagttgatcgataataataggatcaagggttgtcatttgatcagtccttttaggaatttatgaaaagcagcatctaggccttttaactgcgggctttttttgcgatactggtagctaggatgttatcgtttttaacacttaacggcattttagccggtaagtaggcaaaatgcaattagaaagataatcggtaaagcagagggtgtagggatgatctggttcttcattattgttgcgattataattgtggctgctggcagtgtctggtggctgcagcattattttcaaacgcgtatcaaagacttagacgaaaaagtcgaagcgattgatattggtgcgctctcgagtcagattcgcagcattgagcaactgaagctgaccggtgacagtctggcaacctttggcaagtgggagcgggcgtttgatcaattaaacgaccatgatctagctgagctgcaaaaaattctgcttgatctcgaagaccaggttaaacgcttccgtttagatcgggcatcgaaaattgctaaggtgctggaagataaaatcgagacggctcagcgccaatacgaactgattagccaggcactacaagacattcggcacgacgaagcagataaccgtagtaaaatgttgcaattgcgagatgattaccaggtttcacgcaagacgattcttgccaagagttttgtcttcggtgatgctcagccagcattggagcaacagttgcagcaattggcgcagctttttcaaaaaattgaccagatcaataatgatggcgatcatcaggcggcaaaggcagaaattaaacagttagccgagcagatgcgggttttgaagaagcaggttaaggaattaccaccactggtaaacgagcaggtcaacgagtttcctggacaaattaacgaaattcagcacggttaccggcaactcaccaccgcccattatgtgttcaccgatgatattccggggatggttgcggatgtcgaggccaagatgaaggatgccaatgcggctcttaaatcgattgatgtggaggcaacagaggcagccaatgcggaaatcgaagctgaaatcgataaaatgtacgccattatggaaaaagagatgcaggccaagaaacgggtggatgttgcgtcccctgatttgcggcgcttcatcgatcatgcactgcgccaaaatcgggaattgcaggcagaattggatcatctgaaccaaagctatacgctgaatcatcatgaaatcaaaaccgctaaaaatttaaaaatgcagttagatgcgattgacgcaaattacacgaaggataccgatgcgattgaagcaggcgaggccgtgtactcggacgtgattgcgcggtttgatgaaaccaaagaacagttaacggcgattgaaaagcaacaggtccagattaaccaagacgtggcaggtttgaaaaaaggcgagatcatcgctaataaacaagcagagagttttgaactcgatatgcggaatattaagcatgaaatcgtccgccatcacttgccggggttgccgcaagactatgtggataaggttaaacatgttactgccgaaattgatcagcttaatcacgatttggatcaggttaaaattaacatggatgcgattgccaagtttctgattaagattgccagtgatattgatgatttaaagaaaacaaccagtgccttaattgatgcggccggattaaccgaagaattgatgcaatatgccaaccgttacaaaataacggttaagccggtagcagacgcggttaagcatgcgaccgaactgtatatgcaatttgactatcagcaggctgccgatacgttggcgaccgcgttggagcagacggagcagggcagctacaagaaagttgaagatgcttatcttgcgcggaagaaagcttcattatattgatttgcgtgattggaaagccagcttgggttggggctggcttttggtttggggtagaggttgtgatatggtgcagggatctgcagggaaaattgcagacttaaatggttaataatcattcagtagggtatatacgtctccgaaacgcgttcaccggcgcagaagtctgcgtgtaaggacctcgagcgcaatggccaagaccgggccatcacgctcaaggccacttacactccgacttctacccgcgccggttcactctcttgcttaaacgcgttcgccagcccagaaacctgcacataaggaccttgagcgcaatgaccaaagcccggtcatcacgctcaaggccacttatgcttcggtttctaaccgggctggctcacgctcttgaaacttactaactttttgtctataattcaatccagtcgaattaacggaaggggccggctgatgatttattttgataatagtgcaacgacgaagatttcgcctgatgcgttggcgacttataacaaggtcagcacggatttttttgggaatcctagcagtttgcatgctctgggaactaaagcaaatgaggttttgcaaagttcgcgagcccagattgctaaattaatcggtgcgaagccggacgagatttattttacgagcggtggaacggaaggcgataactgggtgattaaaggcactgccatggctaagcgcgaatttggccgtcatctgattacgaccagtatcgagcatccggctgtgatcaatacgatgaaacagctagagaaactgggatttgaagtgacttatttgccggttgatcggcgcggttttattcatattgacgatttgaaagcggctattcgcaaagatacgattttggtgtcgattatggcggttaataatgaaattggcagtatgcagccgattgttcaggccgcgcgggtgttggataattatccgaatattcattttcatgtcgatgccgtacaagccgttggtaagggcttggatgcagcgttgcaagacccgcggattgattttctcagtttttccggtcataagtttcatgctccccgcggtaccggctttatctatgccaaagagggtcgcatgcttgatccgttgctaaccggtggcggtcaggaacatgattggcgctcaggcacggaaaatgttccggcgattgcggcaatggccaagtcgctgcgcttacttttggctaatgaagatgctaacgtggctcggcagcaagcagttcgcaagcggatttttgatcatgtcagccaaaagcccaaggtgacgatgtttagtcagttaacaccggattttgccccacatgttttatgttttgccattgctggtgtccgcggcgaaacgattgttcatgtgtttgaggatcatcagatttacatttccacaactagtgcctgctcaagtaagaaaggcacggaaagcagtaccttggccgccatgcatacggacccgaaaattgccacttccgcgattcgggtgagtttggatgaagctaatactttggatgaagcggatgcgtttaatgcagcgtttgatacgatttatgcaaagtttgccaagcttgataaagcgaccgtctaaacgagcatcagccatttccagtgcgaggagtggccgggtgtcagtcatagcgactaatactgccaacttgttttgacgcatcaccggttttcattggatcggttaccgcctacatgaaaggattttaagatgcaatattcagaaattatggttcgttacggcgagctttcgaccaagggaaaaaatcggcaagcgtttatcggtcgtttgaacggtaacgttacacgagcgctgcatgaattccccaacctcaccattcggcctaaacgtgatcggatgcacattgaattgaatggcgagcctagtgatcaggtgatggcacgactgtcacaggtattcggcatccagaatttttcaccaagtattgccgtagaaaaggatatggcaaaagtccacgaggttgcgttgcagctgatgaatgaaacggcaccgcacggcattagctataaggttaatacgcggcggagcgatcatgactttgccttggataccaatgctatgaatcttgatttaggcgatttcttgacggataagcggccggacttagttgtcaaaatgcatcatcctgatatgattttgcgagttgaagtccgtcgtgaagcaatttatttatccactaaaacaattcaaggtgctggcggattgccggttggaacagcagggcgcgcggccttgatgcttagtggcgggattgattcgccggttgcgggttactatgcgttaaaacgtggcgtggacattgaaatggtgcactttttcagcccaccttacaccagtcaacaggcgctgaataaggctaaacagctcacggccaagctgaccccttatgttggccggatttactttattgaagtaccatttaccgagattcaggaggcagtcaaagcaacggttccggaaggttatctgatgaccgtgcaacgccgaatgatgttgcgactaaccgaagcgattgccaaacaacgtggcgatctggctatctttaatggtgagtcagtcggccaggtggcttcgcagacgctggaatcaatggctgcaatcaatgatgtcaccacgatgccgattattcgtccggttgcgaccatggataagaatgagatcattgccgaagcagaaaagatcgacacgtatgatttatcgatcatgccgtttgaagactgttgtactatttttgccccgccgtcgcctaaaaccaaaccaaagacggatcgcgcacggtattacgaaagcaaacttgatgtcgatggtttgatggcgcgcgcgttggccggaatcaaggttcaggagatcaagtcatctgatcagttcctgaatcaggatcaggatgttatcgcagaattgctttaaaaattgaataaaagcggtagttgctgataagttatttgcttatcggtaactaccgcttttttagtttagcgttaaaagtcggcgaatgatcttaaaaaagaaataattcacaagatttcgcgatattaataagctgctggagcgaatgccatcatggttgcccgaaaaatggttgtcacctgcagaagacgcattgtgcttaattcctggtttgaaaagatcgttaatataaaatgggtcagtaaaaacagtggtaaaagagcgcgcaatttgttaaacttaatatgtgaaaatggtaacaaacatgtgcggaggtgttgatggtggtcgtcagtaaacaagcgttatcacaagcaacgattaagcgaatcccggtttattatcgaaccgtcaaagatttgcaacagacgggggttaagcgggttcggtctgatcggctaagtaagctggttcatatcgcgccagcaaccattcggcgggacttctccaattttggcgatttagggcgcagcggctatggctattcggttgatttacttgcacaggtgtttggcgagttattagaagtgcactcggaagaacagatgttactggtggggtgtggcaacctcggacgggcgttgttgaccaataattttcgccggaatccggatctgaccattgtggtgggattcgacacggatccgcagctcattgggacgacaattgccggggtgccgatttttgatctcacaactttagccaaaaatattcgcccggggatgcatactgccattgtctgtgtgccgagttccgcccagaccagcgttattaaccaacttgaggctaatggcataaccgctattttaacctttgcccctaagccggtcccggcaaaaccgacaaccacgattcgctatattgatcttacgagtgagctacaggcgttattgtttgttgatcatcaaaaacaggtttcgcgacaggtgacggaaccgttgcgctagcgttacttgacgcgctggatcacgctcgttataaggcgttcagctgcccagaaatttgcatataaagatcttgggcacaaatccgcttttacgcccataacgcgctccccggcgcagggacctgcatgtaaggaccttggtcgcaatggccagacccgggccatcacgaccaaggccacaagtccgcctttacgcccataacgcgttcaccggcgcagaagtctgcgtgtaaggaccttggtcgcaatggccaagcccgggccatcaagaccaaggccacttacactccgacttctaaccgcgccggttcacgctcacctcacattgaccctgtcatgatcacgggttataatgcagctaatgcaatgatcaagagggttgcgttctttttttccagcgacgggatggttggtgtgaatctcgaaagaagaccgtgattgtagcttgtgagctgccgtcctgaagtgagtagggaacggccggtgacagccgttatcctgaaccaagtggggattgattcccaatttaggtggtaccgcgagtagactcgtcctaataatcgatattagggcgtttttttgtgtatacgcacggcgcgacccagcttccgggttggcgtgcgtgtgatgcatcggcgcgtgccaattctagaaaccggatggacgaaaaaattttgtgaggtggagccagtgagtgatgaaacgttagcaccaaagtatgatcataaagcagtcgaggaaggccggtatcaggaatggcttgatgaagatgtcttcaaaccaagtggtgataagaaggctaagccgtattcaatcgtgattccgccgccaaatgtcaccggtaagttacacatggggcatgcatgggataccacgcttcaagacatcgtgatccgccaaaagcgtatgcaggggtttgataccttgtggctgccagggatggatcatgccggaatcgccacgcaggctaaagttgaggcaaagttgcgcaaagaaggcatcagccgctatgacttaggccgtgaaaagtttgtccagaaagtctgggaatggaaggacgaatttgccaagacgattcatggacaatgggccaaaatgggcttgtcactggattatagtcgggaacgttttactttggataagggcctgaatcaagcggttcgacgggtgtttgttgacctttataaccagggtttgatttaccgtggcgaatatatcgttaactgggatccgcaagcgcgcacggcactatcggatattgaagtcattcataaagacgataaaggtgctttttaccatgtaaaatatccattcgcggacggtagcggctacattgagattgcaacgacgcgtccggaaaccatgatgggtgatactgcggtggccgttcacccaggcgatgaacggtataaagatatggtgggcaaggaacttattttgccattagccaatcgcaaaattccaatcattgaagatgcttacgttgaccctgagtttggaactggggcggttaaaatcacgccagcccatgaccctaacgactttcaggtgggcaatcgtcatgatttgaaacgaattaacactatgaatgacgatggcacgatgaacgaaaatgccggcaaatatcaaggaatggatcgctttgaagcccgtaaagccatggtggctgatttggataaggccggtttattgcttaaagttgaaccgattgtgcacagtgtcggccatagcgaacgtaccggcgttcaagttgaagcacggttgtcaacacaatggtttgtcaagatgaaaccattagctgaagcggcaatcaaagcgcagcaagaaccggacaagaaagtgacatttgttcctgagcggtttgaacatacctatttgcagtggatggaaaatattcatgactgggttatttcacggcagctgtggtggggtcatcagattccggcttggtacaacaagcagaccggcgaaacctatgtcgggatggaagcacctaaagacattgaaaactggaagcaggatcctgacgtgttggatacctggttttcaagtgcgttgtggccattttccacgatggggtggccgaataccgatgcgccggattacaagcgttattacccaacagataccttagtgaccggctatgatatcattccattctgggttgcgcggatgattttccaagggttgcattttacccatcaacggccgttccagtacaccttgattcacgggttaatgcgtgatgaacaaggccggaagatgagtaagtcactgggtaatgggattgacccgatggatgtgattgaaaaatacggcgccgatgccttgcggtggttcctgattaccggtaataaaccgggacaggatacacggtttagctataaacaggttgaagcagcttggaatttcatcaataagatttggaacatttcccgatttgtgatgatgaacctaggcgacttggatacgccgcaacagccagatccaagtacctttgatttgtccgacaaatggctttttgcgcaattgaacgaaaccatcaagcaggtaatggatttgtcggcgcggtttgaatttggtgaaatgggtcgaaccctgtataacttcacctggaatgttttcgcggactggtacgttgaaatgagtaaggaagtgctttacggcgatgatgagcaggccaaagcagccaagcgcgtcaaccttgcttatgcactggatcagattttacggctattgcacccagtgatgccgtttgtgacggaaaaactatggttggcgttaccgcatacgggcaaatcaattgtgacggcgagctatccagtggcaaacactgcctttgaaaatgctgacgctaccagtgcaatggatgcgatcattgcgctcatccgcggcgttcgcggaatccgtaaagaggccggcgctccgcttaagaccaaagtcgatattctcgttaaattgacggatcctgctttgaaaccaatctttgaacagaactttgactttatcgatcggttcgtcaatagtaaagccttcacggttggaaccgatgtggccgagcctaaaatggcgggcagtgcggtgatcacaggcgccaccattttcgtaccgctcaatgaattaattgatttggacgaggaaaaggccaaactgactaaagacgctaagaagcttgagcaagaaattgcccgaattgacaagaagctcaataaccaaggcttcttatccaaagcaccggaagcggttgttgcagaacaacgcactaagcgcagtgattttgaagatcagctaacgagcactaagcaacggttggaacaattacaacgagcttaagttaccaagtggctttaagcgattttatggtgaaaaaaccggtattagggttgagttttaagccctagtaccggcttttttgatggtcgtggttaaagcatgccgcaagcaagcaatctggcgcgcggccgtttgtccgatgggttctggcagcaatgaaaacgtaaatttggctggctaagctcataagttagacccatttttctggtatgatgaagctatatattgcagcagtatgaaagctggctgcctaaatgataaaaataaggaaagttaacaatgaattacacagaaagcgttgcctacattcattcttttccgcgtttggccaagaccggtgaccatcggcggattttaacgttattacatgcactcggcaatccgcagcaacaagggcggtatattcacgtgactggtactaatggaaaaggctcagccgctaatgcgattgcacatgtccttgaggcaagcggtttgacagtcgggttatatacctcgccgtttatcatgcggtttaatgaacggatcatgattgaccatgaaccgattccggatgctgcgttagtcaatgcggttgcgtttgtcagggctgcactggagcggcttcagcagcaacaagctgattttaacgtgacggaatttgaattcattaccgcgctggcgtattggtattttcgtcagcgtcaggttgatgttgcggtgattgaagtcggtattggcggcgacacggattcgaccaatgtcatcacgccggttgtcagtgttttgaccgaggttgctttagatcaccagaagttgctggggcatacgattacggcgattgccaagcataaggccggtattatcaaacggggtattccggttgtaaccggtaacttggtgccggatgctgctgccgttgtcgcagccaaggtcgcgacaacagggagtcaatggttgcgttttgaccgcgatttttcggttcctaaggctaagcttcacggttggggccaacggtttacttatgaagaccaagatggacgtattagtgatttggaggtgccgttggttggcgattaccagcaacgtaatatggcaattgcgattcaaacggcaaaagtgtatgccaagcagacagaatggcctttgacgccccagaatattcgccaagggcttgctgccagtcattggccagcccgactcgaaaagataagtgatacgcctttgatcgtcattgacggggcgcacaatccggatggcatcaatggtttgattacggcgctaaagcaacttttttcccaacccattactgttattgccggcatcttggcggataaagactatgcggcgatggcggataggctgaccgcggcattttccacggtttatctggttccggtgccggggacgccgcgcgccttgcctgaggctggttatgaggcgctgcacgaaggtcggttaaaggattcgtggcaggaagcattggcggcgagtcttaatgatgtgccggatcagccgattgtgatcaccggttcgctgtatttagcctcagctgttcgtcaaactttattagggggaaaatcatgaccgcaacagtcatctttgatcttgacgggacactggttaacactgaagcactttaccttaaaagtaatgttaaagccgcggcagtattgggactgcaccggacagaagctgattttcggccattagttggatctgccggaccaagtgaagctaaaatcattgccgatttggttggggccgatcatgccgcatggttccagcaattttcaacccaggatgttttggaccagattcgcagcggtgccgattttgtcttacccggagctgacaaaacgttgcagacgcttgatcagatgggttatcggttagcgttggcaacaagtagtgccaaacattacgttgacgtggtgttggctgcaactggttgggtgaagcggtttgacccgattctgactggcagtgatgtgacggcacacaaacctgatccggaaatttatcacgtgatgaaaaccaagttgcctgagacaccggcgattgtcgttgaagatacgcatgtgggtgtggccgcagcagaaggggctggactcccggtcgttatgattccaggcatcggtcaagggccggatcataaggcgaccgcgattttagctgcgatcacggatttacctgactggctgcaaaatcaccctacctttgcgtaatgtccataatgagtcttcagatgactcaaaatggcggccccatcagagaaggctgaagaggatgcagtcccactctgaaagcggcatgacggagggaaagacgatggcagatgcgactgaacaaccacgtgagcgtttattggcgcatggaccacaggcactgacggatgcggaattattgcaattgattgtgcgcgcaggcaaccagcactatccggtccaggaaattgtcagtgaggtgttgaccacttatcctgcattacgaggcttagcagaaggtgatggtgattcactggaccatattcgcggactgggcgcggctaaacgggccagcattttggcgggtgtggagttaggacggcgggtcatgcgtcgtcaatcggttcgatatgggcagatcaaaaatagcgagcaactgggtaaaacgatggtgtcacgctttgccggagctaatcaggaatccatgttgattttatttttggatgtcaagaatcagatcatcacggaacaaatcgtggcaattggaacggtggattcagccttagccgatccgcgggtggtgtttcgggaagcattaaagctaagcgccacgaatttgatcatggtgcacaatcatcccagtggtgatccttctccgagtcaggccgatcgtgatacaacaacgcgatttcagctggcggcagcgttactcggcatgcacttgcttgaccacttgatcatcgggcggcagtcgtattattcgtttgcgcgcgatgatccggaatttaattaatttgctaaaaagttgtaaggttttctgaaattggcgcaatgagggcaaaaacaggcggtttcacattttgtcatagaaaataatatgctataatgcatggagttaatacgaaatgagtcagcataaggagagaacgtcttgtttggatttggatcaaagaatatcgggatcgatcttggcaccgcaaataccttagtttacgtcgacggcaagggcattgtgttaaatgagccctccgtagtcgcgaagaatacccagacggaagaagtcattgccgttggtgaagaagcccgcgacatgatcggtcgtaccccgaccaatatcgtggcgatccgaccaatgaaagatggggtcatcgctgactacgacacaactgcggccatgttaaaatacttcatgcaaaaggcattaggtaacggcagccacccgcaagtgatgatttgtgtgccaagcggcgtgacggaagttgaaaaacgggccgttattgacgctgcaaaagtcgcaggagcacgcgatgctttcgtcattgaagaaccttacgctgctgcaatcggtgccggtctgccggttatggacccgaccggtagtatggttgttgatattggcggcgggaccactgatgtcgcaacgatttcattaggcggtattgtttcgagtcgctcgattcgggtggctggtgacaagtttgatgaagccatcatcaatcatttacgccagaactttaatttgctcatcggcgaacgtacggctgaagccatgaagattcaaattggttcggcatcggttgaaaaggctgccgatatcgatgggatgaccgtgcgcggacgtgatttattgagcggcctgccaaagaccatcgacatttcggccacggatattgcatctgctattcacgaaaacgtgcttgatatcatcacggcgattaaagaaacactggaagaaacctcaccagaaatcgctgccgatgtcattgatcatgggattgtgttgacaggcggcggtgcgcttttgaagcatttaccggatgtcatttccgatgagaccaaagtaccggtcttcattgcgcaggatccgctagattgtgtggcaatcggcactggtgaatcgttgaagaatattgacgttttaaagaagcgttaacagcccataaatgaagatggtttgcgtgtggcaagaggctgggatgaaggatcctggcctcttttcgcgagtgtgacggaggaaccaatgcagaaattcttttccaacaaaaaattgatcgccctcatgatcgcattgctggtcagtcttggtctggtcgctggatcaatctatgcgagcaataatcgcaatacgccgccgtttattcagcggattgccaatgatgttgttggcatcggtgggcggttagtcgcgttgccgggagattttgcccgcaatggattagatgacatcaataatctcatggatacgtttcaggagaatcagcgcctcaagcaacagctggataatttagcgcagacaaaggtgcaggtacaaactttaaaacgcgaaaataagcagttgaagcaacagttgaaacttaacggtactttgacggattacgcgcagatcagtgctgctgtcattttacgaacaccgagtgactggcgcaacatggtcgttattaaccaaggaagtgccgccggggttaagaagggcatgccggttatggcaggttccggcttgattggccgtgtcgttgaggtcaatcggacgagttcaaaagttgagatgctatcaacggccaataaatccagtgaccggattgcggcggccgttgagaccaaaggcgaaaaagaagttaacggcatcattaccggatatgacgaaaaaaccggtgatttgattctcggcgagctgaatacggataccgcgattaaaaaaggcgatgaggtggttaccagtggcttaggtggcatgacacctaaaggattactgattggcaaagtcgccagcgtcaagaaagatgactatggtctggccaacaccgtttatttggatcccgccgcaaatctaaacgatgtcaccgttgtaaccgtcatctcacgtacgatcaaaggtgactaacatgttaaacgaaaaacatttcacaggacattggtggatctttttactgctgcttttgttattattaattgatggcagcctagcatcagtgctggcacagtggatcatgcagccgaactttatggggacgccgcaattgaccttgttagggttagtcatggtgacgttgttggtgccgcaagaaaagtatataacctggattgcggcattgattgggttgctattcgacagtttttacacgggcattctagggattaatgcgttactgtttgccttggtcatttacgtggttcgccagattcggccgtatatcccgcacacgccgatttttgttggtatggtttatattattgctttgttgctctatggggttgccagttatgctgcgaatcattttattggctacggatctgccagtgttgttatgctgatagcgaatcatttagggccgggattaacggtcaatctcattctttttgtgattgtctatggtccattacatcgattgttgatgaatttagcggaagaataatttggggtgataatgtggacagtgtggtcttaaaaggtcgaaatgatagtctggcgctgcaccttcaagatacagcggactttacgcagattatccagacactgaaaacattactaggcaaattgtacgaagaaacgccaaccggtgatgtcagctatcgtttggagacgggcaatcggcttttaacggaagagcagttggcgcaaattcaggctgtatttgaagattacccgcgcttttcaattaatggcatcacgagtgctgtggttgataaagcggtcgttgccgatatggtgacggctaaaatgacccatcgcatcggtggtgttgttcgatcagggcaaacaattgatgtcatgggcgatgtgctgtttttaggcgatttacatgccggtgcctcgctgtgtgcttctggcaatgtctttgtgatgggcaaagttagtggcgttatccaggcaggcagtcaaggagacacccgcgcagttgttgtgggtgacttgcaaggtgctagtcaggttcgaatcgccgatgtcatcgaaattgtcgctgaccattatgatccggttaaaccggttgcttatttgagcgaattacatacgatggcacataccaagttggctgaactagcaaatcttcggccgcgattatttaagcaaatggaggcaatgtagatggggacagcgttagtagtgacttccggtaaaggcggcgttggcaaaaccaccacttcggcaaatatcggtaccgcgttggctttacaaggcaagcgggtcgtcttgttggaccttgatattggactacgcaacttagatgttgtcatgggtttgtccaatcggattatttacgacattgtcgacgttgccactggccgcgcaaagctacaccaagcgttgatcaaggacaaacgatttgacgatttgctttatttactgccagcagcgcaaaatgcggaaaaagacgcgttagaacctgatcaggtcgttgagattgttgaacagttacgaccggattttgattttattattttggactcgcctgccggaatcgaacaaggttttcggaatgcgactggggcggctgacggtgcgattgtggtcacgaccccggagatatcggcggtgagtgatgcggatcgagtcgtgggcttactggaacaacgtgatatgccgctcaaaccgcgactcattatcaaccgcattcgccaaaatatgttagctgatggacgctcgatggatattgacgaaattaccagtcatctgggacttgatttactcggcatcattgttgacgatgatggagtgattgagagttcaaacaaaggtgaagcgattgtgatggatccggatgaccttgctagtaaaggctaccgcaatattgcccgccggttactaggtgatagcgtgccgttgatggacattcgtttgaaaaaacaaggcttttggtcaaaattgttccatcgccatcattagacggtttacggtgattttgtgccggctgttaaagattaattttctgaaacagttgactttcgttaaagttcggtgtaatttagtgataattcattaaagcgttgagtggaatcgataagcggtcatggttcacagcgagttcgggttgatgggaaccgaatagccatccgtttatcacacatccatgagtggacgattgaacaacagtaggtcgtctcggttgggctcgttatcgccgtggttgaagcaactacatgaggttgattgtgtgagcaattgacaaatctgaggtggaaccgcggtttaagccgtcctcttacagcaaagtgctgtaagaggattttttaatggtcgcgattttttcgaaatcatgtgcggtgctgcaaccacatgaggccgggtgtgtgaacaatcggtaaactgaggtggtaccgcgcagaagcgtcctcttgcatcaagcaagaggacgcttttttcataccacgaacaagttgcccaaccgctcaactcatcgacagccacaaagcgcaattagaaaagaaacggatctgcgcgactcaaatataggcaggttcaaaggaggaagcaccatgacttatatttttcagattttaccggcattattatctggtgtgaaaatgacgttggggatttttgccatcactttagtcggagccattccactgggtctcattttatcagtcggcctaattcccaagcctaaatcgctacttggtaaggcaggaaaaagcttgctggaaggctatgtgtgggtatttcggggcacgccgctgttgttgcagctgatgtttatcttttacggcttgccgattatcggtatcgtgtttgaccgcttctcagctgctttagtcgcgtttattttgaattatgctgcttacttcgcagaaatcttccgtggtggctttggcgcaattgatgaaggtcagttcgaagcaagtacggtcctcaacatgacccgctggcaggcattgcggtttgtggtgattcctcaggttgtcaagattgtgctaccttccatcggtaatgaagtcatcaacttggttaaggattctagcctggtttacgtcattggcttaggcgatttgcttcgagcaggtaacattgccagtgcgcgggatgttaccttgctgccactggtattggtcggggtcatctacttactgctgacgctgattctgacgttcttacaaaaacggatcgaagcagcattttcatattatcgctaggagggttaaaaatgttagaactcaagaatatcagcaaagcgtttaacgggcgaccggttttaaaagatgttaacgtcacgattgaggatggcaaaacattggcgattgtgggtcccagtggcgccggtaaaaccaccttattgcggatcatcagcggtttagaaagtgctgatggcggcaccatgatctggaacggtcagccgacgaccgcgcaggctttacgcaaacaaggggtgatcggcgtggtgtttcagaactttgaattattcccgaatttgtcggttatgcgcaatattaccttggcgcctactttgcagggggttgatcaacaaaaagccgatgcgacagccaagaaacttctgaatcaacttgaactaaccgatcaggcgcaggcgtatccttattcactgtctggcgggcaaaagcagcgggtggcaattgcacgggcgttggcattaaatccgcaaattcttttgtacgatgaaccgactagtgcgcttgatccgatgttgcgcgataatgttgctgcaatggtcaaccaatttaaagtatcaggtatgactcaggtggttgtgacccatgacatggactttgcccaaagtgttgcagacacgacttatcacgttggcaaaggcggtgatggtcaatgaaacggcgaatgataatggccgtcatggtgtttttgaccatggccggtatcgtaatcagtggatgcgcgcgcgaaacagtcgacaattcctggccacgcattgaacggaccaaaaaagttgtgattgggctagatgatacctttgttcccatgggttttcgtcaaaaaaatgggcagttggccggctatgacattgatttagccaaagcggttttcaaacgatatggcattaaagcggatttccagaccatcgactggtcgatgaaggaaaccgaattgaaaaatcagaccattgatttaatttggaatggctattccgtgaccccggagcggaaagcaaaggttgctttttcgaatgattatctgattaaccatcaaattctggtgaccaaaaccaaaagtcagattaacacgttgaaggatatgaaggggaaaaccttgggcgtgcaaaccggatcaagcggggcatttgatttagatgcccaacccaaattgttaaaaaatatgatcgccaacaaaacgccgatcctttacgataccttcaatgatgcatttattgacttggatgctggacgaattcaaggcattttaatggatgaggtttacgcacgttactacattgcccacaagccggatcctgcaagttatcacattatcggcgactcattcccgccagaagagttcgcggttggtatgcgcaagtccgatcatgttttacgagagaaaattaacgcgggattgaaggcgttgaaggcggacggaacgattgctaaactgcagaagaaatggtttggcaaggtcgaacaatgagttgtttgttagcgctgataagggttcagagtttagacatcgtggcaattttatgttgaggctggaatcattgtggttgtgtggatactgtctattgcgacaggtaactgcatgaaaactttgattctggcttttttgttggttgttcaacacgcctcccttaacgcgttcaccggcgcagggacctgcacatcaagaccttgggcgcaatgaccaaagcctggccatcacgcctgaggccgcttgggttctggtttatgtccataacgcgttcgccagcccagaaacctgcacataaggaccttgggcgcaatgaccaaaacccggtcatcacgcctgaggccacttatgttccggcttatgcccataacgcgctcaccggcgcaaaagtctgcgcgtaaggatctcagtcgcaatggccaaagcccggccatcacgcctgaggccacttatgttccggtttatgcccataacgcgctcaccggcgcagaagtctgcgtgtaaggacctcaggcgcaatgaccaaagcccggtcatcacgcctgaggccactagtccgcttttacgcccataacgcgctcgccagcccagaaacctgcacataaggaccctgggcgcaatgaccaaagcccagtcatcacgcccaaggccgcttatgttccggtttctaaccgggctggctcacgctcactggactttttcccctgattatcggtaaagtagagtatgataatcgcatgtagagactggacgaatggctgaggtgtgagattgtctggttagggaggcgaaatttatgtggcttgggctgattgttggcggtctttatatcatcaatgcatttattgcgattgtgacggtgtttcggtcccatcgtgatatttctgctgtatgggcgtggctgcttgtgctgttgctgctgccgtttgttggtttcttaatttattttgtctttgggcgtaaactgcgggcggatcgcatgcaggatttaatgacgcaacggctattgggtattaatgatttggtggttcagcaacaagaagcgcttgcggcagggcagccgttgattgggacgccaggtagcggtggggtttcggagctggtgcgaacgttattgcgggcggacgatgcgttggtcacaactcacaatgaagttcaggtgctttctttgcgggaagccttttttaaacagttatttgaagatattggcttggctaccgaacatattcatattgaagcctatacgattcagcctgatgcagtgggccggcaattgcgtgatttactgattgaaaaggcgcaagcagggatcaccgtgcgcgttttatacgatacgtttggttcccacggtttaccgattagcttttggaaaggcttgacagcagccggtggtcaggtggagcgatttgtggcgaccaaactcggacggtggaatccgcgcatcaactttcgcaatcatcgtaaactgattgtgattgatgggcatttggcatacttgggtgggtttaatctgggcaaagaacatcgcggtttgccaacactgcgggatactcaactacgaattcaaggtaaggcggttgccgtgattcaagcgcgtttcctgatggattggaatggtactagcaagaggcaacaggtcaaagacgtcgatgtgctgtttcgtgaaccggttgtcaccggaaacacaaccatgcagattgtcgctggtggaccggggcagcaggttgaagcaattaaacttggctatttaggattgattaatcaagccaagcgtagtatctggatcgagtcgccttattttgttcccgatgacagtttgttggacgcattgaccattgcggctaatgcgggagtcgatgttcgcattatggtgccgaagaaaacaaatcagagtctgatggccaaagcatcgcagttttacctcaatcaagtagttgccaatggtggtcaggcctttttatatgaagaaggtttcttacacgctaaaacgattgtggttgacggcaagtatgtttcaaccggcaccgcaaatttcgatatccgttcatttaaattgaactttgaagttgctgcgtttctttatgatcatcatttaggcaaaacatttcaaaaactatttcttgcggatatggaacgtgccatgccgtatacgcaaaaggtcattaaggccaagaaacgaccagcacgcttggccgaagagttatcgcggttgctggcgccgattttgtgatgggcgaaccattcactgattttttggcaattaaaaaagccgctgaaaaatcagcggctttgtggtcatttggtgatcggattagatgatttgcaaacttgcgagcgcggtgagaacaacaccaagcacggtgataataatcatcacccaagcactaataattgtcattttctggaatttgctctttttctttttctgcaccgaaaacaccacctttaaagttcttctgggtctcattgtactggtttttggaaaaaacggcaactaaaactgagcgcgagccggcgcggttagaaaccggagtgtaagcggcctcggacgtgatggcccgcttttggccattgcgttcgaggtccttacacgcaggtttctgcgccggggagcgcgttatgggcgtaaaggggaactattggccttgggtgtgatgaccgggttttggtcattgcacccaaggtccttatgtgcaggtttctgggctggcgaacgcgttatgggcataaagggggactagtggccttgggtgtgatgaccgggctttggtcattgcacccaatacaatgtccgtacacgcgaattcctgcgctgaagagcgttaacttctgcttgacgcctttctttcctttgggtacggttaattgagaagtatcaacagacagcaccttacgtggttgctgccgctggagggaattgtcatggtgttgcttgcgttgggattaccaattttagtgtggctcttggttgttgccgctgtcgtctatttcgactttcatggtggttcgtggttttttttactgacaatggtgaacctctgggccattttcgagttaacctttaccaaaagtccgaatttcatctgggtgatcctgtttacggcgatggtgattgccttaatcctggttgtttggcaggtaatccgcgaatatgacctgattattcaccgatattggcggatgctgacgcgcattctctccctagcaaccacttgttggtggcttagcggtatttttatttattttatgggctgagtcaccaccgacttaccacttgtgaaaaaatcccgtgatccttgtgatcgcgggattttttgtggcttaaatgttttttaaacaataaaataactaaattttgcttcagaagtggttagatgtggagaagagtggggcgttgtggtagactgaaaatcgtagggaggtgcaggccatgctcatgggtgaatttgaacgcagtatcgatgctaaagggcgtctgattattccagccaaatttcgtgagcaattgggtgcatcgtttgttttgacccggggcatggatggctgcctttttggttatccaatcgcggaatgggacaaactgcaggcaaaattggccacattacccttagctaaaaaagatgcccgcaccttcacgcgttttcttttttcggctgcgaccgaatgtgaaattgacaagcagggacggatcaatattcccaagccactgttcaaacatgcggcgttgaaaaaggattgcgtccttgtaggggtcaatacccgcattgaagtctgggatgccgagcgctggcagcaatttgccgacactgctgaagaagactttgatgacatttcagaaaacttaacggactttgggttatagccatgacagaatttaaacacgagacagttcttttaaaagaagcaacagcggctttggccgtgaagtcggatggtacatatgtggatgccactttgggacgcggaggccatacccgccagattttaaatcagcttacgaatgggcgtctgatcgcttttgatcaagacgaagcagccatcgccgcggtcaagcgtcattttgggacgttaccaccgcagttaacgctggttcaccgaaactttcgggatttaagcgcagccttggctgatttggacattaggcaggttgatggcgttttgtacgatcttggtgtatcttcgccgcaatttgacgattcaaagcgtggtttttcttatcgtttcgatgcaccgcttgatatgcggatggatcagcggcaaacgcttgatgccaaaacgattgtcaatgaatggccgtatgctgaattggttcggatcttttcgcgctatggtgaggagcatttttctaagcagattgcgcgtcgaattgagcaagctcgtgcccaagcgccgattacaaccactttccaacttgttgagttgatcaaggcaggaattccggctaaagcaaggagaacgggtggccatccggctaaaaaagtctttcaggctatccgaatcgcggttaatgatgaattatccgcgctagaagcttctttggaacaggcactcaagctgattaacgttgggggacgcatcagtgtcattaccttccagtcattagaagaccggctggtgaaaaccatgtttaaagaagtgtcaaccgtccaagatgttccgcgcgggttgccggtggtgccggaagctgctcaaccacattaccagttagtcaatcgtaaaccgattttaccgagtgcggccgagctggctgaaaaccatcgtgctcacagcgccaaactcagggtgatcgaaaaaattcgcaattaggggggttccatatatgcttgagagtacagcaaggcctttagtgcaacaaccggcaccgaaaccggtacataaatcagctcctgcacccgcaccgcacacacatattgcttttagcgggttcgagaaaacgatgatgtttgcctgtggcgttttagcaacagttgtttgtgtcgtttgtttgttcatgcaaaatcgcttgagcaacacgcaacgccagtatgaagatttacaggcgcaaattatgaagcaatcgcaagccacggcgaatctcaagcaagaaattggcgaactctccaactccgaacgacttgatgcctttgctaaggcccatggatttaaagtcattaacggcaatataaggcgtgttgataatcaatgaaaattttcaaatcaaaacgatcaacgaatgcacatccagcccgcaaccgtaaatttttcggtattgggctgatcgggtttacgcttctggtactcggtgggttcgttcttcgtttttcttttgttgcaaccattggcgaagtggattcaaataatctggcgaagcagcggcaaaagcagtatcagaccgacaccgttttgcaagcgcagcggggtgctattttggatcgtagtggtaatgtgatcgccgaagattcaaatacgtataccatttatgccatcctcgataagcaaaacaaaaatggcgataagcctgattatgtcaccaacaaagctaaaacggccaaaatactgagtcgttatttggcgattggtgaagataaagttttagcacgtttaaatccaagtaagaatcttttccaagtcgagtttggtcggccagggacgaaattaagtttggcgatcaaaaaacaaatcgaagctgagaaattgccggggattcattttcgcgaaaccccatcgcggctttatcctaatggtgtgtttgccagtcatgtgattgggttggcacaagagcaggataatggcggcggtttgaccggggtgatggggttagagaaacaatttaacaccgttttaaccggcaccaatggctatcggcgaagtgaaacagatgcatatggatataaactgcctaatgccaagaccaaagccaaggccccagtgaatggcggcagtgtctatacaacgcttgatagtggtctccaagcttatttggaaactctcatgacagatgttcaaaccaaatatgaacctaaaggcatgacggcggttttgatgaatgccaagaccggacgtattttagctgccacacagcgtccgacgtttgatgcttcgactggcgaaggattaggcgatatgtggcgggattctttggttgaggataattatgagccgggatcggtaatgaagatcatgaccttggctgctgctattcaaagcggtaagtatcaccccaatgaatatttccagtccggatctgttaagcttgatggcggcacggttaacgattggcggacaggcggctggggatccattccgctgagcaaagcgtttccgttatcgagtaatgtcggcatggttaagatcgaacaggaaatgggtgccggcatttggaagagctatttggataaatttaaatttggccaaaaaaccggcattacgttaccgggagaaacaagtggccggattagttttcaacgcccattggatcaggctatcaccgcctttggtcaaggcattgaagtcaatgtgatgcaaatgatgcaggcaattagtgcggtggcaaatgatggcaagatgcttaagccgcaaattgtatccaaggtggttaataagaacggtaaagccactgtttataagccggaagtggtgggtcagccgatctcaaaagaaacggcagctcgggttattgatgccatgcgtcacgtggttaatgacgaggacggaaccggggtggcttataaaatgccgggtgttgacttagccgttaaaaccgggaccggtcagattgctagtgctcaaggcggctatttaaccggggattccaattacacgtttagcgttgccggaattgcgccggcttccaatccaaagtatgtcttatacgttgcgatgaaacagccacagaagatgacggaaccagcggaatcaatcttggcaagcatcttcaagccgatgatgcaacgggctttggacacaaccgcgaatagcacggtgtcaggtgaaaccaacactgctgaagtgcctgctgtcaccaatgcggcgttggcgagtgcacaggatacggttaaaaaggccggatttgacgtagcaacgatcggaaccgggaataaaatcgtccaacagttgccagcaagcggaaccaaagcattgcgggattcacgggtgttacttttgacgaatggtgccatgacaatgcctgatctcactggttggtcgaaatccgatgtgttaaaatttgtacaattgaccggcaagaaatttaagcttgtcggtgatggcttcgttgttcggcaaagtattgctaaaggtaccttattaggtaatgccagcgggacaattgagtttaaacaacaatagaattggggatagtcatgcaacttgctcaaatgctcattccgatggtttcggcatttgccattaccattatgtttatgccgctttttatcggttacatgcggtataagaaagaaggccaggtgattcgtgaagaaggaccaagctggcacgaaaagaagtcaggaaccccaacgatgggtggcttgatattcattgctgcgatcatcatctcggctatttgggtcagcatttggcagcaccaattaacgctgagtgtctggatttccttatttattttggttctttatggcttgttaggattttatgatgatttccagaaattggtgcaccatcgtaatgaaggcttaaaggcgtggcaaaaattagccggtcagattcttggcgctgtcatttttctgatcgcttattttcacgaaggctttgatcatacgttatgggttccggttttaggtaatgtcaatgccacttggttttatgtgatattcgttgttttttggctcgttggttttagtaatgcggttaatctgacagatggtttggatggcttggttgccggacagacgaccatttcgtttgcaacgtatgcagtgattgcggttcgtgaaggccgcgttgacgtgttgattatttgtctggtgactgtcggcgcgatgcttggatttttgatgttcaatcataaaccggctcagattttcatgggcgacctaggatccttggcattaggcgggatgctggcagttgttgccattttgcttcatcgagaatggtcgttattattgatcgggatcatctatgtgattgaaacagccagtgtgatcttgcaggttgcttcattcaaattaaccggtaagcgaatcttcctcatgtcgcctattcatcatcattttgaaatgaaaggttggtccgagtggcagattgacttgaccttctggctggttggactgatcgcaagctgtgtttatctggtatttttcctataaaatcaagctataaaaagaaggaacgattgtgaaaaacatttcggattatcgtaataaaaaggtgcttgtattaggactggcaaaaagcggcgtcaatgcagcgcgcttactacataaattaggggctttggtaaccgtcaatgataagaagcaattcgatgacaacaaagaggctcaggagttgttggcagacgggatgcgcgtgattaccgggcgccatccagttgaattgttagatgagcattttgagttgatggtcaaaaatccgggtattccatacagcaatccgatggttcagcgcgcgcaagaattgggcctgccgattattactgagccggagctagcttttcaggtatccgaagcagagtggatcggcattaccgggacgaatggcaagacaacgacgaccacgctgatcgggttaatgttgaaccaacagtggcctcaccacgcctttgatgccgggaatatcggcattccggtcagtcaggtggctcaaaaagcaggtaaagatgacaccattgttgctgagctatcgagttttcagctctgcggcattaagacattgcatccccatatcgcagtattaacgaacatctatgaggctcatttggactggcatggcaaccgcgctaattacgttgcggcgaaaatgcgcattacgatgaatcaaacgccggatgattactttatcatgaactgggatcttcccgaaatgcaccagttagcaaagcaaagtcaagcccagattgtcccattttcccgcaaacaggctgctggtgcacgggcttcgttaattgatggctggttgacgtttgatggtgacaagattatgcctgccagtgacctgcagattccggggttgcacaatatcgaaaacgccttggctgccattgccgcggccaaactgaagggtgtgagtgatgacgcaattcgtgaggtactgcggactttttctggcgtcaaacaccgaattcaatatttggaaacgatcaatgggcgtcgggtatacaatgactccaaggcaaccaatgtcgaggcggcaactgtagccttgaatgcattccagcagccaattgtttggttggcaggcgggcttgatcgtggtttgccgatggacgctttaaccccgctcgttaagaaacacgtcaaaagcatggtcgtattcggtcaaaccgcgccattaatggcaaaaattgctaaagaagccggcgtcccggttcaaaaaaccgagaatgttatgacggcggttccattggcctatgaagccagccgccccggcgatgtgattttgctctcgccagcagcagcaagttgggatcagtatcctaactttgaagtgcgcggcgatgatttcatcaaggctgttcatagcctacagcaaaatcttgaaagcgagggtcattaaatgcggctggttatttctggtggcggtaccggcggccacatttatccggctttagctttgattgaagccctaaaagcagaaggtaaacttgatgatgttttgtacgtgggcacgcaaagaggcttggaaagtcggatcgtccctgcaaccggcttgaagtttgcaaccctggacttgcaaggctttaagcgcagcctttcgttaagcaatgtgacaacggtcaaaaagtttatcggcagtctcggtcaagccaaaaagttattacgagattttaaacccgacattgtcgttgggactggcggttatgtttcaggtgccattttatatgctgcggcacggttgcatattcccacggtgatccatgagtccaattcggttgctggggtgacgaataagtttttaagtcattttgtcgatcgagtggcgattgtctttccggaagttgcatcctcatttccggctaagaaagtcgttgtcaccggtaatccgcgggcacaacaggttgccggcttaaagcccaatgaccggcttaaagattttgggctggatccgcataaacaaacacttttgatctttggcggttcgcgcggtgcccctaaaattaatgcagcagctgttgcggcgttgcctatttgggctaaggcagactttcaagtgttatttgcaactggtcgcagtcactatgacgccattaatgcgggcttgccagcgttaccggcatctattaaggtcgttccgtacattgatgacatgccatcgattttaccggacatcggtttgttgattagtcgcgccggtgcaaccacacttgctgaaatcacagcactggggatcccggcaattctcattcccagcccgaatgtgacccaccaccatcagtacctgaatgcgcaaagcctaaccaaaaaaggcgcggcgttaaccattaccgaaccagaattgaatcagaattttccccagcgggttgtgaccttgatggaagatgatgcaaaacgcgctgcaatggcacaggcatccaaaagactgggcgtgcctgatgcaagtgatcaattgattgcggtgatgacaacactacttacgaaacgtgggtgatgactttggcttggctccgaaaaaaagaacagcaatctgatccgctgacgccgtggcaacaataccaggcacgccagcagcagacgccgcgtcatgatcggcgccaaaaaccgaagttggatgttaatctcccgaagatccagacgttgcggcgccgtaaactcgtgaagaaccttgtcttgattctgctccccctgctgctattgctgggggtttttggctattttgccagcccgctatccaaagtcggacttgtgagtgttcaaggcgtgacaacggttccggatcagcaggtcatcaacgcgactaaattatcagacgatgacttgatgttgagtgtggcatttcataaaaatgccattgcgcagcgggtacagaaatctttaccggaaattaaaactgccagcctgacgatcaagggattcaatcgtattattattaaaaccagcgaatatcagacggtcggatatgtttatcaaaaacatgcgtaccacaagattctggttacgggggaagtgttagccgccggaacccaaacgccagtcacgacttatccggttttttccgggtttacagccaaagagttaccacaaatgattacgttacttaaacagttccctgctgccattcggcgtgatatctcggaaattgacgccagtcgcggggatgccaatcctaaccagattgcgctcaacatgaatgacggttatcgcatcattgccgatacgcgcaccattgccaagaaaatcaagtattatccggcgattgtttcacaggttaagcaaaaaggcgtggttgatttggaagtgggagcattttggcgaccgtattctagtagcgaaaagtcgtcaaatgactgattttgtaaggattgttttctcatcagaaaatgagtgtgttacactgatgatggcaccgttttaatatgaaaattgagttaattaaaaagttacacaaggaggttcccgatacatggataatcaaggtatttacgttggacttgatatcggaaccacctcaataaaagtcattgttgccgaagcagtacagggacaaatgaatgttattggtgtgggaagtcagcggtctgaaggcgtgagtcgtggggtgatcgttgatatcgataaggcagtcgcagtgattcaagcggccgttgcccaagctgaagacaaggcaaatatcaagatcgatcgggttgtagctggcatccctgctaatatgctgcagattgaacaggtttcggggatgattgcggtcggcgaggaaaacaaagaaatttccgataaagacgtgcgcagtgttgctgcggcagcattagtacgtaatctaccgcctgagcgtgaaacattatcgctggttccaaccgaatttatcgttgatgggtttgatgacattaaagatccacgtgggatgttgggtgttcggctggagatgcgcggtattatgctgacagttcctaaaactgtgattcataataccaaaaaggccatcgaaaaagccggcttacgagttggcggcttggttatttcaccactagctattggccggcttgcgttaacggatggtgagcaggactttggcaccgtcttgattgatatgggtggcggtcaaagcacggcagcagtgattcatgaccgtaagctcaagttcacttcggtggatcaagaaggcggggaatacatcaccaaagacatttccgtggtgttgaataccagttttaccgatgccgagaaattgaagcgcgagtatggaaatgcggattctctggctaccagtgaagatgagacttttccggttacggttgtcggcaagcatgatccggccatgatttcggaaaaatatctgtctgaaattatcgaagcgcgggttgctcagatattcaagcgactcaagaaggcactggatgcggttaatgcgcttgagttgccgggtgggattgtcattaccggcggcaccaccgcactgccgggtgtcaccgagttagcccaggacattttagagcgaccggttaaacggtttattccggaagatatgggcctgcgccatccgtcatttactgaagggttagcgctcatcaagtacgccgctgaaatgacggatattgaaatgcttgtttcaagcgttttgccaacaccgtttatggttgatggggcgcaaatgccaacgcaaccggcacggccgcaaccagaaaccccggcggcaccggaaaatcaacgttctgccaagcgcaaacctgataaacaacccgaaaaagcaaaatctaaggaaccatctcctttacgccggttctttggtaatttctttgaataaatctcgatcctaggaggaacacgaatggattttcaaatggacgcacaaagtgaaaaaggtgcaaacatcaaagtaatcggtgtcggcggtgcaggcggtaatgccattaatcgcatgattgcagaagatgtcaaaggcgttgaatttatcgctgccaataccgatttgcaagcattgaatgccagcaacgcagaaaccaagatccagctcggaccgaaattgacgcgcggcttgggcgccggttccaacccggagatcgggcaaaaggcggctgaagaaagcgaagaggcgattggggcagcattgcaaggtgccgacatgatttttgtgactgccgggatgggcggcggctccggaaccggggcagcgccaattgtggccaaaattgccaaagatcaaggtgcgctgaccgttggggttgttacccgcccatttacgtttgaaggccctaagcgtgctaaaaacgccactgaggggattgctcagttaaaagagcatgtggataccttggtgattattgccaacaatcgtttattagaaattgttgacaaaaaaacaccgatgctggaagccttccatgctgcggataatgttttacggcaaggggttcaaggcatctctgatctgattacaagtccaggctacgttaaccttgattttgccgacgtaaaaacggttatggcaaatcaaggatcggcgctgatggggattggcagtgcaactggtgaaaatcgcaccgttgaagcgactaaaaaagcgatttccagcccacttctggaggttaatatcagtggggctaagcaggtgctgcttaacattaccggcggcccggatctcagcttgtttgaggcgcaggatgcttcacaaatcgttgcggatgcagctaaagatgatgtcaatattatctttgggacttccatcaatgaagagctcggagatgaagtggtggtgaccgtgatcgccaccggtatcgaagaagaagaccaacgccgcgaaacaacgcgccggccagctgctgccaatcgtaacactgatcagacccagtcaaacgggtcgtatcggccaacattcggcgggcatgagcagtctgccgatcaagcccctaaaaatgatgatccgtttggtaattgggatttgcggcgggaaccaagcaagcgccagaccccgagtgcagatgatatgaacaacgttaagaagaaagattttgatattttcgagaatcaaaccaatgcagacgatgccggaaccgatgatcagccgccattctttaaacaacggcggcgtcagtagtcaggaggtcatgaaacatggcgtttggaaagttaggggaaaaattcaacaatttctttgccatggatgacgaagatgaatatcaggaccaagaagacgaacaaacgcaggctgcacctaaggaaccttcaaatcatggccagtatcgtagcaacaaagtcgtatcaatgaatagtccggttggtaaaactgccaaaatcgttgtgtatgaaccgcggatttattcagatgccaaagagattggttcgcatttactgaacaatcgcgcggtcgtcattaactttgatcgaattgaggccgatgatgcacggcgaattgttgatttcttaactgggactgtttttgcgattaatggtgagattaagcggattggtgagtcgattttcttagtcacgccagccaattttgaaattgatggttcattggctagtaccattgattccgatggtttgaatctctcatcgcaaccataaacgaggtgtcaagtgtttaattttctttatgcattatttcgagtcggcgattgggcgatttatttatacatgatcatggtatttatttatatcctgatttcatggtttccaaacgctcaaggaaccgccattgaccgtttcttaggtcggtgggttgatccgtttctgagtatctttcgccgtatcattcctgctattggtggacttgatctttcgccaatcctggcgttcttcgtgctttcgctgattaagtttggatggtcgcggttgtttctgatacttgttcaaataattgggtgacaagcatggatgccatctatcaacattttcgcaaagatgaagcagcattgattgatcattttgcagaattaatcgaaactgcgcggaccgagtatcgggcagtattaaccgattttaccgatcctaggcagcggttgattgctgcgagcctgatcaatgcacatgatgatatgaagttggtacatttcggcgggtatccgcatgctgaacgacaacggctgatttttgcaccggactactttgccgctcagccagctgattttgatattcggctcttacaagtggtgtatcccgaaaagtttgccgaaatgcatcacagtacgattcaaggaacattgttaaatgccgggcttgatcgggatgtttttggcgatattgtgacggacgggcgcacatggcagttttttgttgccgcacatatggaagattgggtgatgagtaatatcaccaaaatcgggcgtgtcggggtccattttacggactatccgttagacgctgccgttacgcctgaaaatgactgggaacccatcagcttttcagttagtgcactaaggttggatgccatagtggcccacggtttcaatatgtcacggcagcgggccaagatgctaattcaggcgggaaaagtccggctgaactttggcgaaaacgatgcacctgacgctgaggtcgccacttctgatattatttcagtacgtggatttgggcgattgcggctagatgcgatacttggtgaaagcaaaaaaggtaaattgcgtgtctctgctgccgtgattcataagtaaaccgtatcgtaggcggttcaatgcgcttggtttatcggtaactttttaacaggttgcagcaatcagcgcctgatgagggacgtatcaataagctaaagtacgttcatgatcacgcgtatgccggcctaacaagcggttggcgcacgttcactagaggaggaggactatttatggctttaagtccactggacattcacaataaagaatttagcagcaagatgcgaggttatgacaaggatgaggtcaatgattttcttgcgcagatcgttaaggattatagtagcctgatcaaggataatgaggggcttaagaaggaattagcggatgcaaaagaaaaggtccgttacttcaccgatatgaaagaagccttgaatcagtcaatcattgtggctcaagaaagcgctgaaaaggtgaagaacagtgcgcatcaagaagccgatttgatcaagcagcaggcgcaacaagatgctcaggggatcctcaaccgtgctaaggctgatgctgatcagaaagttcaccaagcccaagcgcaaaccgagcagacgttgcatgatgccgaacttaagcgtcagaacatttctgttcaaacagaggatttgaaacgccagagccgggttttccgtcagcggttacaggtcatgctggaatcgcagttggaagttgtgaaaagtccggaatggaaagaattactgtccagttctcctgaagctgcagataccacggatccaagtcaagaagcacttgacaattcgcaggctggtttcgtaaactctagtggagcagtttccggtgctgatgcgtatacggagattattttcccagatgatcaaagtgcaacatccgagtcggcaactgcaacgccggcaccggtggattcagatcattctgaatcagaagcgacaacaagcgcaaccacaagtgccgataccgatgttacaactgatcaagacgcacaataacgtatgaacacgcgtcatttgccggtcccctttgcagcgagtcaggaataggtgtgagcctgataagtaccgctgaatgatatcagttcgcagttgtctcgccgaataactaagcgagaccggttgatcaccgttaagcaatcactgagggggacttgttccctgaagttaggtggtaccacgtttgctcgtcctaatatagggcgggcttttttcattcaattaacaaaggagcgggacacgtgaaaattaaagatacgttgaacatgggcaagacgacttttccaatgcgagcaggcttgcctaaaaatgaaccgatttggcaaaaaaagtgggatgaagaccacgtttacgagcagcggcaaaaattaaatgaaggcaagccgacgtttatgctgcatgatggcccaccgtttgccaacggaaatattcatatggggcatgcgcttaataaaatcagtaaggatatcattgttcggtataagtcgatgaatggcttccgggcaccttatgttcctggctgggatacgcacggtttgccaattgaacaacagttggccaaacaaggcgttaaacgcaaggaaatgtcgatgaccgactatcgcgagttatgccggcagtttgcgatgaaggaaattgataagcaacggactgatttcaagcggcttggcgtcatgggtgactgggaacatccgtatattacgttacaacatgcttatgaagccagtgaaattcgggtctttggtgccatggcgaagaaaggttacatctatcatggcttaaagccggtttattggtcatggtcatccgaatcgacgctagccgaagccgagattgagtatcatgatgacaaatcaccttcgatttatgttgcctttccggtggttgatggcaagggaatcctggaccaagatacgtcacttgttatttggacaacaacgccttggaccattcctgccaactacggtattgcagtcaatccgcgcttcgattacgtccaggtgcaagttggcgagcataagtatgtcgttgctgccgagttgcttgatcgggtagctgaagaagtcggctgggaacaacctaagattttaaagacttttaaaggcactgaaatggataagatgacagccaagcatccgttgtatgatcggacaagtctagtgatgaatgcggatcatgttacgcttgatgccgggactggcttggttcataccgcccctggtcatggggaagacgactacaaggtcggaatgaaatatggcttgccggttatttcagtggttgatgccaaagggtacctgaatgaaaatgcccctggttttgaaggcgtcttttatgatgatgccaacaaactcgtcacgaaagcgttggacgaaaaaggtgccttgctgaagctggacttcttcacccatagttatccgcatgattggcgcaccaagaagccggttattttccgcgccaccacccaatggtttgcgtcaattgaggcctttcgtgatcaaattttgaaggccattgataccgttgactttaaaccgagttggggcaaaacgcggctgtacaatatgattcgtgatcgcggcgactgggtcatctcccgccagcgcgcatggggcgtcccattaccgattttctatgcagaagacggtgaaccgattattgaagaagcaacgatcaatcatgtagccgatttgtttggtaaatatggttccaacgtctggtttgaacgcgaggccaaggatcttttacctgatgggtacaccaatccgcacagcccaaatggcaagttcactaaagaaaaagatattatggatgtttggtttgactcaggttcatcacaccaagctgttttggcgcaacgtcctgaactaagcttcccggctgacttatatctggaaggttccgatcaataccgcggctggtttaactccagcttgattaccagtgttgctgcaaccggaatcgcgccgtatcgcgggattttgtcacaaggcttcacgcttgatggcaaaggccggaagatgagcaagagtttgggcaatacgattgtgccgtcaaccattgaaaagcagtttggtgctgagatcattcggctctgggttgcaaccgttgattcatcatctgatgttcgggtctcagtcgataatttcgctcagacgtcagaagcctatcgtaaaatccgcaacacgctccggttcatggttgccaatactggcgatttcgatccggaaaaagacgcggttgcctatgatcagctaggttcagtggatcgttatttgttggttcggcttaatcaggtcatcgccaaagtcaaagaagcgtatgatgcctacgactttgctacggtagagaaaaccatcagcagtttcctggtcaacgatttaagtgccttttatctcgatgttgccaaggatgtggtatacatcgaagccgcaaacgatcctaaacgtcgcagcatgcaaacggttatgtataccgcattgctggacttgaccaagttgttgacgccgatcctgccgcatactgccgaagaagtttggccgtatcttaagcagaaacaagcatacgcagcgttatccgacatgccagatgtgacccactttgctgatgaggatcagctcctagatatctgggcagcgtttatggattttcgttccgaagttcaaaaagccttggaagttgcccgtgacaacaaggtaattggtaagtccatggaggcagcggtaacagtttacccaacggagccggtgcgcgacatgctcgatgatgttgaagccaatgtgatgcaattgctgattaccagtcactttgaagtagcgccacttgaggcgaaggcgccggaaaatgccgaacagtttgaggatatggctgttgtcgttgaacatgccaaaggaactgtttgcccacgttgccggatggtacgaaccgatatcggcacagatcctaaattaccggagttatgcagtcggtgtgccgcgattgttgaagctaattatcctgaagcggcagcaaacggatttgataagtaagcggaggctatgatgcaaggacgggtcaaaaatttcaacgtcgataaaggctatgggtttattgaagctgaagggcagcctgacatttttgtccacttttcggcgatcaatgagtctggatttaaaagtctgacgcctggtgaacaagtcgattttgtcattgtcgaaggtccgcggggtccgcaagcagcaaatgtcacgatccatcacgaacccgacactgaggatcatgcataaattctcgttcaatcgtgtgacgtgattcattaaaagcaatccgaacagtctgtctttgggtggcaagctagtgatgcttcctagcaagtacgtctgtggctgtcaggattgctttttaatgttgacgactcaagtttataggacaataagaaaaccgcgatcattgcgttgatcgcggtttttgtatacatgctgctttttatttggtgatgctgggtaggttacttgttaacttcttcaattttaccgtcataagtccgagcaacggtcatcttggtgattggaatatagcctaactttggaaccagagtcttttgaacgttcttggactggatatagttgataaatgcggcagtcgatgcattcggcttgcctttggtgtacatgtgttcgtaagcccaaatcttccaggtgttcgttgtaacgttcttatcagttggttgtaccttatccagtgccagcttttggacgccatctttaattgccgagaaggctagatagctaatagcaccgggagttgaggagaccatctgataaacggtaccgctagaatcctgttcctgactggtcttgactttatcggtcttgatcccgaactgttcgaaggttgccctggtacctgaaccttgcgcacgattgatcagaacaatttgctgatctttgccgccgacgtctttccagttcgtaatcttgccttggaagatatcgatcaattgctgggttgagatgttcttaaccccggcatctttgttgaccaccggcgcaatggcaacgaccgctacctggtgatccaccagatcatcggccttcaagtctttcttttcttgagcgaaaatatccgagttaccgatcgtgaccgatccagctgccacttggcttaagccggcaccggaaccgccgccttggacagtgatctccgcttttggattatctgtttgatattgtttcgcggcctgttctaccagcggttgtaaggcagtggatccgaccgctagaattttgctttgttttgccggtgctgaactggatgaacttgaactgctggcggattttgacccgcaacccgttaataccaaagtggcagttaaggccacggtcaaaccgactaacaatttcgaatgcttcattacttttccctccaatacttgaataactttaggataaggtttgtgtgtaaagacttgaccactttgatgtaaataatgcgttttgcttttgtaaatatgttcaacagtcctttgaaaaagtaaccaaagtcggcgtataatgactcagttaggcgttattaaaggagcggaaaatgtgaaaaattacattgaggatcaaaaagttcagaaaaaccggtggtggatcatcacggcaattgggatgtttaccattatgtcgacattggatggttcaattgtcaatattgcgctgccggtcatgagtcgcgatttaaacattccaatgaatcaggcggaatgggttgtttccatttatttgatgatgatctgcggcttgttgctgttctttggcaaacttggcgattcgatcggtaaaatcaaagtatttcgaattggcatggttttgtttttaatcggcttgctttttgctggtttcaataatagtttggcgttattactggcggcgcgaattgtgcaggcgaccggtgcttctatgaccatggccaataataacggtatcgtgacggaaatttttccgatgaatgaacgcggcaaggcgctgggattgattggttcatttgtttcgatcggcgccattgccggtcccggaatcggtggcctgattcttggccaactgccatggggttatattttctggattaatattccaattgggattgttgccctcattctgggaacagtcgtcttgccaaaagatttgccaagtaagcgggtgccaatcgattggtcagggtttattagttttctggcgtacattctcacgctttttatggggatttttttgggtcaggaacgcggctttactgatccgctgattcttgggttatttgtgatcgccgtgattgcgctggctgcatttgtacaaattgaacggcacaaaaatgatcctttggttagttttaaattattcagtaacagtgcgtttacactgagcttgttgtcggcattcttcattttcgtgaccaacttcttttttaacgtgatttcgccgttttatttgcagaatgcgcgtgggttatcaccggaaaaagccgggtacttgttgatgattttcccgattgtgcaggttattgtggcacctgtagccggttcaattgcggatcgtatcggaccttatcgaattaccatggtcggcttgttgtttattgttggcagtcagatcgggtatgcattgtttaatttacaaacgtcttttgtttttgtcgcgttgatgatcggcttggttggttttggtaatgggttgtttcaagcgccaaataatacggtcgtgatgtcgagtgtggcgccgcgagatcttgggattgctggcgggatgaatgccttggcacgtaatttgggcatggttgtcggcatttcgagtgcgaccacggtgctattttcttcaatgagtcatactgccggacgcaaggtgacgacttatctgacgggtcagccaaatgtgttcatcgccggtatgcatgtgtcattttgggttgcaactgccttatgctgcctagctctggccttgacgggttatcggatgtggcagatgcgcacacaaacgcaggcatgaattcggtaacgagaactgataactgctgaatcgtacaactacacgcaaaaagcccgtgatcatcgtatgatcacaggcttttttcaaagtattgacgcaattatcaatggcgactgagtagatttaacttagtgtggcgtcacgtctttgggattttgttcgttcatactgccgtgcgtgtagtttaataattgttgctttaattcgccttccatttgtactaactgcttttcggcattttggcgttttagacggccgtcttgttggatctgcaaggtttgtttcaaggtatcgataagatcgttttgggtttgggtcaatgtttcgatatcgacaacgccgcgttcattttctttggcagtttcaattgagctgattttcaacatttcgctgtttttcttgagcagatcattcgttgtttccgaaacctgacgttgggcggttaccgcatttttttgccgtaaaagcgtcagggcgatggccacctgattcttccatagcggaattgctgtgttgacgctggcctgaattttttctgccaatgcttgattggtgttctgaataaggcgaatctgcggtgcttgctgaattgtaatttggcgcgctaactgtaagtcatacgcacgtttttccaaacggctggcaaattgcttgagatcattgacttgttggatcgccatttgatcattagcggcttctgcggctttggctgcttcgggaatcgttttttcatttaactccgcgattttgagattggccgcttcgatgtaaatattcagtgcatcaaaataggctttattttggtcataaagttcgtccaaaagtttattgtcatttaacagaccttgttgtgaagtctcaaggcgattggcgatggtgtcgatttgcgcgccaatcttttgatacttagccgtaatttcgtagatcgagcgcttgacacggccaaagattttgcggaaaatattattattttctgcttttagctcatcggggttggcctcatttaaacgtgtcatcaagctggttaaggcatcaccgactgcaccggtatcctgactttggacttttgtcagcatattttgggaaaagacgccaagctgcttttgagcatcggcaccataattaagcacggtttcaccttttgtgacatcaattttactggctaaatcccgtgctttggcttcctgttccggattcaatttaggtttagctgtcgttgcttctgggatgtttggctcggcattggcgtctgttgctgtgctgaacggatcagctaataaatcatccgttaaattggtttgtttatcatcgctcacgttggtcactccgtttcatgagttttttcgggttcaaggtgttttttagctaagcgcacatcgctatcgagatcagctaagtcgtctttaatgaaggcttggtaatcagtgcgaattttgcctgccatattcgtcatggtttcaaaggctttatcaagcgtttcataagtgtcggcggttttaacctcatgatgggtaatttgagcatatttttgcatgagatctaacagatttggcacttgttgatagacgaaggtacccgcatcggtcaagcgttgcggtgcctgaactagggcctcgaaataagcgtggagtaaatcaactaaatcagtgtttaaggttaatgcccgtaatttggggacttgttgggttaaggcttcaatcgtgcgaatttgctcggcaagatcagccatcgtctttctgaaaagtttgatttcttcttcacttaatccagatgccgcatagtgttccgccattttgggatctaaacttggcagactggcagattttggcttgggccgactcaattcaccgataaagcgggcaaatgcgaaaacggtgccgacaaaaatggcaatgagccatcgtccggacaaagcacctaatactgcacccatggcggcccagagtatgattcgccaagtgcgaatacgtttgcttgtggccacgagatcacttcctctttcgtttgagtttagtttagcacacccttgtaccttgcctatcagccggaagttggatattcgcaaattttttgttaagaacaagcaccaaattgtctgctggtgtaagctgatgacatggctaaaaaaactgatcgtcaatcggacttaagagcattgacgaatagcgacactattttaacaggaggcgatcatggtggaagaaaaaccaattgcccagcaacgcttgtttaccggtcacttggttgcggttgatgaactgacggttaaattggataaccagcagacggctaaacgtgagattgtacgggcgcacccagcggccggcgtgttggcgctcaaagatcagcgggccttattcgtgagtcaatttcggtcaacggtcgggcagatgaccttggagattcctgctggtaagatagccccaggcgagatgccgttagcagctgcccagcgcgaattaaatgaagaaaccgggatgcaggcgcgcgactggcaaccgttggcaagttattttcagtcactcggtttttccgatgcaaccatggcactttttttagcgcgtcacgtcacaaccgctgaacatcatttggatcaggatgcagatgaatttgtccaacatcgctggttaacgctgagtgaggcgcaacaggcagttgacgatggtcaaatctgtgatagtaaaacgctgctcgccttgttgtattggcagctgcaggagggaaattatggcagaggttaatacacgcaaagcataccgtgaggagcaggaaaaagcgcaacgagcagcgcgtgaacgtgaagccaaacgtattgaggttgaaaaagcctatgcgcggcagagacggggaaaacccgaagtaaccgcagctcgatttgatgacgttacttttcgtaaagtgaatagtctcaagaaacgtttgaattgggcaatcggtattgtcgtcggtttgattgtgatcgtctttttggttttatactttgtctaacttagacgctgataagctcaggaaagtttatgatcagattcacgacattaatttaaagaaagaatgaggcgattttttgattaaggtcggggttatttgtgcgatggaagaagaaattcggacgttactggctaaacagactcatcagcaagaaacggtgattgccagccagcattactttgaaggccaaatagatggtgttgatgttattttggtacaatccggaattggtaaggtacaagcagcgatgacgactgccttgctgttagcgacttttaagccggatgttgttgtcaatactggcagtgccggtggtatcggtagcggtttggcgatcggtgatgttgtgatttcaagcggtgtggcttatcatgatgcggatgcgaccgcgtttggttatttgccggggcaattgccacaacagccgcagatttttgaagccggcatgagttatgtgcgccagattcaagctgctgcgacggcgaccggcttgacgtcaaaagtcggcttgattgtttcgggcgatcagtttattaatggcaaagaggcgatcgcccgaattttgaaaatttatccacaagcgcttgccagtgagatggaaggcgcagcggttggccaggttgccaaggaatttcacaccccgtttgttgttattcgggcaatgagcgatgtggctgatgagcagtctggggttgatttcgacaaatttgtgatcaaagcaggggagcaaagtgctgcgatgttgttacagttctttagtcatttgcagcgatcacagcataattaggagtgattgtaatgcaacacatttatctcgacaatgctgccaccacaccgatggctcctgaagtcattcagaccatgacggatcaaatgcaacatgattttggcaacgccagctcgactcactggtttggccgggaagctcacacggtaatggacaaaagccggaaagttttggcggactcgattcatgcccaacccggcgagattgtgatcaccagtggggcaaccgaaagtaataataccgctatcacccagacggcacatgcgcgtgcgtcattaggtaaacacattattaccacggcgattgagcatccctctgtgttgcagccgttaaaggcccttgaaaaagaaggttatcgcgttacctatttgcctgtggatgagaacgggcgtatccggttagctgattttgatgccgcgctggatgacgacaccattttggtcaccatcatgatgggtaacaatgaggttggcagtcggatgccgattagtgaaattggtgcacggctggttgaccatcaagcctggttccacaccgatgcaacgcaggcgtatggcttgcttgatattgacgtcaacgcacagcacattgatatgcttagtgtttcggcccataagattaatggtccaaaggggattggctttttgtatcgcgatccgaaagttcagttccctgcgcttttaaaaggtggcgaacaggagctcaagcggcgtgcggggaccgaaaatatcgccggaattgccggtttcgcttctgcggtgaagttgattacgcctgaggaaaaggctaagcgccaaagcaaatatctcggctttaagcaacagattatgaccgctctagatgatgcaaaggtgccatatgcggttaatggcgatattcggccggacaatgtcaatcacgtgttcaatttgtggttaaaagggatttcgacttatgcgcttcaaacaaatttggatttagcggggattgcggtatctggcgggtcagcctgcacggcgggatcactggagccatcccatgtcttgacggccatgtttggcggtgatagtccgcgtctgggtgaatcaattcgcgtttcttttggtgggcagacgactgcagatgatattcaggcgtttattgataccttattgccgattatcaaacggttaactgccaaacaaacgagtcggtagctttcggaaaagtaggcagtaccatcttgagactcgttagggcactgtgaagctaagcgatggaaaagaagacacttttcgggcaatcccgtgatgtgctaaacttatgggtagttaagcgtgttcataacgcacgtgtcttgcgttttacgctcatattaacgcgttctccagcgcagaagtctgcgtgtaaggacctcagtcgcaatggccaaagcccggccatcacgcctgaggccgcttacactccgacttctacccgcgctggttcacgctcaggaggtttggtaatcatggctttagcttcaaccggatcggctcaaggggatcctaagacttatcgaattgggtccaacttaaaacgatttacgttaattgatttaggttttgttccaacgaagaatggtaattttcagcttcagcggtcgttggatcctaattcaccgtataccgcggcgaataaactgaagatgacggtggctaagacgctggacaagtttcagctggatgtgaccacaggcaacgggcttaaggcgattaacattttcaagaatgacagcacgaaggaaaatgttgaacaatatgaatattggattaacaatttcattgaacgtggtgtgctcgagcctaaataagtctctttgaaaatcacggtaactttccttttaaacaagcggagattaccgtgtttttttgttgcatgaatcacggattaaagcgttacgactggtaaagcatgagccacatcacggatgcgtggttttagtgaggcgaatgtcgtgaccgccaaatcaagtggccaaaagtggtaagctggaaacattgaaattttgatatgaaggagggcttgtatgtttgaacatgggtttattgaggtacatgatgccaatcagaacaatttacaacatgtgaatgtgaagatacctaaggatgccattacggtttttgtgggtcggtcaggatcaggcaaatcatcgttagtgttcgatacgattgctgcggagtcacggcgggagttgaacgaaacttttccgagctttacccagcaatatttaccaaagtatggccagcctgatgtcggttcgatcgatcacttgccggttgccattgtggtggagcaaaaacgtatcgggaaaaacgctcgctcaactttagcaacttacacgggtatttactcactgttacggctgttgttttcgcgtgccggcaagccattcatcggctattcggacacattttcgtttaatttacctcaggggatgtgccccacctgccaaggcttaggttacgtggatgatattgacgtcagtaagttgattgatcccaataaatcgcttaaccaaggggcgatcacctttgtcagttttggaccggatacttggcgttggcggcgttatgcctacagcgggttgtttgataatgacaaacctttacgtgactacacgcccgaagaaatgaaactgttactttatgcaccgcaacagacactgaagcatgcaccagctaaatggcccagaacagcgctatatgaaggtgtcgtgcctcgcattaaacgatccattattggtaaaaaagaagcagaacatcataaggcggcattggcagaaatcgtaacgcgcaagccttgtccggattgccaagggacacgcctacgtccggaagtgttaacctgtttgattaatcaaaccaatattgcccaagtgttgcagatggacttggtaaacgtacggcattttctgaaagccattcaagtgccgctggttcaggatgtgatccgggaattattacgcaaaattgatgcactgattgatattggcctcggctatctttctttagatcgacccaccgagacgctttccggcggcgaaacccaacggatcaaaatcgccaagtttctaaccagtgctttggtcgatatggtttatattctcgatgaaccaagtgttgggttacatcctcacgatatcgagctgatcaagcgggcactgctccgtctcaaggaaaaaggcaacaccatcttgatcgttgagcataacccagcgctgatcgcattaggcgactatattgttgaggttgggcccggtgctggcacaactggcggccacattacgtttaccggcacttatccgcaactattggcgagtcaaaccttgacggggcgtctgcttaaacagcgactgacatttcggcaaccgcgatcggctaaaacgaccatccatttgccgcatattacccgccacaaccttcaagatgtcgatgctgccatcccactgggcatcgaaacggttatctccggtgtggcaggttccggtaaaagtacgttagttgcggcgttacgtgatcatttaacggtgccgtacattgatctggcccaagcggatattggtgctaatatccgttcgacacccgtgacttatttgaaaatccttgatccaattcggaaagtatttgctcaagccaatcacgttggcagcagttggtttagctacaacggccgtggcgcatgtccgcggtgcaaaggcaaaggggtcaccattactaacatggccttcatggatccggttgtttccgtttgcgaacagtgccatggcaaacgttacaacgatcaggcacttggatatacgtttcaaggcaaaaacatggcagatgttttagccatgccgattgccgcagcgcagacattttttgcgcagaatcacgacattgccaagccgttagaaaatatggcgcgagtcgggctcgattatctcacgctcggtcagccgctgacgacattatctggtggggaaaaacaacgattgaagcttgctgttgaattaaaccgcactggcgaaatttacttattggacgaaccgactgccgggttgcatctacaagacgtcaccaaattgctgcatttgtttgatgatttggtggcagcgggcaactcactcatcattgttgagcataacttgcaagtcatcagtcaggccgattggctcattgacatgggaccggatgctggtatctatggcggtaagattctctatgctggcacgccgcaagctagtatggaggctaagcaatcgcgcaccggacaggctttacggcaatataatgcagcaccggagcgtcagcacgattaatggcagcactttggcgcacttagcagggagctcgcttgctatctgttcttggcctgctataatagcacttactggaattcgaccttcaaatcggatatctccagaatctgatgaaatgatggtgattgttttggacaattccaacacccgtgttgttgttggcatgtccggcggcgttgattcaagcgtcacggcattattgctgaagcaacaaggatatgatgttgtcggtgtcttcatgaaaaactgggatgacactgatgaaaatggtgtttgtacggccaccacggactatgaggacgttgctaaggtggctagtgagataggcattccttattattcgattaatttcgaaaaggaatactgggatcgcgtttttcaatatttccttgacgagtacaaggctgggcgcacaccaaacccggacgtgatgtgcaacaaggaaatcaagttcaaggcatttttggattatgccgagcagctgaatgcggattacattgcaatggggcactatgcgcaggttaaaaccgatgagcagggcgttgttcatatgttgcgaggcgcggacggtaataaggatcaaacgtacttcttaagtcagctttcccaggatcagctcaagaagtcgatgtttccaatcggtcatttgcagaagccggaagtgcgcaagattgccgaggcagctggattggcaactgccaagaagaaggactcaaccgggatttgctttatcggtgagcgtaacttcaagcagttcctcagcacctatcttccggctcaacccggaaagatgatgacagtggatggcgttgagaaaggcacccacgacggcttgatgtattatacaatcggtcaacgtcaaggcttgggcatcggcggtaactcgcaaaactccgagccttggtttgtggttggcaaggatttagacaaaaacatcttgtatgttggtcagggttttgacaacccggcgttgatggccacaagtctcagtgcatcgaaccttaattggaccaccggcgaggctccggctgatggcacgcatatgacagctaagtttcgttaccggcagcgtgataccggcgtgacgattcactatcatgatgacggaacggcgactgtcgactttgatgtaccggttcgagccattacgcccggtcaggcagtggtcttctatgatggcgaggagtgtttaggcggcggtacgattgatgcagcctatgctcatactaatgagttgcagtatgtttagtgcgccagcaagttggcatgatgtgatgtaaggaagatcggtcccggagataaactttatctccggggccgttttactttgtctggctgattggggtggggttgttttgggttttataacgccgctgttggttggtcgggtttattctccgaaacgcgctcacagggccagaaacctgcacataaggaccttggacgcaatggccaaagcccggccatcacgtccaaggccgcttatgctccggtttctaagcggccctgttcgcgctctgtttccgaaacgcgctcacagggccagaaacctgcacataaggaccttggacgcaatggccaaagcccggccatcacgtccaaggccacttatgctccggtttctaagcggccctgttcgcgctcttgatattttgtccgaaaatactgataataaaaaggttaagatgtgaaaaggggagcggcttgtgaccaagttatattttgtgcgccatggcaaaacagaatggaataatcaggggcgttatcaaggtgcaaatggtgattcgccattattgccggagagctttgaacaaatcaaagcattggctgattatttgcgtggcatttcgtttgcgcatgcttatgtcagtccgctcaaacgtgcccgcgtcacggcccagacgcttattaaagacttaaatgaaccgattccgttgacgattatgccggctttgcgggagttcaatttagggaaaatggaagggatgacatttacggatgtcgctaagcattttcctcaggaattacatgcatttcggcatgaaccggcagcgtatgatccgcgtaaaattcacggtgaatcttttccgcagttgattaatcgggccattccggcgattgtggctaccgtcgcgatggatcggaccggtacggctaatttgttatatgtcagtcatggtgcggccttggcagcggttattcagagtctgcttggtacaccattggcagagattcgcaaagatggtgggctgacaaatagcagtgtgacgattctacaagcggatggtccgagtctgccatttaagttgttaaactggaatgaaacgagttttcttcccgagccaccgaagccaaccgacacgatttaatggtcgtgactgcgatcatatcgcacactgaatgaagaggatgctatggattcaaatattttaaccgcatttaatcaaggaaaacacgaagaggcgattcaggcagccgttaaagcgattgatgctgatccgaaaaatcctaagcgttatgcggttttgacaacgatgctgattagtttgaaggccttggatcaagcaggtgagttactagccaaagcgcgggcactcttcccagatgacttggaattacagtacacagctggtctttttgcctatgcgcaggcggattttccggcagcggctgcctggtttactaagtgtcgccaggatgagacgttaaaaaacgatgccacgtacatgttggcattgagctatcagcaagccggtcaacctaaaaaagcactggcctttgcattgacggcacacgaattggcgccgaagcaaacagatgcggcgttgctggcggcagatttgttattaggcgagcaagcttttgacgcggccgcggagattttgaaaccgctgctggaaacccgtcagccgcaagttctatttacttacggcatggcgttgagtgctgcgggtaaagatggcagtgcctatttagatgcagccaaacggcttgatcctaaaggctacgatcaaaaagccggtaccgttgctgacatcaatcgcttcttacggttgcaggaagggggccatgatggacaggcatgaagatagcgtcactggccgggtcaaaagtattttctttcagaatccgactaacttttttaaaatcctgctgattgatatcacggcaaccacgattacctggacggagccggatattgtggtgaccggtacgttcggggatattaaagaagatgagacgtacacgtttaccgggcatgtcgtggaccatccgaaatatggccagcagtttcaagcggataattaccatgtggatcggcctacgaataaaacgggactgatcaattatcttagttccgacaagtttccgggaattggccccaaaacagcggagaaaatcattgacaagctcggggttgatgcgattgatcgtattttggatgaccctgagagcttaaaaggattggggatttcggcggccaagcagaagatgctggtcaccaatctcaagacgaatcagggaatggaacgggtcatcatcggtcttaatgactacggcttcaccagtaacatggctggccgaatttatcagcaatatcaaaatgatgcgctggaagtcattaagcaaaatccgtatcagttaatcaatgatattgacggtatcgggtttacgcgggccgatcagattgccgccaagttagcgattgccgcggattcgcaactgcggctcggtggtgcggtcatggataccttgcagcgcttgacggacggtgaaggcgacacttttgtcgatttgaaaacgttggtcacccagacgcttgatttactggagcgagcgcgtcaggttgcagtgaaccccgaagcagtcggccaggcaatcgtcactttagccaaggacaatgcgctggtagcggaaggtaagcgcatttttcctaaacgactttatgattccgaatggcagattgcccggcagttaaaaggactggcggatgccgggcgcgctgccaagcaacctgcactggccgaaattaaacaaacattggccgccgtacaggaagagactggcattgcctatgatgaggtgcaaaaaaaggcgattatcactgccttgcagtcgccgatttttcttttaaccggcggccccggaaccggaaagacaacggtgacggacgggattgtccgcacctatgcgcaattgcatgatttatccttggatcgccatgaatacacgccggatgatcctttcccgattatgctagcagcaccgactggccgggctgctaaacggatcagtgagacgacacagttaccggcaagcacgattcatcgactattgggattgggcgtggatacgcaggagtttgcgcctaatgatctcccggacggccttttaattattgatgaaatgtcgatggttgatacgtatctttttcgaacgttgttgacggcgctgcacccgggtatgcaaattgtgttggttggcgataaagatcagctgccaagtgtcggaccgggacaggtttttgctgatttgttacgcagccaggctttacctcacgcagcgttaacccacattcaccgccaggacgcggacagttcgattatcccgttggcgcatgcagtcaatgccgggcgcttgccggatgacttcacccgcccgcaagtggatcggagctttttgccgtgttcacccagccaggttccggaagtggtcgggcaggtggttcagcgtgccgcggttaaacagttttcgattgcggacattcaggtgcttgcaccaatgtatcgcggaactgcggggattgatcggttgaatccattgttgcaggatattttgaacccgaaacgcagcgctcggacaaaaaccgttcattttggcgaaaccgagtatcgaattggcgataaaattctgcaattggtcaacgatccgaatcaaaatgtgtttaatggcgaaattggccagattgtcgggatcacacttgccaaagaggcggccagtaaaaccgatgagttgacgattgattttgacggcaatgaaataacgtataaacgcagcgacttcagcaaaatcaccttggcttatgcgacttcgattcacaaagcgcaaggcagcgagtttccaatggtgattttgccattaaccatgcagagtcgccggatgctgcgccggaacctactttatacggccattacccgagcaaaatcgtttttgattctggtgggcgagctggctgcatttgagaccgcagttggcgaaattgcggtaaatcggcatacgggtttggtccagcggctgcaacaagcgtttggcatgaccgtttcccagccggacgtagaaaagccgacgcctgcaactgaagtcagcaagaataacggacaaattgacactaacccgtctgacttggataatggaattagtactgacgaatcgaacaattatcagctaacccctgcattggtggcttcacagcggattgatcctatgattgggatgaatggtgtgacgccacaaatgtttatgacgaaggagaaataacctttatggaggacaacatacgcaagtcactgcaaattaaatcagtgacgcctaaggatcttgaacagttcaacgaccttttgacttatgtatttcaggtcacgcaaaaagatctggaacaatctgggtatgaagaaggggaacttgaacgggccaagcgtccggttttggaaaagtcggacgtattgggatggtttcatcaaaatgagctggtcagttcgctggcaatctatccgtgcaccgtcaatattcacggcaccttatatcagatggctggtttaaccggagtcggcacttatccggagtacgcagggcatggcttaatgcacgatttggtgaagttaggcttagagcacatgcggcaacataagcaatggatttcctatctgtatccgtatagtattccgttttatcggaaaaaaggctgggaaatcatgtctgatcatctgacgtttgatgtgaaggatacccagttgccgaaacaagtcgaggttccgggtcacgttgaacggctggagatagatgatcctgatgtgattgaaacttacaatcgctttgccatgaaaaatcacggtgccatgattcgcaatcagctaaactgggatgaatattggcgttgggaaaatgaagaagagcgaacagccggcgtgtattatgatgccaatgacgaacctcaaggctatgttttatactggattgccgatgaagtttttcacgtcaaagaaatgatttataccaatcaagaggcacgcgtaggcttgtggaattttatcagtgcccacttttcaatggtgacccacgttaagggcaatatctataaaaacgagccgttacattttcttctggacgatggcgatatttatcaaactatcaagccgtattatatggcgcgaattgtggacgttaaagcatttctggcacaatatccgtttgctgccgagacgacagaaccgtttcatttcgttgtaagtgatcccttggcgccgtggaataatgggacatttggcgtttattgggatgagcatcagcaggtaaaaattacgaaccgacctgttggcgaagcgattacgacggacattcaaaccttaaccacgatgttaatgagttaccggcgcccatcctatttagcccaaatcgagcgtttgtctgctagcaaacatgcgatcaagttgttggagaatgcggtaccgatggaagagccttatttttcggactatttctgatcggcatttcgaaagactgcatgctgttgtcaaagcctgcacgtgatgggttttatgtgataaaagcgaaaaagcctcagactgatttttatctgaaggctttttttaattggaaactatttaaaaaggttaaatactacggtcaatccaaaacttttgggaggccaccgaaaagtcgatttcaaacgggcgtgttcccatttcttcgccatccatttggccaaattccagtgaactggtttcaactgtcaactttttggcgtgaaaaagatgcaccgcgcgacttgttggagccttgccgcgcatgagttgaatcatcgcgaatgcccaggacacgatattaaaccattcgacaatgatcaaatcaagatgcccatcagtcgggtcagccggcttatagatttgaataccaccgccaaaatagggaatgtttgtcgttgtgcaaatgtaggcgcgatgaaaaaaatgccggacgcctttttcatagaccgcaaccggaaacgggcggcgggttagcaaactcccaataacgtgaaacaagtaagttaatttaccgagatgaaatttatttagcagctgtttactatcgctgtgattggctgcactgacaaccgccgcatcaaagccaatcccgatattattgacaaaataaccggtttcatcacgagtacgttcatgataacggccaatatcgattgcaaccggtttagtggcttgcagtacctgttctagcgcgtgcattggatcttccgacatcccgataccgcgagcaaaatcattgccggatccggccggtacataggcgacgggcagatcgtgctgccgggtaccgattaaaccgttgatggcttgatttaatgtgccatcgccgccgatcaccagtaaaatagcatggtcgcgggtattaaaattaccaatttgtttcgcgatgatattggtatgaccgggatagcgggaggttttgattgcataaggcaattggcgttggtctaagacggctttaacctgtttaaaaataggaattgctgctccgccacctgccgccgggttatagatgagataataaaaaacagccgccatcaactttcctcctaattagacacgcaatcaattataccgaaaaagccaagaaaaacaatattaccgtcatatttgaatagcatattcgtcaatagaagtaaacttaacttttcagcaaagccggcgtaacggtcagggggcctttcaaaaagattaacgtttaaatggcaggttaaaaattgcaaaaaaacaccgcacagcttacatggcaggtgcggtgtgagaataaatatttgagattgtgaaggctgctatagcagaatcagcatcggtagaataaccggatgacgttcggttttatcaaaaaggaattcctgcaagctgctggtaatcgcatccttcaaggtagcttcggtgaccttttcattatttgaaaaagttgatttgatagtgcgataaacccgccgctgagcctggttgatcagttccccggattcacgcatgtagataaagccgcgagagagtaaatcaggaccggccagcaccgcttgtttttgcatattgatcgttgcaaccacaacgaccaaaccttcttcggataacatgcggcgatcgcgaatcacggcattaccgatatcaccgacaccgctaccgtcaatgtagacgtcaccagcagggaagtgtccggcaattcgcgcacttttttcggttaacgccagcacgtcgccattttccatgatgaagcagtttttctctggaaccccgcattgttgggcgagttcgcagtgaattttttgcatccggtattcgccgtggcaagccatgaagaatttcggcttaatcagacgaagcattaatttttgatcttcttgaccaccatgtccggacgtgtggacgttgttgaccttgccgtgaatcacttctgcgccggcttcgcttaactggttgatcacgtgattgacgctgaccgtattgccgggaatcgggttgctggagaagatcaccgtatctcctggttgaatactgatctgccggtgagttccgttggcaattcgacttaacgcagccataggttcaccttgcgagccagtacatagaatcattactttatcggctggcaatgaattcagttgatgtgcatccactaagacgtcatcgggaatattaaggtaacctaactcacggccattcaccattgccgtttccatagaccgtccgaaaaccgcaatcttgcggccatgtgccattgctgcatcggccgcttgagcaatccgtgaaatgttggaagcaaaagtggcaaaaatgatgcggccatcaatccggtcgaaaatatgccgaattgacttgccgacgaaacgctctgattttgtaaaagtcggaatttcagcattggtcgagtcagacatcaagaccaaaacgccttcttcggcgaaccggcacattttttggaaattcggtgatggctgatccccaaccggagtcaaatcaaacttgaagtccccggtttggatgacaattccttgtggcgtatgcaccgcaatcccgagcgtatccgggatactgtgggtggtacggaaaaattcgacacttagctttttaaacttcaaaaccgtgtcttcgttgatttcagttaactttgtggtccgtaataacccatgttcttcaagtttgccgcgaatcaacgctgccgctaatgggccggcatagatgggaacgttgggcacttgctggagaaaatagggaatcccgccgatatgatcttcgtggccgtgggtgatgaccaaagctttgatcttatctttgttttgaaccaaataggagtaatcggaaataacataatcaatcccaagtaaatcgtcttcggggaatttaatccctgcatcaatgacgatgatctcatcttggaattgaaccccgtacatgttcttcccgatttcacctaaaccgccgacagcaaagacggcggtttcgttatttttaatatttaatttcatatgattagaaagtggtcagcttgaaattggctgacttttcctcatactccaggaaatttccagaaagttcctgaataaattcaatattgtaaggcgtgttggcttctacaagcgcacgcgcctcaaccgcagatggcgcctcgaggtatagcgtctgagtggtttcccgtcgcggattttggatcttgtctttttgatataagactttgtagatcatgtttggactccttccgtggtacaaaaagaaaggaagtgcaacaaaacagcttccgaaaaaaaggacatgccatcaagatgacgaaccacaaaaagcatgggcgatcttgctggaatggccgatgtttcgtcgcttgaaccgcaaaatggcaacataacaccattgccgtggtccatttcctgccacaactcctaaaacttttatgaccgatcgatttgttgtgaatacaacagctaggcatagtttagcatatttaatggagcgtgaacagcttacgagcatcacagacgtgcctgctggcgaatcagctaattgtggcaagaaaagtttaacgtacttggtcgatacctcgatcatagctggacggccccgactaccagactttttagtaccgaggagctgcccttttaagtagcaatggtgagttaatcgttgaacttaggtataatgaagacaggtacgttcgcagaatcagcgtgaaaggggtggatgccatggtctggcttctgattgttgtactgcttgttgtgcttgccactctctggttattcagaaaacgttggcggcgaaacaaggcgattcagatcctgctctaccacagccaacgattaaccgatcaggcgatgacagaggctctacagcagcttggcatctcaactgacaagccgatgacgtcaaagcccatcgccgatatttgggggcatggggtgatggcattttcatatcaaatttcgtcaagtctggggaaagtcacccagccggcacttgatcaagctttacgccaagcagccagacagttagacattgccagctcagatccggcattgccaccgtttgttttaaccgatttttttgaactcgaaggcgaattacatattgatgttgcctttattactaacgaggcaactattgaatatgttcgcgacgttaatcgtgtgtcgtcataggcagataaggagctcgcgcgatatgaatgatgatcaagacttaatcatgcgtcaaatcaaaagctttgctcagggattaggcgctgctttgggcaaaaatcaacgcaaatcagaccaacccgtgatcgtttttcacgaagcagaagtgagtctggccagttatcaaaaaacgctcatgactgtgattcgtgaaaaagggttaatcgcggcccaagcacaattgaaaaagtggcaacagacaagattgtctgctcaccaatatcagcgtttaaatgcgtggattcaagaacagcagttaataaatcgtaatccggacaagtaaaaaagcagcgagccgttttataaggctcgctgcttcattgtttaatggatcagaaccgcttccggatcaatcgagaagggatgttccttgttaatgtggtcatagaataaaacgccattgaggtggtcgatttcatgttgacaaacaattgccggatagtttttgagtcggacttttttgtgttcgccggcttcgttttggtaagcaatcgtaatgcgatcggcacggacaacgtaacccggaacatctttatcaaccgagagacaaccttcgccttcagccaatgcggcatgttgcacactgttactaataatccgcggattaattaaaacttctttgaagagaatttcatcgttgtcaccaggaaccaagacagcggccattgctttactttgaccaacttgcggcgctgccaaaccaacacccggacgcaaatgatatttctcgttttgctcttcgtcttggctgataaccaagtatgccatcatatcatgcgccaattgcttatcttcatcggaaagcggaaaagtaaccggtttggccctttctcgcaaaaccttagcgccgtcacgggtgatatccttcattaaatacacgatccgtacctccgttcatttcttctattagattagcacaggagcgaaaatgtgaaaagcgcgttattgcagcaggagtcggagtgttgacatctaccacccaatcctctatcatatagaaggttcaacaaatacggtgctttccgttaggtgaggctcctatacgaacaatgctgctgctcagaaacatcgagagatgccaattgagtcaactgcgtctgcccattaaggcttacgctaatgcagctgaagctcgcttctaggcgtatagtgctaaaactaaacgattgggatgctttttctgcacgctctcaatcggcgtgcagtttttttgcttgatgggaagaaaaaaggtggtgagcataatggaacaatcttcaaagagtagtggtagtagtagcgatttagcagatcccggaaggcccattatgctgccactacgatctcttaagtgaaattaatggattcggcagcatcgcggctcttcccgggatacgggaaggagtttgtcgatgttgatgatggtatcaagcggtctgacacgctacgaagcgcagaaggcccaaaaaacaactaccatacgccaagaaacgatcagcaagacgaatctctttttgcccttgctgatgacattggctggtgtgagcagtttaattatggttatgagccacagctggtttttaactgctattgttgcgattttggctagtttgacggtgatggtcattgcttatttggcaaaagcaatcacgcgccatcaaggtcagccgcagcagccagtgttggtcgtgcgtgacggattggttcgtcaagttcgcgcgcaagatctcgttgttggtgatgttttaatgctgacagcaggagaaaagctgccggttgatgttgcattagctcctggtgcatccgtaaccttgccacgtgacctggccgggctgctgattttgttaaatcggcgggtgccaaccggggtgggtattgccggtgctgtgatggcaaccgatacccaggcaacagtgaccgcagttttaaatgacggattgcttgatcatggactcaagcaattggctggacaatctgttacaacaacgccaacttcacttgtaacgagtgcggttgccggcctgaaattggtcttacaacagatttgccgaattttccgtctggctgtatcagttgcgtcacttgaaatgttaaaaaataagcaaatagaccgagacgagcagattcgggtagagatcgcatttgctcatcacgctaccttggttggggccatgaaacatcacagtaaaactagtgattttcggcacaaccaagatccagtctcgtgaagcttggtcattaaattcaattatgaaagcatgcgcttgtgaaggcgcatgctttctttgtgttttagtttaaaaagtattctgttatagtccattaagctttcggataagcggcaatcttatcgcaagtcagttcttgctcaccttgaaataaaacgcttgcaacaagaattttgcaatgttacgctttctttgtaggagttttaattagtacagttttcctgagttaatgactacaggaatggaaagaggttctgattatggcaaaacagcatgctgcagttgattttaagcaactgttggacaatcaagatgccgattttaagcccacgatccaaattctggatgaagttggcaaagtcgtcaatcctgatattatgcccgatttgagtgatgatcagctggtcgatttgatgtcaaaaatggtttggcaacgcgtgctggatcaaagggcgacagcgttgaatcggcagggacgattaggtttttatgccccaagtgcaggcgaagaggccagcatgattggtagtcacgctgctatgaagtcatcagattggctgcttccagcttaccgtgatttaccgcaattgattcaacatgggttaccgcttgacaaagcttttctctggtcgcgcggtcatgttgccggcaatgagtatccggaagattttcacgcattaccgccgcaaatcattattggtgcgcagtatgttcaaactgcgggtgttgcgctcggtttgaagaaaaatggcagtgatgaggtggccttcacctatacgggtgatggcggtacttcacaaggtgacttttatgaaggcgttaactttgctgggcatttcaaagctccggcactgtttattgttcaggataacggctttgctatttccgtgccgcgggcgagtcagacggcagccaaaacgcttgcgcaaaaggcggttgcagccggtgttcccggcgtgcaggttgacgggatggacgctttagcagtctatgaagtcaccaaggaagcccgtgcatgggcggcggctggtaatggtccggttttgattgaaactttgacatatcggtatggcccacacacgctatcaggtgatgacccaactcgttatcgctccaaagaaaccgatgagttatggcaaaaacgggatcctttaattcgaatgcgcaactatttgaccgataaaggcttgtggagcaaagacaaagaagatgccttgattgaaaaggtcaaggatgaaattaaagatgctatcaataaggccgataaagcgccgcagcagacggtatcgcgcttcttgaaagacacctatgaagtcgccccgcaaaatgttgctgaacaactggcagaatttcaaggaaaggagtcgaagtaaccatggcacaaaaaacaatgatccaagccattaccgatgcgcttgatgttgagttggcgaacgaccctaagaccttggtattcggcgaagatgttggtaagaatggcggggttttccgggcaaccgatggcttacaggccaaacacggtgaggatcgtgttttcgatacaccattggcagaatcaggcattagcggtttggcaattggacttgccttgactggttggcggccaattccggaaattcagttctttggtttcgtttttgaaacgatggatagcattggcgggcaaatgtcacgtatgcgctatcggatgggcggaacacggtccatgccgattacgattcgggcaccgtttggcggtggcgtccatacaccggaaatgcatagtgataattttgaaggattgatcgctcaatttcctggtatgcgggttgttattccaagtaatccatatgacgccaaggggttactgatcagttcgattcgcagtaacgatccggttttgttcctggaacacatgaaactttatcgttcattccggcaagatgttccggatggcacttacacggttccactggataaagcagccgttacccgcgaaggcacagatgtttcgattatcacttatggtgcgatggttcgcgaagcacttaaggcagctgataatctggcgaaagacggcatcaacgctgagattgtggatttacggacgattgcaccgcttgacgtcgagacgatcattgcttccgtcaaaaagacacacaaagcggttgtggttcaggaagcgcagcggatggccggcgttgcttctaatgtgatcagtgaaatttctgagcgggccattttatcgcttgaggcaccgattggtcgggtcgcggctccagataccccattcccatttggccaagcggagaatatctggttaccaaatgctaaggatatcgaagctaaagttcgggaaactgtcaatttctagagagaagaggtgccaacatggcttttgaattcaaactgccagaacttggcgaaggtttggcagaaggcgagatcgtcaagtgggacgtgaagccaggcgatgacatcaaggaggatgacaccctgcttgaagttcaaagtgataaaagtgtcgaggaaattccttcaccggtttcaggaaaaattttgaagattttagtaccagaaggtgaaaccgcttcagtcggtgatttactggttgaaattgatgatggctccggtccggccgcacaacctgcagccgcacctgccgcggcaaccgatgcttcagcaggcaatgcgccagttgctaagtcggtctatcaatttaaattgccagaacttggtgaaggtctggcggaaggtgaaattgtcaagtgggcggttaaacccggtgaccagatcaaagaagacgatacactgcttgaggttcaaagcgataaaagcgttgaagagattccatcaccagttgccggaaccgttgttaaaattttagtaccagaaggcgaaaccgcaactgttggcgaagcgctggttgatattgacgcaccggggcataatgatacgccggttgcatcgggtaccgctgcagcgccccaagccaatacggatacggctgcctcggccgcggcaccagctgctgccggatcagtaccggccatcaccgatccaaatcgggaaattctggcgatgccgtctgttcgccaatatgcacgcgaacaaggcattgatatttcacaagtgccagcaactgggaagcatgggcgcattaccaaagccgatatcgatgcctttaaagcaggggcaccagctgcagcacctgcgcagccagcagcaacctccgcgcctaaagcagcgcaaccagctccagcagcaacaccggcagcgccaaaaccgcagccagtcgcgccttacgtttcaaccggcagtgaagccgagctggagactcgcgagaagatgacgccaacgcgcaaggcaattgccaaggcaatgttagcttcgaaacaacgaagcccgcatgtcacgagctttgacgaggttgaagtgtccaagttaatggcgcatcggaagaagtacaagcagtacgcggctgataaaggcattaaattaacgttcttgccatacatcgttaaagctttggtcacggtattgcgtgaatatccagaatttaatgcgtcaattgacgacaccaccgatgagattgtttacaaacattactttaatatcgggattgccacgaacacggatcatgggttatacgtgccggtcatcaagaatgctgatgccaagagcatgttcgaaattgccaaggaaatcagtgacaatgcacaaaaggcatatgacagcaagttgaagccagatgagatgcgcggcggttccatgaccattagtaacgttggttcaattggtggtggctggttcacaccggtgatcaatcagccggaagttgccatccttggtgtcggtaaaattgctaaagagccatatgtcaacgctgataatgaaattgttgtcggtaacctgttgaagttgagcttgagttatgatcatcgcttgattgatggtgctttggcgcaaaccgcattgaatctcatggataaattgttagcagaccctgatctgctgttgatggagggataagcatggttgtaggcgattttgcaatcgatttggacaccgttgtgattggctctggcccaggtggttacgtagctgcgatccgagcagccgaaatgggtcaaaaggtaactgttatcgagaataccttcattggcggggtttgtttgaatgttggctgtattccatcaaaagctttgatcaatgccggtcaccgttatcaagatgccttggaagcaagcacgtttggtattaatgccaagggtgcggatcttgatttcaaaaaaacccaggattggaagcaaaacaaggttgtacacacgttaaccagcggtgttgcgatgcttttaaaaaagcacaaaatcgaaaccattatggggacggctttcttgaaagatgatcatagtctgcgggttatgcaaaaagactcggctcagacatacaccttcaagaatttgatcattgcaaccggaagccggccaattgaaatcaaaggcttcaaatttggcaaacggattttggattcaaccggtggcctaaacttaccggaagtaccaaaagaattcgtggtgattggcggtggctacatcggatccgaactggcgagcgcctatgctaacctaggcgcacatgtcacaattcttgaaggcaccagctcaattttgccaaactttgaaaaggatatggttcaactcgtcttgaactcctttaaaaagcgcggcgttacagtgattaccaacgcgatggcgaaggaagccgaagataccggcaatggcgtcaaggtaacctatacagcggacggtaaagaacaaaccattgccgcagattatgtgatggtcacagtcgggcggcggccaaataccgatgatttgggcttagacattgttggcattgaaacaacggatcgcggcttgatcaaagtcgatgcgcaaggacgaaccaataagcctaatatttatgcaatcggtgacattgttcctggtgctgcattagcgcataaagcaagttatgaaggtaagatagcggcagaggcgatcagtggcaaggcaagcgcggttgactataaagcaatgccggcggtttgtttcacggatccggaactggccacaaccggcatgacgcttgctgaggcaaaggataaaggcatcaaagctaaagcaagcaagtttccatttgcggcgaatggccgtgctttaagtttggcgcaaaccgagggcttcgttcgtctggttacggatgaaaacggaaccgtcatcggtggtcaagttgctggcgccggtgccagtgatttgatctcagaattgacggtcgccgttgaaggtggactcaacgctgaagatttggcgttgaccatccatccacatccgaccttaagtgaaaccattatggatgatgctgaagttgcattagggttgccaattaatatctagcaagtagattcatattgccaacatgatgcactgttaaggtgggtatcgacaactgattgtctgtgcccacttttttgatgggaaagcacaaagtcaaaagccgaaagtgcgagtgtaaggacttcatgaaaaaggactaatatttcagttagttaacaattgcaaaaataaccctgtttaattttgtcttaagattgcgcttccgctaaaatgtagataacgcagctgagaggaagggttttcatgcaaagagtcgtggtacatggtgccagcacggggacacaagggcttttacaaatgctgattatgtcattgcttgatttgcaagtcggctgttatgaacctgatgaaacattggttgacgtagccgggttgacggccttgagtcaaatttgtcacaatacatttgtgaaggtgacgcccaaagttctaaaggcagccgatgttttgattctgactgacacagggacgccagcagatgaggggtttgtagccactaatattacggccattcggaaagtgctaaattcggcaatggcagcagggtttaaggggcggattatcgttgccatgacccatgacgagcttttcacctatttcgctcaacgattttccggcttgaataagcgtcaggttgtcggtttaggtacttttggtgcaacctggcaatttgaacaatttctagcagagcggttggcggttcccgccgctcaagtgactgcctatgtggtcggaaccagtcagacgccggttctggtttggagccgagcctatgtaggcgccacgccggtgttgcgcctactggatgaccagacaattttttccgaggctgtgaaggcggttcagactttcttagccagtacgttgaccgtgatgcttggcaagttggttgaaccgatcctagctgcttttgccggtgatggggtgataggcacttttacccacttacgcgatgccgatgatggtacaggacagattagcagttcgccggttttattggatgaacgcggggtggtgacgttggcgatggtggcaggttccgatgatgaagaagctgccttaagccaagcgattcaagcagcccagacccagattgaagcgatcgaacaaggagcaaataagaatgaaagctaactatcattatcccttagatctcgattggaccacggcagaaaagattaaagtgaccaccttttatgcgttggtcgaggatgcttatgagcatggggttgatcgggataacctacttgctgcctataagggtttcaagcaggtcgtaccggataaaggaaccgagcgtcaactggggcgtgaatttgaaacactctctggttactcgatgtacacggtcgtacaaatggcacgccaaggtgtgagtcaaaagattagggtgagggtgagttaaacatgacacaagatccagaaaagatacgtgagacattgatcggttggtttgctgccagccggaaacgcattttgacagcaatggcacagccacttgatgttgcccaaaaaagcaatcgcaatgacctagtcaccaatgtcgataaagccaatcagcaatttttgattgaacatatcaagaccgattttccaacggcgcgaatcattggcgaggaaggtcacggccatgatgatacggatcttaatgggttggtcttttttgtcgatccaattgatggcaccatgaattttgttaaacagcaggcacattttgcggtgatgatcggtgtctatcgtgacgggcaaccgattgtcggggctattatggatgtgatgcgcaatgaagtgttgagtggcggtccgaatctaccagtcacgtttgccggacgtcagttgaagccattaccggatctgccactgaaggacggtttgttgggagtggcagggcccatggctatcaagaatcgcttgcatttaggtgatgtggccttagctagttccggtgcgcggatgagtggtagtgccgggatggaatttattgaagtcgccttaggaaggcaagtcggctatgtttcctatctgcagccttgggatgttgcagcaggcatggcgattacgcaaggcttgggcgtcgagtttagtcgggaagacggttcggcaatcaacttaagtcagccaggcgttgtcgtggcagcgaccccgcaagcacatcaaacgattctagccatgatggccggtaaaagtgaacaggcgcattaacgccgctcattaacgagcaacctcaaaaactggcggagacgattcccgtcagttttttgaatgtatggcctagatgcacggatttcaaagaaaattccatcaaatcattcgcgtgaatcacttcacttttcagaaaactcacacagattgggtagaatgtgttataattcaaaatcgtataactgtgtcagttgctggcacttttttaatgcggtaagcggccagtagtgccagcagaaaggaagtataaacgtgaaaacacgtgacgatattcgcaacattgcgatcattgcccacgttgaccatggtaagacaactttggttaacgagatgcttaaacaatcggatacacttgatcaacacattcaattacaagaccgggcgatggataccaacgccattgaaaaggaacgcggtattaccatccttagtaaaaatacggcggtgaaatacggcgacaccaccatcaacatcctcgataccccggggcatgctgactttggtggtgaagtagaacgggttatgaagatggttgacggcgttttgctcgttgtcgatgcattcgaaggcccaatgccacaaactcgctttgttttgaagaaggcgcttgaacaacatttaacaccaattgtggttatcaataaagttgaccgtcccggtgcgcgtcctgaagaagtggtcgatgaagtgctcgaattgttcattgaattgggtgccgatgatgcgcaattggaatttccagtagtctatgcttcagcggttaacgggacttccagtatggattccgacttatcaacccaaaagcacacgatgaatccgctttttgagaccatcatcaagacgattccagcgccaatcgataacagtgacgaaccattgcagtttcaggtggccatgttggattacaacgattatgttggccggatcgggattggccggattttccggggcaagatcaagatcggtgacaatgtaacggttatgaaacttgacgggtcacaaaagaacttccgggttaccaagctctttggtttcttcggattaacgcggaccgaaatcaattctgctaaagccggtgacttgattgccgtttcagggatggatgatatctttgtcggcgaaaccgtgaccgctgccgatacgccagaggctttgccgattttacggattgacgaaccgactttgcagatgatgtttgtggctaatgacagcccttttgccggtcgtgaaggtaagaacgtaacggcgcggaaactagaggaacggttgaaggcacagctgcaaaccgatgtctcgttgcgtgttgacgatacggatcaagccggtgcctggatggtatccggtcgtggtgaactccatctttccatcttggttgaagagatgcggcgtgaaggctttgaattacagcttggccggccagaagttatctatcgcgatattgatggcgtgacgatggaaccgtttgaaacggtgcagatcgatactcctgagcaatacaccggtacggttattgacgctatgagccaacgcaaaggcgaaatgcagaatatggaaaatgaaggcaacggtcaaacgcggctcactttccttgccccatcccgtggtttaatcggttattccaccgaattcctttcttctacaggcggttatggcatcatgaaccatacgtttgaaaagtatgcgccagtgatcaagaactgggaaccgggtcgtactcaaggcgcgttggtatctatcaatgccggcactgcgactacctacagtctgcaatccgttgaagatcgcggccaactcttcatcaatgctggcacggaagtttacgaaggcatgattgtcggtcaaaactctcgtgaaaacgacattgctgttaacgttactaagggtaagaacctgacgaacacccgtgctgccgggaaggaccatgcagctgccatcaagacgccaaagaagatgacgcttgaagaatcgatcgagttcttaaacgatgatgaatattgcgaagtaacccctgaaaacattcgcctacgtaaaaagattctaaacaccggcgaacgtcaaaaggctgcaaagcgtaagaagattgctgcttctaaataatttttcagaaaaccgtcaaattctggcgttttttttgatctccaaaaccaatatttcagcatcggcatcttttgaccatcgtgggtagcggctttcatggcaggcaaagggcaggaccaatcacggtgcgtatttctgactaagacaaactaaacttcctgataacgattgcctgtgcggcttggcggtacgagccggtatgctataattaatccaatcattgcttgaaaggccgcgttttcctaatgaaaaaaatacgccatatggattatttcatcttggtgccgtatctgattttgtgtgcgattggaatcgtcatggtttattctgccagcgcctattgggtacaacgtcaatatggcgccgccgaaactaaatacttagttcagcagattctttttgtgattcttggcatcggaacggtattcttcttttataagatgtcactcaagattttacgtaatcgctgggtgctttttattttgatgagtaccttgctggtgttgttggtttatttgatcctgcatggtcgtgcggtcaatggggcatcggcctggattacgattggcggttttcgattacagccatccgagtttgccaaaatgattttgattttttatttagcgcatatgttgtcatcgcgtgaaaacagtttccagcaagaaaatttccggttacaccaaatgtggcagccgctgtttatggccggcgtcatcatgtttttggttttcattgagccggacactggcggatttgcgattctcttcttgattaccttggtcgttgtgatgtccagcgggattcccatgcgctatggactgctctgggtgttggggttgattgcaaccggcgtcttagggtactacattgtgtcgcattaccattttgccggtcttgaaaataactatgcctaccagcgattggtagcggcaattcacccgtttgagaaagccaatgctgcgggtaatcaggtggtcaattctctttacgcgatcaatcatggcggctggttcggagtcggcttgggaatgagcagccaaaagctgggctatctgccggagccatatactgacttcattttggcagtgattgccgaagagctcggattggttggaaccgtggtcatcttaagcttattatttttcttagtgatgcggtttttcttaatcggggttcggtctaaaaatacgtatcacacgctgattgcttatggcattgcgacgatgatgctggtgcaaaccattttcaacgtgggtgcagtggcaggcgttatccccgtgaccggtgtgacattgccatttattagttacggcggatcgagtatgatcgtcttatccatggcagtggggattatgcttaatattagttatcacagcgaacgtacgcaacgaaaggtagagaagacgcatgcataaagttttagtcgcaaatcggggcgaaattgctattcggattttccgtgcctgtgaagaactgggcctaaaaaccgtgggcatttatgccaaagaagatgctttgtcgattcatcgttttaaggcacaggaaagttatcaggtgggagtaggtaaggcgccgatcgctgcgtatttggatatggatgacattatccggatcgctaagcaaagcggggcggatacgatccatcccggttatggtttgctttcggaaaatgctacctttgcgcgtaaagtacgtgcggccgggctgacgtttgttggaccgcgcttggaactattggatgtgtttggcgataaggtagcggctaaggaagctgcccacaaggctggtttaacgaccattccgggaacaccggagccaacgcgtgattttaccgaaattcaggattttacggctaagcacggcttcccggttatgttaaaagcggcaagcggcggcggtggtaaaggcatgcggatcgtgcattccgaagccgaattagaagccgtttaccaaaatgcggtcaatgaagctaaagcgagttttggcgatgatcggatgtatgttgaaaaatatattgcgtccgccaaacacgttgaggtacaagtcctgggcgacgaacatgggcatttgctgcatctttttgaacgtgattgttcggttcagcgccggcagcaaaaagttgttgaaattgctcctgctgtggctttgccgttagcattaagaaaccgtatctgtcaaagcgccgttgatttgatggctagtctgcattatgaaaatgctggcaccgtcgaatttttggtcgatggcgatcagtattactttattgaagtcaacccacgtgttcaggtggaacataccatcacggaactgattaccggggtcgatattgttcagtcccaattgcgcattgctgccggagccgatttatttgcggacttgcacttaccgcagcaagatgcgttacgggaaaatggggcggctattcaatgtcgcattacgactgaagatccagaaaataacttcatgcctgacaccggcacgattaatacttatcggtcaccaggcggctttggcatccggcttgatgttggtaatgcctatgcgggtgccgttgtcagtccatattttgattcgttattggttaaggcaagtgtccacgcacctagttttcctgctgccgtggctaagatgcagcgcgcgttacatgagtttcaaattaccggcgtcaagaccaacgtcgcctttttggaacacttactggcaactcagacattccggaccggtgaggcagaaacggcctttattgatgcgcatccggaattgttgcaagtgcaggcgaaaccagatgttgcttcccggttgctttggtatatcagcgatgtaaccgtcaacggctttaaaggggttgaacggcaaagtcaaaagtactatccggagttgcaatatgcacgccatttttctgctgctaaaccgcagacggatttggtggctctacttaaaaatgaaggtgcccaggcggttacggattgggtaaaggctcatccagcgctgcttttaaccgatacgactttccgcgatgcccatcaaagtctgtttgcaacgcgaatgcggacccgggatatgttaacggtcgccgaggatatgggaaacggcttgcctaatcttttctcaatggaagtttggggcggtgcgacttttgatgtagcttaccgctttttaaatgaggatccgtgggtgcgcttgaagaagttgcgagctgctttaccgcataccttgttacaaatgctttttcggggtagcaacgcggtcggttatcaaaattatcctgacaatgttattaaggccttcattaaccaggcagcaaatgacggtgtggatgtttttcggatctttgatagtttgaattggttgccgcagatgaccttgagtattgatacggttaagcaggctggcaagattgccgaagcgaccatgtgttataccggggatattttaagtgacgcccatccgaaatatcagttggcatactatgtcgacttagctaagcagttagttgatgccggggcggacatgattgccattaaagacatggcgggactgctcaagccacaagctgcgactgaattgatcgcggcacttaaggatgcggtgacggttccgatccatttgcatacgcacgatacaaccggtaatgggattgcaacttatctggctgctaccaatgccggcgtggatattgtggatgtggcgcaaagcagcttttccgggaccaccagtcagccgagtctggaaagcctgtattacgcgttgagtggcaatcaacgtcagccggaagtcgcgatcgaaaaggcgcaatcgttgaatcgatattttcaggcgattcgtccgtattatgcggacttcagtaatggggtgaccggtccgttaaccgatatttacactgtccagatgccaggcggtcaatatagcaatttacaacaacaagcacacagcatgggcattacggattttgaggcagttaaagccatgtatgcgcaagtcaatacgctgtttggtgacattatcaaggtgacgccttcgtcaaaagtcgttggggatatggcattgtttatgttacaaaatcatttgaccccgcaagacgttaaggaacacggagaacaatacgactttcctgcttcagtcgtggcctttttcaagggtgacttagggcagccggtcggtggttttcctaagaccttacagaaaaagattctaaaaggacaaaagccgttaaccgtgcgtcccggacaattagccaagccggttgactttgaggcggtacgacaggatttaatcgcggcaggtgtgccggatccaagtaccgaagatattttaagtgccgttttgtaccccgatgttttcaaggcctatgcgcgcaagcaaaagcaaatcgggccggtgaccaaattggattcaccttcctattttcaaggtatgcgcctaggtgaaacggtggcggtcccaattcgggccggcaagacgttgattattcaactgaatgccattggcaaagcggacgccagcggaatgaagacgttgtactttaccgttgatgggcagaaacaggaaattcagatccgcgacgctcatcaaaagagtgctggcttgcagcatcagttggccgaaccaaccgataagaatcaaattggtgcgccgatggctggaaaaattgtttcggttgccattaagcaaggacagcatgtggccaaaggtgaggctttgtttgttattgaagcgatgaaaatggaaacaacggtacacgcaccattttccggaacagtgacccatctgtatgttgaagcaggtgcattaatcaagagtcaggaactgttggctaaactgcaacccggggccgccaagcagtgagtttagaaggtgagaacatgtttgcaatgaaacagcggcaaggtttagtcgtttgggtctattcacttaagcaattaaagaccttgcgccgttatggcaccattatgtacgtttcgcggcggttaaaatacgtttatttatatctggatcgggatgaaattgcagcaacgagtcacaagcttataaaattgcggttcgttaaacgcgttgaaccgtcacatcggcctgagttgaaaacagagttcggtgatgaaattggcaaattcaagccgactgaggaagatttggaaaccaaggcgaaaccccaacgacacgcccgacttttaaccggcgaggcaaaaggtgatcaacatgcgcgtcattagcggtacatttcgggggttacgtttaaatgcggtaccgggtaatcaaacgcggccaaccgccgataaggtaaaggaatcaatgtttaacatgcttggcccttattttgatggtgggcatgcactggatttgtatgctggcaccggagcgcttggcatcgaggccgtatcacgggggttgacggatgcagttttggtggatcggcaatatgcagcgatcaaaaccattcacaccaatgttgccctgactaaacaggcagagcgctttacggttttgaaaatgtccgtgacgaaagcgattagccattttgcggccaatcaccagcagtttgagcttattttgatggatccgccgtatgcccagcagcatgttttagcacaattagctgcgtttgtcagccaacaattagtggtgccaggcgggcgggtgttagttgaaaccggcttggatgttgattatcctgaggtcatccccggatataccaaaatacggcgtcagacctatggcgttgcgcaggtgcttattttagagcgaaacgaggaagaccatgactaagaaaattgcagtatttcccggcagctttgacccgtttacaaatggccatttagacacggtattacgtgccagtcgcttatttgatgaggtggttgttgcggcgatgacgaacaccagtaaacgcgcgctgttttccagtgatgaaaaactcgcgctgatcgaggccagtactgctgatatagcgaatgttaaggcagttgcggcccctagacggttgacagttgaatttgcccgttcaattggcgcacggtttatcatccgcggcatccgcaatgttgccgattttggttacgaagctgatattgccacggttaatcatgacttggatcaggaaatcgaaaccgtctttttgctagcagacaaacagtacgatgccttgtctagtacgattattaaggaggtcgcggcgtttgggggcgacatccatcgattcgtaccggcaccggttgaaaaggccttatatgcgaaactaggtgagtctcatcaagcaaagtaatcatttgaagtccaaaaaacgttggcggtggctagttggcgcgattattgccatcgtcttgatcgccgcgtttttattctttcccaccaattattatttggaagtacccggttcagccgaatccttaaaaccgtttgtcaaagtcgccggcaccaaagataaagccaagggaagctacatgctgacgacggtcggtgttgtgggtccggcttcccctgcgttattacttttcagcaaaacccaggcgcataccgagattgtgtccaagcaggatttaatgggtagtgacagcagtgccgaatacgatcagttgcagacttactatatgaaaagtgcggccaataacgcggtagcagctgcgtttaaagccgcaaaacaaccggtcaaaaccgagcatcgcggtatctatgtgatgtccgtgttgccacaatcaccatttaaaggcaaactagccctcggagacacgatcacaaaattgaatggtaagtcttatcaaacggcggatgcgtatgtcaatgccatcaagtcaaaaaaagttggtacgaatatcacgttaacctaccaacataagggccaaacgaagcaggcaaccgctaaactaattcgtctaccgcagaccaaacgagcgggtattggcattactttaactgagaatacggcggtgaccagtgatcctaaagtgacgattgatgcgggaaacatcggtggtcctagtgccggcaccatgtttgctttgcagatttatacgcaaatcacccaccaggatttacgtcggggtcgaatcatcgcggggaccggtacgattgatccagatggtcatgtcggtcagattggcgggattgataagaaagttgttgccgcagatgcaaaaggtgccaagattttctttgccccgaatcaaccggccacaaaaaagttgaagcattacgatcctaattatgtcaataactacgccgaggcggtccagaccgcaaagcaaatcaagaccaaaatgaaaatcgtgccagtcaaaacgctcggtgacgtcattcgttatatgaaagcttatgccaaagctgaccagtaagtggttagtggttgtaataagttcaatttaaagaagaactgttgaaaaaacagttctttttgtttgccatgcgtaatgtgttgttgaggtgagaaaaatggcgacactgatttattggctgaaaacatattggtatgcacccttgattattttaatcggcggtttctttttttggcagcaggcgaaggcaggatcggcaaatcagcctttgtcggtgagtgtgaattcccatagtagttcgcacatggcggcgtcacgatctagtaaggcaacaagcatgagtggcagtcatcgtccgagccacggtttcgtgcatttaaaaggcgcaatacaacatcctggcatttatccggtcaaagaaaacacgcgctgggatgaagtggttaaagctgccggcgggttgacggcagcggctgatatgcaacaagtcaatctagccaagatcgccagtgatcaggaaagcctgtatgtcccggaaaaaggcgaaacgtcaactgcaacggcaccaactaccacggcaggtggcacttctgctactgggaagcccacccagactgccagtggtgccgttgttgatcttaataaagcggatgtggcgcaactgacgaccatcagtgggattggccccaaaaaggctgcggatattattagctatcgcgacagtcatggtgggttcaaggatattaacgaactcaaagaagttcatggtatcggggataagacttttgaaaccctggcgccgcagctaaccgtgggcccatgagcgggcggttaatcttacttgcggctgctttacttgccggcatcatgggcggtatcggtttgtggtgggtgctggctatcttgcttatttggcttgtcatgaaaaccaatcgaaccagtttcgtttatgttggcctttttttagtcatcggctgggggtgcggaagggcagatgccaatcaatggcagaatccgccgcaaccccgtggtagtgtgaccatcccggcgtcagccattaagctcaaagacgggtatgtcagctttatcggtcgggctgccaacgggattgccgtcagtggtcgtggttcggtctcaaaggaacttgcggaacggttggctagtaatgatcagccggtacaattggccggtggttatgaagtagcacgtttggcacctgcacgtaatcagtttgaatttgattatgcaacttatgcgtggcaaagccggcagcttgcctatgaattagtcaaaccgactttgaacttttcttttcaaccacgaagacaattttttgatgtcgttgatagttggcgcgtccatctgtttgcttatttcgaacaattaccgaacaaggtacgccaatatgccaaagggttgcttttagggcaattggatgatgattttttaacgcaacgccaagcatttgttgatttaggcgtctttcatctgttttcgatttccggattgcatctgttcgccttggttgcctcgctttattggttggcagcaaggttacggataccgcaaggattagtcgatggcctgctattgggattgttgccactatttttattattgctgccattaggtgcgggcttgtggcgggcggtatggatgcggttagctgatattattaatcggtatcttcggtttggcttaaccgggctggatctgtttagcatggtgttgatggtcaacttgctctggcaaccgcgtgtcttgatgaccatgggcgggcaattgacgtacttgatgactgggttgctcattggtttaccggcgctgcataagtggcaggtgaattggcggttagtattaggcggcatgcctgtcattgcctggcatacgttcagctttaatcttttgacggtattcttcaattggcttctcatgccgatttttgaactgatcatcataccggggttggtatttgccttattgatgccgcatgcagggttaacgtatttgtttaacgatgcattgcaattattagagaccatcctcattcggttgagtcacttgcctgggcagattattattggtgcgtttcccagctggttggctgtgcttggggtttttgctatgatgctggttttgacgtggcaatgttggcccgtagcagttggctggtttgttgtacttgccttgtggagttggtatcagccgaattatcgggtggtgatgtttgatgtggggcaaggcgatgcgattttgatcgaatccccgtttcatcaaggggttatgttgattgacacgggtggccgcatattcggcaaaaccagccatcctcctgttagccgcgcgattgtcccgtatttgcatgcacgcggttatgcccgcttgaatacgctggttttaacccatcctgatatggatcacgttggcgatgcacctaaacttgctgagttgataccgattgagcggctagtaaccaccccaaccgcgcagcatcatcctatgattaaaaaagttagccagcgggttgccgcaacgcaaacagtcacagcggatcaatggctgcaggtcgggccacttcgattacaggtacttgcgccaagtgccacgggccatcacgacccccaggatacaaacgcggattccattgttctctatggtaaaataggtaacagtcgctggttatttactggggatgctgaccaaaccgttgaaaaaacgcaaattctgccgcggcatttgcaagtcgactatttaaaggcaggacaccatggttcaaaaaccgccagtgcaccggcgttaatttcgagtttacagttaaaagccgctttaatttccgctggtgtcgataatcggtatggtcatccgcatccagaaacattggcaacgtttgctaatgcccatgttccgtggtcaagtaccagtgaacaagggatgctttgggtggaaccaaacccgcaacgtcaacaggatcagctatttggctggttgcagaaaaggagcagacaatcgcatgcaggtccgtgattttatcaaacatctgaaaaatggcgaacgaccgccgctgacattaattcttggcgaggagcaggctttacggcaacaggctcaacaagcgctggctaatttgattcctgaagaccaaaaagccatgaattttggccgttatgacatgcatcaaactccagtgggcgttgccttggatgatgcgacttcaattccttttttcggcgaataccgcgaagttgtgattgacgatccttactttttaaccggcgaaaaaagtaccgataagattgaacatgatctcaccggactgcaggcttattttgacaatccggttccgtcaacgatgatggtgttaatcgcaccatataaaaaacttgatgaacgtaaacggctgacgaaagctttgaagaaggcagctttgattgttgatgctgcgccactggatgaacggtcagcgcgaatggcattggcacaaatcttcaagcaacatcaagtcgatattcagccaccagcactcgatgcgcttgttcagcgaacgaacggacagtattcggtcatgatgggcgaagtccggaaacttctgacgtatgcaagtgatggtagtccattaactgttgctgcggtatcggcattggtccccaagcagcttaatgaccgggtttttgatctggtaacggatgtgttgcgtcaaaatgctgcggatgctttggcactttatcgtgatctgcttgcacaacgcgaagaaccgattcggctcaatgcgttaatgctaggccaatttcgacttttaattcaggttaagttattagcgcaaaaaggttacggccaaggtgatattgccgctacgctcaaggcccatccgtaccgagtcaaattagcattacggcaggttggtcgtttgccttatcaccaactggcccatgcttatagtgggctggtggatactgaaaccgcgatgaagacgggaacgattgataaggcactggcctttgaactgttcatgctgaagtacacaggtcaagcgtcagcgcatcggaaggggaagtatacggcttcacgctcctaaaactgagatggtcaatgatgcgcgggtgtgcctaaccgatgacaacaaaaaataacccttgtggacgaaatatcgtcacacaagggttattaaagttggcataacgccttgattacttgttaagtagggctgcaagacggctcttgtcgcgaccggccttgttcttcttgatcaggcctttgctgttagccatgtcgatggcacgagttgccgctttataaagatcctgactgttgtcagcattttgttcgcttgcactcttgaacttcttaacagcggtacgcattgcgttcagctgggcaatgttacgttcacgggcattttcctgcgtcttaacgcgtttgattgcagatttgatttgtggcatgagatgttcacctccaacagtggattatgataaaactgcataagtttcaacagacgctattatacagaagccagagcggcaatgcaataaaaagttgtaaaggaaaattgcttgatagctaaaattacttgcaatcagtggcagacttcggtaaagtatgaaggtacttttgaacctgatacttagtttagcgaaccaccgacgctttactcagtttcaggcaatattctgaaaggtggtacaacacaatggcaattgaccaaacgcaaaagaacgaaattatcaagcaatacgcacgacacgatggtgacactggttcaccggaagttcagatcgcagttttaactgctgaaatcctagctttgaacgaccatttatccgttcacaagaaggatcatcacagttatgtcggtctgatgaagaagatcggccaccgtcgtaatctgcttgcctatctgcgcaataaagacatcattcgctaccgtgacttaatcaagtcattaggtctgcgtcgttaatcacgtttaacaaaggtcgccgcggcggcctttttgcgtgtttttatattaatagcgggcatcagctagtggtaaaaggccaaaaagacagttccaacttacaggagggatcagctaatgtatccggaatatcggcagcgttatcaggatcagctagtacgcgtcaccattttaagcgtaacgacaacgattgcgtgggcgatcggcacgattggctcacagtgggcagttgccggtgtgagccctcgtgatgaaaagcaggccgcttcggaacaagttgatccggtactcgtcgaattggtccgcgttatcgcaggtcgcttagtcgacaaaaatttagcgacgacctcattgccggaatcattgctgccaatggtgacggcactgaccgagcatcactggctgaagccggattcggaatctgcgttaaagttgattccaaagccggcaggggcaccgctgaacttctggtcattgcgcaaggcggttttcttgacggttccccagcaaaaagttcgaccagctgatttgcatgagtggcttcggaatattttgccgaatgtccatgggttaggatacgggccggtgacagatctggctgccttagctgttttagcgctggataccagtcaccaccttgctgctggcagttcacctgaagtagcggtggtgctggataacggaaaagaagttgctgcgtatcatctggatgccgctcaaacaagcgataccgggtatcaaagtgcacttcaggcggctaaacaaaacctgaaaaccgtgcatcgcttttttgcaaacgaggtgtaactgcgcctccgcgttttaaggtgatatggtagttggaattttaattgtctgatagagcatgttgagctaacgttgtcgtttggatattaagtccacgttctccgtccagtgaccattttcaggggcattggatggatttttttatagcattcaacgccaaccatttgccgcctgaaattcggctctataggttttcgccttatcgtgtggtacacttgtatcagaatttattcggcggaggtatgcggcaatcgattgtcggcaaccatacttccataaattaaccacgaggtgaaaccatgacgaagatcaatctggtcgctcttggtggggtacgtgagaatggaaaaaacatgtacgccgtcgaagttgacgaccaaatttttgtatgcgattttgggttgaaataccctgataatgaattacttgggattgatgttgtgatcccggactttagctatttgactgaaaatgccgaccgaattgccggaatctttctaagtcacggccatgcggatgcagtaggagccttgccttattttcttgtggatcatccagttccggtttttggctcggaattgacgattgcaatggccaaggtcttcatgcagcatgacagcaaagccaagaagtttaaagactttcatgttattgatgaaaagtcggtcattgactttggtgatgtgtcagtgtcgttctttaaaacaacgcatagcattccaggctcgttaggtatcgatattgaaaccagcgaaggccagatcgtgtataccggcgactttaagttcgatcctagcgctaccccgatgtatcaaacggattgggcgcgattggcacaaatcggtaataagaaagtgttggcgttgttatctgattcggccaatgcagagtcgccttatccgaatgccaacgaacatgaaatttatgaccatatcaaagaaacttttgaataccaagatggccgaattatcgtggcaggtgttgccagcaacattcagcgcattcaacaggtgattaatgccgctgcatcgcttgggcggcgggttgtcttgaccggccgtgatgtcgaaaaggtcgttaaaaccgccattcgtatgggctacattaaattgccagatgatgacattttagctaaaaccaaagagctaaaaggcttggcaccggaaaagaccgttattcttgaaaccggccggatgggtgagccgatgaagtcattgcaacgaatggcaacatcccgtcatcggctgattcacatccatgaaggggatcttgttttcattaccaccacgattgcccatgcgatggaaaccatggcggctcgaacgaaagacatgatttatcgtgcaggcggggatgtcaaagtcttaggcgacgatattcactcttccggccacgcttataagaatgatttgcaactgatgatcgatttactcaagccagaatacttggtgccggtacaaggcgaatatcgcttacttgcagcccacgcggaaattgcgcatgaagctggcattccgttagctaacatcttcattgtcgggatgggcgatattttgcggtacgaaaaaggccagatgaacgcctctggtcatgttaacgccggcaataccatgatcgatggcattggcgttggcgatatcggcaatattgttttacgtgatcgcaaaatgctggccgaagatggcattttcattgcggttgtcaccattgaccgtaagaaaaagcgcgttgtttccaagcccaaagtcacaagtcgcgggtttgtttatcttaaaaccagtcgtgacttattggccgaaagcggcaccttggtaacggagacggtacaaaagaatctggataacaaagaatttgactggacccatttgaaacaagatgttcgagataaactcagccgcttcttattcgaacagacaaagcggcgtcctgtcattttgccggtcatcatggaagttaatcaaaacagtgcaaaacggcaataaacaacaaaaaattcggatcattttccgaatttttttattttcactgcaatatccgaataaaacaacgacaggaggaaggcatgaccaatatggtatcattacccgacaatgagcaacgtcacctgacaatcggcaaacaggcgctgcaaaagggtaactatgcttcggcggcggcgcatttagaaaaggcgtatgaagccacgcaaacttttgcaatcgcccagccattagcggctagtttaaatgggcttaaacagtttcatgaaagtcttaatgtgatgttggcgcattaccagtcgtttatgcaaacagacggtgatgtccaactggttttggacgcttggcttggtacgcttaactttgtcatggcgcgaacgatgctgcggcaacttgatccgattcggcgccagcgttttcgccagcaaattgaggcggcagaagctttagccttgaatgaacggggcgaacaaattgcggaactggttcgcaaagtcagccatctggggggcttttcccggcaggagcagcaggatctgtttaatcaggtggggttattgccaaaagcacaacttatcaaagcggcggttcccgacttgaccgatgaatcgattccagtggcgatgcgcgtgtcattgttagaccttttaacgaatgttggctatgatcaaccggtgcaatatcaggcttatgatcgagtcgaaaccattattccgagtgagttacccggcatggcggatgagccaaccgggccacagattctggatcgactgcaaaaagcattaggcgatgacgatcaggagctggggcaagcattggtccaaatggcgcgggtacagattgcctttttatatccggatatcagtcggctaattcctgaccaagcggcatttgttcaagcctatcttgatcatcatcaggggaaaaccaccccgtttgacgatctttttgcttggcaagcggctgaaacagcgaaattgtccgaataggcgtgatgacacgttttcactgtaaatgaaagaaacttgacggtagctgtttacaaagtgaaaatgaccatgtatactcattgctggaattcatttccagcgtagatatttgttttggtatttacgctcaaatgtagtacacttaaacgtaaaggattatcagggtacacaaacaaggtatcctgtattcttacgaaaaatacaggaggttcgttttttcatggctgaaaaagaacactatgaacgcacaaagccccacgtaaacattggtacgatcgggcacgttgaccacggtaaaactactttgaccgcggctatcaccaaggtattgtcggagaaaggccttgcccaagcgcaggactatgcttcgattgatgctgctccagaagaaaaagaacgtggtatcaccatcaacaccgcccacgttgaatatgaaacggaaaagcgccactacgcacatattgatgcgccagggcatgctgactacgttaagaacatgatcaccggtgctgcccaaatggacggtgcgattctggtcgttgctgcaactgatggcccaatgccacaaacacgtgaacatattctgttggcgcgtcaggttggtgttgattacatcgttgttttcttgaacaagactgacttggttgatgatccagaattgatcgacttggttgaaatggaagttcgggaattgctcagcgaatacgattatcctggtgatgatattcctgttctccgcggttctgccttgaaagcacttgaaggcgatcctgaacaggaaaaggttatcatggaattgatggataccatcgatgaatatatcccaaccccagttcgtgaaaccgacaagcctttcttgatgcctgttgaagatgtcttcaccattactggtcgtggtaccgttgcttctggtcgtatcgatcgtggtacggttaaggtcggcgatgaagttgaaatcatcggtttgaagccagatgttctcaaatccaccgttaccggtcttgaaatgttccgtaagaccttggatcttggtgaagccggcgataacgttggtgtcctgcttcgtgggattaaccgtgaccaagttgaacgtggccaagttttggcaaagccaggttcaatccagttgcacaacaagttcaagggtgaagtttatatcttgacaaaagaagaaggtggccgtcatacgccattcttctccaactatcgtccgcagttctacttccacaccaccgatgttaccggtgtgattgaattgccagatggcgttgaaatggttatgcctggcgataacgttactttcgaagttgacctgatcgctccggttgctatcgaaaaaggtaccaagttcaccgttcgtgaaggtggccgtactgttggtgccggcgttgtttccgaaattcttgactaatttctgaataaacgtttaaaagcctgcaagcttgcttgcaggctttttttgtgagcgcgagccggcgcggttagaagtcggagtgtaagcggccttagccgtgatggccggtctttggccattgcggctaaggtccttacacgcagacttctgcgccggggagcgcgttatgggagtaagctgaaacatatgaggcgtgatggccggtctttggccattgcgcctcagggtctttacccgcaggcttctgcgctggggaacgcgttatagaaagtgagcgttagccagcgatgattacagggttccgtgtcaggacaataataatggataaggaatgaataatcgcggttattttgcgtttcaagatcttgacgcttgaacagtcttgggaaatcaaagattattttatcgaatcatgacaccaaaaaatctcaagtcgtgtttggcttgagattttttgggctattttcagcagggattaggtaaaccaagtaactgcaaaacattagccgctctgggtgatcaaggaagggatttaaaattaagctgactgtttaatttcgcttggctgtgtcactgtaatcttggttttagctggttcaattttgtccgcttccagaatgatgttaccgatcgattgtgctcggatgttgccgctgcttggattcttgacgctgataatatcggaacaaatgtcggcattgatattggtgctgtattcaaagaccaaatcggaatgaagcagtgcgcagtttttcattgttaaatgatcaacataacataacccctgattgctctcgattgtacaattgataagcgtcagattttttgtattccagcctagataagcaccattaatagtggaatcatagatagtaatgttctcacagttccaaaatgcatctttggttacaagcgtggaatgatgaatttcaacatttttagcaccatcaaaggcgtaatcaccaatcaaatcgaggtggttggcgacaatgtttgtgctattcataccaatatagttaccacttgcttgcacatggtcaaagctaatgtgattgcagttccacaaactttcactggcatcggaaaaatgaacgttttttaagcgaatattctggctacggcgaaaagtttttggtgcttgaattgcactatcggacatagtgatgtcattcgtataccagatgcctgaccgcgccatggtttcgaagatggtgttagccaccgtaatgtgctggctgtaccaaagcggatacttatatagaaaaattgactgatctagtttaatattgcgactttccttcagaggagattcaccttttccaaaagtcgttttgacaatggtggcattttcctgaccaaacagagaacgttcaccatgaaaaaattgattgttgtaactcaccataaaagattcgcttctttctatatgttctcgaaaaatggtcgctacttccaaaactttgattgcagctgttacgctacgatgtcatggagaagttcagcagccttaccggataaataaatggtatttgactcatgcaaactgtctctagcagattgagaggtattgatgacaatttttggacagtttaatcgaaagctggtggcaggacggcgcgtgccaatgattaacaagaggtccgcttgtgcgagcatttgctgaccatattttatttcgtctgggtaggttgccaggcgtcttaaaacgaagtcaggtaaaatcagtccgccacaattggggcaagtcggcacagtgctggttgacggtttttgccagtcataagaatgatgacaaatcgtgcagtgattatgccggacatcgccccagtattcggcaacatgacgggttccggctgtttgatggagatagtcaacattcatcgtcaccacaccaagcagcttgttagcctgttcgagctgcactaacgcttgatgggctctgttgggtaacgcctctggctgacagaacgtctggcggtatagctggtagaaaccagacgggtcggcgctggcttcttctggatcaagaaaacgaaatatgtcaccagcaaatttgtgtgatttttttaagatttgatcaatcccgttcaaatctggaatgccagattctgtggagataccggcaccagtgaaggcaacgatttggtgatgttggcgaataagggctgctgcctgctgtaaacgttgtacttgtttcaaggggctcatctggtttcgaaaacgtgccgggcaaccgttaagccatttagtacccgaggaaagccaatataaggaatgcagtgaatcatcgtttcgacaacttcggttttagtcagaccgacattgagtgccccattgagatgaacctgtagttggtcggcggtatcgccttggataagcagcgcggtgacggtgatcatttcccgctgttttaggtccaagccaggacggttgtaaatatcgctaaaagcaaattccaaaatatatttaccaacatcaggcgcaatgtcggctaacgaatgcataacgttggccgcagcctcaccgtcaacttgggcaagcgtctcctgaccattttctaatcgtgttttttctgacatgttcatgacctctttcatttaggatagcttcactctaaatgctggagttaactccatgtcaatcacttttttgaattttctgtggttaatttggcttttagctgatgataggtcgtgattttgttttctaaaaatgcaatatgggcatcaatttcccggcgttgtgccgctaaccgggatttttgcgtgaagagtaacttcagacgttcgtcaatggtgctattgccttgataccgtaaacgggcataagttttgatttccttgatgggcatgccagttgcttttagccgcttgatgaatgcaatccagcgctgatcagcatctgagtaggtccgtcgattattttgatcgcggtcgggaataatcaagtgttctttttcgtagtatcgcaacgtatcaattgacagtgaaaccatttttgaaaatttaccaattgggtagcccatcaacgaagccttctttcttaggtcatgttgggttgtatgatgagactttctgtgaaattagtcaatacttatacaagagcctaagcgttttaatcgctaaattaaaactattgttatatgataaagtctcggaaaagggggccattcatttgacgaaatcaacaacttggcgaatgatcgcatttttctggcatcagctggcagatatgaaacgtcaattgttccgtattattgtggcattggtcggggtggcggtggcttcgtatctggtgccgcgactaacgcaatatgtcatcgatcaggtcattccgcaacgtgcgatgggaacactaatgggcgtgattgcgatggcgctcttgctgacggctatggctgggtggttaagcggtcttagtacttattggatcggtcaggtgagtttgcacgcgattgcccgcatgcgcgatgacttgtttcgccatacgctaggattagatatgcggtattttgaaacgagtcaaacgggtgatttgatggtggtgctcacgagtgacgtcaatacgttgcagcgcttaatatcgagcaatacattgggtctatttggcagcttactcagttttgtcgtcgtgctggtgctgatgattgtgcaggactggcaactgaccggtctgattttattaacttttccggttttgtttattctgaataatattttcgttcgcaacattcgtgctgcttatcggcgggtgcgggcaagttctggcatgatgaataatcaaattcaacaggctttgaccagtatcgggctgattaaaagctttacgaccgaagccacaacggcaaggacctttcaacaagccaatgcacgtaaccgcgattatcaacttaaagcaaccaaactcagcgcgactttttcaccgctaaccgatttcgtcaattatttgggtacggcaattattttaggctttggtgcgattcaggtgatgcatggtcagtttacgattggcttgatcgtcgcttatactgcctatcttggcattttgcaggcgcccattcgccaactgaccgggttgattcaacaattacagcaggcaacggtttcgtttgaacggattgaagcgttgcaggcagcgactccgcaaattgtttcgccgccaaatgctgtccacttgccgcgatttcagaaacgaatccagtttgatcacgtagatttcagttacgatgaggctgtgccagtactgcaggatgtcgactttaccatcgaaaaagaagaagtcgtggcactggttgggtcgtccggcgccggaaaaacaacgattacaaatttattagcgcggttttacgatcccaccagtgggcgcattctgatggatggcatcgatttgcgtcaggcggatctgatgagtttacggcaacaaattgccattgtctcgcaagatgtgatcttgcttgatggcaccattcagcagaaccttgaatatggcacatcatctgtcagtgaggcggccatttggcaagcagcggaggccgctaacattgcagcttttatccgcagtttgcctcaaggactggcgacgcaggtaggtgagcgcggaattcggttatcaggcgggcaaaaacagcgcatcgcaatcgcgcgagttttcttgaaaaatgcgccgatcgtcatccttgatgaagcaaccgccgcattggataatgagtcggagcgttttgtgcaaaccagttttgatcggctaatgactgaccggacatcgatcgttatcgcgcaccggctttccaccgtgcggcacgcggataagattcttgtattagaacatgggcgaattgttgaagcggggaatcacgagcagttaatggcccaaaacggacgctacaaggaactctatgatttacagtttacgtgattgctgttgttgcgattgttattcttaggttcatgcgcagtttgtgaaaatcagaaaaaatcaagttgcgacaaggctttttttgtcacaacgtttactttcccaccggtttcgggtatcatacattaagtatgcaatgtgaattgcgagactaattgtcggaggtacagcatgtctgcaaaatgggaaaaaaagggcaccaatgatggtgaactcacctttgaaatcgatttaccaaaaattcaagaaggcttagaccaggcgtttcaacgtgttcgtaagaacctgaccgtccctggatttcggaagggcaaagttagccggaccgttttcaaacggatgtatggtgatgccgcgttatatgaagacgccttgaacatcttattaccagatgcttatgaagcagcggttaaggaatccggtattgacccggttgaccaaccaaaaattgacgttgagtctatggacgaaggcaagccttgggtgatcaaggctaacgtaacggttaagccagaagttaaacttggccaatacaagggcgttgaagtgcctaagcaagacgttgaagtatctgacgacgacgttaacgctgaattggaaaagcgccgtgaacaacaagccgaactcgtggttaaagacgacaaggcagctgaaaatggtgataccgttgtgattgattacgtcggcaccattgatggcaaagaatttgatggcggttcttccaagaactatagtttggaactcggctcaaattcatttatccctggctttgaagaacaattggtcggccataaatctggcgatgaagtaaccgtcaatgttacgttcccagaagactacaaggcaaccgatcttgctggtaaagcagctgaattcaaaaccaccattcatgaagttaaggtcaaggaattgccagaattagacgatgactttgccaaggatcttgatgatgatgtcgatacattggctgagttaaaagacaagatcaagaaagaattgaccgatcagcgtaaagaagcggccaagaatgcagttcaggaagcggccatcaagaaggctaccgagaacgcaacgatcgaagaagtgccaaatgcgatgattgaacaagaagtgcataatcaaatggatcaatacctaggcaatatgcaacgccaaggtatcagtcctaagatgtactatcaattgaccggtacgactgaagaagatctgcataaacagtttgaagccgatgcagaaactcgggttcgtactaacttggttcttgaagccatcgttaaggcagaagatattcagccaactgaagatcaagtgaccgaagaagttaagaatttagcttccgaatacaacatggatgaaaaagccgttcgtcaggcattgagtgaagatatgctcaagcacgatattggggttaaagaagccatcgacatcattactgacaatgccaaagaggtcgaagcggccaaggatgaaacagctgataaggctgattctgacaagaagtcagctaaatagttgtcacaatcgcgtcaaagagacgatccttgatcgtctcttttgtcgtcttaacaggtccaaaaagccgaacagatcccttgacattggcatagcggttagttgctagtcggtacttgacggttctggtagaatgaaggtaacaagaaagggttgaattagatgtttgacaacgttgaaacaacgggtccggtgacttgctctttttgtggcaagtctcaggatcaagtgaagaaaatcgttgctggccctggggtttatatttgtaatgaatgtatcgacctctgcaaagagatcattgacgaagaatttaaagaagaagcctatcagaatctactcgaagtccctaagccaatcgaaatcatgaaatcactcaatgattacgtgattgggcaggatgctgcgaaaaaagcactttcggttgccgtttataatcactacaagcgcgtcaaccagatgcagactgcgacaaaagacgatactgaactccaaaagagtaacattgcactgatcggcccaaccggttcagggaaaacattcttggcgcagacattagccaagatcctgaatgtgccatttgccattgcggacgcgacaacgttaacagaagctggttatgtgggcgaagacgtcgagaacattttgcttaaattgctgcaaaatgctgattacgatgttgagcgcgctgaaaagggtatcgtttacattgacgaaatcgacaagatcgccaagaaagccgagaacgtttcgattacccgtgatgtttccggtgaaggcgttcagcaagctttgttgaagatcttggaaggtacgattgccaatgttccgccacagggtggacgtaagcatccgcagcaggagtttatccaaatcgataccactaatattctcttcattgtcggcggtgcctttgacggtattgaaaatattgtcaaaaaccggattggcgaaaagacgattggctttggtaccgactccaccaatcaagtggatccggataagtcactgatgcagcagattattccggaagacctcatgcaatttgggattattcctgagttcatcggccgaattccgattttggcagcattggagaagctcaacgaaagcgacttggttcggattttaaccgaaccgaagaatgcattggttaagcagtatcagaagttgttaagtttggatgatacggatcttgaattcacacctaacgcactgaaggccattgcccatcaagcgattgtacgtgacactggggcgcgtggcttgcgctctatcatggaagccatcatgcaagacaccatgtttgacttacctagtcgcagcgatgtcgacaaggtagtcgtcacgaagtctgctgttgaaggcaaggctaaaccacaattagtgcttaccaagggccgtgaagcctcctaaagcaagcagggtttcaaagagcaccaggttggataacctggtgctctttgtttgggctcaaccatgaataaagatttgtaaattcccgctagcggcccagtcagcttttaaaatatgctaaactattgaaggcagtggtgcttgagtgccactaaaagagatgaataaaaaaggaggccgtttaagatggacgtccatgatgtcaaactgacaatcagtgcggttgcggctgcgcaatatccagaagatggccgtccggagatcgcctttctcggacgcagtaatgttggcaaatcttcactgatcaataagttaattaagcgtaaggcgatggctagaacatccagcgttccggggaaaacccagacgcttaatttttacgatcttgatagtcgcctgttttttgtcgacgttcccggttatgggtatgccaaggtcagcaaatcagcccgggcaaagtttgcagcgatgatcgagacctatcttacaacgcggcaaccattacgtggggttgtcttgctggtggatagtcgtcatgagccaaccgccgacgatatcagtatgtatcaatatttaaagtattatcagctcaggactttagtggtcgccacgaaaatcgacaaaacgcctaaaagtaaacggctgcacgttgttaagcaaattaatcaacggttggatttaaaccagactgacacggttattccgttttccgcagtcaccggtgaaggctatgatgcgatttggtcttggttgagtcagacttcgggagtgggggaaaatgaataatgaactttaatgaatatcagcagaaggctaaccgcacattggccggcaacgaacatgtgttaaccaacttatcgctaggcttggcaagtgaaagcggcgaagcaattgacttgattaaaaagtacacctttcagggtcaggatttagataaggttaaattacagcacgaattaggggatgtgctgtggtatctttctcaaattgcattgtgggctgacattgactttgatgatgttgccgctggtaatattaaggcattggcaaaacgctatccgcaatccaaaaagtgaacttagcgtcattcagaacatatttaaacgcagctaatgatttagcgtctaaaaaagcgacctccgaaaaattttcggcagtcgcttttctgtttgcttgagtatgaaaatcagcataaatggttactttactttttcggctttttagcgctatctttatcagactttttcgtcatcttttcgtgatgttttggatctggcccggtagcttgttctttatcgctgggaatgcttgcgaatttatcgaacatgtcgtttaggttggtttgagtgttgatcttaagtgccatgcacggccacccctttccttggagaaagtatagcatcaaccagcattagcgtctagactgacaaccggtttttctaatgccgatatttggccaaaggttgatcttgaaaacgatttaaggactaggtcgtgtttttcgatgattttacgagttaaaaaaagagtcaccaaaatatgaatatttgttgcataaaaattgaattacgtgtatagtacattcttgtaatcaaggagggtattatgacgcatttgaaacgttggttaatcgctttggtcgcagtttttgccgcaattgtgaccttaaatatgcaaactgtccaggcagatgacagcctggcaaagattcaacaaaaaggcacgattgtgatgggcactagccctgattatgcaccatacgagtttttggtgaataaaaatggcaagaatcaggttgtcggcatggatgtcgaagttgcccgcaaaattgccaaggatcttggggtcaagttagtcatcaagcagatgaatttcagctcgttgctagtggcgctgcaatccggcaaggttgatatggtgctggctgccatgtcaccgactaatgctcgccgcaagtcaattgatttctccaagacgtattataaatcgggtcaggatattctgattaataagacggatgctaagatttacaaagaccacaagagttttgccaataagaaagtcggcgttcaaaacggtagtctgcaggagaccttagcaaaaacccaaatgaagtccagtacgactttaggactgacaaaagtaaccgatttgattctggcgctaaaaacccacaaagtcgccggggttgtcgcggaaggtgcggttgctcaagcctatacgtctaacgatgataaattggttgaaattcccggtcattttaatctgtcaagtgacacgatggggactgctatcgggtttgccaaaggatctgattctttagtcgcagcggccaataagagtttagcagatattaaacaaaagaatttgatcccgcaatatctgaaaaccgctggcagttacatgaagacgaataccgaagataccagtatgctgcactattggacttatttccttaaaggggttgagtataccttactcatcagtgcgattggggcgttcttcggggtcttacttggtacgatctttgctttattgcggttgagtaagcatcgattgccacatctcattggggttgcctacatcgagttcgtccgtggtacgccgttgatgattcaggtcatgtttgtctacttcggtattggcattttcattgacattccagcgctagtagcagggttgatcgcggtatcgcttaattcagctgcatacgttgccgagattatccgtagtgggattgatagcatcccgattggccagactgaagcggcccgttcgctgggcttatccgagcgccaaacgatgaccagcgttgtgttaccgcaagccatcaagaacatttggccagcgctaggaaacgagtttatctcactgattaaggaaagttctattgtttcgatcattggggttacggacttgatctatcaattaacggtggttcaaaccgcaacttataaaggtgttcagccgattttggtcgcaatggtcttatactttgttttgacattcgggctatccaagctcctgagtcactttgaaaggaagatgaatcatgcagcataaacctttgatccaaatcaaccacttgaccaagaagtttggcgataatgtggtcttgaatgatattagcgaaacgattgaccaaggcgatgtgattgtcgtgatcggtgcgtcaggtggcgggaaaagtaccttcctgcgcagtttaaatctgttgaaccgtccaactgcaggcgaaatcctttttgaaggaacaaacctggttgatcttagcgaaaagcagttggataatgtccgggagaaaatggggatggtgttccagagcttcaatctttttccgaatatgacggttctagaaaacatcaaactggcgccgttaaaagtcaaaacggtgacggatgaagaagcaaccaaaacagccaaggaactgttggaacaagttggcttggcggaaaaagccgatgcctatcctgctagcctctccggtggtcaacaacagcgggtggcgattgcccgcgcgctggcgatgcaccctgatgtgatgctttttgacgaaccaacgagtgcattggatccggaaatggttggtgaagttttgaaggtcatgcaggatcttgccaaaaccggaatgacgatggtcgtggtgacgcacgaaatgggatttgcccgcagtgtggccgaccaagtctggtttatggatggcgggaagattcttgaaaaaggcacgcctgaacagcttttcgaacatcctcaagaagagcggacacaagactttctttctaagatcctcgcacaataattttcatcaaagtactttgtctggcgcatactgggcaaggtactttttttgtgaaaacgagctggtggggtatcatgaggtttgaaccagaagtacaagcttggtatgacaagcatgctggcaggtgtataggctatctgcttgcaatcgcattttagaatctttataatgttaggcgaacatttgttttataaggagcttacaatggcatctgcacacattgaacataagttatcgttactgccggatcttcccggtagctaccaaatgaaagacatcaacgggaagattatttatgtcggcaaagccaaaaatctcaagaatcgggttcgatcctactttaagagttcgcatgacggaaaagtagcggcaatggtggcacaagtggcggattttgactacattgtgacctctacgaataaagaggcgttcttgcttgagattacgttaattcaaaagtaccaaccttattacaatatcaagctgaaaaagggcaccggttacccttatatcaagatcactaatgaacgcgaccccaagattgaaattaccgggacgattcgcaaagacggcggctattattttggcccttatcccaatgtttacgctgcccaggaaaccatgcactttattcagaaagtgtatccactacgccgctgtaacggctatcagggtcgcccgtgtctttattaccatatggggcagtgtctcggcgcttgttttcgcaccgtcccggagaaggaatataccgatcagattgcgcggattaaacgctttttgaacggtaatgtcagcaaagccaaggccagtttgactgccaaaatggagcgcgcggcaaagaatctgcaatttgaacgggcagccgagattcgggatcaactttattacattgagcaaacggttgagaagcaaaagattatttcgacggataataccacgcgcgacttgtttaatttttatatggataaaggctggatcagcattcaggtcttctttattcgccaggcgcgattgatgaagcgtgagtcgcgcttgtttccggtggtcaatacggctaaagaagagtttgaatcttttatcttacaattctacagccggaaaaataacgttaaaccgcgtgaagtattggtgcctgcagggctagataataaggtgctggctgatatccttgaagtaccggtacgcacaccccaacgaggcgaaaaacgcgagctgatggcgctagcagccaagaacagcaagattaaactggaagataagtttcggttaatggaattagataatcggacaacggtaggggcgatgaaagagctgatggcagccttaaagttaccgatgggccatgtggtagaagcatttgaccatagtcatatccaaggtgccgatccggtgtctgccatggttcaatttgtcgatggccaacctgccaaaaacaattatcgcaaatacaagttggatgcggacaaaacccataatggtgctgacgaagctgccaatacgcgcgaagtcattcgccgacgatatacgcggctgctaaaggaacatgcggcattgccggacttgattctgatggacggtggtgagattgaaatgaacgcggctaaagatgtcctggaaaatgaattgaatctcgatattccggttgccggaatggtcaagaacaataagcataagacggctgccttgctattcggtcacgccgacgagatgatcaatttggatccgaagtcgcagggcttctacctgttggaacgtattcaggatgaagtgcaccggtttgccatcacgttccatcgccagcttcacgccaaaaactcgttggcatcgcgccttgagggaattaagggcgtcggacccaagacacgcttaaagttgctgcgtaaattcaagaccatcacaaagatcaaagaagcaccattggaagatattcaggagctaggcatttcaaaacgcgtcgcccaggcactgaagctttcgttaacggcagatcccacgccggcacgtcgggtataaatgatgcggataacgtggtaattttttagagccgttttcaagacaatggaaaaagcaggttccaaaagacaaacgttgccttttgatgcctgcttttttgcaagatgattgaaagccacaaaccgaatttaaaaagcgtcattcaaacggacaaaaaaactcgcagcgcatttcaaagctgcgagtttttaatttaagccatgaccgctattaagtgacgcttacaagcttatcttgacttagcgattctctttagcaactggacgccagaagccaagaatcagtgcggcgatgatggttccgataatcaatgacatgataaagccaaatttctgatcggttagtaagagtgcaacgacaccgccatgaggagccggaacgttaacgtgccagagctgagttaaaccaccggcaatcgcagaacctattacggagctaccgatgatgtgcaatggatcggttgctgcaaacggaatcgcaccttctgtaatgaacgttaaaccaagcgcatagttagataagccggcattgcgttcctgtagggtgaatttcttcgggaagaaagtggaagcaaccgcgatagccaatggtggaatcataccgccgatcataacggcagccatccagcgaccatctttaaagccagatgcttgataaacgccaattgcaaacgtataggccgctttgttgaaaggaccacccatatcgatactcatcattgcggctaggatgaccccaatgatgatggcattaccagtacctaaaccttcaaggaagttaatgagtgcaccgttaatcgctgcaaaaatcgggttgatgatgaagaacattaacagccccataatcgcaagaccgatgactggataaaggagaatggtccgcataccgtctaatgagcgcggcatcttggccaatgctttcttaagacccacgatcatccagccggcagcaaacccggcaaccagaccgccaaggaagccggccgggttttgcgctttcacaaccgatgccgaagcaacggttgccatataaccaccgacaaacccaggcatcaaagcagggcggtcaccgatagattcggcaatataagcagctaataccgggaccaagaaactaaaagcaaaagaacccagattattcgtgaacgtgaaccacatagaggtcttacccagccattgttccaggatgaatgagatcgccatgataatcccgccgccaacaacgaatggtaacatgttggagacaccattcatgaggtctttataaatgcgattccaaacggtgccgccggaagtctcctcactttcactggcttcggtgttggcttcaccagcagcgtgaaagacttggccttgacctttaagggtttcttcgatcagttcttgcggtttcttaatgccgtcaatgacagggcggttcaataatttcttgccattaaaccggtccatcgcaacttttttgtctgcggcaacgatgacaccggccgcacggttgatgtcagcatcggttagcttgtgcttgatgccttcagagccgttggtttcgaccttaatatcaacgcccattttctcggcagtttctttcaaggctgcttcggccatgtacgtatgggcaatcccggttgggcaagcagtaacggcaacgataaatggccgttctttgcgcttttcgtctttaaattcagcttgcttagcggctttgtccttggcttcttgggctttttccgcttcttcttcagctttatccttggctgctttttccgcttgtgcttttccaaaaagatcaatgacttcatcaggggttttagcctgctttaagtcagcgaccagttttggattgatcaaaagtgaagacaaggcagctagagcagctaagtgttcgttgttggcgccttcgggagcagcaatcatgaagaacaagtgcacgggctggccgtctaatgcattaaagtcaacgcctttagtgcttttggcaaatagaaccgtagcccgggtaaccgcgctgtctttggcatgtggcatcgcaataccttcaccaatgccggtagttgattctgattcacgctttaaaatgtcattgcgatattcgtcagcgtcagtcacaatgccttccgcgtggtatttggcaaccatttcatcgatcacagcctctttagtggtgcctttgagatccatgatcatgacattttttaatagtaagtcacgaatgtccattttgtcctcctaaacttcattaatcgtaatcgtctgcttaacggcagcaattttgtcggcagtggcaagatcctcagaaaaagcggttgcagaaccgcatgcgattccaaccttaaagctttccagaacatcatgtgtttgcgcaaaagttccggtgaaacccgctaacatactgtcgcctgcaccgactgagttcacagcaggttgctttggtacgttaccgaaccaggcatgatcttgctcaatcatgagggcaccaccgcctgccatcgagatcaaaacatgttgtgcgcctaaatcaagtatgcggcgaccggctttgataattgcctcatgactggtatatggtgcgtcattgaacagagcagctaattcatggtgatttggtttcacaactaggggatgatcggaaagggtatccagtagtgcctggccggtggtgtcaatcacgaagtctgcgtcatgcgcatgaattaaggggatgaggtcccgataaaatgtgcttggtaatcctttaggcaaacttccggacataataacgacatcgcctgattttaggttggtcagcttagctttaaagtcggcaatttcggtctcgctaatagcagggccgctggcgttgagttcggtttccgattctgctttgagcttgacgtttatccgggtatcacctttgatttttgtaaaatcgcaaggcatggcaagctcgtctaacttatcttgaataaacgtcccggtgaatccgccaagaaatccccaggcagttgtgggcaagccgagtgtttgtaatatacgactcacattgatgccttttccacctggcaatttaacgtcgtgggccaaacgattgacagcgccaaggttaagccgaggcaactcaatgacataatcaatcgaagggttgagcgtaactgagtagatcaagaatgaacctccttaatattttgatacctttgatagctcgctggaagcccttgtagtgaactggtcaggatggttgcatcgccaatatcggcgaatttgacgaaactgacctgttcgaacttactgggatctgcgagaatgatcggttgacgcgcttggtgaatggccaagcgcttgatcacggcttcttccggatctggtgtggtgttcccaaattcagggtgaataccatttgtaccgataaaggcgatatcgaaacgataatgatgaagtgcttccgcagtcgttgcgccaatcagcgccttggttgctgacttgaccataccgccaagcattaaggtcggaatttgataatcggctaacaatgaggcattatcaaccccggtcgtaataaccgtgaccccaagatcggccaaaaaaggaatcaactgggccgtggtggtcccggcatccaaaaagaccagatcgtcttgttcaacttggcgagcagcggcatgagcaatggtttgttttgcccgtaaattttgcgttgacttacttgccacgtccggttcatcgccaagaccgttgacacgcttggccccgccatggatccgtttaagttcgccggctgcttcaagttcatccagatcgcgacgaatggttgattccgatgcatccaacgcggccattaacgctttagacttaatgacggtatgttgttgcaattgagcaaggatgtattgtcgccgttcttctgtaagcactttcgtttcacctcgtccttcattatactgatgaaacgttcaaaatcaacctaaaaccgttaaaaacattcactgctgtcacaattcgaaccttttcattttgccttacatttttacgatattgttgcgcttgaagtgtgagtccttgtcttggacgtgttaaaatgaaaaaggcatctgatttactatgcgaacagcgcgataacgcgtataattaaaaattatgttttttcagaaaggggatcgccaatgtttgtcgatcaggtacaagtagaagttcaggcgggcaaaggcggtgacggcatggtcgcgtttcggcgcgagaagttcgtgccgtttggcggaccagccggtggtgacggcggccgcggtggcagcattattttatatgttgatgaaggcttacgaaccttaatggattttcgctatcaacggcactttaaagcgccagccgggggtaacggccaaggtaagtcgatgtatggtcgcgctgctgaagatcgccgaattgccgtaccagctgggacaacggtcacggacgctgatactggtgaagtcctcggcgatcttactgcaccgggacaagagttggtcgtggcaaaaggcggtcgcggtggacgcggcaacattcactttgtctcgcctaaaaataccgctccggaaattgcggaaaacggtgagcccggccagcaccggtttattaagctggaattgaaagtgttggctgacgtcggtttggttggctttccgtctgtcggtaagtccaccttgttgtcagtggtgacccaggctaagcctaaaattgctgcctatcagtttacgacgctcgttcccaatttggggatggtgcagttggatgatggcaccgattttgtaatggctgatttgccgggtttgattgagggcgcttcacagggtgttggcttaggcatccaatttttgcgccatgttgaacggactagggtcttattgcacctagttgagatggatccggaaaatggccgtgagccgctggaagattatgatcaaatccgtaaagaattaggcgcttatgacgaaaatatcttaaagcgtccagaactgattgttgccaccaagatggatttgccgggtgcagcggaacggtttgccagctttaaggcagctttagttgaccgcggtattgatccggctaatatttttgaaatttcaagcctgacccaccgcggcgtcatgcctttgatgcataaaaccgcaacagtcttgaagacggcaccgcaattcgagccaaaacaggaaccggttcaatcgaccgagtacaagtacacgccggaaccagcattgaaagtgacgcgtgatagtgacggtacctttgttctaaccggcgagaaggtggagcgggcatttaaaatggccaatcttgatcatgaagacggagtcatgcggtttgcacgccaattacggagcatgggcgttgacgatgccttgcgtgaggccggtgcacaaagcggcgatttagtcgctattgatgattttacttttgagtttgttgaataatcttcgagcagcatgttgtaaagaattaattttataaagaatggtggggcctcaagtgaaacagacgcgcaaacgaaagcgtcggtatatccatggattcgacgggttacggacaattggtgttattggtgttattttatatcatttacgtcctgaactttttaggggcggatatctgggcgtcccaattttcatggtagtttccggttatttaattacggatggcctcctgatagaatttgaccgctatcggcacattgactttaaaagtttttttattcgccgatttaagcgactttatccggcgcttatcaccgttttgtttggtacggcggcctatattacgcttttctcgcagaatctattgcataacctgcatatgatggttttgacaaacctgttatatgtttataactggtggcagattttaaatgggcaatcctatttcgcccgctatgcgaatggagaatcgccgtttacgcacttgtggacgctgtcaattgaaggtcagtattatcttatttggccgtttttggttctgggcttactattgttggttaaaaatcggcatcaaattgccaatattgttctgatcctggcagctgttagcggcgcgtggatggcgatcttatacatgatgacggttgcccacacgtcgccagcggcctttgacccaagtcggctttactacgggacggatacccgtgcgttttccattctgttcggtgcggcactggcttttatttggccgagcagtcggttatcgacgcatttaccgcgcaaatgggttttcagcctcgatctaatcggaacggtgagccttgttgggttactgacgatggttttcacggtcgatgcccagagtagttttctttatgaagggggcatggtccttttctccattttgacaacgattttggttgcagtggttgcgcatccggccgcgcattttgatcgcttgttgacgaacccgctgtttagctatatcggcagtcgcagttatggcctttatctctatcaatttccggtcatgatcttctgggagaatcgtttccgcaacattgccgatcatccggttttatatcctgtgattgaagtgattttgattgttctgattacagagatttcttatcggttgattgagcagccggccgcgcattttgattatcataaaacctgggactttcttaaggcactggttgaccccaaaaaacgaatgggtatggcccgttggatcagttatgccgctgttattattttggcaattgggagcgttggcctcgctaaggcaccttcagccaaggcggtgggtgataattcacctctggcaaagcagttgaagcgacacagtgagtcggctaaagaaaaggctaaacgtctggaagcaatgcgctccagtctgtcagagcagaaaaaagcggataaaaataaggccgatgagtcgtcaagttcgcgcgcgcaacaatccagatacgcttcgcaggccaaaacaaagccggtgaatcaggactatgaacgttatgggctaacccaaattcaacttcagcaagctcaggatgttaccttcacggcagtcggtgactcagttatgcttgacggtgagccgggacttcaacagcttttcccaaaagcggtgattgatgccgcggtttcccgacaaatgattaatagcattgacttggtgcgcagttatgctgaaaaaggtgtgttggcgaatattgttgtgatcggtcttggtaccaatggaccgttttcggacgatcaattagcccaaatgatgcaagccatcggacctgatcgtcaggttttctggattaatgttcgcgtaccgacccgcgcatggcaaaatgatgtcaatagcaaattagatgctgcccaaaagcagtacaaaaatctgacggttattgactggttccataaatccgatggtcatcctgactggttctacaatgatatggtgcatatgaatccaaccggcaatcctgagtatgcggcgtttgttgccaaaactattttggaaaagattgatgaatagccgtttttatgacgttctttagtgaacggtcattgttcagttaaatcgagcctagaggtcatgccattctctaagctcgattttttataatattggcgactcggtttagaaaaaatagacggcgtgaaagtctatgacagcaatgattccgggataatcgcagagaacttgtggtagactacaaagtgaagtttgacagaataggaagtatggtatggaaattcaatttttggggacaggcgcaggttcaccttccaaagtccgcaatgttagcagtttggcgctcaagctgcttgatgagcgcaatgaggtttggttgtttgatgtgggcgaaggaactcagcatcaaatcttacagaccacgatcaaaccgaggaaaattgccaaagtatttattacccatttgcatggtgatcatatttttggcttaccgggctttttagctagtcgggcaaatcaaggcggcactgaaccgttaacgatttatggacctccggggattgaggactttgttaagacaagtttgaaggtttctcagagtcatttgagttatgcaattaaatttgtgttgttacgacatccaggcgtgatttttgacgatcagaccttcaaagtcagttttgatcgacttgatcatcggattaccagttttggatttcgggttgaagaaaaaccacacccgggcgagttactgattgataaggtccgtgccgccaagattccggctggaccggtttatgcttcgttgaaagcaggcaaaaccgtcacattgccggatggtcggacttttgatggtcatgacttcatcggatcagcacaaccgggtcggacagtggccatttttggcgatacgcgtatgtgtcgtcgggccttaccattagcagccggggcagatgtcttggttcatgaaagtacgtttggtccggatgaaagtcaactggccaagcagtattatcacagtacgaatcttcaggcagccgagttggcgaaacgagctggcgttggtcggctgttgttaaatcatatttcagcacgctatcttggccctagtgtggcaatgttagaaaaaagtgcacggcatattttcccgcaaacgcatgttgtcagagatttggaggaaattaacattccatttgcaagtccgcaactgcaaccgactgtttccgctaaatgacgattccggtttgatgagacatcaggcaagcgttgttgaagattacgggaaatttaggcaatacaccgagttgaaatgcgaaaactggcgcagaagtatagggacgcgtcacgactccttactttttgacgattatcggtaccagttcacactcacacgtgctcaggagggaactttatggtgaaaaaacatctgaccgttgtcatttctggcggatcggctggcttgggaaaggcgatcggactcgaggcggcgaaaaatggtgcgacggttgtatttttggcgcggcgccgggataaattacgtcaggctcaggctgaagcaacggcgctttccggacatccggcttatgcttttccagtagatgtgggtgatccggtggcaattgaagcggcggttgatcaaattcacgaaacggttggaccggttgatgttttggttaatgcagccggttttggtcactttgaaaatgcctttgacacggatatgcggttagtcgaacggatgtttcgggttaatgttttaggtgttatgtatctgaccaaactgttgggtcgtgatatggcaatacgcggtcagggacagattattaatgttgcctcaatggctggtaaaatggctaccccaaaatcagccatttattcagcaacaaaatttgcagtgatcggctatagcaacggattgcggctcgaacttaaaccatttggcgttcatgtcacgacggttaatcccggtccgattgcgacggattttttcaaggcagccggtgctttggattatctcgcaaccgtttcctggctggcattggatccggatcaacttgcgcgccgaatcgttgggacatttgaccatccggtgcgggaaatcaatgcaccgcgcgtgatgagtcttggggctaaactatatacattatttccaggtatcggtgattggctagccggtggtatgcttaataaaaagtaaaggggtggctcacatgaaaagtcagcaacgttttattatcggactggttcttgccttaatcttgattatttttgctttactgaacggccaaggggtgtccgttaacttcttcggcattcagttagagtggccgctgattgtgattatcgcagtatccgtactgatcggcgcggtggtaacctggttaatctccaccagtgccgttgcgagcgctaagaagcagatcaaagaacttcaacagcgcgtaacggaattgaccaagacaaacaaaaacgaaaaaccggcgccgaaaccggttcaggcaccaaaagaaacgccttctgatacatccaaaaactaaacgaaacgacgcggatattttgttcgcgttttttatttaaaatagtttgaccttaactgaccaatatcgtaaagtgaatttgaaaacaatgaacagttatggaggcatgatggatgaatccagataattttacgcaagcggtggctgaagccttgggtgctgcccaacaaattgcccaagtccgccaccatcaagaaatcgatattccccacgtcatgaaaagtctggtgcagcccaatcaattagctgagcagatttatcgtgaagccggcgtcaacattcacgggttaaatgccgcgattgacgctgcgattgacgcagagccggtaattgaaggcgcaagcgcatacggccaaaacatgtcgcagaatctggcgcagatgttaagtgatgccgatacgatcaaagatgagtttggtgacacgtatgtttctaccgaggcactgttactggcactctatgagcagcgttacaacacgattacccgctatttattggatgatgccaaagttgacgccaaaaagctgcgggcagtcattaccaagattcgcggcggcgagaaagttaccagtaaaaacgctgaggctaattataagagtcttgaaaaatacgggactgatctggttaaagaagcacgcagcggcaagatggatcccattatcggtcgcgatgaagaaatccgcgatgtgattcggattttaagtcgcaaaaccaagaataacccagttctgatcggagaaccgggtgttggtaaaacagcgattgtggagggcttggcgcagcgtatcgttaaaaatgacgtgccagacaatctaaagaataaaacgattatttccctcgacatgggcagtttggttgccggtgccaagtatcgcggtgaatttgaagagcgtctgaaagccgttttgaaagaagtcaaaaagagtgaaggtcaaatcattctgttcattgacgaaattcataacattgtcggtgctggcaaagctgagggatcaatggatgccggcaatttgcttaaaccgatgctggcacgtggcgagttacatttaatcggtgcgacgacgctggacgaatatcgcgaaaatattgaaaaagataaagcattagagcgccgattccaacgggtgctggtacaagagccaactgtggaagatacgatcagtattttacggggtttgaaggaacggtttgaaatttttcacaaagtgcgcattcatgattcggctttggtagcagccgcgacattatccaatcgttatattacggatcggtttttaccggataaggcgattgatttagtcgatgaagcctgtgccacgattaatgttgaaatgaactcgcgcccaactgaactggacgtggcggagcgtaagcagatgcagcttgaaatcgagcagcaggcgttaaagaatgaaagtgatcccgcaagtaaaaagcgcctggaaaatgcaaacgccgaattagccaatttaaaagaaaaaaccaataaactcaaagcacagtgggaagccgagaagaaggatattcgccaacttaacgaaaagaagtcggcgattgacaaagctaagcatgaactggaagatgcccaaagtcggtatgatttggaaacggctgcgcgcttgcaacacggaacgattccacaacttgaaaaagaattgcaggcaatggagcacagtgatcggccgcagtcttggctcgttcaagaaagtgtcacggctaatgagattgctgctgttatttcacgagaaaccggtattcccgtggcaaaactggttgaaggcgatcgtcaaaaattgctgcatcttgccgataatctgcatcagcgtgtcattggtcaggatgaagccgtcacggcagtttcagatgcggtattgcgttcgcgcgccggactgcaagacccaagccgaccattagggagttttcttttccttggtccgaccggggtggggaagaccgaactcgcaaaagcgctggccgaggatctgtttgattctgaaaaacacatggttcgaattgatatgtccgaatatatggagaaggcgagtgtttcacggttggtcggtgcggctccgggttatgtcggttatgaacaaggcggtcaattaaccgaagcagttcgccgcaatccgtatacgattgtcctattagacgaaatcgaaaaagccaatccggatgtcttcaacattcttttgcaagtgttagacgatgggcggttaacggacgggcaaggacgcaccgttgactttaagaacacgatcatcattatgacctctaacctcggctctgaatatttgctggatggcgtgcaaaaagacggaactgtcagtcagcaagctaaggatcaggttcgtcagttgatcggtaaagcttttaaaccggaatttctcaatcgcattgacgatatcatcatgttccatccactttcactagatgatgttaagaagattgccgttaaggatctgcatgagctgggaacacgcttggcagaccagcaaattagtttggacatcacgccagaagctcagacctggttggcggataagggctatgacccggcatttggtgcgcgtccgttgcagcgtctaattaccagtgccgttgaaacgccgttagccaaagagctcattcgcggaacgattcagcccggtcaggaagtggtcataaccgttgcggatgatcagctgcaattcaaagcaaaacaagtagcagcgaagtcataagcctgtaatagctgaattattctgtaaagacccttgccttgacgccgcttttcatgtatgattagcgttgctgtgacagaacatgtttctgtccacgcgtgacgatgattggacttgcattttgatcatcgaccgtataaagtagtttagaaatcttactaaaaaaggggttttccgctcatggcagttccagcacgcagaacgtcaaagaccaagaagcgtatgcgccgcggtcacattaagttgaatgtgcctaacttgcaattcgatgcagcaaccggcgaataccgtgtttcccaccatgtttcacctaagggttattacaagggtgcacaagtggttaagaagtctgacgacaacgcaaatgcataacaaaaagccaacatctcgggtgttggcttttttgttggcgccaaatgatggcggcactagacgtcagcagtacgtggcgttcaacatttctttcatgacgaaactgagggttatctagttttcaaaaccacatctcatgatataatacgactaaaagaggtgcgatcaatggctgataacaaacaattttcggattacttagcccagcttcaaaaagcccaatttccgcggtgggctgacttaccgcaatttgatctttacatggatcaggtcattcagtatgtcaatgatattgtgacgccacttggttttggcgaaattacatcgactatggtcaataattacgtcaaaaaaggcgtcatccaagcacccgtcaagaaaaagtatcgccccgaacaattagccaacatactggtcattgccatgttaaaaccggtttttgctttggatgccattgccaaggggattcagtttgctaaagaaggccgcccccggtagctcaagcttacgatacattcattttgacttttatcagtgccattgagcaggcaaactccgacttcaacgacaccgttgccattaatcgaaccgttcagccaagcaccgctgccacgcaacatgccgtggtttcgttagccatcaatgcggttttgcaaaaactgatggttgaaaagctgctgacgctcacccaagtccctgctaatgagaaaggaaaaaaggcatgaagctgaccattttatcgacgagtgatacccatggctttgttttgccaacgaattatgttaaacgcgaccagaatctgccgttttcattggccaaggccaaaacggttttggatgcccaaaaagcgatggcagaagggcctgtgctgaccatcgaaaacggtgactggttgcaaggctcgccgttagcctattatgccgccaagatgaatcggaagcctgaacagttgacacaaatctacaatgcggttgggtatgatgcgggaattatcggtaatcatgaatttaactatggttccgattatttacgtcaagcgttggcgacactcaattacccaacgttaaatgccaatatcacgaaagccggtcaaccggcatttggcgagccatataagatttttgaacggtcagggatcaaaatagctgttctcggcttaaccaccgcgtatattccgcattgggaggcacccaaacatattgccgacctccaatttgaggatgtcattgccactgcgaacgattacgtgccgcggttgcgcaaagaagcagatgtggtgatcgttgcttaccatggcgggtttgaacgcaatttaaaaaccggcgaaccgactgaacgcttgacaggagagaatgttggctacgcattgacgcaaataccgggaatcgatgcactgatcaccggtcatcagcatcgacagttggcggcgatcgtcaatggtgtgccggtgacgcaaccgggttatcgtggtgaagcagttggaaagataacgctgacgcttgcgcagacaacgaccggttatcaagtgacagatcagcaggcagttttggttaaagccggcacggttaatcccagcgcagttattgagcaagtagcagaaccgttaaatcaagtcgttgaaacgtggctcgatcaaccattagcacgggttgaaggcgatatgcggattcacgatccatttgcggcgcgggttaaagaagtaccttatattgaattcattcagcgggtgcaaatggcaagtaccggtgcggatatttccgggaccgccttgttcaacaatgaagggtgtggctttggctcaaccatcacgatgcgcgatgttgtcactaattatatttatcccaacactttggcggtgctgcggctgactggtgctgaactgaaggccgcgttagagcagtgtgctacttatttttccctaaatgctcagggtcaattgatggtcacgccgcgatttgaacggcctaaaccgcaacactacaattacgatatgtaccaaggcattgattatactttggatatttccaaaccggttaaacagcgcgtcacgaaactaacttatcatggcaagcccgtggtcagcacgcaaacttatgacgtggtgatgaaccaatatcgagctgcaggcggaggcaattttgccatgttcggcccggaaaaggttatccgcgaaaaccaaaaggacatgactgaactgattgctgattatttgaaagctcatccggttttaaaagccgaggccgaccataactttaccgtggtatcgtcaatgtgacactgagtcatattctgcttgtcaagtggcgggtgaacgcttatgctgatgagcgtcatcattaggttaagtgaaaggaatgttccgcatgaagttttggaaatatggtttgattggtttattagcactgctgctagtaggctgcggccaacaattaagtacgacaaaggcaacttacggacgcaatggtttggttgcgacgatcaaaggcagtgcaagcggggttgatcgggttaaatatacaagccaagccggtaatggcagcgtgccggtgaaaagcggaacgtttgtggtcaatgtaccggtgacggatacaacccaacagatcaaactaacagcgggatcgcttaaacgtgaagtcaacgttaaggccggtacatcactggggcagtacactgctattgcgaccaaatttaatcaaatgttggccgtttcgagtctctccaaagcagatcaggcaaaactaaaacaaggacaggcagcagcggctgagcttcagaaaagtgcggcaacgatgacgcctgcagaaaaattgacggcggcacaacaggcacagacgctaaaaacattgatggcacaagcaactgccaatacccggggcaagcagttgccaaccaccgctaaaaccggcatccagtcgattttaaaaacggctggcgtcaattatcgtgccagtattgtcaatggtaaggcgatgggctttgctgtcattgtgcctttgtccgtgcttaaagacagcaaaaagatgcaacaattcgcgactggttttggcttgttgagtacagcagtcggagctaatgctaagactgtcttctcgcacttcaagaaactgacaaaagatgccaaatcgaagaacaactcgacaacgatcaagacaattaagagtaacaatgttaagtttgatgtgggttattcaaccaccgacttgtatctttatgtaaccaagtagccaagtttaagcggttgacgataccattaaaaaagcactcgagaaatgtctgccatctcttgagtgcttttttggcgccgcttcgcttgattcacatgttcggcgcactttgcttaatgttctggtttttccgctgacttagcaaaatgttgcataatcggtgggaagaaaaataaaatgacaacaaagatcacactgacaatggcacttgtctttggatcgtaactgctgccgctcaaggcgccaatcaggaagccaacaacttggccgaggatcacgccccagacgatggtaggtaaataccgcatgaaatccctcttttctgtcgtcatcttaccacgactatcgaggaattcaactgaaattaaattattttccagtataatggaaatgaggtggcaagatgacgtttacccaattacaggttcacagcaattataccttattacacagccctttggcactgcctgatttgattcaggccgcaaaaaatcggggttattcggccgtggcattaactgacaccaatgttgtttatggcctggtagagttttatcggcaggcaaaagcggcggggttaaagccgttattagggatgcaaatcgaaattgccgatgccaagttgcttgtgattgccgaaaataataccggttatcatcaattgttgaaactctcaacccaaattatgcttgcccaacagccgcttgcatttgctgatttgctgccgctgaatgggctggcagccgtaacattgcccgattcaccttttggcgtggcagtttctgagcgtcacgaagatcaggcacagacttttctgacaacgttaaaagctaagcaaccaagctccttgtacattggtgtggatgaggaacatcttgaaggaacattgcctgcgtttgcggacaccgtaaagttaccgttacttgctttggggaatgttttgtaccgcgaccccaccgacgcctttacgcaaaaggtgatggtggcgattgaaacaggaagtcagttaaactttcgcgatccggttctaacggatgccgggccagcgtggttaaaaccgccaaccgatgcggccaagccgtttgtgcaagccggcttgcaagcggcggtgacacagactgaagcaattgctgcgcgtgccgatgtgacgattgactttaaacagccccagttaccgcactatcagacgcctgatcaaacgccttcaaaagattatttgaccaagttggctgaatcgggtttggccaagcgctttcatgggcagtcgattccgccggcttatcaagatcggttgcagtatgagctgcgggtcattattgaaatgggtttcgcggactattttttggttgtctgggacgtgatgaattatgcgcacaaggtcaacattatgccaggcgccggccgtggttctgcagcaggttctctggtgagctatgcattggccattactgaagtcgatccaattgaatataatctgttatttgaacgatttctcaatcctgcccgagcgcaaatgccggatattgacttggatattcctgacaatcggcgcggtgagttgattcagtatgttcacgacaaatatggcaagaatcatatggctcagatcattacattcgggacttttggggccaagcaggcaattcgcgatgtcgcccgggtttttggcctgagtcaatttgaaagcaatacctggagtaaagctattcctaacttatttcatattgatttgaaaaccgcgtacgaacaaagtcagccattgaaaaatctggttgccgattcgccaaaaaatcggatgctttttcaaacagctttggctttggaagggttgccgcggcattattcaacccatgcggctggcattgttttgtcagaagaaccattgactgataccgtcgcgctccagcctagtggcgatggactcgaacagactcaggttcccaaagacgatgtagaagcactcggattgttgaagatggactttttaggtttaaaaaacctcaacatcttggcagcagcaagtcatttcgtcacccgcgatacaggcaagccgtttgaccccaaagcaatcccgcttgatgatcaacccacgctggcgttatttgcgcgtggcgacacaaatggggtcttccaatttgagtcatccggcatcaaaaacgttttacgcaaactacgaccaactgcttttgaagatgttgtagcggtcaatgccttgtatcgtcccgggccgatggagaacattgataccttcattgcgcgcaaaaacggtcaggagccaattgcctatccggacccagcgctggccaaaatcctaaggccgacttatggcgtcttggtttatcaggaacaagtcatgcaggttgccaacgtcatgggtggtttcagtcttggtgaagcggatttgcttcggcgggcgatgagtaagaagaaatcttccgttctagctgcggaacaggataaatttattgaaggtgcccttaagcaaggcttcccggaagcaaccgcgaaaaccgtgtatgcttacattgatcggtttgctaattacgggttcaatcggtcacacgcggtggcttacagtaaagtggcgttttggctggcttatctcaaagttcactatcctgccgcctttttcgcggcattgatgaacgccagcatgaacaacctgccaaagctacggacgtatgtacaggaagctaaagcgcgcaaagtggggttacttggtccggatatcaatcaaagcaatggcggctttaaattgagccaaggaaagatccgctttgggttactatcaattaaaggcatgcggcgggattttgtcgaagccatttttgccgcccgcaaaaatggaccgttcaaggaccttcgtgatttattacaacggcttgatcctaagtggttgaaaaccgactactacaaagcaccaacgcttgccggcgcttttgaccaattcagcaataaccgtgcgcagacgctggctaatttggatgagctgattaattccgttaagttagccggtaatgatgtcgggttattttcaatgttagcgccaaagaccattgaggttcccgagatgccggcgagcgagcgcttagaggcagaagcagaagtgctcggggtttatctctccgggcatccggttgataagtatgccccgctaaagacccagtatcgccttattaatgttagcgatcttgaagaaggacgagccgttgacatcttgctattagtacggcatatcaagcggattcgaaccaaaaccggtaaacccatggcatttatcgatggtcaggatgcgaccggtaacgtgtcattaacaatctttcccaatttgtatccaacgatcgagaatctttcggaagacatggttgtattagtcaatggccgggtcgagaagcgcaatgatgatttgcaattggtggtcaatcggattcaggatgcccagccattgttagccaacttgccgaccgcggaattgttcattcgcatggatgccaaggatacggcgatgcgaaccgatttactgaaaaaactgcaagctgctcacgggacaacccccgtcattacggttgatactgccacccgcgaaagcattttgctggataaacgttactgggtcaaggcgcagacggaactgatcgatgcgttaaagacacagtttggcgcgaacaatgttgtgttaagaaaacggcaggaaacctagagaaaattgtaaaatgttctcattttcagggactttgtttcagaaaagtggtaaactcaatgagtatttgtggtaggacatatcgcaaaagaatatgcatgaggtgaaataatgaaacgcattggtattttgaccagtggcggtgatgctccgggcatgaacgccgcggttcgagccgttgctcgcaaggcgatgcatgaaggccttgaagtatacggcatcaattatggctttgccggtttagtggccggtgacatttttaaaatgagcgagtcaacggttggtgacaagatccaacgtggcggtaccatgctgtactccgcccgttatccgcagtttgctcaagaagaaggccaattgcgcggggttgaacagcttaacaagttcggcattgaagcactggttgttattggcggcgatggttcataccacggtgcattggcactaacccgtcacggtttcaatacaatcggcttacccggcacgattgataatgatattccgtacactgatttcacgatcggatttgatacggcggttaataccgtggttgaagcggtggatcggttgcgggatacggctgcatcccatgaacggacctttgtcattgaggttatgggacgtgaagcaggtgacatcgcattgtggtctggcgttgccggcggggccgaagatgtcattatccccgaacacgacttcgatgttaaaaagattgcttcgaagttacaaagttcccgtgaacgtggtcaaaagcatgcggttatcttgctggctgaaggcgtgatgcacgccgatcagtttgccaaggaacttgctgcctatggtgatttccaattacgtgctaccgttttaggtcatatcgttcgtggtggtgcgccatcagcacgtgaccgcgtattggcttcccaaatgggtgcttacgccgttgaactcttgctgcaaggcaagggtgcgttggcagtcggcattgaaaataacaaaattacggcgcatgacgtccggactttgtttgatgccaagcaccacgccgaactttcgctctacaccttggcggaagagttaacattttaatttttgtaaacaaacgacattaacgtctgtttaaataattgcaaggagcgatttcatttatgaaaaaaaccaagatcgtcagcacacttggacctgcaagtaacaccactgatatcatcgttaagttgattgaagcgggtgccaacgttttccgtttcaacttctcacatggtgatcatgaagagcatttggcacggatgaacatggttcacgaagctgaaaagatcacgggcaaaaccgttggtatcatgcttgatacaaagggtgccgaaattcggacgactgttgaggatacccctaatggcaagattgaattccatacgggcgataaggttcgtatctccatggatgcaagcctgaagggtactaaggaaaaggttgccgttacttatcctggtctttatgatgatacccatgttggtggccacgttttgttcgatgatggcttgatcgacatgaagatcaccgaaaaagatgagaagaaccgcgaacttgtcaccgttgttcaaaatgacggtgttcttggtggcaagaaaggggtcaacgcacctggtgttgcgatcaacttgccaggtatcacagagaaggattccaacgatattcgttttggtctggacaatggcattaactttattgctgcatccttcgttcgtaagcctcaagatgttttggacattcgtgaactccttgaagaaaagaacgcacttaatgtccaaatcttccctaagatcgaatctcaagaaggtatcgacaatatcgatgacatcttgaaagtgtctgacggtttgatggttgctcgtggcgacatgggtgttgaaattccatttgaacatgttccgatcgttcaaaagcgcttgatcaagaagtgcaacgctttgggcaaaccggttattaccgctactcagatgttggattccatgcaggaaaacccacgtcctacccgtgccgaagttaatgacgttgctaacgctgtctttgatggcaccgatgcaaccatgctttccggtgaatctgctaatggtgaatatccagttgaatctgttgctgcaatggcacggattgatgaatacaccgaagcagccatgcaggatcaggatgcttttgcattgaaggaatacagtaacaagaacattaccgaagcagtgggtcagagtgttgcacacacggctcgtaaccttggtgttaagaccattgttgctgctactgaatctggctacaccgcacggatgatctccaagtatcgtcctaaggctgatattcttgcgattaccttcagtgaaaagactcagcgtggtttgatggtcaactggggtgtttatcctattgttgccgacaagccggccaacactgatgcaatgtttgacttggctaccaagaaggctcaagatcttggctttgctaaggaaggcgacttgattctgattacagccggtgttccagttggtgaatcaggtacgactaatgtcatgaaggttcaactgatcggttccaagctggttcaaggctctggtgtcggtgatgaatctacaatcggtaaagctgtcattgcaagcaacgctcaggaagccgctgccaagatgcaaaaaggcgacattctggttgttaagacaactgacaaagattacctgccagcaatcgaaaaggccgctgccttggttgttgaaacaggcggcttgaccagtcacgctgctgttgtcggcatcgcgatgggtattccggttgtcgttggtgctgaaaatgctaccagcgttatctctgatggtcagattatcaccgttgattcacgtcgcgggattgtctacaagggtgctactaacgcactttaatcatcatcagtttaacaacgatttttctgaaactcctgaggaaactcgggagttttttattatatcggctagataacccgctaacctgagtgcgagtggttaaaatcgcttaacaggctcgtcagtgtggttgggatagcatataataagacccagcgtgcttgatcggataaaaatataatttcagccgatgaaggaagtcggtaaacgattggaggaagatagccatggaaagttggctgtttttactagcgattcttgctattgcactcattggtaaaaataaaagcctcgttatcggtgtggccgttgtcatggtgttaaaattaattccgcaaacgcaacatttactcaagttattgcaaagtcaggggatcaattggggcgtgacggttatttcggccgcaatcatggtacccatcgcaaccggtgaaattgactttaaggaactactgcatgtcattaaaagtcctgcagggtggattgcaattggctgtggggtattggtggcggtattgtctgccaaaggtgtcggcttgttggcggtaagtccggagatgacggttgctttggtttttggtacgattctgggagttgttttcttaaaagggattgccgccggtccggtgattgcaagtggtatgacctatgtaattttaaccgtttttaatctcttaccgggtcgttaagacggtgttgttgacatgtgaaggagcaataagatgaaatttaatggtcaagtcgtcaccgcacaagtgatggatcacaatgaaaaagaagtgtttgcccaatatgagggtgtaactttagcaatcgaccggcttgaactgccgacgctaccagaaatcggtagtcaacttaaaggccttgcgtatgaaaataaacatggtcaggcacgattgacgaccaagctgcctaaggtgggtcgcgatcactacgcttttgctccggttgttgaagttcgccgagatttaggcgtctttgtcgatatcgggttaccggataaggatatcgtggttagtgaagatcagctgccggaattaagtcgtttatggcctcagcgcggcgatcgtctcatgatcgcgctgacaattgataagaaggatcggttgtgggggaacctagctgatgaaacgattattcgtgccgttgccaatcgtgcgaaaccggaccaaatgaatgctgatgtcacggcaactgcctatcgtttgaaaatggcaggaacccgggtattgacagatgacttttatcttggttttattcatccaagtgagcgcgatgttgaaccacggctaggacaggtcctgcatgcccgcgtcattggcgtgagtgaccaaggcgaattgaacctgtcattaaagccgcgtgcttatcaagcgattggtgacgatgctgctatgattctagccgttttgcaacatgatccggcaggcaagattgcctataccgataaaagtgatccagctgtcatcaagcaggttttcggcatcagcaaaggcgcatttaagcgagcactaggtcatttactgaaggcgggcttgatcaaagaagaagccggttacacggttttattagattcgaatagtcaaccatctcaggaggcatagtatgcatgggttgattgctgattttattcattatctggatgttgagcgcgggctggcccgaacaacgcaggtcagctatcagcaggatttaaccacctttatggcttggttaagcgaccaaaagcaaacaacttttcccgaagattttggggttattcaggcgttcttaaagcatcaaaatgataccaaagcgcctgcatcagtcagtcgaatgatttcggcgttacgcaagttttaccggttcttgttacgcgaaggcgccattaagtctgacccgatgaccaaaatcgatacccctaaaaaagcacaacatttaccggccacattatcagggacggaaattgatgctttgatggcaaagccggataccactaagccgttgggattgcgtgatcgcgctatttttgagctgatgtatgcgactggcttgcgggtatcggaagttgtcggattgcgattggatcagttacatttagcaatgaacttgcttcaggttaccggaaaaggcgataaggagcgactggttccaatcagtccccaagcagccgattgggttaaccggtatttgcaggaatcccgtccgcgtttgatcaaacaccagcaacccaaggcagtgttcgtcaactttcatggtcatgcgctcacccgtcaagcaatttggaagaatctgaaagcctatattgcaagtgttggcattgaaaaggatgtaacaccgcatacgttacggcacagttttgccacgcgtctgttggaaaatggcgccgatttacgggtggttcaggagttactggggcatagtgatattagtaccacccaaatctatacacatctgagtaatcagcatctagtggcggtttatcataaaacccatcctcgtggctaaccgtaaccgacagccgttgagacgttacgggccagaccttttgttgctttgcggaaggtgactaaagtttaaatctaagcacaacggcagatagccaaccgctattcccatggcatagtccaatttagttcacattgccccggtctcgtttctatgatagagtgtctggagagtatcttttggaggcaaatatgctggttaaatataaaaacgactatgagaaaatcgcgatgggacttttatcctttatcccggatctcaaagatgtcgggcatctgaagactgaacttaagatgtacactgaagatgattcccatgcgttgtatttgtataaacatcatcatgattttgtcggtgtggtcggtgttgaattaagtgccgattttgttttggtgcggcacttgagcttctcgccaaacttccgtgatgaggccaccgcatttgccgcattggcagaattaacaaagctttttccagataagaaactgatgggtgcattggaacacgcatcgttgatagctgcttttaacaagtttcgaaaagaggatgaccatggcactgacactcgtgctgaatgatttctccgggccgttggacttgctttggcatttgattcggactaacgaagtcgatatttatgatattccaatcgccgagatcaccacccagtaccttgactacctgcaccaaatgcaggatttagcactggacgtggccggcgattattttgtcatggccgctaatttgatggtcttaaaaagccggctattgttgccacaaccggaaccggaaacaaccgcgccggatgagccgactgatccgcgagctgacttagtggcgcagttgttgacttatcaggtgtatcaggaagcggcaaaggatttaaagcaacgtgaagccaagcgtgcccaggcttttgccaagccaacaactttgccggatgaaaagatggcggttccgcttgctccaggaacggtcaaactaattgatcttcaagcggcgatggcgcgggtcatgaaggcccaacaggcggcgcggcaaacgattgcccacatcgaaacggaaccggtctcggtagaaaaacgcatcggcgaagttttgcgtgccttgcaacaagatggtcaatgtttatttgcggatttattagcagtcaactcggtggaacaggtcgtgacgacttttttggccttgttggaactgatgaagaatgatcaggtgatttgtgaacaagatgcgccatttgatccgatcacggtgacattgaaggaggctgcttgatggagccggtattagaggcaatcttatatacggctggtgaaagcggtgtgacgcttggtgaacttgccagtatcttggaaatcagtgaaagtgccatgcgccaacaactggaggcatatcaacaacgattggccgcagacgaccagcgcggattacaagtacaacagtttgccgatcggtattacctactgaccaaaccggcctttgtatccgcgattaaaaaatattttgcggggccacccgctgccggtctatcccaggcagcattggaggtgttggccattattgcgtatcagcaaccgattacccggatagaaatcgatgaaattcgcggcgttcagagctccggtgcgcttacaaccttagcatcgcgacaactgattaaagaagcagggcgcaaagaagcaccggggcgtccgattctatatgccaccacccagtttttcctggattattttggcctcaatcaattggccgacttgccgccactagccgatgcacctgaggatacaggagaagtcgatctctttacggcatttcgcgatgatgatcagtcacaaacggctgaagatgataagaaaatggagcaaaaccaacaacatgacaaccaaaaatgaacgactgcaaaaagtcattgccaacgccggtattgcatcacggcgacatgcagaaacactcatcgcatctggccacgttaaagttaacggtcacgttacgacagaaatgggcatcaagatcggaccgcatgataccgttgaagtagatggggtgccaatcgggaaggaagccaagcgctatttcctgttctataaaccacgtggcgttattagtgctgtcgaagataataaagggcgcaaagttgtgactgattatttcgaggacgttcaggaacgtctttatccagtaggccgactggattacgatacgagcggtttgctagtcatgaccaatgatggcgaattggccaaccatctcatgcatccgcgctatgccctggaaaagaaatatgttgccaaggttgaaggaatccctaaccgaccggcgctagcaccacttaagaccggtgtttcaattgatggtaaaatgacggcaccggcaaaggtcgaaattttatcaactgataaggctaagaaaaccgcaattgtggccttaaccattcaccaaggtatgaatcatcaggtaaaaaagatgtttaaagcagttggttttccagtgatcaaactttctcgtgaagcgtatggtaatctgaccttggccggattgcagccaggggaacaccggccaatcaaacctcaggagcttcatgatctccgccaattaaccggtgagcaagaagaagcacattaattgttaacgcattcaaggtaaatgcttgaatttgtgagggttgtttgctacagtgtgattgtaattaaataatttggttcgtcttcagggcagggtgcaattcccgaccggcggtataaagtccgcgacccgctttttgcggtggaaccggtgtgattccggtaccgatagtgatagtctagatggaagaagatggggcttttttgaatctgtattcaatcaaagacctattcccccctgaaggaggaataggtctttttaagttccggaagacggcctcacggaggtaatgttttatggcaagtcgttctaaggttcatcgtttggtgggcattgcgcttttggcggcaatcgggtatgtgctgatgatgttttcattcccgattattccggcctttccctttttaaagttggatttgtctgacttggttgttcttttagggggattgctttatgttcctgttggcgggattgctgttgcgtttgttcggagcttggttcacttcgctttaactggcggtggtgttgttaacctgattggtgatttggccgcctttattgccagtgtcggcttcttgttaccggtcgtttatacgattcgcggtaagcatcggatttggcggcagattgaagggctggttttagggaccttgagtttgacagttgtgatgagcgtgctgaactggctggtgatcaccccgatgtatatggctgtcttcaatttcaatttagggatgtctttgactaaatatgttctaattggggttgtgccatttaacttaatcaaaggcgtcgtcatttcagttgccttctttgcaattgcaaaggcactggctccatggttagcacgtcaggaaatgcaaatgagccattaaaagctgttccggttttcatttgactgatcggttcacttagacaagcaaaaagcatccaacttgcgcggatgctttttgtttgcctgaaaatgttagcgacataaacgttaacaggaatcaatgcgtaatttatcgatagcggtctaatttggctgtccggttacgcttgattattccgcttttgttggcgtaaacggagccgtgttaaacgggtggtcactgcgtttgatggcatgtgtcgggcaacgctgatacgcaagccgaaaatcaatttttgcatgatcatccaggggttttgtgcctgtgttgcgatcaggcttataataagcaataccggcttcgtcatagtcaaacaaggctggtgccaacatttgacacaatccacaagcaatgcattcgggacgttccactctgccatataatgccatgttgatagaggactcctttataattttcagtttaaccacacccaagtatacaataatcaatgaaaaagaggtgattggcttgttgacagacttggccattcaattttttgatacccagccacggcgagagcgagctgtattcggcctgttagccggtaagaaaaccatttcaaatctctatgccgctttaacccaccagcaattgcaatggctgcagctttatccaagcctgtctaaagagttgtttttacagacagtggcgcagttaaaaatgcatggtcagttaacaacgacagaaaccgggttggtgttaaccgcaaagggccaacagtttcagcgtcaagcggcaaagcgggtgccattaccgacctactatcagccgtggatgcacctgtcaaaatttgcgccgcggttctttttggccattcaggttttgtcagaagccagttaccactcacaggcatatcgtccgattagtaccgattgggcgaatcagcaagcggttaaacgctggtatcgccaactgaatatcgagtctgcgattgctgatctgattgcgctttttgaacggttgccgccgcagttagccgacatacttgcggctaatctaattggtcacgagtacgctggtcaagcgcagccgcctactttaagcgcgcgtttccgccgcattaatgctttggcagccttagttaacgagattgcgggaattaaggatgaaggcaatccgtggtacgagttatggggcggcccgcaagatctggtgacgcgtccggcacgttatagtttacagcaagtccaagccggtgttggcttaaaggcaattgcaagtaaaagtcaccgtaaactgagtaccgtgaaagagcatttgctgctggcggctatcatgggagagtcgcttccggtcgaacaattgattccgcaaccgatccatcaagcattggatcagatcgatcattggcaggatcatcaagtcttattggatgctgttccagctagtgacttctttcaggtacgcttgtttcaaatcttgaaattgcaagggagatggtcgcgtgtcgcaacttgaaacggccttggcgcagcattttggctttaaacagtttcgtcccgggcaaaaagccattatcgaatccgttcttagtggacgtgacaccttaggcattttacccaccggcagcggcaaatcactttgctatcaattgccgaccttaattaaccataaaccgactttaattgtcgaaccactgattgcattgatgcatgaccaagtgggacggctgcaggcagcgggcgaaaaacgcgttttggcattatccgggcaaattgcgccgcctcagtttgctcagattttagcgtatttgaacgtttatcgctatctgtttatttcgcctgaaatgctacagcgaaccgatgttatgtctgcgttgaagcagctggaccttgggctgctggtaattgatgaggcacattgtatttcacagtggggaccggattttcgtcctgcctatttacaactggggcgagttagggcgcagttgcacgtggatgccgttttagcgttaacagcaactgcaccgaatcaagtccgcagcgatattttaaagcaactggcaatgcaaaatccgaatacaattgcggattcagttgatcggcctaatatttttctgggcgttgagatgtgtcaaaatgaacaggagaagcatcagcgcctagatcaactcttgcaagccaatgtcggaccaacgattatttattgtgccactagggcagcagcggaaaacttggcaacggtgttaaagaacgcgggattgaaagccgctttttaccatgccgggttggattcacatcaacgtgatttgattcaacgtcaatttcaatttgatcaactgcaagtcatctgtgctacgagcgcatttggtatggggatagataaggctaatgtgcgcttagtggttcatttatatgtacccgagtcgcttgaggcctattatcaggcaatcggtcgggcagggcgagacggcgccgcgagtctggctgcaatgattgtgacgcaagacgacttgaaccgaagccggggacttgcggggatgctgccggatcaaacgatgatccagacagtttttgcccatcctgatatttatcgcgatttcgacgatcctcaaataaatctgatcgaagcctatattgcagccggtttttcgctggcacaaacgcaacaacaattgcagcatcggctagcagaaaagcaaacaagttttatggccatggccgcatttgtcaatgaatccggttgtcgccgggcatggttactcaagcactttgattcaccgtccatttcacatcatgccttttgttgcgggccggtgacggcggaagtgctagagaagttagagacagcgaatgtatcggcacagcttccgcctaagcactggcaggcagtttttaggcaaatctttagataagcggcgtcttgatccggttcaatatgatacaataaatccatgtagtgaggaggatcgtgatggcggaaaaagataaaaaccaacatgataacgcggatcaagaacaacatcagggtgaggatgccaataagccttgggaaacccttttcgatgacgaccgtgacgatcagggcaatttaagccgagtcgccacccgtaagaagcggcaaggtagttcgaagctgacttggatattggctattttgctgatactggcagttttagcaccgattatttattataaagtcatggataatcaaggaagcagcggtggcaacctgtcaaatgacaaggttgtgattcaaagcgccaaaaagaccagtcattcatccaagaccaagaaatccgccaagtcttccaaaacgtctaagacttctaagacttctgcaaaggaagcctcaagtagccaacaggcaacatctgcgcaagcgagctcacaggttagtcaagcacccagcgcctcccaaaaccaggagcaggcaagcgcgtcagcagcaccaagtcaggccagtacggctggcaactcctatacggtcaagtcaggcgacaatctttatcggattgcggttaaccacaacatgacgttggacgagttgttacagttaaacggtcttagtgccaactccggaatcacaccgggaaccgttttaaaagtgaaataatagtgacacggccctgttcggatggttaaatcgatgaacggggttgtgtgttgtggaggaagttcatgcagattgcgattgacggccctgcaagtgccggcaaaagtacgatcgcgaaacttgtggcaaaaaaattaggttatatttattgcgatactggtgcgatgtatcggactgttacttatatggcgcttaaagatcagttgccattggatgatgaaacgaccattttacagcatttgagtcagctgcagatccggtttgcgcctggcgatccagaacaacgtgtttttatgaatgatgaagatgtgacgttggcaattcgtgaaccggacgtgacaaataatgtttctcaagttgctgctttgccaggtgtccgaactgaattggttgagcggcagcgggatattgctgcaaaacatgatattgtgatggatggccgcgatattggaacaaccgtcttaccgcatgcggcactgaaaatctttatggtagcttcggtgtcggaacgcgcaaaccgccgctacaaggaaaacgttcaaaagggaattaaaacgccacttgccacgctggaagcggaaattgctgagcgtgaccgcaaagattcccagcggaaggtttcaccgttacgtcaagctgccgatgccattcgtatcgacacaacgagtatgacaattgaagaagttgtcgcgaagatattagcattggttgcagaaaagaagcaggcagattgaccagagcaaaataagcgctggtaatttgattcgttttcaagtacaatagatccagtatacagctgcataggaggattttttggcatgagtgataataacgttaatgagaacaccgaaacaatggcggacgcccttaagagtgtcaccacagtaaagattggtgacactgttaaagcagatgtccttgctgttgaagataaacaattgatcgttgggatcgaaggaacaggcgttgaaggcgtggtcccgatcaaggagttatcaactcagccaatcgatgacattcacgatgttgccaaagttggcgacaaacttgatttagttgtgctttcaacggttggcaaagataaagaaaatggtcagttcctactgtccaagcgccgtctggaagcacagaaggtttggaaagaaatccaagctaaatacgaagccggcgaaaccattaccgcaccggttaccagtgtggttaaaggtggtttggttgttaacgcaggtgtccgtggattcgttccggcatccatggttgaagatcacttcgttgaagatctcaatcaatacaagggcaaagagctcgaatttaagattattgaaattgaacctagtgagaaccgtttgattctttctcatcgggcaattgttgaagcaagcaaagccgaagcacgcaaagaaatctttgcaaaaattcagcctggtgatgttgttgaaggcaaggttgctcgtttgaccaactttggtgcctttgttgatcttggcggtgttgatggtttggttcatgtttctgaaatttcatttgaccatgttgataagccaagtgatgttttgaaagtgggacaagagattaaggttaaggttttgaatgttgatcctgaccgtaaccgtatttccctttcgatcaaggcaaccttgccacaaccatgggatgacatcgaagaaaaagcgcctgctggctcggttttgaccggtaccgttaagcgtttgacaacttttggtgcttttgtcgaagtattccctggggttgaaggactcgttcatatttcccagatttcccatgaacatgttgcgaccccggcagatgttttgaaagaaggccaagaagttaaggtcaaggtgctttcggttgatccggatgctcatcgtctggcattgtccatcaaagccttgcaggatcgtccagctggttccagcgatgcgtccgagggtcacgaaggcggcaataacggcaatcaggaacgtcggcgttcatcacgtcctcgtcgtggtaacgatcgccatcagtcaagctcgatccctgctgaatatcagcaagatgattctggcttctcactcggcgatatccttggcgatgcgttgaaagatgccgctaaaggtaacgatgatcaggatgataacaagtaattttaccatccgttaaaaagttgagccttggctcaactttttttatgctaacgctgctgtttataatttatatactggcagtgagtgaactagatcatgttaagctactaaaaacaaacttggttaaagaaaggaggccgtgatatatggtcttaccaacacttgccattgtcggacgtcccaatgtcggtaaatcgacaatttttaatcgaattcttggtgaacgggtctcaattgttgaagatactcccggcgtcacgcgtgaccgaatttatggcaaaagcgaatggctaggaaaggaatttgcggtgattgatactggtggtattgatctcggtgatgaaccttttttagcgcaaatcaaagatcaagcagaaattgcgattgacgaagccgatgtcattttatttttgaccagtattgaagcaggcgtgactgacgcagatgaacgggttgcccagattctttatcgggccaataagccggtcgttttagccgtgaacaaggttgataaccctgaacgccgccaagacatttatgatttttattccttgggttttggcgagccgctaccgctttcaggtacgcatggtattggcttaggtgatgttttggatgccgtgctagctgcatttcctaatgaagccagtgcggacgaggatgattcaatcaaattcagtttgattggccggcccaacgtcggaaagtcctcgttggtaaatgcgattctgggagaaaatcgggttattgtcagcccgatcgaaggaacgacacgagatgccattgatactaaattcgaagctgacggtgaaacttttacgatgattgatactgccggcattcgtaagcgtggcaaggtgtacgaaaataccgaaaaatacgcggtgatgcgcgcgttacgggccattgatcgttcggatgtggtgttattcgtgatcaatgcagaagaaggcattcgggaacaggataaaaaagtggccggttatgcccatgaagccgggcgcggcattattattgtcgtcaataagtgggacacacttgaaaaagataatcgcaccatgaaagactttgagaacttaattcgtcaggagttccaatatctagactacgccccgattatttttgtttctgcgaagacacatcagcgtttacagagtcttccggccatgattgtcgaggtttcagaaaatcaaacccggcgaattcaaagcagtgtcttaaatgatgtcttaatggatgccattactgttaccccaacaccgacagtcaatgggaagcgtttgcgtatttattatatgacgcaagtggctgtcaaaccgcctacattcgtggtttttgtgaatgatcccgatttattgcatttttcttatgagcgtttcctcataaaccagttacggcaggcatttgacttttccggcacgccgattcatgttattgcgcgtaaacgtaaataaatttgacaatttctgacaatgacttttcatttaataaatcgtgattttcgataaaggtttcaaggatctcagccaaaaagtttggcaaaaaccttgtcacaacgggcttgctatgctatgtttaaacctgaaatgatgatacataattatcattgtttcttcattcctgagcggtcaggaatgagcatgtttagatgttcacgcatctaatcaattatggaggtgaaatattcatggcaaacaaagcagaattgatcgaaagtgttgcaagtgcaaccggtttgaccaagaaggatgcaaccgcagctgttgatgcagttttcggctctatccaggattccctttcaaagggtgacaaggttcaattaatcggctttggtaacttcgaagttcgtgagcgcgctgctcgtaagggtcgcaacccacaaactggtgcagagatcaagatcccagcatccaaggtaccagcattcaagcctggtaaagcacttaaggatgccgttaaataaacggttttctgaggcaacaatgaagtaacaccaaaaaccgagtcttaacggactcggtttttgcgcgttttggcgaaagccgtgtccggtgatggtcatcaggagcattcaaaatcgtcagacgcgtgttagacttacactagatagtggatggtgaaaaactataaaagtactttcatgataggctttgacaatagttaagtgtataataagtgtaagcctaccgatgcatggcgtaacagcctagaccactatcaagaattcgttatcatcgttgcacttgacttgaaaattgagggtattatgttatttgctcttttatgtattgcttaacgtttatctaattccctcgggtgactttttgggcaatattcccgcagttttaagaggagaattatggcgggtggtgacgagcagcgtttttcattatgattgggaaaatcacctattgcccaatatgttcgccattataattttaggaccgtttattgaatggaaacttggtaaggctgcgttcgtcattagcttctttatctgcagttgggcaggggagttgctgttttgctttggatttggaggatttattcaatcacacctaggaattggcagctatgttgagcggtttaatggtgtttcgatgtcggtatacggattatttccattagcagttttggcacttgtaactagtaaacctgccttttcaccgttgacaaaagttgttgcatttggcgtaattctttacgttttcacaaccggatactggccttatcaagaactatcagacacgagaatctatgagcagattgggcattcgtgcggttttcttgttggcattggatgtgtcttggtgattttgatacaaaggaatcggaagaaacgattgacgcatttgtgcgagccaattgaggcgctccgtggtgattaggcttagaaattgacagcgtctagtcacggttgatttccaagtgctagcggtttcaaataaaacatgctatactgcctttacaatcgaatagaaacatttggggtgctgaaaagctgagataatacccatggaacctgatgcagttagtactgccgcagggaaatgtcgctaagatcaatcgttttatgacgatgcttatttgtgatttcatggaccccgccagtgtttggtgtcgggtcctttttctttgagttgacctgttcgctaaccgattggcgggagaagttgatggagattcacacataaacatggttatgactgattgtgactgcttaggcccccgtctgtcttttgttcgaagaaagaggggcttttttgatggataaatggtctttgcgtgacgtggtcttgttggcgtttttagccttcttgtttggtggtgtcttcatgggtgccgatgcaatttatgccgtgttggcggcggctttgacaccactgggctatgcaccttttgctaacgagattctgtttggtatgtgggtgatggctgcaccgatgacgaccatgctgttgcggaagaaagggagttcaattcttggtgagtgtctggctgcgttggccgaaatgctttatggctcttattttggccctgccgttttgctatccggttttgttcagggactaggtagcgaggccggatttattgtgacgcgataccggcgctatgacacggtgagcttgcttttggcggcagtgggcaccaccttgtttagtttcacttatgaatacttcaagctgggttatggcgcgtacagcttcggcatgatcttaggcttggtcacggtacgtttattgtccgttattttctttggcgtcgttttggtgcagttggtcatgaagctttacgagcaagcagccggtgtcaagcgacttgctggcaggtaaaagccaatgggaattaggttgaaagatttgcagttccaccgggaaacgccgttgtttgatcacctgagttttgagtttgcgacaggtgcgttaacggtcctgacaggtgatagcggtagtggcaaatccacattgctcaatttaatcgccgggtttgcgccgatgacctattccggcacgattttgcttgataatcatgatctcagtggagccagtatgcaggtaaaagcgcagcaggtcgggatgttgttccaaaatcctgatcaacaatttaccatgcggacgttaagcggcgaacttgcctttgcgttggagaatctcggcttgtctgcaacagccatgatccaaagaagtaagcaggccgtggcgctgggcgatacgcaagcgttgttaaatcgtgacttgcagacactttccggtggtgaaaagcagcgggcagcattaaccgttttgctagcgatgaatccgcccattttattgctggatgaaccgtttgccagtattgatccggtcagtcgccagcagttgattaccaagttagggcgattgcgcgatgctggcaaaacgattgtgattgcggatcatgatttgcgtgattacgccggagtagccgatgcgctagttgctttgaaagacggccagctgaccaggctgccactcacaactttgaccacgattcccacccagtttgacttaactcaagccaatgcagccaccgtttcgttgctacgatttgaccaagttgtctgcgcccggaatcaccaaattttggtgcaggctccgacatggcagtttaataccggtatcacgactttgacaggcgctaatggtagcggcaagtcaaccttgctgcgggcaatggtgcagttgcatccgtatcgcggccggatgtttctcgacagccgccgattacgccgcactaaaaaactgtaccggacgatgacattggcggtacaggatgccggcaagcagtttgtcacattgactcccgccgatgaacttgcatttgggccagccttgacgccaaaagtacgcaaacgccaggcagctgcccttgcctatttgggattgacagaaaaacaaaccggcagcctgtatcacctgagcgaaggccagaaaaaaatggtgcagctgatcgcaatgttaagtctggagcgaacttttttgctgttggatgaaccgtttagcggattagatgaacgtgcctgtgctttttttgccgcgtggatcaaggaaaaagcagctaagcaggcgtttttgattgtgacgcaccgactggctccgctagctggcatcagtcaccagcatgtggcacttgccgatcaccggttacacattctacaggagtgacatgatgccagtaaaaaagaccaatgcagtaaatctgagtttatttattctgctgctgacacttgaaatatcttttagccatgcggtgagccttaatgtggcgttgatcggactggcaagcggttttttaatatggcggcgggcgtttaaaagtctcgtcgttttggccttgttaccgttgatcccggctgccagcacgtattgggcaattaccctgcatggtacggatacgacttacgctttgctgctgtgggttcgcacctatgctttcaccgcgttagggttggtgtttcttatcggggttgacttagagaccttgctgttatggctggagcagcataaattatcccctaattttgtttacggattactggttgtgattcacgccttgccgcagatcatgcatgaagtggctgctattcgtgaggcgagtctgttacgtggccaaaagttgcacgcgtggtcgccgatgatttatgtgaaggtgatttttgttgctatgtcgtggcaggaccagtacgtcaaagccatgtatgcccatggttataccgaaggagcaacgcgaacggttcaccaaaccatccgtagttcatggcgcggcttgatcgccatggtggggggctttgtccttttgaatctaattgcccgttagtttgaggatcaaaaagacgtggtcgtgcgatgtttaagcgattgtgcagcggccgacaccgcccgcgacagactaacgcgagctataacaaaatcattaatgaaggagtgcttatgaaattttccaaaattgcccggcaacaagttgtgccgtactgggaaggcagtttttcccatccgtttttgactgaattgcaagccgggacgcttgatccggccattttccgctattatctcattcaagatgcgtattatttaaaacattttagccggttgtatgcgttaatcgcccagcaggctcaggaatcagacctgaaagcttatgcagcgcaatccgccgcgggactgacagaaggcgagttggcggtgcggcgggacttttttgacacgctgatgatcaccgatgcagaagtggcagcaactgccattgcgccgaccgcctaccattatgtatcgcatatgtatcgccaattagttgccggaacgccgcacgtggccatcgcggggatgttgccgtgtccgtggttatatcaagaagtcgggcaatatctagcccagcgccaatcaccggtgccaatttatcaacgctggattgaaacatacagcggagcggccaacgcggatgatcagcaggccgcggtggcattggtcaatcgattatacgatcacagcacatcggcagaacagcagcagatgctaaccgcttttcgaatcagtacccagatggaatacagcttttgggagatggcctatcacctggaaaagtggccggaagggagtcgcaacaatgacgcaaaatcgcgttaaacggctagcaatattggccatgatgatcgcactggacgtggtgctgtcacctttatttcgaattgaagggatggcgccgatgtcgagtgttgtcaatattgttgctgccgttgttatggggccgctttatgccacagttatggcctttgcctgtgcgctgctgcggatgacattattgggcatcccgccgcttgctttaaccggcgcggtgtttggcgcactgttggctggaatcggttatcgcattggcaggcggtcggtatgggcagcagctggtgaaatcctcggcaccggtttgattggctcgctgttgtcatacccggtgatggtttggttcaccggcagcagtcagtcgctatactggttcgtctacacaccgcgatttttcggcggcgcgatttccggctcgctgattgccttgtttgtgttatacgaacttgaccatagtggcttaacccgccggctgcaaaagatcttttaaccgctttacccgcacttcaaaaagaataatttataggaggcacataccccatgaatcaatccgtaaccacaagctttaaacaggcgtttgaatccgccttgccactgacttcatcgccgttagttcaatgcattaccaatgaaattacagtcgagtccatggccaatgcgcttttgtacattgatgccaagccggtaatggccgatgccgtgcaggagtttccggaattttttgcccaaaataatgccttactgcttaacttaggacatatctcgccagaacgtgaaaagagtctgctagcggcgggtagttttgctgctgaaacgcataccccggttgtggttgatctagtcggtgtttccgccacccaattgcgatatgaattagggcatcagttgttggcgaatcacccgaatgtggttaaaggcaatatttccgagatgcgccgctttagtggtctgaaaagtaccggtcgcggggtggatggcagccagctagatcaaagccctgctgcattttccgaacttgctgaagcgttgaagcggttgacccggcgttttcctgcgaccacttttttggcaaccgggcaaacagacttggtggtcagcgctcatggccagtggcgcctggaaaatggcgtcttgcaactggatcgcttcacgggaaccggtgatatcgttggtgccttgattgcagcgctgcttggggtagggctcacaaacgatgcagctgtggtcgttgccgttagctattttaattgttgcggtgaagtggctgcagccgaaaacaccggcggcctcgcgtcatttagagagaggacgctggatcaattatccttgttggcaacgcatcaagattggattcaaaaggtgaaaggacaggcactatgaatgcagaagctttacaactttatttagtcaccaaccggtacgccgattcgcctgaagtttttttagccaagattgccgcggcgtgtgaaaatggcgtcacaatggtgcaattacgggaaaaatccctgacaacccgtgattattacgcgctggcaaaacaggtcaaattgatcaccgaccgctatcggattccgttgatcattgatgaccgggtggatgtttgtttagcagtcgacgcagccggggtgcatattggcgatgatgaactaccggttgcggttacgcggcagttgcttggttccgacaaaatactgggcgtctcgaccaaaacagttgcgactgccaccgctgcggttgcggccggtgctgattatcttggggtgggcgctatttttccaacccaaaccaaggccgctgctccgttgacgtcactggcaacgctaaaagcaatcacagcggcagtctctgttccggtggtggcgattggtgggattaaggcggataatcttgacacctttaaggcaaccggaattgccggcgtggcgattgtcagcgagatcatgcaggctccggatacggcacagaaggtccagaccctcagcgctaaactgaaagaggtgttataaaatgacgattaacagcacgcctcaagtcgtcaccattgctggctcggattcaggcggtggtgccggtatgcaggcggatctcaaaacctttcaggcacgtcatgtgtttggcatgagtattgtggtggcactcacggcgcaaaacacatatggcgtccaggccagtttgccgattcctggcgatttcattgatgcacaatttcaatcattggcggcagactttgcgatcaaggcatgcaaaaccggtatgttagccgatagtgagcatgtgaacgccgttgtccgcaatcttaaacaggtcaatttcggtccgttgatcgtggaccccgttatggtcgcaaaaggtggggcaacgctgctggccccggaagccgttgcgacgattaagcaggaactattgccgctagccgatgtggtgaccccaaacttgccggaagcagaaatcattgtggggcatcccattaagcgtgaagccgatatgatagcggcagcgcaaacgattcaggaactcggcgtcaaaaatgtcatcatcaaaggcggccaccgtcaagacgctcaagcttcagacttcattttgttagcagacggcagcagtttttgggtacggtcgccgcgcatcgccactggcaatacgcacggtaccggcgacactttttccgcctgtattgcggccgaattggcaaagggcgagtcactgaagaaggcgattatcacagccaaagcatttcttgaaggcgccattagccaaggcatttttgtgggccatggacacgggccgaccaatcattgggcaacgttaagcgaagacgttcaggtgagcgcggtaaaatcatcggctggtttgcagggatagcaacctaaccagaaaaatcaaaagtaagtcactcatcatgatggggtgacttattttttagtaaaaatatttttatgaaacgctaccatttcccgtgtaacaacgatccgaaacgctggtatagactagcgcagcgctgtgaaacactattatttttatgaagcttcatttatacttacggcaaggagatgcgaggttctcgatcggtgttcaaaagcgtggctgactgtctgggttaccgtcattaaatcggtggatgaccggtgatcaaaatggcagtcggatacgtttaacctgacgatcagaacccacgcaagtcagcttggtgcccggtaacttggaagcttaagcgacccacactcctagtttgtatttggaggcattaaattgtgcaagaaaatgaactgacaccccagcgttatatgagctggccagttttaagtttgcttgtttttattacggttattggttttgaaaacatcttctacccgtttcaaaatcaaggcctgtctgttgtgatcaactgggtgattttattaatcgtcaacatcgtcccgtatgcattgattgcggcacagctggggacgacttttacccgggctgatgaaggcggcgggttggcaacctggatgcggcggacgctgggggatacctggggttattggaccagctggatttattgggctcagacgctgccttatctggttgacgtgtcaaatgccgttattgtggcgctttcgtggatgattctcggcgacaatagcttgggtaagcggatgtcgaatctgacatttggcttgctaacttttgccattattcttttattcatcgtcttggagaatctgttctcgcggtcgcttgaagtgatgtcgctcatcggcggggcagccatgtttttgatggcggtgctatttgtggcgttgaccgcggcgggattggctaaggggatgccctcagccacgcactttagctgggacgcatttcgaccccacttttcactgcattattttgcgacaaccgggctgttgatttttgccacttccggtgcggagctgggggccacgtatatcgcgcagttgcggaacccgaagaagcaatttcctaaagcgatgtgggcactggcactgatgaccgggtttttggtgatcttcggttcgcttgcattaggcgtgtggttcaacgccaaccatctgccggatgacttgaaaatgaacggcgcctactacgctttttccatgctaggtaaggcgtggggttggggtaaaacgctgatgtatttgtttgcggtcacgcagctgttgttcatgttggcgcagttggcggtgttgattgatgcctctagccgtgtgttgtctgccgatacggcgatgcgctttatgccgaagtggttattgcagaagaataagcaagggcggccagtacatagctatattttcaccgcctcactttgcttgttcctgttgttgctgtcgggcacattgccgaacatcaatgcaattttcaactggctgctgaatttaaacggcattgtgtcaccgtataaaacggcgctcgtgttcgtggccttcctggcgttgcgcgctcaaaccgacaaattcacgtccggctacacctttatcaagagcaaaaccggtgcctatctagtcggcggctggtgcttcgtctttacctttatctgtgcaacactaggcttcttacctcaggaagttgtgtttggaaccaacggctggacccatcagctcatcatgaatatcatctccgtcatcgtcctcttcggctttggtttcatcatgccgctgttggcacgacgagatgtgatcaaggaaaaattgctgtaagcagcagatgaatcgttatcccgaaaagttttgggataacggtttatttttttgcatcgaagaaggtgttggcctcaatccgaccagcaaaaaagtttcacagccattgagcagaattcacaaactgattgatactgctgttatgcaacaggatcatgttttcagcaatacagatacgcacctcaagttaacaaaaagtctggttcacacaagatccgtgagatgacactttgcaagccggtgtatagcagttgattcacccaacaaatgagctgcatgttaatttaagctaaatttgtttcatgaaaaatgatttgatttagttgacagcgcttccatgtgcggggtaagcttggtttgcaagattaagtaaaacgttttacctaactcagcaaatagggtcgtggttggtgtgaagaagaaagtttcgattacggacgtggccaaggaaaccgggctttccgtcaccactgtttcgcaaattttaaatggcaaaggcgcgcggtttagcgaaaagtcacgcaaacgggtgctggccgctaaagaagcattgggctatgaaccggatctttttgcccggggactagtcggcaagcgcggcaactcaatcggggtcgtgattcccgatatgatgaaccccttcttcgccagctttgtcgttagcgtggaaaaagccgccattccgcgcgggctgtttccgcaaatcttttcgattaatgggttccatgaaaatgttgattattttattcgacagtttctgggcggtacccaacgcggactgattcttgcggcaccggaagcttcacaggagattgtccaaaaagtcgggaagcaattgaatctgcccatggtgtttacggatcaggcgaccacgctgatgaccggcgacagcattcggattgacgagcggcatgccgggtttctggtggccgatcacctgttgcagttgggtcatcgccgcatcgcattcgtattgccgcaacgattgaccgttaacttgaaggatcggatggcaggttatcagcaagcatttgcgcagtatggggtccagctagatccggggctgattttccccagcgcgtttaatccggaaggcggtcggcaagcggtggcacagatcgtcaagaccgatgccacggcgatcatcgcgatcaatgatgatgtcgccagtggagtctaccgcggcttgtatgagcaacacaagcggataccggctgactacgcggtggtcggattcgatgatgtcacacaagcacgctttatgacgccaggattaaccaccctcgcccagccaattgatcagttaggccaacaagctgttgaactcctggttgcgcagatgagtggcgagcataacacgcgtaacacaattgagctgcccgtgaaattggtgaaacgcggctcaacgaaaataacgaaccaccgcggctaatcgtcaaggcattttcacaaggaggaggacgcattgaaaaaagggactgtcatcaacacccaactgtcacaagtgattgccgatatggggcactttgacttgttggggataggcgatgccggcatgccggtaccagcagacacatggaagatcgatctcgccgttagcagaaatctgcctagcttcatggacgttttgaaaaatgtcttaactgaactacagattcaaaaagtctatctggccgaagaaatcaaaacgcaaaatcccaaacaattagaacaaattcagcaactcattgacgtgccaattgtctttatcccgcacgaccaaatgaaaaaagatctcagcaaaactaaggccttcatccgaactggtgagatgacgccttatgccaatatattgttggaaagtggcgttactttttaaaacagagcgtgaactggtgcggttagcgatcggaatgtaagcggcctcagccgtgatggcccggtcttggccattgcggcagaggtccttacatgcagatcgctgcaccagtgaacgcgtttcagaacaattcacaccacaatcagcacttgggggaaagcaaaatgaagatcgaaatgaaggagatcaccaagagctttggcgccaatcaggttttaaaaggggtgaattttaccattgattccggtgaggttcatgccttgatgggtgaaaacggggccggtaagtcaactttgatgaacattctcaccggcttatacccagccaacagcggcgaaattcttgtggatgggcagccaaccacttattccggaccgatggaggctgagcagcatggcatcagttttatccatcaggaaatgaataattttctggaaatgtccgttgttgacaacatgtttttaaacaaagagctgcgtaatcgttttgggttgatggacagcaaggcgatgcgcgatcaagccgatcattatctaagtttgctcggggcaaagcttgatgtggatcaaccgattggcagcttgagtgttggtcgccagcaaatggtggaaattgcgaagtctttgatgaccgatgctaagatcatcattatggacgagccgactgcagctttgactgagacggaaattagtcaacttttcacagtggtgcggcgattgaaggctaagggcgtgggatttatttatatttcccaccgcatggaagaaattttcgagattgcagacaaagtgaccgtgatgcgagatggacgctcaatcaccgaatacgccaccaaagatgtcacgatgaaacagttggtcaaggacatggtcgggcgggagatcgaagacttttatccggagcgcacgccgacttttggcccggttgcgatggaggttaagcacttaactgaaaaaggcgtctttcaagatgtcagtttcagcgtccgtcaaggtgaaattctcggtttttccgggctgatgggtgcggggcgaaccgagattatgcgggcaatttttggaatcgacaagtatcagtccggcgaaattctgctggacggacagccggtcaagattcgtgatccgcaagcggcaattcgtcacaatctcggtttcttgacggagaatcgtaaggacgagggattgattctggatgactcgcttcacgacaatatagttttgccttcgattgatgggtttgtgaaacatggtttggtggacgataaagccactgatgattttgttcgattattaatgaaaaggcttacagtcaaagcgatgggaccggacgtgactgctggcagcctcagtggcgggaatcagcagaaggtcgtgttggctaagtggatcggctcggggtcgaaagtcttgattctcgatgagccgacgcgtggtgtggatgtcggcgccaaacgggagatttatgatctgatgaacgagctaacggatcggcatgttgccattatcatgatttccagtgacttgccggaagtattaggaatgagtgatcggatcgccgtggtttatgaagggcgactgactggtattttggatgggcagaccgcaacgcaagagtcgattatgacgctggcaacagggggagtggaagaacatgcaggcgcaatctaagacaaaagcagctagcaaagtagacgtaaaaaagatttttagtcgattgggaccgctactggccttggttgtactgatcattttggtcacggtgatgagccccacctttgtgtcaccagccaacctattgaacttattgcggcaggtctcgattaatgcggtcattgcctttgggatgaccttcgtaattctcactggcggaattgatctgtcagtcggctccattctggcattgtcaggtgcggtcaccgcttcaatgttgacaagcggatttgccgctccactggcactcacggtcgggctgatcttaggcgctgtgtttggactattgaatggcgtcttaatcgcttatgggaaggcagctccgtttatcgcaactttggccacgatgacgattttccgcggcgccacctatgttttcacaaatgggaatcccattaccggcgcgaaaatgaacaacagcttcttgttccagttcatgggccgcggctatctgttcggcattccgtttccgattatcatcatgattgtagtttatggcgtgctgtttgtgctcttgcataaaaccgctttcggccggaaaacttatgccttgggtggcaatgaaactgccgctcggattgccggggtgcgcaccaaggttgtgacgatgctgatttacacgatttccggcttaatggcagcaatcgcagggatcattctcacatcgcggctgagttcagcgcaaccggacgccggtacttcttatgaaatggacgccattgctgcggtcgtgcttggcgggacatcgctggctggtgggaaaggtcgcatttttgggacgttaatcggtgcgttgattattggtactttgaacaacgggatgaacttgctggggatttccagtttctatcagcaaattgtcaaaggcatcgtcatcctgatcgccgtgctacttgatcggcggtccggtaataatgggtaattcatcgcaggcgggtgcttgcgagttaaaacactttaagttggttgctggaactgagtcgtgcagagtcacgctcacattaacgcttttacaataggaggagagtcttcatgaaacacacattcaagcgcttcttaatggttgcagttatcgctgcagctgcgatttttaccttaactgcttgtggaaacacggggttggggtcaaagtctgacggtgatgcgaaagttaccaagaaagcgcctaaggatctgaaagtcggtgtgtcgctgtccacattgtcgaatccattctttgtttccgtgcgtaacggcattcaggatttggcgaagaaaaataaaactaatgttcaggtttccgatgcccaaaatgacactgctaaacaaaacaacaatattgaagatatgatccagaaaaaagtcgacattttgattatcaacccagtcgattccagtgcgattacgccagccgttaaagatgccaatgatgccggaatcccggttatcaccgttgatcgttccagtgatggcggcaaagtgttgacgctggttgcctccaactcgaaaaaaggtggggaaatggccgcgaagtatatgattgaaaagctcggtaagaacgccaagattgccgaactgcaaggaatcccgggcgcttccgcaactcgcgaacgtggaaaaggatttgatggcgcggcaaagggtcagcttgacattgtatcaaagcagacagccggttttgatcgggccaagggtttgacggttaccgagaacattttgcaaggtaacggtgatattgtcggtatcttttcacaaaacgatgaaatggcactaggcgcggtgcaggcagttaaagccgcgggtaagaagattactattgttggttttgacggtgaagcagatgggattaaagccgtcaaagcaggcgacatggctgcaactgttgcgcaaaagccagaagagatgggacgcttagcactgcaagcagcctatgatcattttgacggcaagacgattaagaagaatattgaatcgccgttgtcattagtcaccaccgaggatgcgaacaagtaagcttcatgctatgctggtcaagcaatgtcgcgcggtaaggtaaacaaaaaaggggccggatgcggtcccttttaaatggaaaaatggaggggtctttatgcctaatcatgttgtcgttattggcagtatcaatgtggatgctatcttgcacattcaacgactgccacagccgggggaaacaattcaaatggatgctttttctaaagctgccggtggtaagggggccaatcaagcggttgcggcggcgcgatctggcgctaagaccagtttcatcgggcgcgtcgggaatgatgccaacgctgctttcatgcgcggcgaattggtgaaaaatcaaattgatacccaatatgttgcaaccaccgcagacacggaaaccggacaggcatatattctgctccaagcatcgggccaaaactcgatcatcattcaacatggcgccaactttgaactgacgccagcggatgtgcagcgggcgactggcttgattcaatcggctgactttgtggttgctgaactggaaacgccggtagccgccacagccgaagcattcaaaatcgccaaagctgcggataaagtaaccatcttaaaccccgcaccggcgcaaaaagatctgccagaagcgctgctgaaaaatgttgatctaatcgcacctaacgagactgaaagcgaattgatcaccggcattccggttaccgatgaagccagcatgcgccagtccgccgcgtattatcatcaactcggcatccgcggggtggtcatcaccctcggctcgaaaggttctttcatttcgctaaatggtcaggcaaccctcgtcccggccttcaaggtcaaagccgtagataccacggcagcaggggatacctttatcggtgctttagtcagcaaccttcagcccgatctcggcaatattgtcgatgccgcaacttacgccagcatggccagctcgtttactgtccagaagctcggcgcattcccgtcgattccgatgggggatgaggtgcgtgcggggttggcaaaggttaaaatgggtcctgcgtaaggttaatcgtgtccgaagaagatcagttagactaaaatcgcgtcaacttctcagaaaatgggaggtcgacgcgatttttaaggttggcattagcggcctatcaattaaactatcgagacccttacttgcttgcctaaagcatttgcgattttggttagcgtttcgatgcttgtattgcttcctcgttcgatacgcgcaatcgttgtcttaggaacgcctgatttgtttgcaagttcctgttggctcaatcccgcattttgccttgcctctagaacagcataggcgcttgccagcttggctttttcagattcggctagcttcctgtagctggagtcttgcatcatctcggcgaagaaggcatccatatccgttgacgttgtttcagtaaatttctttatgttcttcaagattttttctctccctaactcggcatccgcgggctggtcatcacgcttggttcgaagggttccttcatttcggtgggtatagtagtgtttgtaacggttactgaatcacgtttaaaggtaaacacaaaccttctcctaatttctattagaacattgcgttttagtcagtcaatctgtttaaaaaaactgcaaaagaccttcttccaatttcgtaatgcaaaaatcataattacacaaataattccagcaaggaagccggaaagatgtgcaatttgtacaaatttttgcgcgtctgtcgcattctgtttcggcaatattcctaatataagagtaaagaatgccaccgttaaaatagccttcgtaattaaagaaaaatcaggtttctttattaaaaaagcaaacacggacattgggaacaaagcataaactgatatagacgcaccatagaacagacaaatgtatatgcttattcctaaggctgactgaatatacccgccaaacccaaagcagaaaataagggctccaatccaaccagaagtaaagaatccaatcacaagcgcgacacttccaattttccattctatgaaggggcctagaacaaccgttgggagaagattccacattaaatgattccattcaaagtgatatagcggaccagttattatataggaaaattcacctcttaaaactgaaggtatatttcccacaaagttggatgcaggaaccataaacgtattggttaaaattgaaaacaaaaagtagcaagaaactaatatacaacagatgacggaggtgcccttagctgctaaacctattgataaaagattcgatcttttcaagttctgtatcatggatatctaacctctttctttcgagtcggattcatgtctacaaatataagtattcaaaaaggcggacttgatctgttccgccttctttgttacctataggcctagttttgtttgatcataactctccaatcaaaaactagtttcttgcccaatgccggccagcattacggtattgatttgaagatccgtaatatggcgaaccatttgggcccggaaggtctgcaggagtaaaaatgtttctaccaataggcaaagcaccaccaccaccactgttgggtatgtgatcgccaccaattgtggtctgaagagtctcatctgagatcgtagtgatgctttcgaacttaatcatattaacgttattcatgttattcctccatgcttgcgacaatagtgacattacgatgttaaactcatgagtgtagcgttaatatatcgcaacaaagtcaagtggtcaagaaaaaatcaattttctgtagtaaaacgcttagtaagtattaaaaacacaataaattaacattatatataattgttttaggccaaaaaagaaaatataaacttttgacgatgccatatggattgctaggaaagtaaagcgtggtcatagacacacaaaaacccttatgtggaaaatcgagccatattggcttttagataaattgactgaacgggcaattcccaccaagatgttcttgaatatttgaattgttgtccttcgcttatgttctatatcaattagaagttaaaaaattctgtttgattggatggacgattggtaatttgtatttatgagtcatcccatagattggcgtttgttcatataacgtttggtttaaatctccacgatacggaatgatatttccgctcctggctttggtgagagaatttgaatctaactgtaagacattgtttaccagtttttcgagcattgaatgtcttcctttccgaaggtgattgtttacgggactcactaaattagaatgcacaacagtaaatggcacaaatcaattttccacaacactttaaggaaaaaataatcaaatacattagtaatgattaaactcattaaaaaccgtatgtaagtactgtacgcagtgatcactttgggtgtaattaatttgaacgccttgtcgatagttgaatacccagacattaatctttaacagatcaggatctttaatggattgagcgactacatttgtcccgcgtggcaacagttcatttcccatatatacagcgattacttgacatgctaagcgtcattgaggtgtttgggtttagattttgtatcgaggtacaaatgaggtcattattatgtggatcactaagcaacaacgaaaagatgcaatcgacgggttaacattcctttatcgggtcgcaacgcgtgatccagtggatgcgcaacgaaggattgaaagaattattcttagaaatgcaatcaaaccaagtagagagaatttgacatttgactccttgggttgatacgcggtgtggaacccggattaccttgtgagaaattattatcaacttctgtttgaaatttggcattatgcagaaaaagtcaaaaaaggtgaaacagaatgatgtgccagctgtccctattcggtgaggtagctctattatcaagaaaatccgtgttcttatttatagatcgcgctagccgggagaaaaaaatagccgcttcccggacaggggaggcggctattgtgttgttatactgatttccttaacctaaacgaactatatcacatttgatcgttttagtcatctttaaatttaaatattagcgaatattagcgagccggatttaaaattattgttgaaactagagctcttgaaagaaccgttgatgatgaaatgtaattttgttgaaacaaaaaagagaaaatcatttgcgaggaatttatgttgttacagaggcagacatgaccaaacccaactgccggctgtaactatgttgagtataggatagcgagttactaaccttgcttcgagtaaagttgacaggaattgttactagttaaaaaggtatgtgctatgaaatggcttagacttataagcattaaaagagtattgatatttggtgttattgctgccattggttgcaaagtaacagagctagcaacccacatagacccaaatgttgccagctatatttgggtgctaggtctctttattacctataaggttgcagacgacatctcaattaaagttactgcaggtaaaaaaggggttaaattatagttgcttgacagtttccgatggatgtaatcggaatgattaatatattgccgctcgcgcttaatcaagtgctgcataatctttaacaagtggccattaattaaactgaccaagaattgtccaagactggcaaccagacattaaggtcacctatatgaagcaccaactatcattcagcatatcccatctttcgaaaatagctttcaatgcttggcaacacctctggccgaagtggtggggcaatgaagtatagagatgttaagatccttttccaagcggacagtcgataataggcgcttaagtttgatggattctgatcatagtctgcccagcgttgttgatcagtttctgcgagaacacttgatatttgctttaactgaacttgggaactgcggctggcagtttgaatgattgtagcaagacgttcttcttcatcatcgaggaagggcgttttttgccggcttaaaatgttgggaataatcgctaaggcctgtttgatttgggcgggggttacttttgggtgtgcgattgcagcacttactaagtcactaccatgtgcaacggcatgtgcccagcctttttcaggaataaagccacgccagtcctgttccaaacgaaggtagttgacggcccaatttaaccacgtattccgttgcctggtcgttaaaaaaggttcacgagcatctgcgtccagaaagagagcgcctaataaagccgtgaatgtgcgcgtaaagactttatcactctgcggattatcgatgccatcaaataattgcgctctttgagttgccacatcggctaatagcttcctttgatcttttctaaaacccggtgtttggaagccacgcgcgaacaaactataaacaagttgatcgcgaatcttacttttggggtcaccaacatggtctagtagccaaatacattggttatccgtgaagtgcaatggatcttttgctaggctcagggtgacaagttcttggtacatgaaggtcatctccttttcgagggtgggtctttctcaacacgaactttcttgtcatgcaaaaaatgattaagcagggtgatggttcaaaaaatacgtcaatttcaccggaatatgtgagattggcgtatcttcgaaagtgaccattaatttagtacaaactagccacaaaaggcttcattgccgtcacgacatccccgctgccggtgccttcgatgagggcgacggtgaggtaggtattcttgtcggcatccatggcgactaagaaaccattttccttgccgtctgtgtcctgtttctgcttgagttcggccgtgccggttttggcggcgatggtgtggccgtcgatggcgaggtcatgggcggtaccggcttgatcggagacaacgtgggtcaaggcggttttgaccgttttggcggcattgctttggagcacgctggtacgttttccttttgcagcttgaatcaaggttggctgttgcatggtgccgtcattggcgatggcactgtacatcgccgcctgttcaattggcgatagtagcagttgcccttgaccataagcggtgtcggccaaaagcgtttcggaggcgagcttgccattgttggagatttgggcttttttcatggttaaaggtaagttggcttgcgttttgaaaagtggctccagacctttgaggtaagcagaggcgcccattttcagtgctacttgagcaaaccagatgttgtcggagttaaccaaggcctgggtcatgttttccgggccggcgtcaacggtgcgggttactttgtagtcgccccacgaactatctttttgccatttgagaccggagatagatttggttgtgtcaggggtgatggttttgttttgcagggcaatcgcagccgttagcattttaaaagtggaacccggtgcgtaccgttgggtgaaccggctgaggaatggtagctcggtgttgttggcgtatttgtcatagttggtttgactgatgccgttcacgaaggcattgggatcgtagctgggggaactcgctaaggttaaaagttcgccgttggttggatccatggtgaccacactgccgcttttgcctgctagttgggtataggcggttttttgcttggtggcgtcaatcgtcagtttcaggttcttaccggcaactgccttggtgtctagcagggggtggctgttgctgccgttgcgaattgcgatcgtgccgccatccgtaccgcgcaagtaatggtcataaatttgttccaaaccggctttaccgattttgctgttggcggtcagtgacggatgctttttaaggtcatcggcggttgccgtcccaacgtatcccacgagttgagcagcggcctcgcctagcggataagtacgtgagccgattgtttggtaagctgccccggttaatgcaggggaatcggtgacgattttgaccggtacaaacgtatcatcagtgacccaggactgcttgaggagcgtttcaagacttgaggttttcacatcccaggcagtcgcaatttttgctagattagcggtccgttcatcgccggagcccagcttgccaggaaccaggccggcttgggtgacattgccgttggtggcgagtgcctggccattacgatcgagaattttcccgcgcgtggcagctgtcaaactaatctgaaccgtgtccttgccatccatttgtggaaacagcaggcttggcgtccagcgaatgcgccagttgtcgccgactttaacgatcggcgcggtgtaatgctgtgccgggagcttgccgattttggtgttcatgttggcggtaaaagtgagttgataggtaccgtctttagaattggttgttttcagatccgtgattttaatgttgctagcgccgatccggtcgaaaacggcctgattgcgctcagccagagttttggcggtatactgccagcccggacctttgaggtggctagtgtcgacttgtttaacggctttttcatattgacggttggcaaaagctttcgtgtaggcttgagccgtggccttaacctggtcgccttcagccttgccttggtaccagcgaaaggcaccgaagccacccacaatgacgacaattgctgcgaccacactaatcaagatggtgcgcgtcgatttcttcatgtctgttccccatttctagtttttacgcttctccatgtataacgccattctacgcttctgggggaagggaagaaaccgggggaattttgcaatgattacagcctttgtagaattgctttagacgtactcaacgctaatcaaccacatcattccagcaacaacgaatacttcacaagataattctcgacgggcacgaggaagctgaagcgcattttttggttgcgatgctcataacttgtccgagttgctgagaattgtagggttaatggttggcgcacggctgaaggatgcatcgctggtttaaccctgactttgttgttatcgaaaatggtatcggtttggctgctcatgctataaggaatgttcaaccacatgttttcgatgtaattagggttgtcctttttatgaccataatttgccggtcctgtttgtttaatcgcgagggtcacaggaacgataacctgatctttctttttcaaaacctgaaccttactgaccctaaagtcgacattttcagcatgaacaagttggcctcttttaatcagcacctctttgatgacgcctcgttgctgcgggttggcattgacctgttgatagcgcagaaagccaataataccgaggaaaacaaccagacatccgctaatcatccagaacttgggattaactttcatgctggatcgtcccttccttgacagataacttatgagtcgcaacctgttcgacaaattcgtgattgtgcgaggcgatgacaaaagttgacccgttggcgttgaagcgttgaatcaggtcaatcaatttgataatactgtcatgatccaaagcgttggtgggctcgtccaggacaattaatggatagccgcctaagaacgcttcggcaatccccagcttttgcttcatgcccaacgaaaatttgcggactttttgggttggaaaccttgtgagctcaaaataggtcagcaggtcatcgagttgttgcggttggatagtgggatctagtcgtgccaacagttctagatttttcattgcggtgaagtcatcaatcaggctgggattttcgatcaaaatgccagccttaatcggataggcttcttgagggctgaccgtctttccggcaaccacgacttgacctgttactgtgataagaccgagtaatgcttttaaaattaatgtttttccggagccattaatgccttcaagtgtcgtaatgctgccacgctcaatgcttgcttcaacgtgatgcaagagctggcggcgtttaatcgttttggccacttgatgtaattcaattaaacccataagtttctcctttaatttaaactggcgtgacgctcaacggctaagtaacccatcgttgctaaactgctgacgccaagcagaacaagaatggggtgccaagcgtttgttgcgttgatccgtgtgagcatgaggtaaccaagcggattcatgcgaatagccgtataagcattaacgatgagcagacaggcagggatgatgagcgccaatgacggactaaaatgattaccgatcgcttggagtaataatagtaagaagacgcctagccaagtggtgacaaaaagaccgccgactgctgccaatccctgccaattaccgaaatgaagattaaaagcggcggcgatggccatgataccgatagcgccgacttcataaatggtggtgatcaaggcaataagcatgagattcacttcagcaaatttccgcggcgggatttgaagtcctctaagatgaatcgtgcgggtgtgccaaagttgttggaggccgttgagcagtattaacaaaggcacgaaaaaataagcaaaccataatacaggtaacacgacccgatgcgtttcagcagctctaaaactcaccccatcaaaaaacagtgagaaaatggtcgcatgcggattcccggcagtttgcatgcttagaagaataaccacagcattcattaagatgaaccaaaaaagaaagcgcgtgcgaatgaggtaccagaagaagggtaattagttgcaaaataaacgccagatcataagtccctcctgttgacgatggcggtcaataaagcagtcatgaaacaaaccagtcctagcatgatgatgccttttgccagcagtaatgggtttgaatcgcgggcggaaaagtcgaaaagcagcgaaggcaagtgagagatcacgaggaaaaacgatagcccgcaaatgccaaagctaacgaaaaaggccatgagcttgcttttggttgctagcacaatcgttgcggcaatcaatccgagcagaaagcaggccagccaaagataaacggcgtgaatcagtaagtatagccagatggtttccagaagataagcagcgccattgacggtgatcacggttatgttggtcaggctccaaatgccggccatcagtaaggttgagatgctgacgcggtaaaggatttgcagcgtgattatttttcgcgattgatataacaaaacatcttgtacccggggttgaatgcaaggcagtagactgagcaaataggttggcatgaggccgctaaagatgaggtagcgggggaagatgaggaccatgatttgttccggggaggaggtgagttcaccgattaagttaatcccagttaaactgatgatggcggtaatgaggccacagacgagataaacttttaaaaacgctggtgtcagtaagttctgttgccgaatgacattatggtacaagccgcttcacccctattcgggcaaaaaccaggcaataagtgagcaacgtcaaggtggcgaggccggtgaccggtaaactgatattggtattcggggccatctcgtgcaggaaatcggctggcgagaagctaactaagtccggcagcatgagtaaactgttaagcatcaaaatcgcaatctgcacaatcaatcctgtgctcaacgccacgaaaacatgcttaatccacaatgacgtcaccatgacaaagacggcgaaaagcccaccccaaaagctcgcaaataaaattgaaatcagtgcgtgtaacaacggattggcgtaatacaggcttacaaacagcgtattttgattcgtcaaaaggatgttgctgttcagcagattatccggacgaatatttggcagcatcatgaagtaaaacaacaagttaagcgccaaaacaagtgccacaagtataaaaccggtcaaaaaggctaatccaacataggatcggataactttttgaacgggaaaacacaatttaacttttgccaacaaaccggagtcggcgtcttcttttagcaatgacgctgcagggatgctggcaatgagcggcaataaaatgaaaaagatgatcggcgaaaagttgaatgggtcaattgacagccagcgcgtgtacggcgagtccattggcggaatcgggcctaagacttggatcatttgtagagcgctaatggcaaaagcgactgacatggcaagtaacagtcgttttcttggtaagcgtagccatagaaatgacaatagggaaacacctcgctttaaatgaaatagcacctagcagaaggtggagtgggcttcggctgggtgcggtgaagaatttggcgtggttctggaaacatcgaaactaaagatgatcagggattagaaaaatttttgatgcaggctatgatttggagcatactattgcttaaagttgtggtcaattaaattttatggttaccattagctgcaaactgaaaacgtgggctgggagtgctaagatattaagaatgaaatagactggattttaatattgaaatatatttaattcattgataagggaagtagatacagtcgtgttgagagcttataatcccttggttgtcagtcgattttttgatgggatcacagatagtcgttagtcattatgcatgttcggatgcaaggttaacgtggcttcaaaacgcaatagcctttcacagttgaaagttttttagcagcgaaattatggcgaaacatttttttagttttagcaggtggtcggggtgagtgaaccgaggatgatgagaagtcggagtaagacgctaaaagaaatgagcgtaaggaaaatcttaaaataattgcttgcgcacgcaaataaatgcgactatactatcagctggaggtgagtatgtgttcaaacgctggctgatactcatgacgctcgggctgtttttctttatggtgatcattgatggcaccattgttgtcgtggcggttccgacgattgcgcaggcattggcggtgcagcctagtcgggtgaatcttctgttgacggtgtatttgaccacgatcagcgtgtgtctgttgttttttggacagttagccgatcaagttggccgaacgcggctttttattcacgggacgtattggtttttgcttggctcggcggtggccggattaggggtgaatctccagttggttttggcggcccgcatcgttcaggcggtgggtgcgagtatgaccatggcaacgagttatgcaattgtcgccgatgtctttccgccggcgttgctgggacgggcgctgggagtcgagtcgatttttatttcgttaggcgcgctggctggcccggggattggcggcttgattttaagccatcttccgtggggctttattttcttgggtcaatttaccgattggcttggtgtgtgtggtgattgaatggctggtatttccgcgcgcatcacggtcacaggcaaaagtacaactggatattcgcggattcctgatacttctactgctggggggattgttggtgatactgcagatcaatcgcgagccgcttgtggcaggcgttttgctggcgttgatggttgtcggcggcttgggattttggcaagttgagcgccatgcagcccacgcattattggatgtgcagctgtttcggcagtctagcttcagtcgtaatttaggggcgtcattgctgaattacgtcggggcgtattttttcacgttactggcgccgatttacttgcaagtgctgctcggcttgccggttgcgctggcggggatgctgttgatgttaccgccgctggtttcgctcgttgccaatccgctggcaggtattttaagcgatcgcgttgaccaagggcggtcaatgcgagtgggcctgggattgctggtgctcagtaatttgacgtttgccttggtacccagcggacaacggctgtggccatttgtactggtcgccatgaccttcgctgtcggaaccgcgttatttaccaatcccaacagcgtcatgctgattcaaagcgttgatgccaaaatgcgcgggcaggtgggtgcggcgacttcactggcacggcagttagggatgagcatcggcagcgccttttcgagcttggtgttttatcaagttttggcaatgatgacgcccgcccgtaaccttgccaaaaccgcaccagcagcgctattgaccgcacagcgagtgagtttccttgttgccgcaagcctctttttacttgccgcgatcatgttaagaaagaaggatggaaaatggactcagaaccagatgaactgatttcgcgggtgaacattctggcccgccagattcaacacgacttggatttgcggctggctccaaccggactcaatgccagcaactattactttattttgaagttaggcagcgttgaggacatgcggcaggatacccttttcaaaaagattcatcttaacgccagcaacgtgaccagacgcttggcacaactgatcgcgctaggtttggtcaccaaggaaaaggcgatggatgacaagcgtgcctgggtgatcagtttaacggcggaggggcgagcgttggttccgcgcgtcagccaaattgtcgccgagtatgaagcagaactaaccgcgaaactggcggctgcggacaaggttaagtttgaacaaatacttgatgtgctcaataaaacgaaagaggatgcgaatcgatgaaaaacgtgatggcgattttagggattccggcagattatcacgtggtccagacaacttcgcgaaccagaaacggtgaaccggtgacagtcgagcgcttgcagacctccgctgatatcacgccaaataacgcgcacataacgctggtccggaatgaagcgggaaccgtgatcagtttcaacgacagtacttttaaagctggcggaaaactgcctgctgctgaacgtgcgcgtcaccaagcaagccaactgttccagcagctggattcgacatacgccgccaacctgacctacatgcgcactgaacgccaagagcgccactacttcgatcatggcgaacgtatcagcacgccggtttactggatcaagtttgctcaccgcaacggttcgtacaactgggtgacgatcgggccggataatcgtgttattgaggtagagcgcgagtcgtactgggattacttcaggaaccgccgcgccacggagatgtggaattatgatgattgggtgctggcgtatgaaggtaaaggcccacagatggcagcgccgaatgcattggcgtgagtgttgtggaaaagggcagcctgctggtgagagagtgaaatacccttgatgaagtgagaaaagcagaaaagcagccttttggtgaaggaaaacacttttgaagtggtgaggaaaagcagaaaggcagccttttggtaagataacgtcttgatgcgaagtcagagacagaaagaggcgatccagtggcaaaaccggattttgaaactttagtcgcgcggcttggtgacttacgggaagcggcgcgccggttggcagacgaggattatatcagcgcgcggtataagggttatagttcagaagggctcacgctggaggaagtgctggcgaagttggagacaacggagcatgagattgctaagttagagcgggcgttggagcagttggcggatgaggagtgagcttgtgaagcgcaagcgaaaatgatgcctatgatagcaaaaattgagcagcttgattccgttccttctttcaataccttgaatcgttatgcagcagggctagggcttaagttgaagatttctataactgcttaaaaaatacaaacagcgatgcgattgacccgtgtggataaggagggtcaattgcatcgctgtttttatgatgtggcaggttattaatgaaatgtgtattggactgtcgggcaatgatgctaatctttgtctcaataaagatcctggcgaaaagacctgcagactttttaaatttgcgctgatattttccaaatcaaggagatatcagcgctttttactagcaactgaactgcttcggattataaaacggggaagaggggcaatgacccattcattgccgttatgagcgtttcatcatgcgcaatactgatcaaggtgcaattcgtttcccaagtgaaggaaaaaggttctacttttcggaatgtaagcgcttgcttagtatagaaaatgtaaggaggcaaagcaatgcgagaaagattgacgaatcttctacggacattgttggacagttcggaaatacctctgaatgagttggcagtacagtttgatgtcacgattaaaaccattcgtaatgagattcaggtgctaaatgatttacttgctgaaaaacagctgcccttattcacgatcaaaagaggtgtcgcctacaatcatatttcaaaagcccaacaccaatcgttagctgacctgcttgacttcaacagtgtcagtcaaggtgcattaacccctgaacaacgaaacgtctacttgttactcgatttactgcaagcgacgaaaccactgtatttggtggacgaacaagctgccatgcaggttagcaaaagtacgatggatgctgatttgcggcggttacgcgctgacttagctaagtacaatttggcgttaacaacacatcccaaattaggcgcacagcttgaaggtaacgagcgctccattcgcacgatgtttggagatgtcttaacccggcaacatgctttggccaccttggtttcgcaacaactgatcgcaagtggtatgtacatcaacaaaatgaaagaagtctttacggagaaggatgttgcctatatccacgctttattactgaaatgctttcctaatggcgctttggccgcaaacgatatgtacagccagcaagtaacagttttgctcatcatctggctgcatcgcgtttcaaatggccattacctcaaggacgatgagggtgaagttgatttaaataaagcaaccaccaaatttcttaacgctttaattcagcactatgatttgaagcttgatgttgcaagtgaatttgcctatgtcagcttcttgatcagcagttttaaccggcgtggtgccattgatcttgacgattgggtcaaagcccagattttcagcgtggcgttgattgatcatatggaaacagaaatcggttttccattttccaaaaatgaaaaactgttcgaagagctatataaccacatgaccgcgctgttcaagcgggtgtctaggcatgtgaaggctgtcaatccattgaaacgcaccattcaacaaggctatgcaccaatttatcacgcggttgatcgtttctttgaaaacacccgctaccacttgccgatgtctgatgatgaaaaggcatttctggccatgtacttttccgctactcaagctgaagagcggcaacgtcaagactacaagtatcaagccgccgttgtttgtaactttgggaccgccaccggcagagtacttgctgccaagttagaggagcgttttaacatcgatgttttggcggttctgagcacatcggaaatcagcgttttacgcaagctgcccgtgaccgttgtttttaaaaccgtggacatgccgattgaaaagattccgagccttaaagtgagcccgattccttcagaggctgacttaaagcacgttgcggattttcttaaccaacatgcaacattgaccaagtatgaaggccggacttttgatcccacacgattgttccagtccattctggatgtcttaaagcagcatcaagtcactgtcaataaaggactgcttgcggcattgcaagcagccttcagcgaaaaccatgtcgaaattaacgaaagggaggttcagccgatgttgaaagatttagtcaatgatcagcagattcagcttcaacagacagctgacgattgggaagatgccatccgtgtttctgccaaaccattgctggatgaaggcgatattaccgagcattacgttcaggcaatgatcgattcggttaaacagttcggtccgtacattgtcatcggaccatccattgcattagcacacgcacggcctgaagacggcaccaagaaactggcggtcaccattacaacgttagccacgccgatcaattttggtaatccggataatgaccctgtgaaaatcatcttctgccttgctgcgattgataattattcgcacctaaacgtgatgaaggccattgttcaactgattaatgatcagcaaaaagtggatcaactggctaagcaaactgatttgcagacttttaaacagattctattcaatgaaaagacctcaaaggagacgatttaagtgagtaagaagctcacgatttattttatctgtggcgctgggctgggttcatcgctggcttgccaaatgacggcggaggatgttttaaaccgcctgggattagaggagaaccttgaacacgaggcgatttcttccacaccgggtttgcgtgccgacatcattgtttccgctgaaaattttgccccacagtttaagcaatacgaccttgatccggccattaagtttgtattcttgcataacattgtcgatcccgctgaaattgaagccaaacttgtgcccgtcatcaaatcattgtcagaacagtcggtgtgagtcccaatccgcatatgaaggagggaaagaatcatggttgtggttaactttattatccaaaatatcctgacgcaggccgccatcaccattgcgctcattgcgatgttggggttgctgctacaacgtaaatcgtttggggcggtattaaccggaacatttaagacgctgttgggattccaggtgctatcagcaggatctgccattattgtcaccgcactcacgtattttggaaaaatttttcagcatggctttcatttaaaaggtgtcgttccaagcattgaggcaattaacggccaagcgatgaacacgctgggactgggaaatgaaattgcgctgacgtttttaggaatcttcatcgtcaacattatcattgcccgcgtgtcgccatggaagtacatcttcttaacgggtcaggcacttttatggatgtcgacaatgacagtagtcggtgggaagatggccggattgaatgccgtgatgaccattattgtcggcagtgttatcggcgggatctttgcagttgcgatgcccgcgatcgcccaaccgttcgttcgcaagattaccaaaggcgatgcgattgcgcttgggcacttctgtacggtcggttacatggtagaagccggagcagcatggcttttcggtgaacgcggcgaaaagaagcactcaattgaagacatcaaactaccgaagtacatggagttcttgcaagacacttatctctcggttgcggtggtaatggttccgctattcatgattacagcggcgtttgcaggacctaagtatgccggtaacggaacaagcctgaactatatcatgaatgcatttatgatgggtatccaatttgttgtcggagtttacgttttactagccggcgtgcggttgttattgggtgagattgtgccagccttccgcggaattgcgatgaagttggtgccaaatgccaagccagcgctggattgcccggtactattcccgttttcacctaatgctgtgattctaggcttcatcaccaccacaattggaacggttattgggatgttcctgatgccagtgtttggtctcgccgttatcttgccagggatgttaaccaatttctttgctggtggcacggccggaattttcggcaatgtggttggcggtcgtcgcggggctatcatcggcggcgtcattcatggacttttcatcaccttgctgccagccttgctagtcactgcactcaccgcattcggttttgtcaatgcgtcagcgactgactctgataccatcgttgcgatgttgatgtatgcatggattctaacgccaattctcaaggcagtctgaagaaaggagcagcgcgatgttcggtaatctttttaaaaagaaagaaccaaagcaggcgattagcgaggcgccaaaagaagcctcagcaaacgccagtgcaattgacgaagcaaacttgaaagaacaagcggcggcattaacccatcaaattgaacagacagctgaggacaaggaaaagcgccacttactgtataaccaattaggcgcagtcgaagcacagctaggtcatgatttagcggcaattgcagcatatgaagagagtctcaaagataaagaagaattcggcgatgcctataatgctttgttgaatttgtacgagactcagcgaaaagccgcggccaaagctaaaaatgatgacgatattcagaaatgggttaataaaaccgacgccttactcgatatgtcaaaacgcgtgatgcgatccggttttggttattaatttgctaggaggcaattaagtatgtataagaacttaaaacaattgatggatgaagcccaagcacttgattatacagtcggtgcctttaacgctcacaaccttgaaatggtcccgccaatgatcaccgcggctaaagatgccgggtcaccgattattattcaaaccagtgttgctacggcagaatatgtcgggatgaaaaacttcgtggccgtctgcaagtcgatggccgaggatctgttggttgatgtcgacttgcatcttgaccatgccaaatcatttgatgcgatcaaagaagcaatcgacgccggctattcgtcagtgatgtttgacggatcagcccttccatttaaagaaaacatggaacgggcgcgacgagttgccgattatgcccatgaacatggcgtctcactcgaatgcgaaatcgggacgatcggtggcaccgaagaaggcgtgacggttaaggaaggacgctacacagacccccaacaagcgcttgaattcttggaacatgttgatgttgaagcattggctgtcggcgtgggcacacaccacggccagttcaagtcaaagacgaaattgaattggccattaattgaagaactccatcaggtcatcagcaagcccatggtcattcatggtggcaccggcgttaatgaagacgactaccatcgtttgaccgaaaatggcttccgcaagttcaacgttggtacggaattactcgttggctggacgcggaaggccaaaaaaatgtttggccagacagaagtgaacacatcattacgtaacaacattgttccttgtaatgatgtcgtctacgatattgtcaaacacaagatcagcctattcttgaacaaagaagcagccgtaccggtcaaggcttaagctggagatgagggatggatgacaactgagcagcaacacgtattagtcctgctggctggtgcaccgggaacaggcaagacttacaccgccgccaaaatcatgcaggcaattcacggctttgtctctttaccactcgacttgtttaaggaacatctttatgatgagctgggtttcgataaccttcgcgaaaagcagatgcttgatgccgaagccagagcgcgttactatcgcggtattgatattttgatggcggaaggcaagatgattttgggggactatccgtttagtcgactacaaaaagaaaacatagaacaattggcgaccaagcatcactatcacgtcatcaccgtgcgcttggaagcagcgatcaacatcttgtacgagcgccaacgtcaccgcgacttaaccgatccgcgccatctcggtcacctaatgaaccattaccatcgcggagataccttggacaatatttcggaacaacccgacggcatgccatcgtttgagacgtttgctatgcgcgtaaaagacagaggttaccaggattttcaaattggccagttgattcgcgtagatgtcaatgattacacgaaaatcgattatcaaaagttgttggagaagcttaagcaagccttgaaagtggaagttgaaagttagaacttcgccgtgattttgaccgcgtggcgtagtaatggatgaccgttttaccaattagttttggtaaggggtcatctttttgttttatggatctggaacgcgaatggttaatcattcgttttgagctttgtggatcaacttattgcgacaagactgggtagaagcagtactggaagttgttgtgaccaagaaagttttgtgagtagtttctgaaggggatgaaggtacttcggttgcgttttgatagctgtgggtgcttggcttgcgacacgttagattgtaggtagatgggaaacgcttattcttgaatgctataagaatgggcgttttttcgatgcatacagttaaatgtgattattaatatcgtaataaggtcgaaaaattatccatacgttttaaaacaacgttgtatttaatgatacaacgttgtataatttaagcaacattgaaagcgcatacaaggagggctttaatctatgatcacttcagcacctgcaccaactattatcagcactgaccccggtattgacgacgcggttgccattgccattgcgctcggtagcccattgatggatgttcaactaatttgtccgattgccgggaatgtcagtgttgagaagacgacacttaatacccgtctgttgttgacttttcttaatcagtcacctcggattgttcaaggaagtcgcaagcctttattgagaccgctcaaagatgctagtggggttcatggtaaaaccggtatggatggatatccttttccagaacccaatgtgccggtggataccgtgacttctgctgccgttgcgatgcacgaaacggtgatggctaacagtcaaccagtgactttaatcgggattggaccgttaactgatattgcacttttcattcatcaatatccggatgatttgaagaaaatcaagcagctggtgttaatgggaggcgcgctaggaagaggcaattttggcgtgttatctgagtttaactttggcaccgatccggaggcagcaaaaatcgtcttcaatagcggcttgccgattcgggttgcaccgatggaagtagggagacaagcaaaaatcttgccggcaacctcggaaaagatcaagcatttgggaaaagttggtgatatgttctatgcacttttttcaaaatatcgtggtggaagtttcaagactggcctaaatatgtacgatgcacttgctatggcaatgattctagcaccaacgtgttttacagaagtgcaaacccatgttgcgattgaaacacgtggtgaattaacggccggtgcttcgctgattgatctgaaaggatatttgggtaaagaacccaatgccagtgtcgccgttgatgtagattcgaaacgttttgaaagttggtttgtcgaggctattggtaaaacggctaatttttaggaggagagacgatgaacgctattttgatctcagtggtaggcatcattgccgtagccatcttgatttatatgttgcttaagaaaaacgacattaaaatgacgctattgggtttaggcattgtcttaatgtatatcgccattctagttggcaacaagatcaaagtttctacgccaaccggtactgccttgcttgatccgtttcaagctgttgtcgatcaattctcgaatacacttgttggaccgggatttgtcatcttgattcttggcggatatagcgcctatatgagtcatatcggtgcaaatcaggttactgttcatgctttaactaaaccaattgccaagatacgctcggtttatattctgattccgatcgtctttctcattggtaatctactctctttggtcattcctagtgcctcgaatcttgctatcatcttgctggcaacgttatatccggtcttgcgcgctgctggaatgagtcgattatctgcagctgcagttatcggaacttcggcaacgattgttccgacaccattaggatcggataatgttgccatcgccgcacaactgcacatgaccgtgacggactatgtttttaagagccatgcgctagtctcgataccgactcttcttgccatcgccatcgttcattatttgtggcaaaaacacgaagataagcgccagccagaaacgctcacttatgctgatgaattgacgcaaaatagcgatggaaaagcaggcgaagcggtggaagacgttacgcatcatggctttatggcctttatttatggcttgttaccgctacttccaattgttttgctgttagtcattttctttctcaacctcgtcattggcaccaagttaaacatgagtgttcaaatggtaaccttgattagctttgttgttgcggtctttgtcgaactattggccaaaagaaaagcccaagccgtgttgaaagaaaccggtacgtttttcactggtatgggcgatgtgatgagcatcgtggcattgttggtcgcagcgcaaacatttgtacaagggctcacctcactgggcatcatcaacttaattcaaaacgccatgcaaaatatgagcggttccggaattatcctaccaattatcatggtacttttcacagccgttatcgttctgttgagcggcagcggaacggcattagtctttgcaatgattccgctcatcatcccactttcaaaagcagctggcattgatccggtagctttatccatacctatgcaactggcaggcaacctgttgcgcgctgtttctccggttgctgccgttgtcttgattgtagccggcaccacaaaactatcgccaattcagattgttaagcggacctctgtacccatgatttttggggttgtgatgatgttggttatgtcactgatactcttttaagcgagggcctgagcaatgatcgagacccgacgaatctccagaaaacttgctactgtcaaagatctaccacatcttgaaagaatgcttgatcatgccaaacaacagatgtgttcagaaggtatcactcagtggactgaaacgtatcctaatcacgaggacatctaccgggacattctgaaacgccagctttggttatttggtgatgacgtaaaagcaatggcggtgattgaagagaatttaaacttctggaatattaaacggctagtcgttgattcggcgttttccgggaaggggattgctagcttggtaatagatgaaattaaacaattgatggtcgttcatcatgtggctgaagcacgcctttgcacaaaccataccaatcaccgaatgattcggttagccaaccatcaagggttcctacttcatcattattatcatgcacaagatcgagaaaactttggagcctttatcgaatttaggtaccgcagattttccaatgcggattcatgttaaaatgaagcgctatataaattattgaaagatggagaatcggcatgcatcgttcaccaaaatacgttcaagtttataaccaaattctaaagatgattaaacaaggccaactcgcacccggcgcaaaactaccatctgaagaagtgctgacaacagaatttgaggtcagtcgagttaccttaagaaccgctttatcactccttaaagaagatggatttatccggagcattcatggccaaggacactttgtcgaggcgagtgaaagtcagaaaaaaagtggcattgaagctctaggtaacccaatgcttaaaagtctcgttctgcccatagaaagcagggaaacctactttcatgaaaaccaggccagtgaatttacggatcgactattcgatcgtcaaaacgccccatacgatacgttaaacatctggtatcaaaataaaggcgaaaatattggaaatacactcgccattgttttacccacaacaattcaaatgtttggcgtagacttgagtgacagcgcggctattatcaactttcttgaggaaaccatctaccaaaaagcctcgagttcaaacgtgctcattactctgtcagatcgccaacaaaagacatttcggcggacgtttggtgacacgagcccacttattttgatgacagaggatatttttggatttaacggtgaacggctcttacaaaacaagcattacattcctgcaaacctgtatcgggcaaatgtgatgcggtatcagaatgatttgcagaatcagattggggctgtggagtaagcgagatactgatactctaattaaaacggcttgtttaaatttatttttgaaagcgcttgactgactctaaatgacatgctactatacagtcgtaatctaaatatacggtaaatttgggcactagaagaaagacgtccgatcacacttggataataagtagtgattgggcgtctttttgtgttcttttttatcaaaaaggagagatttgttatgagtaaagcacgtcggttagcacaaatttggggttcagatgggaatgcgattattgcagccttagatggttttggattttcaatgaatacacagggtgtcgactatacaacagaacaccttgataaattaattgctaatggattggatgcggctttagtcacatacggacaggcaaagacgtatgaaaaggaactagcaaagatcaccacaattctgcgagtagatgcctctattaatgcttatgatagctctgttccagtgactgatcagttctttgatgttaaagatgcactaaaactcggagcacagggagttgtttgcatgacatttcctggcgcaggttcacgcgaacaattttctcaccagatgttagccaaactagctaagcagagcgaggattggggtgttccagtgatcgctgaaacgttgccgtttggctatcctgttacaactaaagagtcaaatgatccaaagtatattgcggctgcagcacgtttaggcgcggagttcggtgctgacatcattaaaactcgtctgagtggagaagatacagataaagaaatcattgaaaatgctagtcgccctgtcctagctcttggtgggcctaaaacagatacattaacttatttcaagtttgttaaacattgcatggagtcaggtgctcatggtgtggctgttggtcgtaatattacccaagataagaatccggctggtatggttgcaggcttaaacgtactggttcataagggtggaacacctgaagaagctttgagtgtatacaacgaaacaaaataagtagtgtagaaaaactgtctccaaaaattgaaaacaaaatacttgaaaggatgattcatatgcctaaatcgattgttattccatcctccctcaatggcaaataccttagagaagcttgcgaggccaaatcagaaatcgtcttattgtctggtgtgaatattggtaatctgggttcctttgttgagtatatccatgcacatcacaagaaagcttacattcacattgacatcacaggcggattcagaccagacgaggttggaattcagttgttaaagaatatgtttcatctagatggcgttatttcaactaatatgcacgcattaacacgtgcacgggcgattaaattagaaacaatataccggctgtttttgttcgattcaagatcgctggaacgggcagctggagcaatgagtgatgggcagttttctgcaatagagattttaccgagtggctatgctctgtcggaatacgacaagatcagaaaatatgcgggggatacgaaattaattgcaggagggtttatacggtcagaaaagaatatttccgacatttttgctgcaggattttggggcgttacgacaagcgatcgtcaactttggcagtatggggtgaatcgtagttaaatatctacccatacatgagggggatagacaagtatgtcaaaaaaatatttgatgggtatcgataatggtggaacgagtacaaaagctgccatttatgatatggatggtcatgagctagaaaagactactgttaatacaaaaatgttgactccgcatccgttctttacagagcgtgatatgaacgaactttggaaagctaatatctatgttataaaacaaacactcgaaaagtcgcacattgatcctagaaatatatcgggaatagcatgtactggacatggaaacggcctgtatctggttgatgataaaggaaatgctgttcgtaatggcattatttctaccgatgatcgggccgccgcttatgtgaaaaagtggctagcggatccttactatgaaaacgagattcgtcccaagacttatcaaacagtttggtcttcacagccagtcgcgcttttggcctggttgcaagataacgaacctgaagtatttgaacgaaccaaatacatcttcatgattccggacctcattcggttttggttaacgggcgatgcacattttgagattactaatgcatctggaacaagcatgttaaatatcaatacgaaaaagtttgatcaggatttgttcaagttctttgggattgaacgatggatggctaagctgccaccgctagcaaactctaccgatcattgcggtagtatatcaagaaaaatcgcaagtgaaacaggtcttgtcgagggaactccgtgttcgggtggggtattcgatattgcggcttccgcgttgtcaacaggattggtgcaccgtcacaaacttggaattgtaaccggaacttggtcaatcaacgagtacattacgaacaagcctaaagttgtcaaagacttatttatgacttcaatttatccgatagcagatcgttggttgattacggaagccagtcccacatcagctagtaacttagaatggttcatcaatactttcatgaataaggagaagagggctgcagaggatgcgggattttcaatatacgagtattgcaacaagcttgttgcaagcacaaaaccacaggatagtgatttactatttttcccctttatctttggtggtaatgcggtaccgaatgctagtgctggttttgtgggagctacaaaatatcacgatcttaaatattttgttcgtgcagtttatgagggcgttgtcttttcgcatatgtatcacattgaaaagttacgaagaattgatgggcatttagacggtgctgctcgtattgctggcgggatcaccaactctcaagtttggttgcagatttttgcaaatgtcttaaagcagcctttagaacttgttaacgtgaaagaaaatggaactcttgggactgctatgacagcgggggtcatgacaggagactttaagagcgttgaggatgcggcaaaccacatggtgcatattagccgaacaattcttcctcaacccgagtttgaagatgtttatcaaaagaaatatgaatgttataagaaagcattgacaaacatggaacctgtttggaatggactacagacggtttgaattatctcgtatgaagatatggaggttttaataatggatttaggtattaaagggaagaacgccattattacaggaggagcaactggactgggtcagcaatttgttctcggattagcaaaagaaggcgctaatgttgcttttacgtacatgagtgaaaaagagaagccagagcagacggttgaaaaggtgcatgcaattaatccaagtttgaaagcggtacctgttttaacaaatctggccgacgaaacacagattgttaatttcttcgatacagcacttcaaaggcttggcagcgttgatattgtcgtgaacaatgcgggtatttggctttcaggaaaagtggtggacattcctgctaaagattgggacttgacgatgaaagtcaaccttcgagctccgttcttactatgccagcaatttgttcgatatgctctgaagacgaagcggagaggtcatattgtcaatgtgacatcacaagcggcttattatggatcaacaactggacatgctcactatgcggcaagtaaagctggattaattgctttttcaatttcattagctcgtgaagtcgcaaaaaatggaattaatatcaataatatcgcagtcggagtgatgcatacgcgaatgattcaagccaatcttgataaagatcctaattactatgtaaaccgtattccaatgggacgtgtcgcggaaccatccgaaatcgcagagctaggaatctttcttgcatctgagccagccagttatatgactggggcaactgttgatgttaccggtggtatgttaatgcattaataaatggggagatagataaaatgaaggcaatcgcatttggtgataatttaattgatgtttccatgttaaaagttggtcttactactctggaaaatgcggggattgatgtgacaatccgagattggtctcacgaatccactgctgcacttcaagcagacaatctgaaggttgagcagcatggcccggaagcagtaaacgttgacgattcgcttttgaaagatattgatcagtttgatttgatcattacacaatttatgccaatcggtaaaaagattatcgatcgtgcaaaaaacctcaaatatatcggagttttacgtggtggtattgagaatgttgatgcggaatatgctaaatcgaaaggcattaaagttatgaacacggctggccgcaatgcacgtgctgtagccgaatttacggtaggcatgattcttgcggagacacgtaacattgcgcgaactcacgccgcaatggaaaaagatatttggttaaaagactttcctaataaagattacattcctgaattgggaggtaaaactatcggtattgctggttttgggcacattggccagttggttgggcagttcttgaaaggctttgacgcaaatgtcatcttttacgacaaatatgttgatgaacagaaaggatttacaaaaattgattctttagatgaattgattaagcggtcagatgtgttaacaattcacatgcgggttactcctgaaacagatcacattattaatgcaaagcgcatcgccgagttaaaacctaccgcttactttattaatacagcccgcgctgagttggtagatgaagatgccctgctgaccgctcttgagcagggaaagataagcggtgctgcagttgatacattcaacaacgagccattgcctccagacagccgctttttgaagctaaagaatattactttgacttcacatttagcaggaagtactgctgacgcttttcgtaatacgcctaaactctttgctgagagatttatggcgtcattgcaagagtagcttgtcactaaagaagggctgggtgaagcataatgcaaataattcaggcaatcgttaatttgggtgccgcagttatgatgccgattatcttcttcgttgttggggtagtgttcaggctctctataggaaagtcatttaaggccggcatgttggtcggtattggattcacaggagttagtatggtaattaatcttttactaaccaatcttggacctgcttcaaaagcaatggttgcgcggatgggattgcatcttaccgttgtcgatacaggttggccgactgcttcaactatcggatggggaacaccaattatgccgattatcgttattgggttcctggtaattaatgcggtaatgctagtattaaatctgaccaagacggttgatattgatatctttaactactggatctttcttctgcttgctgccgttgtatatgccgcttcgcatagcttttgggtcgcggcattgacaacatggattatctttgctctgacactgatagtcgcagatttgacagcaccgtggatagagcgacagtataagtcattaaatttaaaaggaatttcatttcctcacctaacatgccttgcttgggtaccatttggcatagcaaccaactgggtgattgaacgcatccccggtctcaagaagatagacatgcaacctgagaagatccagaagcgttttggggtctttggtgagccattaactttaggctttattcttgggatagcgatagcgctaatggcggggtatgatatctctaagaccctgactttggctattaatgttgcagccgctatggttctattaccaaagatgattgacatcttagttgagggtttgaccatggttcgtgatcatgttgaaaaacagctaaaaaagtggtttcccaaacggtccttctatattggaatggatactgcgttgcttatcggtgagccatctgtacttgcaacaggtttgattctcattccgatcgcaattatcttggcctttattttgccgggcaataaaatgttaccatttgtggatctagcatcgttaatgttcttgctggcactggtaaccccatttgttaaacggaacatgttccggatggtaatcgcggggacattaattttaatttgtatcctttacgttggaaccagcattgcacccgaatatactcaatctgcaatttcctcaaagattccgatgggtaagggaataaccagtatgtccaatattgttggatctgcaaccacctggatcggatgggtttgtgtcaaaataggatcgttgttttaaagtggaatagttgaatgcgttggtttatcagattaacgaagtgcttaaaaaggagccgaggggaatgccaccttgactcctttttcagtcctcagtgcttagttaagtagacatgcgtaggctgtattgtatgatactgaccttaaaaaactctacttccgggcccggaaaaatatatactaatgtaagcgctaactaacgtgtcatactggaattgtcaggagggcaattgggattgacctgtagaagaggaggcaattatgaacgagaagattaaacagttgcttgacatcttattacagcaaaaagattaccttactgccttgcaactatctgaaatgttgggggttacagagaggagtattcggaactatgtgagaactttaaacagtagtgagacacaagggcctctgattatttcctctaacaaggggtaccggatacaaagagacttgtataacgaaagtatagaaaatcggttattcgctgaggatgatgcagaattgctctttagaattgcttttattctagtgagccatgtttctttcattacgttcgatgaccttgcaatgcaattaaattattctgtcgaaagtattcgcagtaaggttcaggtgctgttctccaaaattcatgatatgaaccttaacgttgcgttggagtcgcgaatctttacaggtattcggattttaggggcagaaaatcaaaaacgattgcttttagaacaactaataccaattggaaaaattgttaagggagatttaaccgattctacttttaaattgttaaatggggtgtgtgataagcaaacgattgagaaagaaattgttagtatagacacggttttctctcagcaccatacaacaatggatttcattgtatacgcgaagattatctgtcacatggtcattgcgataagccgttacagagaaaatcatccgatcaatagttcagaagttaaagatagcaacaaggaccatcctgaatttcaattggcttcttctttattagcaagagccccaacagcaataagtaacaaagctgaaataatggcgcttaccaactatctgattgccatgccattaaataccccaggttcgttcgtgccaaatatgaatgtgctacagcgtggtcaattggaaagttcactgaaaagagcagaaagctattacggcattccgctatattctaatgaaagttatcggaaccaaatcataaatcatattatgagacttctagatccaatcgaagaaagtataccggtatttaatccatattctcaaaaaacaaagagagaatatctgtttgcctattcgattgcttgttttctttacgatgagctgcaaaacgattttgatatacaagcacctgaatcggagatagcctatctcgcaattcatattcaacttgtcttaactgaggagaccaagagcacaattcggacagaattagttttccaaggcaagaaggcagaaggagaattgtttcgatataagatccagacatattttccaaggatagatattggggtagtcacaacggcaatggatttagctgatatatcgaagtatcaattgatcataagatgtgggtttcaagagtcggatgaccaggtaaacgataagataatagaaattagcaaagcattgaacactaatgatatagccagaattcaaaattttattgagacagttggtacgatgtctctgattcagaagcttgactatcatcatatgaatgagtcttcgagtatggatgcgatagcatatttattgaaaaaatcagggtactttaaccttttcccgtattttaaaaagagggaatcaatgtcatctactgatattggacatcttgtagctatgcctcacccctttttaaagggttcggagacagctgccaaagtcatcgtaggaattaataagacagcaatttcttggggacgccaaaaggttagattggttgtgatatacattcccgcggctgatcttaaaacaaacaaaaacttttttaatgatgtttatgaacacaccaataacttggctgaagttcatgccttattagagactaagacaaagcgagagttcatcgaggtttggaatagaaaaggagattattcgaatgctttataacatggttgatttactaagtgttgcatataaaaataattttgctgttggatcttataatgtcgccaatagtgaattcgtagaagcgattattcacgcggcggaagctaaaaatgcgccagctattattcagattcaccccaacgaaatcaatttggtaggtgacaatttcactgcgtatgttagacaagcagttgatcgaactcgtgtaccaatggccattcatgtggaccatggtgcaacgttgggagattgcgtacgcggcattcataacgggtatacgtcagtcatgattgatgcatcggcaaagtcttgggatgacaatgtagcactcactaaacaagttgtagatgtggcccatagtgtaggtgtttctgtcgaagcggagctagggacaatcgggtctaacgaactttcgacagaagggaccggggtcaacaagattctctacaccgatccagaggatgcaaagaaatttgtgagtttgactggcgttgacacgcttgctgtagctattggtacgcggcacgggcattacagtcatgttgaaaaacctgaactgcgaattgatttgcttgagaagattcatgaggcagttgacattccattagtcttacacggaggctctgataataaagatgaggagattaagaagacgtatcttcatggtgtggctaagatcaacctgtcaacggacatgaaaactgcattcttttcgcaattacgcaagaatttggatgaaaatcctggtgcttatgaacccgatcagctgatgccatcagccagaaaggcggctcaagaggtagtcgaatacaaaatggatctctttaattctactggtaaagctgaattgtactagagataaccatcgagatttccaattgtggaggtgaacaagatgcgtattgatgaactaattgatatcaaaaatattgacactagcattgaaccgatgacaaaagatcaagtcattgaccggatgatcagtaaactaagccagaatggttatgtccaagatgcagacgtattcagaaaagctatttatcaacgtgaaaatgaaatttcaactgcagttggatatggcgttgcaattccccatgcccgaaccagagcagtcgaaagatcaacaattgctgtctttagagatcttgcaggtgttcaatggggccaggaaaaagttaatttagtgtttatgattgcagctgaggagagcgcttcggatgaacacttgaagatgttgtcaaagatttcaacttttttaatggatgaaagctttcgagctagattgataactgcagctgaccctaatgaaatataccagattcttgtccaagaggatgctaagaaagatactgaagccaacatttcaaatgcgcgagaatctgctgggaaatatcttattgggattagcgcctgcatgactggaatcgcacatacgtatatggcagccgaggcacttgctaatgaagccaaaaaaagggggatgcgcgccaagattcaaactaatggttcgactggtgttgagaatagactaacttcaaaggacattgaagaagccgatgcaattgttgtggctcatgacgtaaaagttgacaccacggtttttggtgggaagcctttcttagatgttcccgtaaaacgagctattgatcagcccggctcagtggttgatcaagctttagaaaaagatacgacaagttcaaaatctactccaacgcataagaaccttgaatccgccttagggaaagaaactaagtctgaagaagagttgactggtagcggtaaatttgctcgtgctttctacacgcacatcatgagtggtgtgtcgtatatgattccatttgttgtcgttggtggtatttttatcgcaatttccttcatgtttggtatctacgcatcagatcctaagagcgatcagtataatatctgggcagcatttttcaatgaaatcggtggtaatgcggcttttaaactttatgttccgattcttggcggcttcatctcatggagtattgcggataaagcaggtttagcgcctggtatgatcggcggcatgatggctgttaatggtggatcaggcttcttagggggcatggtcgctggtttcctggccggatatgttactcgattcattgtcaaaaagacacagaatgttcctcactcatataaagggattatggcagtattagttatcccgctcatagcaacctttattgtggggcttgttatgtttttccttctgaatacaccaatgtcgaatatgataaggttcctgacaaattggctaaaatccatgacgggcgtcaacgctttcttgatgggagcacttctagctggaatgatggcatctgatatgggtggtcctatcaataagaccgcttcagcttttggacttgctatgttcgcttcaaaaatctatgggccttcagcagccttgatggtcggtggcatggtgcctccgctcggaattgcactcgcaactgttttgtttaagcgaaagtttacaatccaagagcgcgaggcgggtaaagctaattgggtattaggggcaagcttcattacagaaggggcaatcccgtttgcagcagctgatccgctgagggtgattccggcaaatattattggtggtgcagttggtggcgcaatctgcatggcgtcaagcattacgttgcaagcaccccacggcggaatctttgttatcccaattgcctgcaataagccacttctttatattggctgcattctaatcggaacaattataacagcgcttatcttgggctttaccaaaaagaatttgagcgaacagcaaatgaagcaacagatggcagcaggtattatctgagaattatgcaaggtgcgaagctgaatatagagagaattatcgatatgataaaaggttcggtcatagtataaggactataccggacttttttatattgattcttgtgacagttgtgaatttcttataactataaatactgcacaatttaaatgaattaaaaaagtagcaaatacatttcttcgatgtatccgctactttgaatatttgatgctataagctagtccttaagcttaaagtatttaagaaatttttaacgctgaaaaatttagatagtgatggtgttttctacgcatcatagtcgggttcgtttgtcagaatccaatcctctgcttcttttgaccacaagccgtcatgcttggccagaatctttcctaggtcggtcgtggggtctactttggctaattctattcggtcaaattttttaccactgtacaccaactttttgccaccgccaatttcaggttgattcattgttgtctcagctgcatcgtttaagcccataacatgggtaataactttggaaacgtccagctttttctcggcaattagcttagctgcttctgcttcattgtctgcgtcaccacctgatgtgccaacaaaatgagtaaaattatagtggatgttgtagaaatttacagacgcagaaaagtcttttttcatcgggcctgcaaactgatttaagcacccatcaggattgagcagggagtctgctaaagttgctaacggtgcaacgctgatcatcaaaaaagcgtcatcgtacccattgccatcaactgcatctagaagaacttctttttgctcatcaagtgataagttgttgacgttgacaaacttgatatctacccagtcagatggataaagttttttagcacgatccagtttggcctgattgacatcggttacaacaagcgtcgacggcttttttggaccatgtagtgcgtagtcaatggcaagtagtcccattgggcctgtcccgcccatgattaacatgttgccaccttctttgatacctgttgttggttggtatgagtggaagttgacatggtattgtgctcgaaatgcggcaataacacaacttaccggttcacacaacgaaccttcataatatgcatcgccttcgaatggaattaagcaccccattgtcatcacttcatcaggaataataatctttgttgcatcaccgccgatatatggatatgaataacctggtacaaaaggcgtgttttgacgagccaaatttggctggattacgtaattttggccagcgtggaactttgactgccactttttgcccacttttaagatttttccagaaaactcgtggcctagaactgctggattatgcgctaaatcatcaggggtctttttgtgatcttcaccttccatcgcaagcttccatgatgacatacacattgtatcgctcacgacagtcgcgaggatctcatcgtccttcatttcgggaaggtcaaaagtgtcaattcggagatccttcttaccataaattcgtaatgctgtactttccatgttgatatcctccattcacaaatgtgagaattgattgggtacttattttttctagctacaaacagatgttaatccagcaatttcgtttgagcaagtaagcgctaccaaaaaatcacatatgtgaaactgttaggacaactctttgattgcctttgctgttgcttcggtagtaattaaagtgtttaagagaccacctcgaagagcggcaaggatagcatttaccttttcttccccaaaagcaattccaacggagtgtggtacttttcgcaatgccgaaaaaggaaaggcaacaagaatggagtcgatatcgcgagctaattttccatccttgtcgaaagggtgtgaaagaatatctccgaccatatcggcactgaaataagacttgaagtttgtgttctcatagaacgcttgccaatcaggagaatctgtaattagtgaacttccgatgccaaagatcgcgatattgacacgattccacaatcctaagatttcttgcgtgttggggttggcgagaagctctttacgaagcgcttttgatctgacaaaggcaggggaatccaagacaaacgctgttccgtttagccgattggcgagccggtgtgtcagatagctcacatgatagttcgaaggtattcttcccattgggccacccaccagcggaacaactttaatatcacgaaggcctttatctgttggaaattgactgataacacttgaaagcgttgaaccccaacttaacccaattacgtcaccacttttaatgattcttgataaaaacattgatgcgtaaacactcaaagcgtttaactcattgcctccattttcagaagccgggactataacggcctctcgcaaattgtatttttgtttaaaaaaatcaataagttggctgacggcggtggtttcgggattgattgcgatagataccacgccttcatccctagccgccttcagaattcgacttatttcggttctgtgaatatgggcaatgttagatatttcttgttgagttagaccgtgcatgtagtaaagatcggatatcttgactaaagttgcacgatcataccgtttaggcaaatttgacattgatgtcacctcgaaatcacaaatgtgaaattattcaacagtcacgttgtaaccgattacattccaattataatcaaaagtgaaattagtaacaacttaagtttaacatttgtgaatgatgaaaggagaaatatcatgtcagattggctcagtttgttagggaagacaattattgttacgggaggctcgtcaggaattggggaagcaatcgtcaaagagttactgcaaaatggagcaaatgttgttaatggtgatttaagagaaggatctatacaggatccacgcttaacatacgtaaagacagacgtgactaatcctgaggctgttgaaaatcttgctaaagtggcaacacagattaacggggagatttggggggttgtcaataacgcaggaattaacaaaccacgtgttttagttgatccgaaagatccgcatgggaagtatgaacttgatgttcacacatttgaccaaatattcaacgtcaatgtaaagagcgtctttttagtttctcaagctgcagtacggcgaatggtcaagcaacgtcacggagttatcgtgaatatgtcttctgaagcaggtctagaaggttctgttggccaaagcgtatattcagccagtaaaggtgctatcaacggttttacccgttcatgggcgaaagaattaggtaaattcaatattcgagttgttggcgtcgcgcctggcatcatggaagctacagggctaagaactcccgattatgaagaagcattggcttacacccgagggacaactgtagaagcaattcgagcaggctataagtccacatctacaacgccaatgggccgaagcggcaaactgagtgaggtggctgacttagttaactattttgtttccaatcgtgctagctacatcactggggttacaactaatgtcgcaggcggaaaatcacgcggttaaaacatgtttataagattggagatgtgcgatagaaatggaaataattttagttgggcatgcacatactgcaaaagcctttaaagaagcagtggagatgatttatggtgaggtgccaaatttccatccaatagactttacacctaaagagggtttgcaatcgttgacgaataaaattatttcagcgattgatcctaaaaaagcgtctagtactttaattattaccgatttattttcaggaacaccttacaatgcagcagcagaattagttttgaaaaagaaagcggccgatgttgtcgctggaatgtgcttgcccatgttattggaggttgcagttaacgcaaatagtatggatgttggtcaactagtatcacatttaatgaagagcaaagaagaattctcaacgagccttagcgaaaaattgacagcaaatgcaaaggaggatgatttctgatgattattacgcttgcaagagttgacgatcgcttaattcatggtcaggttacaacagtctggtctaaagaatcaaatgcggatcgtatcatcatcgtcagttcagaggtttataaggacgatattcgtaagaccttgttaaagcaggcagcacctccaggcatgaaagtcaatattgttgatgtaccaaaggcgattgctgtttataacaatcccaaatatagcaaagataaagtgttctatttgtttaccaatccaagtgaagtagttgatctggtaaaaggtggaattccattaaagaaattaaacattggtggaatgcaatttaagcaaggtaagacccagattagtaaggctgtttccttaaatgcagaagatgttgcagcatttcgagaattagatcgattaggagtcaagcttgatctccgtgtagttaaaacagatccatctacagatattttgactaagatagatgaaacgtttggaaaggattaggtggtgattataaatggcaatctctaccattcaaattattcttatattcatctggtcttcagtagtgggtatgggaagtgtattagatgaatttcagactcatcggcccttgatcgcgtgttcagttatgggtttgattttaggtgatccaaagacagggattattttaggtggaactttggagcttattgcccttggctggatgaatataggggctgcacaatctccagattcggctttggcaagtactatttcaacaattctagttattgttggcaatcaggatattcagaagggaattgcgattgctttaccggttgcagcggccgggcaagttcttacagtcttggcacgaactgttacagtggcatttcaacatgcggcggatcgtgaggcggaaaaggcaaactttactgccatcatatggttacacttcacggcattaattgttcaagcgctccgggtctcaattccgaccacgattgttgcagtattcgtgagtccagaagagattaagagcatgctagatgcattgccacaagtgattaccggaggccttacagtagcaggagggttcattgtggttgttgggtatgccatgattctaaatatgatgagtgttaagtatttgatgcctttcttctatctcggctttgtacttggcggatatttaaaattaagcttgttagcttggggcgctgttgggctgatctttgctatcatctatgttcaactaaatcctaagtttgcgcaaaaccacagcaatggatcgggcagttccggtggggcagttgcatcggccagtgatcatcctgctgagttaccagaagacgagttggacgactgaaaggaagtgtaatgaattatggctgatcaacctgtacaagtaaataaactgaaaactaagattacaaagggagatatgtttaagacttttgtattcgagaactttcaacaagcttcattcaactttgaacggattcatgcgctcgctttttgtgttgatatgattccgacaattaaacgtgtttattcaaagaaagaagatcaagtggcggccctaaaacgacaccttgtcttctttaacacaacgccggctatgtgtggaccaattgtcggtgtgacaatggcgttagaagaaggtcgagcggctggggaaccgattgatgatgggactattaatagctttaaagttggcttaatgggacccttggctggtgttggtgatccaatcatgtggggcacactgcgtcctattcttgcagctttaggtgcctcactggcacttcagggatcttggctggggcctattctgttcttcttcgcttttaatgcagttcgattggcatttaaatggtatggacttcaacttggattttcgagaggattagcgcttgttaaagacatgagcggtaatcttctacaaaagattaccgaaggcgcgacggtacttggcctctttatcatgggtgttttagtcacaaaatggacaaccattaatgtaccattagttgtttcgaagacgaccgtgagtggtaaaacgacagtaacgaccttgcaaaatatcctagatcagttttgtccaggactcttagcgttgggtctgacactgttgtgcatgtatttacttcggaagaaagttagcccaattcttttgatttttgttttatttggagttggcatcattggctattggctcggtattttgaagtaagggtgaagtaaaacgatcaatcaaaacacaataataattgcaatcggcctcatacttttgaccagtggttttctagtaaaaaacgaaaagcagggtaagaagcagagatgtaatttgctgtatatgattgcaggcattgtcatcgtattaattgggctgaaagtaatttagggaggggttgttcttttatgccacttgtatcaacgaaatatctagtgacgacagcttatcaaaataagtttgcagtcggtgcctttaacgttggaaatagcgaatttgttaaaaatatcattgccgttgcggaagaattagagtcgccggtcatccttgaaattcatcctcttgaatatgaactaatgggaagtgctatttttaaatatattcgagaagcagctctgaccgccactattccagttgctattcatctagaccatgggaggaatatggctgatgtattgcgagcaattcaagatcaagcgaattctgtcatgattgatagctcggggttttcgttcgaagagaacttgaggctaacaaaacaagtagttgaagtggcccacagggttggcgtctccgtagaagcggaactgggaagtattggaaatagaaagttcacagaagatcagaatatgggcagaatttatactgactctgaaagtgctaaacaatttgttgaagaaacgggcgttgatgatctagccgtggcgattggcactgtccacggcccgtatccaagcggggaaaatgatatacgaattgacatcttgaagaaacttaacgcaacattgaagatgcctttggtgctacatggcggatcagacaatcctgacagcaagattcgagaagctattcaaaatggcatatcaaaagttaatatttcgacagatattaaagtgccattttatcatgggattgctaaagctgtggctgagaatccgaatgagtatgagccgtggattatgacgcccggtgcggatgattcgcaaaaaaaggtgattgcggaaaagattcgtttatttggcagtgatcataaactaagcctttaccttgagtctccagaaaaattgacgccatatatcaactcataatgagagaccaacgcttcaagattcccactatatttactttatatgtacaaaagcggttctgatttctggcaagagatcagaaccgctttttagcttagatattttgaaattaaaatatctttgggcggcttattaattaaagatcagtgacgcaacaggataaccaacgaatgctaagataagtataccagcaacggctagcgccaatccatatcttaacatcaccttaagatctacccacccagaaccaccagcaagtgccatgggtatcgttgaaggtggtgttgaccatgcataagaggcaccagcggcaataagcgtcgtgagcgccgctacatttacatttccaagagctgtagctaatggaattagtaacgagtagaaaactgttgccataatcgtacttgaaataaattgctttaatagaaccagtaagaacatcgctactaatacgaataggaaactagaaaagtcaccgacaactggaccaacgatttttgcaaagtacttggtaattccgagtttatcttgtactagtgcagtggataaaactaagacagctgcattgaatattaatgtgttccacggcacgccctgagttgaagcaactttaaaatccattattggcttgccatcaatactgatcaagcaaagcaagataacgccgataaaagcaggaatggcatttcctaaagaagacatgtatgcgccaaatgcaggatagaagtttccaattgttccttgaataatccaaataccaatgacactgacgaacacgaatgcggtgatcttttcttgtttagacatagggggtaactctcggcgtaatttatttgaatcaaagttgcgcaaaggattaacatcaggacggtaaaaaaatttgtagattagtatgaacgcaatgaaaacgagcagtccagtgataatgccaacaatgctatatgatacaacgtcaatgtttatgttggtatcacgagccaggaatgttagtggaattagaacaatggcatgtccgataggtgtcattgaagatccaatgccgacgcacattgcaagacccagaataatcatctgcggtaagcgatcccccttttttaaacctagttctttgaataactcctcagctattgggatgaaaactaacaaagcggccgtttgagacataaaagccgagagaaagactgaggcgaagagaaagatcacaatgaaagtccatggaccgcgactagcaaatttgttagatactgaccaaattgcaattcgttttgacaaacccgtttctgccataacgtaactgatcatgaagaatgcataaagaaaagagttcacccaattgccaattccattggcaaaaatctcagtctgagtcatgatctggaagataacgatgactgtcatgcataataggctggtccacccaattcccgcaaaattccaaagtaacaatatgccgatgaagattcctatcatttgcatggagtcaactgatagtccatctggagcggggataaaacgaaagagaaatataaaggcaaacgaaatcacgttcataatctttttcgaattgattttgccaagaaattcagtaatactaaaagcttttgccgtagtttgcatatcagttcacctcactaaaatttgaaaccagatttgtttgatttaagacttgctgtaatttggaaggagagaaatcatagatattcttgtgagcgttaattgcataggcaaagatggcaccaactgattcgccaacattcataactattggcataactctcgtagctgcaaaagtttcatcatcggttgatattgctttgcctattacagcaagattgagatcttcctgtgggagacaagcactaaaaggaatttgatacatactgttaattttcataaaatgaactttttttgtaatcggatcatgaacatcgactggatagcagccaacagcaacacagtcttcaaattggcgtgcctgctgaatatcagataagctcaacgttgttcgtcctttgagtttaatgcttgccctaacgcctagaattggtgcgatatttgagatataagaattttcacaacctgggatattttctttaatgaatacaatgattgaacttatttgttttctgctttcttgcaatcctcttgaaagttgcaaggcatcacgatagtcgacgcttgttctggtaacattcacgcttacatcgttggttcccggtattggagcaaatgcaagtattctccctttaataatgtccttggcaaaggcatcattaattatttctgacagatgaccgctgtcaataaattcctggagagtagtaagatctacattagaaagtctgaacaattgtgtcgatacgggaattttatttgaagctaatggttgagtttgacaccctaaactaactgcaactgcagaattactggttccatcaatgatgtacttcgttgaaagctgaactgatttaccaaaactttcagcttctatttcaaatccatttgtcaatttctgtgcagacctgaaggaagtattgtagtatatgcgaacgttgttttcagtcaatagatcctccagtatcagtttcaaaacttcgggattataccggagtcgatctactcgtatacttttgtcggaagacattggtaattggtaataatatttacctgaattccattcaacgagacgatcaaatatctttttttcaaaacctttatagatcaatctttttttaaatgtgactgcgttgaattccgctaaccctgataaagttgcatttcccccacaggtggattgttgttcaataatggttacctttataccccttgaagcggctgctaatgcagccattacgcctgcggttccaccaccaacgactattaagtctgaattcatcaaaatgtcctccttgagcatatcctttttttctgttgtacaacaggctgttggtgttagaataaaatagcgctttcattcgtgcaatcgatttaattcactacttctttcggtaaaaccgatttatcagagcagagaggacagtcatgaatcttaatcaactgaattactttttggtgttggctagagttggttcatacagtgaagcggcatttcaattggatattgcccaatcaacattaagccagtcaatgctgaatcttgaacgagaatttggaacaccattgttttatgctgagaaacgagttacttatttgaccggggcaggggctgtttttcaagaagaggcaaagaaaatacttcaagatgttgctcaaagcaaggaaaaggtagctcaatatctaaatggaaatatcggaaatgtcacgattggagtttccggatcttttggagtgaatattgttcctaaggccattagacgttaccgacaatttcatccagaaaaccttgtaaattttagtatcattcaaggaaataccgaacagatattacaaggtatcagggatcacgatgttgactttggaatctgttcctactcaaggcataatgaggatatcgaattttcattaattgaacgggaaccctatgttgtcataaccagcagatggcatgaacttgctgaacgtgaacagattttaatctcagaaatccttaagtatccgcttattacttttagcactcagagcgctgtttactatgacattgcacgtatgctgaatgttgatatgacaaagttagacattgttatgcaggttgacgactcatccatgatggtgtcgcttgtagagtctggtattgggattgcagtcataccacgtatctatgtgttagataactttgatgtcaaagttttgaatttagaagatcaacgataccgggatatattttgtgcgtatctgaaatatcaaattctttctccggttgcgaaagaatttcggtcattaatacagctatcaagtatcagaaatagcaaaggatgaaccgaattaagcgtctccaaatttgacggtattgaatttcaatcaatcttaattttttccggcaagaaatttgaggtccttggtatgcggaaagatttataaactaagcagtttaagtttgaacacagcctttacacccgaacatttctcagctaaactctgattacattcagtttccacagaacccacaaacaagtaccaaaactgaacgaaacacagcagcatctgccaacgaacaattggtcataggatgctgctgagaatataggaggcgagtagatggcaaagttagtgttgcagacagatttcggattggtggatggtgccgttgcggcgatgtatggggtggcttatggtgttgatgataagctgtcgattcatgatttgacgcacgagattccaccgtatgacatttttgcggcgtcttatcggttgtatcagacgacgaagtattggccggcggggacggtttttgtttcggtggttgatccgggtgttggcagtgatcgacggagtattattgcggagacggcggaccatcattttgtgattacaccggataatgggacgttgacgcatttggcgaagtttgttggtttgaagcgggtgagtgtgattgatgaggcggcgcatgcgttgcctggtagtcaggagagtcacacgtttcatggccgggatatttatgcgtacaatggcgcaaagttggcgagtggccagattacgtttgaggatctagggacaccgcttgctgctgatcagattgtaatgttgccgttgggcgaagtgacgcagcaggaaggccaaattgccgggacaatcgatattttggatattcggtttggttcgttgtggacgaatattccgctggatgcgtttaagaagcttggcgtggcaccgggcgagttggtgcaggtgtcgatttattatcatgatcagatgcggtatcaaaaccagatgccgtttacgcggacgtttgcggcggtacgggttggcgagccgctggtgtatgtgaattcattgctgaaccttggcgtggcgattaatcaggattcattttcgaagttgtatcatattggtactggcgttgattggcatatcactgttaagcggctttaggtataatgaattcattatgaaaatgttgcgtcagctaatcattcgttgacgttgtggcacgaatgatacgaggaggatttttatgcgagatcacaaagttttgagtgtccgaacggttgttgcaatcgggattggtactgcaattttatttattttaaagcgctttgccgttattccaactgggattgctaacacgaatattgatatttcttatggtttcttgggctttattgcaacgctgtttggaccgatcgccggcttctttatcggttttctcggccatgcactgaatgactttactcaatacggtcagccttggtggacatgggttttcactaccggtttggttggctttgtgattgggctattttggcggcggtttaacgttgaagccggcaattttggtgcgaaaaaaattgtggcgtttaacgttttgcaggtgattacgaatgtggttagctggagtctgattgcaccgacgctggatattatcatctatagcgaaccggctaataaggtttatgttcaggggattgtttcggcaatttccaatagcatcgcaactggtgtgatcgggacgattttgttggtggcgtatgcagcaacgcggacacgttctggcagtttgaagaaagagtcttaatatggcggcaccagcaattcaacttgatcatgtgacatttcaatatgacagtcaggctgaaccgaccttacacgatattaacctgacaattcagccaggcgaaaaagtcttgattgtcgggccatccgggtcaggcaaatccacactaggcaacctgattaacgggctgattccacatgcatttcccgggaaattaagcgggacagtgaaggtgaacgggaatgttgtgcaggatcagagtctggctgcattgtcgctgaatgtcggaacggtgttgcaggacccagatgcccaatttgtcgcgttgacagccggcgaagatattgcctttgcattggaaaacagcgccgtggctccgagtgagatgcacaccagagttaaaaagtgggccgagcgtctgaaaattggtgatttattggcgcaggcaccgcaatcactttctggcgggcaaaagcagcgggtggcaatggccggcgtcttaattgatgaaggcgacattttgctgtttgatgaaccgttggcgagcctggatccggcaaccggtgaagcatcagtggcgttaattgatgagctgcatcaaacctatcatgtcacggaagtcatcattgagcatcgactggaagacgtgttgcggcggccggttgatcgcgtggtggtgatggcagatggccgcattctcgctgacgacaccccggaagcattgttgcgcggccaattgctccaaaaaatcggactacgcgagccgttgtatcttgaagcagccgagtttgcaggtattgatttgaagcaggcaacgcacttggcaaacctcgaaacattcgacgccccgaatttaggtgccaaacttgcagactttaccaccgaggcgccgaaaacggtcgccgatcagccgcaaacaccgctgttgacggttgccggcttacaatttgcgtatccaaaaggccgccagattttcaccgatttgaacttaacgctgcatcatggtgagatggtggcgttggtgggacgcaatggtgtcggcaagtctaccttgagccatttgatcgcggggtttctgaatccgaatgctggccagattacgctggatggcgaggatttggccacatggtcggttaaagagcgggcagataagattggctatattctgcaggatccgaaccagatgattagcaagcatttgatttttgatgaagttgcactgggaccgcgattacgtggttgggatgaagaccgcgtcaaatcggcagtgctatcggcgcttaaagtttgcggcttgtatccattccgttcctggccaattaacgcgttgagttacggtcaaaagaagcgggtgacgattgcagcaattttggtactagagccggcattgatgattcttgatgaaccgactgccggtcaggattggcggcattttaccgatatgatgcgctttttgaccaagttgaatgaccaaggcattacgatgatgttgattacccatgatatgcacctgatgttggaatatgcgcagcggacgattgtgctcggcgatggcggcgtcttgatggatgccacgcccgctgcggtattgaccaatccggacgtgattcaacacgcttcgctggcccaacccagcctatatcgtttagccaaacgcttaaatcttgacccgctggcatttacccaagcagtgattgatcaggaacggagggtgcgccaatgaattctctttttggatacgacccccaagacacgtggctgcaccgtttaaccggagcaactaaaatgttggcgttcctcggcatttcggttattgtcatggccagttacgacacacgcttcgtttgcgcagtcatgctggcttcgattattttattcttacaagcaaaaattcactggcaccaaattagcttggttatcaaaattattaccatttttgcggtcgtgaacctattactggtttatgtcttctcgccgcaatacggggtggggctctatggaagcaaacatgttttgatccatgccggctacctgaccctgactcaggaacagctattttatgaactgaatctcgctttaaaatacatcgtaactgtcccgctggccttgatcttcttaatcaccaccaatcccagcgaatttgcggcgagtctcaataagttacacgtatcgtatcgcatcagctactcggtggccttggcactgcggtacattcccgatgtccaagccaatttccgccaaatcagcctagctcagcaagcgcgtggctatgaattgtcgcgcaaagccaagctgttccagcggctgaaagggatggggcagattctcatgccgctgatctttacaagtctggatcgcatcgaccaaatcagccaagccatggaactgcggcgttttggtactggtaagcgtcggacgtggtacatggatcagccgcttcggacacctgattggttggtgctgggtggtgttgtggtgattactgtggttggattggtgctgtttcgggttaatggcgggcggttttttaatccgtttctgggctcgaaccagtaattatgcgtgaccgactgttcaatcaatagagataaatatatggcaatggcggcacgattctcctgaagttaaggaaaccgtgccgccattattatgtcaatcgagaattaggtaagaggaaaccttatttgtcttgatggccaatatctcttacactttctcgttcaacaattgaaattgatgtgtaaatttgctgtttggagactattttcttttctgcgtcaggcgcttccaatcgtttaacgccttcaacccccattttatagaatgcttgggtgacactcgttaactgtggttgtaccatttcgcatatttcagtgccgtcaatgctgactattgataaatcgtctggaatatttaggccaaagtcgcgtgcttggttcaaaataccgactgcggcttcatcacttccggcgataatacccgttaactttgttttgcctccgtaagctttcattgccgcttggccagaagtataactatagtcgcctagttgcacccaatcatcttttggcgtgataccggcttcttttagggcctcacggtaaccctctaaacgaagtcttcctgtataaggatacttgtcaatagcggctaatccgatttttcggtgtcctttagctaaaagtaactgtgtggcctgatatccgatttggcgatcgtcagagctaatgaatgggaatcgctgatcattaaatccaattgataagaaacaaaacggtatttgagactcctgcaagagttcaagattttcagcggatagtgcaattgacaataatagaattcctctaacaggacgttcaatagcagtcataagagctcgtctttgttcaacaggatcggcactatttgaatagatgataattaaattcaatccatgcttaattgcttctgattgaataccatcaataatttgacctgaaaagcttgtcttgacagaactaacaacggtcgcaatgacgttactgcgctgtttgactaactcaactgctgcttggtttcttttataacctagttctttagcagcagcacgtacctttgcggctgtagcctgactatatccggattgtttgttacccaaaacgcgggaaacagttgatgctgcaactcctgtctttcttgcaatatccttgattgttgcaaccatacaattgcctcctgattccaaatgatatttaccaacaattgtacattcttaggttcttaaagcaagaattacaaggaggtacttcagcaaattctattttccttcatgaacgataactacggaaatagcaccgatgaccattgacacaaaaccgacaatcatcatcattgattgactgttacccatcattgggaaaatgatgaagcttaaaagtgatccaaagatttgaggtaagcaaattgcaatgttaaatagccctaaatatgatccttcattttgtccattcagagaggatgttaacaaggtaaatggcagtgtattgatcgtgaagttaccgatgccatatagcgcaaaggcggctaaggcaatccacttattaccagtagttgctgtaataatgatactgattgcatttgcaaataagccaaaagaataccagaatttccgttgatttggttttgttttagcataaacgaatccccaaagtagggcggcaacgctataaaaggctgtcataacgccgtaccaatttccggcagcctggaagcctgccgacatgggatcagttgtattccagatgttttttgccatggctccggttgcataagtccaagtgtacatgatgccgatccaactgaataattgaacaacagccagttcccagaaagactttggcgctgtttttgtaagttgccagagacttggggttttagcgtgttgctttttgaggtcaatttcatgatatttggcatacgtttcaggatcatactccttgaccttgagtacggttacgaaagtggtcaaaaggaggatggctgcgccgattaagtaagcccaaataactgtattaggtacctgacctttagcggcagtatttgacatgccacccatcgtcagaaggtagggcagcaatgcagccaagataccgccagcgtaactgaagatctgttgccaagaccatgccagattcttttgcttgttattgaccatgtcgccggccatcattcgatatggagctaggcaaacattgctgaacaagtccatgagagcaattgcgacagcagcgtatacaagcgcagtgattgagccatagccaaaaccaaatgagccagtaaagggaagcataaccatcacaatggcagcaattggcgcaccaaacaacaaatacgggatccggcggccaaaacgggtccaggtcttgtcagaatatttacctagtagtggctgaacaaccatgcctaacaagggtggtagtagaaagaagaagccgagactattaggattaacgccaatcgtttgggtgattcgactcatttgagatccttgtagcgtaaacgccatgttgaccccaatgcacccaaacgtcatggctaagatcgtctgcatggacaggtcaggcatactgctatcgactgtggtcgtttcgactttttccttgctatctactgaaggattcatcgtatttttagacatattagctatacctttctcttagtattgataaacttttgcttcatatggccgaatgttgtctccttgatcatcagcgtaattagaaattaatattttcgcgtgacttggaagatcataatggcgagtcaagtttttgttcgtgtagtttagaatgacgacaagtgtggtatcagcgtttgttcttgtgaaagcataaatctcctcatcgtcagaatttccggggattaatgcgtaggtgccgtcggtgatgactgggagtgtatgacgtagcttgatgagcttttgataataataaaacactgaatttggatcacccaatgcttgttgaacattaatagttttaaagtttgggttcatttttcccaaggactgtgtttcgaaaagcctgcattttcgtgatcactccattgcatcggcgtccgcgcattatcgcggctatgcatcttgatgtaattcatcatggtcgttttgtcgacaagatgttgctcttcaacgatttggtgataagagttaagtgaatcaatatcaacatagtcttcaattttggagaagtatgcattggtcatgcctatttcttcaccctcatagatatatggggttccttgttgcatgtgcagcatggtcgcaagcattttagcgctgaggacgcggttttcttcggtggtatcatcgccaaatcgggatacgactcttggttgatcgtggttattccaataaagtgaattccatgcttttccggctaaggctaattgccatttggtcagattggcgcgaagatcttttaacgaagccttacgatcggcccaacgtcctagggcggggtttgaattgccgtccaagcccatatgttcgaattgaaagaccatgtttagttctttgttgtcaaggctggcatatttttcagcctcgtcaactgtcacacttggggtttcgccgacactgatcaaattgtgtttgctcagcactgtctgattcatttctcgcaagaattcgtggacatgatgtccgttggcaactaagggttcgggattagcatataattcctgtttgccttttttaccatcaggcaatccctcaggcttagaaatataattgataacgtccatgcgaaatccatcaacgcccttgtctgcccaccagttcatcatgtcgtaaacggaatgtcgtactgtagggttttcccaatttaggtctggttgttcaggggcaaacaagtgtaaataatactggtttgactgagcgtcatatttccaagcagacccggtgaagaatgatccccagttgtttggcgctgtgccatctttcccatctcgccagatgtaatagtctctatacgggttatctttgccttttcgtgattcttggaaccaatgatgttcgttagaggtgtgattaaccactaagtccatcatgattttaagcccaagtgaatgtgcttttgctaataattcgtcaaagtctttcatcgtaccaaaagttgggttaatcgcctgatagtccgaaatgtcgtatccattatcgacttgaggtgacttatagattggacttagccataaaacatctacacctaatttcttaatgtagtccaatcgctcagttatacctcttaaatctcctacgccatcgttattgctatcttgaaaactagctgggtagatttgataaatgaccgcgtttttccaccatttttccactggtaaaatcctcctaatagctcttcattgacattgaaaacacaaatacattgaacaagataaggttatctgtgcaccatgagatccctcgctaccaaaccggagcaaggattgcatgtgagatgaactaaatccgatcggcctaaatgataagggtttagacagagcaaaagagtcaattcaataatcagtacttggtttgaaagttacgcaaacgtttgcttaaaatgaatgtaatccctttcattctgaaagtcaatgttttccggagattgtgattaactttatttatgatacgaacataatgtggactgctgccggggcgcaataaagaattttctagttgagttaatttgccctgtttgttacgctgttcacgtgaacaagtacacatgacagggggagttattttgaaaaagtgggttaagatattgggctttatcgcctttttgagtgtgattctggtaggttgtagcagtcagacaagctcaaaatcaagttcttcaagttcaaaaactaacaagtcaacgagtagtaaagttacaagcggtgcttctcagcaaggctattcggatccgaaaactatgaagagcaaatatgatattgtgatcgtcggtgctggtggagcaggaatgacagctgctattgaggcaaaacaacaaggtatgaaccctgtaattcttgaaaagatgccgatcgctggcggtaacacgttaaaagcttctagtggaatgaacgctagccagactaaggtcgaagcggcacagggagttaaggacagcaatgaccaattttatgaggaaaccttaaagggtggcggcggaaccaacgataaggcgctgcttcggtattttgtcgataattctgcgggtgcaatagattggttagactcaatcggaattaagctcgataagctaactatttccggtggtatgtcagtcaagcgaacccacagacctcatgatgggtcagcagttggcggttatcttgttgacggtttggttaaggaagtcaaaaaggaaaacattccactatttgtaaatactgatgtcactaagttgaatgaaacgaatggtaagattactggtgttactgcaaaagttaatcaagacaaaactaaaaaaatcgttgctaaggccgttattgtcacaactggtggttttggtgcaagtaagcaattaattaagaagtatcgacctgatttggcgcattatgtcacaaccaatcaggcgggcgctactggcgatggtattaagatgatcgaaaaggttggcgggtatgcgattgatatgaagaagattcagattcacccgactgtaaatcagagtaaacatatcttgattggtgaagctacccgtggtgaaggtggtatcttggtcaatcaaagcggcaagcggtttttcaatgaaatgaatacacgtgacaaggtatcagctgcaatcaacaaacagaaaggcaaatacgcttgggtagtcattgattccggcgttcggcaacgatcaagtgcgattgatttctatattaaggacaagcttgatgtagagggcaagacactcaatgatttggctaaaaagatgaaggttccagctactacgcttcagaagactgtagcgacatggaacgatgccgttaataacaagaaggatagtgaatttgggcggacaactgggatggatcacggtctgacaacaggtccttactatgcatttaagattgcgcccggtattcattacacaatgggtggcgttaagattaatacaaagactgaggtgttaaccaagaaacagcaaccaattcctgggttatatgctgctggcgaggtggctggtggccttcatggaaacaaccgaatcggaggaaattctgtggccgatattgttatcttcggtcgacaagcaggtacgcaagcgactgctttcgcgaaagctcagtaagataagtcgcgtacttgagaaaagacagttgtcaccatgttttaagtacttctattcatttgaatattaaaaaaaacagccataccaattttgacactggtatggctgttttttaaaccggattacgcaataaatttttgtctacatggcaatcagaattacgtactagtcaccgttaactgccactgctttacggttgtaaatgggtgttccgtcttctaaatcttccaatgagccaatcttgtttcccttagagtagtaaccgtctaaaagacctaacttttgcattagggtttgtttaaaggcgatatcggcattccattcaactgtatctacaattgcaagtgcagaatgaagtgcggtcaatccatccatatctttgccaccagtggtaatgagcacaccgtggctattcaaaagatacatatgcgggattgctttctcaccaatcttggcaatgttagcggagaccagttccgctaatggttctgaacagttcggttcgaatggaagggtttcaataaagcctaccttttgagttgcttcggtgatattcggcatgttcaggccactggttgcccaaaacatagcattcttagcgtgtgaatggaaaacgcatttgatgtcgggatttgcgtcataaaccgcttcatgcatattaatttcgcgggtcaaatttccttcgccagctataatcttacgggtgtgaggttcaacaaccaagatttgttctggagccagatcgcccaaatatgcctcggacatcattgtcggcgtcatgatgatatattcttttccggtatcttccgcactcactttaaaagaaatatttccgcctgcaatatttgtatcatcgcgttccatcacgatttttacaactttggcaagatcttcgcgttcatgttcaaacataattcgacccttaggtgctttaaacatagtcattttaattactccctttttttagatatgactttgacttgatgacatgagactcgatcagttcacgtttgatgatcgctcttttcttctcgttttctgaaaagagaggacgataacccttttccttaatcaaaaggccaagaattatgacgaaaatatttaaccagtaagtttttgaagttattgcaaagacaaagattccaaaggtgataaaactagtgattgtccacgtaagtctttgaattcgtatctttttattagccatgatgtttcgcttctatccttttgtactggccgttgctgtaggctggttagttttatcgacatactttctagccgggtttggatttttcttaaatgaacgatagacaatccagaagagagccatcagcaaagcaagtcccaataatgccagccagctgcctttaaagccttgagccatcaggaaacgcagatctggtgcttcaattgaactccaggaaacagttgatcccttaggtactgcaatagcctgagttgattttgcaagtgcggtgaattcgttagcaaagaaggtaccaccgtacaggaataaaggttcgtagatgattcccagaacaaccatccttaacaggtttccaccagttaataacagtccgccaacgcctaaacagtagttgatgacgcctgcaaacggcagaattgtatttcctggtagaactgcggcatacaaaatgctaactggaataaggatgaccattgtgacccataactcagtactttgacccaaaatcggccaatcaagtccgataacaaattctcgatttttgaaacgctttttcataaagttgctcattgtcgttccaaatggtgtgagagagtccataaagaactttgccatcactgggaagatcgccataattgcgccggtggtaacagctagatttagagccttaccgattgaatatctaccagctagggcgagtaccagaccgatgatgaatcccatgacaactggttctgaaataatgccgattttcttcttgagtgcctttgcatcccagcggtgattgaagactggaatgtaatccattaatttgttaaccggcgccattaacacggcagtgaaagcttcaatgtgggttgttgtaacacctggataaccaagcatttcatggatttcttctgaccacatatcgccaagttttaacataacgatgacttgaattgcaccagcagcgaatgcccagatataactattagttgttgaataaaccatgtatccggtcaaagctactccccagatattccacatatctgcgtttataacatttgttgtctttgtcaaaagcatgattaggttaacgccaatttctacggcaaagaagacgaaagctagtggccacgcccaagtgattgcagcggcaccggtccagccaaagtcaacggtaggtaaattgattccggtgtttgttgccaaggcttttgcagcgggactgactgcagcaactaaagcgttgattgccattgtcatacctacgaaaccaacaccgaggtaaagaccggaaagtatagctttagaagctttcatgccaaacgcgaaccctaaaatcataataagggcagaaacaacgacttgtggtccaggagagagaatcgcctgaacaatttcattccaattcataattcagtcctccaaattgattaccctcagctcttttgtgttgctgctaaaacggcttcctcaactttggcattcgcctcatcttcccccataccggtcaaccaaggaacaccaacgatttcggttacgtgatttgcttcaatggtttcgcgtaaatcatcgtctgcaggtgcaatgccaacataaacaatgatgtcagggttagaatcaattcttgacttggccgtttcaacaggatgcggttcggcgtgagctacgttatccaggtcgtgatctgcgagaaattcgttgattttatttgcaacttggggacttgtggcaacccctgaaccgcaacatacaagaatggttttcatgacaattacctcctagtgtgcactaactttagagaaatgatcggacaatagactgtacatttgttccggtgtattcgctttcaaaaaagcggagacgaaagttgaatctttaaatgcgctcatcaactgggcaaggaggccaacttgctgtgaaggctctttaatacctagaaataaaaagttgcgagtcgtcatttgctgcatatcgcccatctgtcgccacgggatttcggaattagttctaaccacgtaaatgaatggctttaaaacaaattcgggatcaacgtgtggtaatgcaagttttaacttaggaaagatcaaacctgttggaaacttgttttctcttagttgtaaaccctgcttataatcgcttcggacgtatccttttgaatgtgcgactgaagctacagactcgaacaattcgtcttctgtagaggatttgttttctatatcgattaacccctcatcaaacatgaattcatacaatttcggttctcctttctaaatgttcgacatttaaaaatgtttaactttgtttcaattcgtatagtaagcggtttccttttctttgtcaacaaaaaacttttacttttttcaagctaactctgacaatgcattgaaactgattcggaaaactgaaacattcaatgacaaatgccttttaagtcgaacatacttgaacaataacccgaatcaggctattatatgggcaacggctaccagattggagaatttacgtaatgatgaagaagcaacgtcaaagtgccatacttgcacttcttaatgctactgagggtaaaacacttacgacgacagaaattgccaagaagatgaatgttgcctcaatgacaattcgccgtgatttaaatgatatggctaaagaaaaactgatcactagaatttatggcggggcctcgttggttaatgaaaaaaccacgaaggaaaaaacacaggttcaaagagaatcaaagattgaaattggacgaataatcggttcattgatcctgcctaaaatgactgtttttcttggtgcaggaaccacaatctatgcttccgcggatttcttgccaaagacaaaagacatcaactacgtcacaaattctgacttaatctttagatatttggtgagcaaggatattaatgtacttctaactggcggcttttatcatagaacaacgaatgagttcgttggtacgattgctgaacagacattaagcaactatttatttgatttagcgtttatcagtacaaatggtatttttgaaaaccaagtgacaacatccaattttgatgaaggaaatatccaaaaagccgctatgaagcgtagtaagaaaaactatatcgttgctgaccatactaagtttggaaaaggagattcctttagttttgcagaactaaaagattttgacggtttaatcacggattcaaaggcgtcacgacaagaattaaagatcttacagactgctacgaaattgcttgtggggaagggctgaagaggatgttactgacaattacaacgaatccctcaattgatctggtttataagactggttcatttgacttgggaacgacaaaccgggaactggaacactatcaaacaattggtggcaaaggaataaatgcggcccgtgttgcttcgattttgtctgaggacaagcaagctgttgccgctacaggtttcttaggtcgtgagaacgcgaaccaaattgctcatgatttggcccaatacaatgtcaaagatgaaatgattcgggtgtctggagcaacaaggttttgttatacaattattgacaatagcggggttaagacggaactgaatgagttggggcagtctatttctgcgactaaagctgaggagctcttaggacaagtttcaagacatcacaacttgaaaggagtttcgatcaacggctcgttggcaaaggatctctctgacgatttttatatccgattgattgaacaaatcaggatcaacaatccagacgcgaagattatcttagacacttcgggagcagctctggattcggtcttgagcagtagcgcgcctcctgactatatcaagccaaacaatgatgagcttggtgagcttttgggaattgtcgtgccagaggaagatgatgcagttttacatgcgttgcaacagccgatcttccaaaacattcccaatatattagtctcaatgggttctcaaggaggtattgccaaattaggcgttgatgttcctcagtacttcaagttaaaaatttcgcaacaaaaggcagttaacactgaaggatctggtgatgcgactgtgggtggaatgctatatgcagttgctaagggaaagcagggactggacgttattcgatacggtatggcggcaggtatggccaatgttttgcaatcgaagacaggctttgttgaaaaaaatgcatttttaaggtttgtaactagtggtgaggcagtaatagctcaacccattcaagcaataccgatattaggcgaaaattaagctcagtattttttgctctagccgagctcacatataccaagaagctctaggtagccgcatttttaacggcagcacctagagctttttcttgatcttataggatattttgtaaagtcggtgacttcctaatgatatgggaaatagtattactgatgcttttgtgccactgcttgatgaaccaatgcaattgtcttttcactttgaagacccattcgtcggacaagctcggtataaaggacgtcaaaaatcgcaagctgagacgtcattgaaattagcgcatcagatcgatagcgagtatcttcggaaattgaaaagaaaacatccgatactctttttgcgagtggcgaggtggcatagctggtcacagcaattatcggtacttgatgggctgataataaatccacgagtgccaggatgtctgtgtcattgccagtatgagaaataacgatcgcaacatcgtgttcagtaagcttgtttgcgctcattagctgcatgtgatagtcgttgtcggcaataagtgttaatggcaatcgtagaaaagtgtgatacgccgcttttgcaataacatttgaactccccaatccaaataaagccactttatttgcgtccaacaacaaattgacgctgtgatcgatttggtcctgagttaagaatgatagggtgccttcgagcgcggcaatattagcattgacagtttttcgggcactggccaaagaattgtcatttgtttcgacatctccattagttgtgttgtcaatttctttaagcagggctagttttagttgatcaaatgaagcaaaaccgagttgccgtgcaaaacgcgagatggtggctgtcgacacaccaattttatccgacagattccgtaacgaagagttagctactttagcgtagttgtgacggaaatagtctgctacttggcggcttgcttcacctaaagcggaataaacctgggcaatacgactgtcaaatgtgttcatgttgtcacctcgaaatcaaatgcttgatttttgctaatgaaaggggttacaattcccttgtaaaatcgttactttaaatattgacgaatcgtgtaacattatatcatatgaaaggagataaacaaagtggctgactttaaaattgatacatctgacattcaaattaacgttcatgcagattcatggcaatctgcattaagattggcagccaagccactacttgataacggtagtatcacagcaacttatgtcgaaaatatgattcaagcagttattaagtatggaccatacattgtcattgcgcctggattagcacttgggcatgctgaaccggatgaaaatgtgcttaaaaccggctatgcaattgcaacgcttgatacgccagttaaattcggaagtaaaaccaatgatcctgttgatgttgttgtcgtcttagcatcgatcaatagtaaggaccatctgaagttactgcaaaaacttgttaatttcttgggcagttcaacgaatatgcaggcattgcgtcaaatgcagagttctgaagatgctgcccgtattgttcaggcaatattggaagggtaagtgggggtcatgaaagcactgaatttcattgtttttgaaattctaagtaatcagactatttttctgggcttgattgcgttattaggtctcttattgcagcgtaagaagctacctcaagtgattgatggtgttgtaaagacagttattgggattaccgtactgggtgcaggcgcgggcttactaattaattcattgtcgccggtagtgcaagagttaaataagtcgttacatgttaagggcgtgctaccgaccaatgatgctgtatttggagttgtgcttaagttcgatgagattgcccgaaatgcggttgtgatcttcttactggcttttttcctgcatctattactcgttcggctgacgccaggaaaagattttaagaatgtctatttgacggcgcatctgatgttatatcacgcagctttcatggcagtaacgttgccagttgttttacatgccaaggcattgggcacgattgttgtcggaacattgctaaatgccttgtattacacgtattctccagcaattacacgtagacttgcgcgtaaatggacgcatgatcaaattaccttgggattcatggatcaggtgggatcaattcttgcacactttattggaaaatgggtgggcaatgctgatcccgatcaagatgcagataaactgaagcttcctaaatgggcaagcatgttcagagattcaacgattgttttatttttcttgatgccaattatctttattggcattggagtggctgtcggtcccgcgggtatcacaaagctgtcaggcgggtctaattggataatctggcttattttacagggctttcagtttactgccggaatcgtcattttgctttcgggcgtccggatgtttattggttcaattgttcctgcatttaaaggaatttccgacaagttcttaccgggatcagtaccggctttggatgcgccgacattctttccatattcaccaatgggaggtatgttgggattccttggctcaaccattggcgccatcttagttacgattctaacgattgtgcttcacgctcccatcatcgtctttccttcgccaattattatgtactttgacggtaatgtgatgggtgtctttggaaataaagctggtgggtggcgcggggccattgccgccggatttgtaactggtatgatttcatctgctgccgttatccttttttacccgttgacaggtgcagtttatggtagcggattaacttggtctaatattgattatgctttagtctggacaccggttatgtatttgcttaaggcaattagaatgctgttgggtttttaaaattttaggaggttcatcatgaaaattattgcagtttgcggttttggtgttggttcgagtgtcattgctaagatgaatatcgagagcattctagacgaagaaaacaaatcaagcgatgcgacagttgaaacggttgatctcggcagtgtcagtggaactgatggtgatttatacgttacaaccaacgaattgtttgatcagattccagaagatattcaagaaaagacaattgtgctgtctaatttcgtcgataaggatgcaattaagaaaagtattgatcctaagcttgaaaatttgggcaaataagactaagaagttgattttatgacaactaaagacaagcaattatcaaatgtgacagaagatacatggatcaaagcgacttttcctgagtggggtaactggcttaatcagagtattgatcgcgagaaggttcttcgaggtcatatgcgactgtggtggcttggcaatatgggaatttggctgaagaatgatgagcagacaaatattgcgattgatctctgggcagggacaggcaaacaaacacatgacttgccggataatccaccacgtcatcagtggcgacggatgctaggagctatgcagactcaacctaatctgcgcagaacgccacaagtgtttaacccatttagtatcaccactctggatgctttactggtgacccactaccatcatgaccatttagatcgaaatgtagctgctgcgattgttaacaataccgctcttaagacaccattaattggcccccaggctgtcgtcaatcaatggctagcgtggggagtgcctgagaatcgtgttaaggtggttcatccaggggatagttttaaagtcaaggatattaagattgaagtattgccttcgtatgaccgtactattttgattactgatccggtcggcatgtccgtgccagacgatcgacagataccggatatggatgagcgcgcggttgcttatcttttaaccacttctgcgggcaccatctatcatgctggtgattcccactattccgtaaactttgccgatgttgggatacagcatgcgattgacattgccttattagcgtttgcggaaaatccggttggagtgcaggacaaaatgacgtctgttgatatattacgcgcggctgaagctttaaaagcaaagctagttgttccattgcactgggatgtttggacgaatacgttaggtgaccccaatgaaattttggcactttatgattaccgtaaagaacgatttcgatatcaatttcacccgtttatctggcaaatcggcggtgaatttgattggccgagtgaccgtgaactgcgggtttatcattatccgcgtggctttgatgatcgttttaagcatccggcaaacttaccgtatagctcatttttgtaggtgataccaatgatacatgtcattgcaactgatcttgaccatacgctcctgcgtgaaaatcacgccttgtcgaaagaaacagcaaaggttttatcacatttgcacgatcagggattgaaggttatcttggcttctggacgaccggttccaggcctaaccgatctgaatgctcagttgggtctaatgcagccagaagattattcaatttatttaaatggtgcattggttctgaataacagaactggttatgagatttatagccgaacattgacagcagaaaccttagaggcagttggtcagtttgcacagcaagaagctattccagtagagtatattagtgctgacacggtatactcaacaactgattttggtagatctagctacagtacgtttgctccaaaagggatgaagttttcttatgtcaagcaagcggagttttttcctcggaagccaatctataagatagggttcgccaatgaaccattaaggattgatgcccttcaagccacaattaagatgttgaacgtatcagttactcgatcacgaagagaatttttagaattaatgccactaggggtcaataaagcagtgggtctcgaaaaggttgttcaccagttagggtacaatgcccaacaggtaatggcatttggtgacgaggagaacgatctggagatgttgcggtatgcaggggttagcatcgctgtggccaatgcacagacaaaggtaaaagctgttgcaaggtatatcacagatacgaatgaggttgatggagttgcacaatttctgaaaagctggttttcaacttcatcttaagtttacgtgcttgacgttggttcgttttcaaatgcattgattcttataacaaacagagcctttagtgagtttccatggcgcctctgagatatgttctcaagaggcgtttttaaagtttagatgatcacatgaaacgattcccacaatacagtgttggaaaacgattgacaaagctaagaaacagatgttggaactgtactaatgttaacgatattggtctatgtcatcgctttgataattgaaaacagaataatgaaaagtacgttttaacggtattgtttttgaattaaatgaaaaattttatgaaacacttttgtttgaatttagctaatagctgtattatgagcattgatgcaaaacaaatctgaaatatatttcattatttggaacatttcgaaaaatccgaaacttgttcccttttaaatgaaaacgcttgcataaagacttgagcggcataatactcaatgtgtacccggggaagagaagaatccagattgaataaccagtttggtataggaggatacacatcatggatgatcgtaaattttcagtattaattgcaggtggcggcagtacttatacaccaggaattgtcttaacgttgttagatcacatcgagaagtttccacttcggaagcttaagttctatgacattgatgggcatcgccaacaacgcgttgcggatgcctgcaagatcttggtgaaagagcgcgcaccagaagtcgaatttttagcgactacggatcctaaagaagctttcaccgatgttgattttgtgatggcccagattcgcgttggtaaatatgcgatgcgctcacttgatgagaagattccgttaaagcatggtgtggtcggtcaagaaacaactggtcctggcggcattgcgtatggactacgttcgattcctggggttatcggactggttgattacatggaaaaatattcacctaatgcttggatgcttaattattcgaatccagctgcaatcgtagctgaggcaactcgtcggttacgtcctaattcacgaattattaacatctgtgatatgccaattggtattatggatcgaatggcgcaaattgttggtcttaaggatcgtaacgatcttgtattccggtattacgggttaaaccactttggctggtggacagatgttcgggataagactgggaaagatttgatgccaaagcttaaagaatatgttgcaaaaaagggttattggttgggtgacgaggacaaagacaccgaggcaagttgggtatctactttcaaaaaagcagcagatgtgtatgcattagatccaacaacactaccgaatacgtatcttaaatattatctatatccgcaatacgtggttgaacattcaaaccccgactacacgcgaacggatgaagtagaagcctatcgtgagaaaaatgtcttttctgagtgtgatcgaattattggtgcaggaactgctgcagatacacatttcaaatccgacgatcatgcgacttatattgttgatctgtgtacagcaattgcctacgataccaaacagcgaatgttagctattgttcctaatgacggtgccattgagaatattgatcctgaagcgatggttgaggtgccttgcttgtttggggctaatggcccggaacgtttagcaatgggtaaggcagctactttccaaaaaggccttatcaccgaacaaaactgcgttgaaaaactcgttgttgatgcttttgaagagcaatcgtatacgaagctttgggaagcaatgagcctttgcaagattgtacccgatgcaagtgttgctaagacgatcttggatgaaatggttattgcaaacaaagactattggccagtattgaaataagttgactgtgtcaaaatccaaataacgtagagaggacgagaattaagcgaatctgttaattgctcgcccttttctttcgaagagaaaagtaagggcttacattatagaaagcgagatgagcttcaatgatgcagaaacttcagcgattcggtgccgcaatgttcacaccggtattgcttttcacgttcgccgggatcatgactgcaatttgtattttgatgacaaatgagcagatttttggaagtatggctgcccctggaacgaattggtatggtgtgtggcagacgctgcaagccggagccttcacagtctttaatatcatcccattattgtttgttgttggtttgcccattggtttggcaaagcagtctccgggacgagcggcaatggaagcggtcgttatctatgcttcttggaactacatgatcaatgctattttaacgaattggggaccggcgtttggattcaagaactttgccaaaatgacaatcgtggccaattccaccaaccaagggcttacgaacattatcggtatcaaaacacttgatacgagcattgtcggagcattagtagtggccggtattgttgtctggctgcacaaccgttattttgacacaaagttgccagactggctgggtacttttcaaggatcctcttacattgttattttaggactctttattatgattccgttggctgttgctacttgcttcttatggcccaaagttcagatgggtatctctgcgctgcaaggatttatgaaagcatcaggggtgttcggtatctgggtctatgccttcttggaacgggtattgattccgactggactgcatcatttcatttatattccatttgaatatggacctgcagctgtatctggcggattaaaagcttggtggtttgctaatctgaatactttgggtcagtcaactcgtccaatcaaagagttagcgccgttaatgggatttgaaggttatggatttgaaaaagtcttcggcatgcttggcatcggattaggtttgtatgcaacagcgaaaccttcaaaaaagaaagagacagcagcactattaataccggccgtcttaaccggaatgtttgcaggtattacagaacctgttgaattcacctttctctttgcggcaccgctattatggtttgtgcatgcttttctggcagcaacgatggacgccataatgtttgcggtcggcgttgttggtgagtttagcggaggcttgatcggctgggtttcggagaactggatacctctttggaaccatcaatggaaaacgtatctcttacaaattgcaatcggattggtattcgttgccatctattatgttgccttcaagtacttaatcctgaagttcaattttgtgacgcctggtcgtgaaccggaagatcaaagcgcgaagcttatgaccaagaaagaatacaaagcggctaaggaggcagaaaaatctgctcattcagtggcttccgacccgtatacacaaagggcaattgcttacctgagcgcacttggcggaccggataatatcaaggaaatgaccagttgtgcaacgcgacttcgagtgacggttaatgatgaaaccaaggtggcgccagatgctgaatttaaagctaataaggccgtgaatgtggttcatcacggcaaggccttacaggttattgttggcctagatgtgccacaagttcttgaaaagattcaaggtcttttgacggatcaggatactgttcaaccggctgcaccatcaatcgcggttgatgatacgcctgagtctcagaccgccgcgcttcttagcgattcactgggtacgcaggaaaatgtgcaaagcgtcaaagatcagggtagcactttaattgttcaagtgaacgatcctaatttagtcgattcggttgatgtctttaaatctctgggaatcggggtcaaagacgtccaagttactgataagactgtcactattacattttcagagatggccgatattgcacgacaaatcatggcgtaaacggttacatgatataatcgggtaaaccagttcatgagagagggcattattgtgcaactagaatccctgattaatcaaaaatataccagtttgaaccaaagcgataaggaaatcctgacctttattgtgaagaatcgtgagtttgtccgcaactcaagcttaagcgaagttgcggcaaaatccttgttttctaaatcagcgattttccgttgttgccaaaaaatcgggctcaccggctttagccaacttcgctatgtgttggctgaggagcaggaaagcgaccaagattcacttagcaacgttgattatttggcccaaacagttaagtccatgttatggacggttaaccaatttaagagcacgaatgttgagggtatttatgccacgcttgaaaatgctggcacgatctatatttattcgactggatggcagcagcagatcatggcccaacaactgcaacgcgatttataccttatcggcaaatttgcgtttctgtttccaactggccatgacgagatgcaactgtcaagcaccaagatcaagccaggggatgttgtgattgtgatttcgtacaagggcatgaatgcaacgattgtccagctggtaaataacttaaaattaaacggtgttcagatcgtgtcatttacgtcatttcggcaaaatcgacttgctcaagcggcaaactataacttgtactatgacgtgatcaacaagacgatcggggccgacaaaaaagtcgagcgtttcttcgcaaatttaacacttcttatcgatattttcagcatgggatttgccaattatttggcagcacaggaagagaggacgcgtgagcatggtgaatacaatcagagggaaagtaagtaactactttcaatcgttggcgcagctgttgcaccttaatcttaaaagggtcttctatactattattctgattctcgcgctcgtcccgttggcttatgtactctttttgatgctgaatgctgccaaagaaggcctgagcataactggtgtcatgaaagaacggcctacgattgcgattctgtccatcgttgcgggtcttgacgtcatgtgcggttattcattgtggatgatacgtgagcaggttctggcagatcgccggctttatcagatgatcttgatcggcgtcctgatcacccaattgtttgtaagtaatctgctggtcgccggagctgctgtggctggtcttatgtttagcggtcagattcagaataccgatgcgatcctgccgaagagtaaagtgattgttcccatgagcttactgacgtttggatatgttttctgcatggctatgatggtagccgtcatgacacgataacactgagcttaataaatgcgggtaaagacgaaaaaggtgatgacagtgcagccgaattataaagatattgcggacaactatatccaagctttgggtggtgcagataatattgattctttggttaattgcgctacccggattcgggttattgttaaggacccagataagactgcttccaatcgtgtctttatgcacgtaggggccgtaaattttaatcttcacggacactttgcccagattatcattggtttggatgtcgctcaggttttagaagcaatgcgcaaacggttaaacctgaccgatgagggtacgttggacgagtatgggttgacgccaaatggcgaacgcgctcggattctttacgagtgtctggggctccctgagaacattctaagcgtcacggtcattggttcggcggtcgctgttcaagttgttgatccggattgggttgatccttacgacgttatgttgcagttaaacattggtattaagagtttaaccaaacacggtcatcaggttcgtatcgagatggaccaagcaaccgcaattgcacgggaacttaatcgcttgcttcggcaaaacaaaagacagatccagtgacgattgcatcaaacacgcaaaagcttttatgaagagtgctaaagaagaaaacgactttaaggagaggcgggactgaagatgtttggtttgtttaaaaataagaaaaagactggtgaagaagttgttgctcctgcaaccggggtgctgatgccgctagatgatgtcaccgatgacgttttctcgcaaaagatgatgggcgatggctttgcagttgatccagaagataatgaagtcgtggcgccagtggctggtaccatctcaaccgtctttccaactaaacatgcgattggcattacgacaccaagcggactagatgttcttgttcacatgggtctagacacagttgagttggaaggaaaaccattcgctgttagcgttaatttgaatgatacggttacggcaggacaaatattagcgacgattgatcgtgatgagattaaagccagtggttacgacgatacgatcgtggttatctacacgaacatggacaaactaaagaactttccaaccgttgtgcagagccatgtcgttcaaggacatcaaattggagaattagtttacagttaaattctaccgaccttttgatgaagacttcatcaaggcgactaaccatcaaacttctaggcaatttggaggatgagacatggcgggctttattttcgattttaatggtacgcttttcgcggatgcggataaacaggagatttcctggcgtcgttttgcacgcgactatgcgaataaggaactttctgaccaagagtttgatgatcatgttcatggtcagaacgccgaactgacgctgaactatttgtttgatcgtcagcttacgagaacggaagttaacgattatagtgagcgtaaggaaaagatctaccggaatttatgtcaggcagacactgaccggtttcatttgctacaaggagcaccggaatttcttgatgagctgcgcagggcaaacgtgccaatgacgattgcaactgcttcggcgaagaagaatgttgacttcttttttgaggcgttcggtttgtcaagatggtttgatatgaagcaggttatttacgatgatggcacaatgaagagtaagcctgacccagatccctttctcagagcggcgttaaaattggagttacgaccagaacaaactgtcatctttgaagattcaccgtcaggattcggtgcagccaaagcagctggtgctaaatgtattgtcggtgttgtgactaatcataatcgcgcggtgttggaaaaggattcgcgcttaacgctggtgattgatgattatcttgaaataccgatgtcgaagataaaacagcttataaattaggtgtcttgcttaggtttgtaagcattagcttcaaacagcatgtcatttgcacatttgaaagatttcacttacgagaacaggttttccaagcaaaagtccttgccacggaagatctgtttttgtacgcttgcacagaaatcaatgctaaagtaaggcttaggatctctatcatatagcgtacaagggggtaggcaggtggaaatatacaagatccttaacaacaacgtcatcgttacgaaagatgaacaaggttttgaacaagttgcgatgggaaagggtatcggatttaagcggagtgccggcgagacgctggatccgtcattggtcgataagatcttttatctgaagaacagcgatctgcaggaacatttttcgtcgctgatcaatgaagtaccttatgcgattctaagtgttagtgagaagtttattgacgaggcagccagtcaattaaaacaaaagctgaacgcaagcttgcatgtgtcacttgttgatcatatctatcatgcgctgaaacgttacgaaaaagggcaacttatttcaaactcacttatttttgagatcgaaaatttgtaccctgaggaatttgagctgtctgagcactttttacagatgatcgctgaacaagaaggcgttcagttaccagttgatgaggccggattcattgcaatgcatttaattaatgctgagatgaatgaagagatgggaacgacggtttccatcatgaaagaagtttatgcgattctaaacatcattaagtactcaatggatgtcgagtatgatgaaagatcgttaagctattatcgtttgttgacgcaccttaagttcttcgttcaacgtgttatgaaggggagcatgctggcgagtgacgatgcagaattgtacatgttggtcagccgtaaatatccggatgcttatcgtgttgccaacaagattacaaagtatgtcgccaacgcttttcacgttgtgctgcctgctgaggaagtgctgtatctcatgattcatcttaaccgtttaaagacacgtgaaacggaacttgatcgggcgtagctacgtgctatgaacttgagaaccgattttgttttaaaaaagatggttgacttttgaaaatgtaaccggtaccattgaggtaacttaataatactgtataagattagtggattgtgactgttcggcaggcgaaacctaagcttttacgaggattcatatgcagatacgtgtatgtttctttgttgaagcttaggtttttcttttgcccaaaaactggttgaatttacgagtcagcacagcattggcgagactatacgaggaggcgtactcatggataaccagaagttagcaaaggaaatactagccggggtgggcggtgaaagtaatgtgaattcgctggtacattgtgcaacccggttgcgattcaaactcaagaatcgcgatattgtcaataaagatcaagttgccgatattcctggcgttgtgaccgtgatggaaagtggcggtcaatttcaagttgtgattggcaatacagtttcagatgtttatcaagcattcaacggcatttcccacttagttgatgacgatcaatcagccgcaccagcggctacagatgagaaagagaccatctttggaaaatttgttgatttggtgtctggattgttcacaccgctacttggggtgatggctggcgcaggtatcttaaaaggcttactttcaattgcgctccagcttaaatgggtagttgccaatacgtcaacctatacaattcttaatgcgattgctgatagtctgttttattttctgccagtattgctggcgattactgcggcgcgtaaatttaaagcgaatacctttgttgctgtcacgattgcaggtactttggtttacccatcaattatcacattagctaatccgggggttcatgctgacctgtttggcatcccgcttgttatggtgaaatacacctcaacggttattccgatcattttagcggtttatgtggctaacaaaattgaaaagtttctaaatgatcacttgcatgaaagtatcaagaacttcatcacgccgatggttgtcttagtcacagttgtgccattgaccttgatggtgtttggaccattcggcgtttatgttgggaatgcgcttgctgctgttttgaccgctatttttaactttagtccgattattgccggtgcgcttatggccactgcatggcagatcctggtcatcttcgggttgcactgggggattgtgccagtcatgctcaataacttagcgacgcttggaaaggatcctttgaagcccggcgttgccatttcagtctttgcacaggccggcgcaacgctgggggttatgctgaaaacgaagaacaagcaatttaaggcattatccgcctcagccgcgatttccgccttgtttggcatcacagaaccagcgatctatggggttactttacgtctcaagcgtccctttatcattgcggtgtcttcagctgcaatcggtggcgggattgccggttttgctggtagtgctggctatgctgctgggccttccagcattctgatgattcccgccttttatggtaaaaccggcgctggatttgtcgggttcttaatcgcgatggttgtcgcattctctaccgccgccattctcacgtatttgattggtttcgaggatgtaccagtcaaggctgattcattggctgcaaacaaagagaagcctcaggttggtgaaccgacaacgacgcatatttttagcccgttaacaggaacgattgtgccactagcggaaattaaagacaaagcatttgcatcaggcgcgctaggcaaaggagtggcaattttaccaacaaagggtgaggtactatcaccggttgacggtaccattaccatggcatttgcgacaggtcatgctattgggttaacggccaatgatggtacagagattctcattcatatcggattggataccgtgaagttaaatggccaatattttactctgaaagttgaacaagaccaaaaggttaaagtcggcgatccgcttgtgacatttgatttggatgcgattaaagcagcagggtatgacattacaacgccagtgattattacaagcatggcgccacatgaggacatgattgaaagtacgcaaacagagattgaaactggagaacgattggcaaccttaatttgagctaaggtcttggatcgtacttgtaggacgaaatcactgaaattaagtgcataggatcggtattacgatcgcctatattcttatgcaaaagttttgactgattgctaattgaggaggatataatcaatgaacgtatttccaaaggactttttatggggcggcgcactagctgcctgtcaagctgaaggcgcttatttgcaggaaggtagcggcatggctgtttctgatatttctttctttgaccctaagttggatcgtgaggatttatcgaagcatcgacatgtgaccacccagaatatcgaagttgcgatggctgatcctggaacaacacgctatcctaagcgacatggcattgatttttaccatcgttatcgcgaggatattgcattgtgtgctgaaatgggatttaaggtgtttcgcttttccattaagtggagtcgtgtctttccaactggtgaagaggcggagccgaatcctgaagcgttggctttttatgatcgagttttgactgaaatcgaacatcatgggatgacgccgctggtcacgatttcacactttgagatgccgttggcgttagtcaatcggtataatggctgggccgatcgccgggttattgatcttttttatcggtatgcggacagcttgtttgaacatttcgggcaacgggtgccttattggatctcattcaacgagattaatgcaggtcgtttttcaacttttaaatcgacaggtgtcgttgaagataagagcgacaactacttgcaagcctgctatcaggcggttcaccatcaatttgttgcagccgcgaaaattaccaaacggttgcatgaagtgaatcctaaagctcaaatgggatgtatgattgcccgctttacaacgtatgcggccaccagcaagcccgaagatgttttgcaaatgatgcatgatgatcaatatgataacttcttttatacagatgtcatggtaagaggtgcttatcctggttatatggggcggtttttccgggagcatcatgttgaaattgtttggggcgatgaagacgagacgctgctaaaacaatatccggctgactatttagccttcagttattatgtgtcgaatgtttcaagcgccgcaccagatgatcttgatgtgaccgattctaatctaaaacagactttgaagaatccatatctggaaagctcggcgtggggatggcaaatcgatcccaagggtttaagatacacactgaataatttgtatgatcgctatcaaataccgcttttcattgtcgagaacggcctcggcgccgaggattccgtgtctgaagatgggcaaatcatcgacacttatcgaattgactatcttcaacggcacattgaacagatgaaggaagccattattgatggcgttgatctcattggctatacaacttggtcgtcgcttgatgttgtatcctcaggaacttctgaaatgtcaaaacgctatggctttatctatgtggatttagatgatgagggtcagggcacgcttaaacgtattcgtaaagcgtcgttttattggtatcgacaagtcattgcgtctaatggcgaagatttggcttttcgggaagcagcggcgcttaaacgttagaaattgaatatcgcctgacattgaagccagttgagtaaggcttgatgtcaggttattttatggctgtttttttggtctgaagcggataactgttacgagttttcgagaaatattaataaagtataagcttaatcgctttccgtgaaggttgttatcaacgtatattggaagcgtcgattctagtttagatcagcaacttttatgtcctcctcaaaggacaaaaacttgtaagcgcttactggcctggctgagataatgatagtggaaggagatgagaccaaatgaccaccgatcttgcgcagtcagtgatccatctactgcaagaccaacaaggtttcttgacttctaatgagctggccagagaacttaaagtttcttctaaaaccattcagcgggttgtgagtcgaatcaacaccgcttatggcaataacatcattacttccgagaaggggcggggatataagctagattacgaacgatttcttctaagtaaattgagcggaaagtcgtcagctgaccattcgctgccagctgaacgacagaagaaaatgctaaagcgattattgctcgcggcaccatcggaacttaaagtcgcacagttagcagaagatttctatgtcagtgaatctgtgattcaaagtgatatcagctctttagagtcgtggctgcaaaggtacgatttaagcgttaaacggattaatcgaaccttgcatattcaaggagaggagaaggacattcgcgatgctttgatggaggcgattctgggtttgagtaaggatacaacgatgaattttcaagcgatgacgcagggcttagcggaacacgatacaacttttgcgctaaaacaagttgatgttgtctcgcaagttttaaaggccgacctaccttatccatacgatgtcaatctgttttcgcatatttacgtgttgatcaatagaattcggaaatttgtcaagctgccaattgaagacgaggacattacccgtctaaaggcaaaagtgcacaactatccggatttgtacagtgtcagcgaaattgtgaagcacaacttggagaattatctgggtgagccagttgcggagaatgaagtttattacctctttcaatatctgatttctgccagatttacgggaagtgatttcaagacaaaggccggcacctcggcttatacgtttgcggaggcgctcatcgataaagtcgctaaggatattcagttgcctgacaatactggggctatggttgaagaacttgttccgcacgtggcgcccatgcttaatcggttggaaaacaatatccgactgccgaatgcgctactcaaagaaattcaggatgaatatcctcgtgtctatcaatcagtgctgttggcgacagcatcactcgccaaagcataccatttgccagagatttcagctgacgaagttggttttctctctctttatatcgccaagtatatggaaagttccaagcgtcctaaaaaagcgctcgtgatttgcacaacagggttaggttcgtccgagctgatcagcgccaagattcgcaaagatttaccggatctggagattttggatattatttcaaatttgaacttggaaaaggctttagccagacatcctgatgttgacattctcattagcacgattaatttgccaaagcaaaagcacattccacaagtattagtgagcgcgatgttcacagttcaggataaaaacaaggttgaagaggcgttgaggaggcggcaagatgactagcttcaaagcgattcaattaattccaattttagacttgccagccgaggtatcgccgactaaattggcttgtctcgatgcgatatcgaccacgttagctgacgtatcggggaaggacaagggtcaaatcaagactgcatttttggaacgagaggctgttggtaatacggcgctagaatcgggtgttgttattccccatgcagtcttggtaggacgtcaggcgccctttcttggcatcctgtgctgtcccgacggcattagtgattggcaagatttggatagtcatgccgtgaggctggttttagccattctgttaggacgagacggcctgacgtcacaagaaggcgatgctattaaggtattatttgaagcactggcatcacctcaatttttggacacacttgcacaagcgtctgaaccgcaagcggttatgacaacaatcaaaaacaaattggaggacaactaatatgttagtatctggagatcgtcttttacaagtagctaaggaacatcactttgccatcccggccttcaatgcggggtcaggacaacttttcacggcaacattagagaaggcagaagaactgcaggcaccctttattatggctattcatcctactgaactcgagtttttgcgggatagttttgtggcgcaggtgattgatgcggctaaccatactgatctgccgattgcattgcatttggaccatggcgcttcatatgaacaagtgattcatgccatccatctgggcttcacaagcgtcatgattgatgcttcactaaccgattatgagcaaaatgttgcgctaactaaaaaagtggttgaagccgcccatgcgacaggcgtttcggttgaagctgaattaggaacgattgcagatacgggaaatgatgttgaaggtcatttaacggataacgtcaaatacaccgacccagaaactgcaaaagaattcgtcgcggcaactggtattgattcattggcaattgcgattgggacggcccatggtttataccccaaagatgttaaacctaaactcaaaccagaaattgcaaaagcagttgcggaagcggtagacattccgctggtattacatggtgcatccgataatccggatgacaagattgcccaggcaattgagtatgggattaataagatcaatatttcaagcgacattaagattgcgtttgccaaggatttgcggaccgtccttaatgaaaatgaccctgacgagattcgtgagccaaaagtgcttttcccttcaccgatgatcgccacccagaaggttgttgcccagaagatcaagttgtttggggatgtagaccggacaaaactctactatcagcacgaaccggttaacgaaattccctatgatatcaagaatctccaagttgaacatttcagcgcttaatgcaacttgagggaagggggcttaattgatggaacagcttgaggaagttcttgatccaaggttgatcagactcaatttgcaggcaagctctaagcgtgatgcgattacgcaattatcagagacgctcgaggctgcagattatattaacgatgtccccgccttcgtcaaagatatttatttgcgggaagaagagggcatcaccggaattggcgacgggattgcgattccccatggcaagagtgattacgtcaccaaggtgggtgtggcgattggcattttaaataaaccaattgcatgggaaacattggatggcgaaggggtgaatattgttatcctctttgcggtaagcaatgatactgaatctgcgcgcaatcaattgaagttattatcgttgtttgcggcacaactgggacatgatgacgtcgttaagaggctaaagcacgctgctacgcctgatgcagtcattgcagcgttcactcagaaagaaggttcggaacaatgaagattgtcggtatttctgcatgtgcagctggcatcgcccacacttacattgcaaaggaaaaaattctgcaggcggctaaggatgccggggacacggcctatgtagaaacgcaaggaacgattggcactgaagatgccttaacctcggaacaaattagtcaggcagatattgtcttgctggccattgatgtcaagatagccgggcgtgaacgatttgcgggtaaaaaagtcgttgaagtgccaactgatgttgcaattaaaagtcccaaaaagcttatcgctaaacttcacgagctttctgggcagcccagttaagcgaggtgggtaagatgaaaaagattcaaattaagcaaccggcattgaccgcaatttcgtatttgattccggttgttgttgcaggtgggttcttgctggcaattggcaatattatgggtggtaagaatttagaagcagtcaaaggcatcgcgaatgtctgggatgccttttcaacaatgggcggcttgatcttggggatgttgccagttgttgtttctacaggggttgcctttgcaattgctgacaagccggggattgcaccgggatttctggttgggcttatatcgcgcattattggtgcagggtttctgggtggcttgattggtggtcacattgccggttggtcagcattgctcatcattgcctacgtgaaagtaccgaagtgggcagcaggtttaatgccgacgctgatcattccttttttagcgtcagtgattgccggattcttcatgttctatattttgggtgggccaatcgctgcagggacagtttggctcactgggtacatgaagacattggatacaagtcaaaagtttctgtatggcttaattattggtatcttggcgtcaattgattatggcggggcaattaataaaacagtctttgcatttgttcttgccttgcaggctgaagggattaatgaaccgattacggttttaattcttgcgtcaatggtaacgccaatgggttatacgttggcctacttcttgggtaaagcggttcacaagaatatctacacaccattggaagttgagacactcaagacagcttttccgatggggctggtagagattaccgaaggcagtttgccgatcgtgttgaacgatctttggcgaagcgttgtcgcaactggtgccggtggtgcgattggcggcggtttctcgatgttatggggagcagattcaaagattcctgctagtggtttgtttgcagttccgacaatgtcgcgaccgtgggcatttattatcgcactcatcattggcagtgttgtgaccgcagttgtctatctggtgctaaagaagccagtttcagctgaagacttggcaacggagaaggaagaagaagacctcaatctcaaggatttgaagatttccgattaagcttaatcaaggagaatggaccatatggaaagtagtctgtttgtaggtaatccgctccaaacatcaggtgcacagacaatccaatttttagaaggtaaagcagctggtttgaaaatgattcgaatgtacaacgaagcgggtctcagcatgctcgttgcgccggatcgcggcatggatataccagagctgaaagttcatgggaccaatatctccttcgtctcggtgactggtttcgtcaacagcacgtattttgtggagcagggcgcaactggattcatgcggaacttcaatgtcggctttttgacgactggtggtctcagttatatgggcgcccccaaggatccagcccgagggctacatggaacgattggcaatacgccggctgaaaacttctatcatcaggataacggtcaggccattgtggctcagggggatgtaagagaagcggagatgttcggggttaatctcttattgaagcgtcgcatcacgctaccaaaagcccaaacgagtatttatctgcatgacatcgtcgtcaatgaaggcagtcgtccagcacctttaatgatgttatatcacatgaacttcgggtatccattctttggtcctgaaacccagctggtgctcgatccgcttgtaacaacagatcgagacggactgccggcaaccgactggaagacattctcattgcccaaagcaaaaactgaagagcgcgtttatttccacagctttaaacctgatttcgacgatatggtgcagtataagctgttaagtcccgagacggggttgcaggcaactatttctgttcaatcatcgttgttgtcggtattaaatgaatggaaacttatgcagacaaagaattatgttctgggtttagagccggcaactaacaatgttaatggcattgaagctgccgagcgtgctggaacattgaagaaacttgctccggatgagcaagcaacatttgatttgcgggttgatttttcaaggatggaggtctgagcttcaatgaagcgatcaaggatcaatcagattttaaaggaaagcgaaagattcctcaggcagcgtcaagttgttcttcccccttttggtcagtggcaaccagctgactggggagatctggatacttcttatgcagaaatcaaggataatatgcttgggtgggatgtcacggatttcggaaccggtgatttcgacaaatacggcttggttgcttttacatttagaaatggcaactatgcggaaccagaaaagtatccgaagccttattgcgaaaaagtcttgttgttgaatgaaggtcaggagttaccttatcattttcatcgactgaaagaggaagatacaatcaaccgcggcggcggcaatttgcaaatcacggtgtggcattcaactgaggatgaaggattggatcgcacaacgccggtagaattggttaaagatggtcacaagcttgtcttggatcctggtacagtggtgacgctccatccaggagaaagcctgacaacaacaacaggtatttaccataagtgggaagtagagcccggcacaggtgaagtcttggtttgggaagtctcctctacgaatgatgacaacatcgacaatcgatttttacgtgatactccgcgagttcctgaaattgaagaagatgaagagccgtatcggttgttgttcggagattatcgaaaattgtagttaattttagcctgaagacgtcacaatcttcaggctttttcaaatcaatatgctaaaattctttggcatgtagcgaagagcctagggaggtaaatgatggcaaacgatgtggttttgggaatagatttgggcacaagtgccgttaaaattttggcgctttgtaaggatgggcgcctttatacccattcggagccgctccaattgattcatccgcaaaatggctataacgaacaggacccagaagactgggtcttgcagacttataaagcaattcggattattgtgcaggaaaattcaatttcgcctgaagctattcgtgctgtcagtttttcaggccaaatgcacggcttagttgcgttaggggcggagcatcaggctttaagaaatgccattttatggaatgatacccgagcggctgaagaagttaatgaaattcatagtgatctgggagaagcatatattaaagtcaccggcaatcgagccgttgaagggtatgttttaccaaagtttttatggctgcagcgacatgaacctgatgtttggaatcagatacgggcaattattttacccaaggactttctgcgattaagaatgaccgggaaactaggaactgattattcagatgcaactggaacgggctattttgatattcagaaaggcacttggagtcaggaaattttgacacattttgggattccgcttgagtggatgccaccggtgatatcgtccgggacgattgttggcgccttaggtgtagaagctgcaatggctaccggattatcaacggatacgatggtcacaatgggcggtgcagacaatgccatgggcgctatcggagctggtgttcttcatcctgatcagatgatgtctagtattgggacttcaggcgtcattttacatcctgaagaccatctgccacagaactatggtggtcaactccagctggaacgacatgctattcagtcacgttattattcgatgggcgtgaccttggctgccggcaattcgctgagttggtttagagatacgttcgctaaagacaagacttttgaagacttgattgacgtggcacgtcgctcaacaattggtgctaatggtgttcgctttgcgccgtatctttcaggagagagaacgccttactttgatccgcacattcgtggtgcctttacagatatttcaaatgcaaatacatttgacgattttgcgcgagcggtgctggaaggcattgtgttttcacttaatgatgtcattaacttgtatagcaagtttggtattttaccgaaggaagtgatcgctatcggtggtggtgcaaaaaatgccttttgggcacaaatgcaagcagatatttttaaagtaccaattaaaattcccaaggttgatgaagggcctggatttggcgctgccatgatagcatcggttgcggctggttggtttagaaatgtcgaggaagcgattaagactttggtgttttacccatatgtctatgtacctgttgagaatcaatcatctagatatgaaattgtttatgaatcatatcatcaattatatgcccgactaaaataaggcatttgattctcaagaacgtttaattggccagaaatcatggaagtcaatccgaagagaaatatgtttggattttgactgcgtgatggagacatcgcctagattagtgattttaactgggatcttcagcctttgtcttggacataaagaaaccctctaatcttcttggtaatccaagcatagatagagggtttcggtaattttatgcagcaacggaatgttctaagggctgtctgcgagctgctataatgatgtcgatagctgaaatttcaaattgatttttaatcctgaacagcagcatcactaggttcaaggttccatccattttctttaagataatcatctaatttttcgcggacatcctggacacctaggccgattatgatctggatgtgcttatgcttgtctacgacacctgaggacggataggtcttcaaggttgcaatatcaactttatcggcgtctttaacgtcaattcgcaatcgagtgaaacaattatttacattttcaatgttgttgatacctccaaggccttttacgattactgcgagatcagaagcgggcttaggtgctgctggtgatctcttttcttggacagctcctttggcagttttttttgttaattcatctggaattaattcgttttcgccatttcgtccaagagtggggatattaagcttaataatcagtgccttaaacacaaagtattcaagaagcgctagtccgagtccaatcggtataagaagccactgccttcctaagccgaatggaaccgcaatactatacatgatggtattgatgatgttttcaaccatcacatttaagcccaatacgttggaaataaatagtccgaaaccatagatgatcccatgcgctaaccacagaattggtgaaatgaaaaggaagagaaactcaatgggttccgtaataccggcgaatgcagaggcaaagaccgctggaatcaggattgctcgtagcttaacgcggttttccggtttagctgtgtgaatcaatgcgaatgcaataccaattggtagggcaatataaccgaaattgactagatagccaacagaggaatgaattgaggtgacggacgacatattaccgatctcagcgagccagatattcattgccccattgtacgtttttcctgcaacctgtgccgttccaccaagtggagtgtaataaagtggcatccacaggaggtgatgcatgccgactggcagtagcattctgtttaggaaaccataaaggaagaagccaaacgcgcccataccagatagacctccgacaatggcgttgaccgcgccattaattggtggccaaatatatgaaactgcgatggcgaagatgatggtcaaaaagatcagtactacatatgcaaatttggttccttcatagggtgatagatatttgtgaaatttgacatcccctaatttattgacaaagaagccgactaggcagcccaagatgatacccagaaaaacccccatgtcggtaacttgaacaccgaggacaatgttttgcccagtgccgaatagtccttgtttacccgctttggcaagttgaccagtttgggacaaccaaaagttattagcatagatgaagatcaaaaagacagtgattcctaatatagcggcatccgtcttcttcttttttgcaattgctgctgcaataccaacgcagaagatgactgataattgattgatggccgcgctggttagaattgtaaataaacccgtccccacatttttgataccttcaggtaattgttcaagcttcataacagcggcaactgaaatcaagagtccggtgacggccataaacatgacaggttgaatgatagaacgggcaaatgtttgagtgattttttgcaatttgtccttcataccggttcctcctccagaggttgatcctgggtgactaaatcgcgataggtaccaagcttgacaccctcagcagccaaccttgctttaagttcgggcttgataagctcgcgaagggtataagtgcggccggtcgtaaaactagaatgttcggtcagatctgcatcaacatatcctgggtgacacatggcttccacactgccaaaggttttgacgtcttcgattaagttgtgaagcggcatcggctgccaaatcggtttgcaaaccccaatttgatcgagagcatcattaaatcgtttgatcgttacaattcccggcgatacgttataatttccgcgaacgggtaattcgtaatcagtggcaagttgttcgaatacttccgttacaccatttagagtatggacgtgatgatggctatccaaatgatcaggcgtaataccgctggcgatcacacgatcaatttgggctttccactctcgataaagctcattttggttaatttcaaaatggtcttcatagaagcttagtcgtttgaattcaccgttgctggtggttagagagggcacatcttgtaaaagtggtttgccacaggttagggtgaggtgaacgccaatacccagggatggcgtttgaattgccagtctaacagccctttcaaaaccaggcattccagccattattgtggtcgatgttagaacgccttttttatgggcatcaaggatacctaaagtaatcccgctgccgtacccaaaatcgtcagcattaataattaacagacgcataggtcggacctccttttagttcaacccattgatcaccatttgccttaatcatttcgtccaatgcttgtttggcgactgttgcatttggcactgtttggttaagggtgaaagcttgaaaggctttttgataagaatgttcaaagaaggcatcaacgagtaatttttctgcagcaacttgtgcttccatcagacccttgtgaaaatcgggaatcggatcacgtaacgagatcggttcgacacccttagcattgacatagcaaggaacttcaacaactgcatcttcgcgcacgtttggaatcgcgcctctatttggaacgatgagcatgaagcgatcattgcgactatgcagaattgaaattgccattcggacaatgtactgaccatgaacgccgctttggtaattgatggtttctagatcacgtttttccttgatttttgaaacggtatcagtaatctgctttagtcggccgtccataatctcatttgcacgcgtgtaatcgggattcgcttcttctacgattttgttgggatagaggtagtattcaagatagttgttaggcagatactgaggaaagtcttgttgcatctcagccatcagctggtacgtttttgcccacgatggatcaagatcggaagttttaaacccttgcgtgataatcttttcaatgatttctggcatgatatctttaccgcgttgaacatcgtatatttcgcggtaccaaccaaaatggtttaaaccataataggtcgaaatgaagttttgcctatcatagccaaacgagttttcaagcaattcttcaatgccaatggtcatatcacaagcattaatgatctttgcttttggaaaacgccggcgcaccgtttcagcgataattgattcggggttggtgtaatttaagatccatgcatcaggtgcatactcttggatgaatccgactagttcaacaaaacttttcatggaacgcatcccataggcaaagccgccgagtccgcaggtttcttggccgactaacccaagcttgagtgggattttttcatccatttcgcgcattttcatgccaccagctcgaatctgagagaagacaaagttgcagccgtaaaaagcaacttgcggatctgaagtcgcaatcagttcgacatccacgttttctcggtgtaacaggtaatccatgataattcgcatttgttcattacgttcttcatcaatgtcatacaggcgaatttccttaattgggaattcatccttatagctcaaggcagttagcagaattcccggagtgtacccgcttcctgaaccagcaatcgtaatgatattcttcatcctaaacctccatttaagttgatcagtgacttgacactctaagttaaccatgtaaccgtttacatttgaacagtgtataatcataatgactggttgttcactaaattgaaaaaaagtgtcattaaatggaaaattatgtcaacagggaggtgctttctgatgttacgtcttttttcttcgcgtattcagcaagcaaaagttacactgactcataatgaaactgaactactgaggtcgcttagtgctcaggctggcgtgattcctagagcgactattacggaattggcacagtccgtttttagttcgccatcaaccatacatcgactaattcggaaactcggcttcaaaggttacacagactttaaagtgcgtgttgaagactcgcttgaaagtgaattgcccttggttcttgcgcaacctaatttgctaaagatcactataagctcaatcgagcatacgttcagacttaatcaaggcgtgattagagatgccgcaaggctgtttttggcagctgagcgccattatgtctatggaaccggctggcgacaaaaacaggccgtggataacttctccacggacctgcttgtttatggtgaaagcagcattacattacgcaataaatacgatttaggtaatgcggtcaagcaaatgaatgagcatagtgtattgctgttcacatcgctctccggtaatacggatgagtatgccgccacgcttcagcaagcaaagcttcaaaaggtatcaatcatttcggtcaccagagatgtttctaaccccttgagtgagatcagcgatgtagccatttactttgcggatgacaccaatcttcaagataatcggcattggccggcaataacgatgtctttttctttagaaatgttaataaatgagattttaaattttcaacatgaatgaatactataacctgaactttattggatgtgcgaaagtggaataagttttgagggcggctctgggactccttatcttaataagggtttccaaaaccgtcatttttattaggtgtgagttagagtaatgaagtttaatttgcaacgatggaaacagagtttattaaattagataccaataattgaaagcggcacatttgatgaatagcagagtactaggaactggatttttacttgctctacatgtgctttatataatccggcaagaagaccttatttaattggagtgagcggcaaatatcaatatctataggtttgcggaagagctgagcgaaaagcgatgacaaatgctgagaatataatggcatcaattttacatgtcacacctcagtgacaaaatcataattaagtttgaaagcggaatcatttaatataaagactgtaaagaagaaagcgaggacagagaccatgccgatgttcacaaaagataatatgatcatggaacttcatggagataatcagaaagaaatattggaagcactagcagcaaaggcttatcaacttggcgctgttaaagatgcagagacattggttgcggattacctggcgcgggaagaagagtcgacaacgggatttgggaacggtgttgcaattccgcattcaaagtcggacaacaacctgaaagcaaccattatttttggtagaagtaaacaagcgattgagtggcaatctttagacgggcaacctgcaaatacctttattagtttaattgtgccagcgtctgaagcgggtgttcatttgcagctgctagcaaaactcagtcgtcagttagttcatcctgattttgttgatgtgttgaagaaaggcagtcaagatgaggtctttgacgtaatccagaaggcaattaattagaagagggtcacgtactcatcacgagttatgattgaatgttttcgttagttttgaatcgaggaggaaaagatgatggcaaagctgaagatagtaggtgtaacgaattgtcccgctggaattgctcacacttacatggtcgccgaagcaattgagcaaaaggcaaaagcgcttggctatgaagtacatgttgaaactcaaggcgctaatggaattgaaaataagcttacaccagcagaaattgcggctgctgattacgttatcctggccttggggaaaggtatgagtgatgaagacaaagctcgttttaatgggaagcaggttatcgaacttcctgtttctgaagcattgaaaaagatcaatgtcatttttgataatctacacgatgaagcgcatttgtacacggcatctaaggttcaattgggcgatcgtaaacaaacaactggtatcatgagccacttaatggccggtgtttcggcagcattgccgtttgttattggcggtggactattgatggcacttgggagcttaatggtccaatttggtgctcctaatgtcgcacctaaagccggccaaatggcttccttggcttgggttcttaatactgttggtggtttaggctttacaatgatgatcccaattatgggtgcttatattgcttattcaattggtgataaacctgctttggctcctgcatttctggtgacttaccttgcaaacactccagatatcttgggaactcaaggcggtgccggtttcttgggtgcaattgttattgggctgagtgttggttattttgtcaaagctttcagaaaagtcaaattagggaagacattccaatcgactttgggttttctaattattccgttcgtgacgctattgctctttggcctcgtgacctattatctcttgggacctggtatggcgtggttgatggctgctttgctgagcttcctgcgcagtattccaccggaaatgaagattgctggtgggttcttagtcggcgcaatgttggcatttgatatgggtggcccgattaacaagacggcttggttcttcgggttctccttgttgagttctcatgtttatacctggtatggaattgcgggtgttgtcacggtgttgcctccgatggctgcggcgattgcaacatggttacggccgggtctgttcaccaagcaagagcgtgaatctagctggccttctatgcttgtcggaatgaccgttgcaacggagcctgcaattccatacgctttagcagcgccagtacctatgattacagcaaatacacttgctggcgggattgccggagctgtctcaatgggactgggcgttgaaagattagcaccgggtctgggtgttttcgatccgctaattggattatcacgacctgcatgggcttattacattgcactagcggtaggcttgatcttgaacgttctgtttgtgattgtcttcaaatcggcatggttgaaacggcaggaacgtaaaaatgggcttgtgagtttggatgatcagccacaaagtaccgttattgcaggcgacacaaatgtttcaaagccagcagcaaaaggtgttcaggcaacaaagacattgtcacccgatgctgccaagaaatagttagcaaactagggatggtgcaggggcttaggcttctgtgcctttttagaaagaagcgattaaattgacaacttatgactttgatcatgttatcgatcgccggggtacgtttagcactcaatgggattatattgctgataggtttggccgtaacgatatcctgcccttttcgatctcggatacagattttccagtaccagttgaagtgcaagatgcgctaaaagaacggttaacacatccaatttatggctatacgcggtggaatcatgctacttacaaagacagtattgttcgctggttcgagcgtgatggtcatacaaagataaacccggattggattgtttatagccctagcgttgtttttacgattgctacgctcattcgaatgaagagcgatcccggggacggagtggctgtgtttacacctatgtatgatgccttctatggtacgattgaacagaacgatcgagtgttgatcccgattcgattagcagctgcagatgaaggctatgtgattgattgggatagtttggcaacggtacttgctgaaaagcaaacaaaaatatttttattaacaaatccgcataatccgacaggatatgtttttacaaaatcggaattagcgcgaatttataacttgtgtcaggctgcccatgtgtttttgatctctgatgatattcatcgtgatattgtttatccaggtcattcgtacgaaccaatgacaaatgtcggcacaagtgatgttgcactctgctgctcagggtcaaaaacgtttaacacaccaggcctgattggctcatatgctttcttacccgatcatgatgtaaggacacaatttttgacggaattaaagcagaaaaatgctttgtcttctgtaagcatctttggcatgttggcgcaaattgcggcttataacggttcagaggattacgtggaacaactgactgcctatacaaaaaataatatggagttggttgctagttatttagaggaaaatttgccggaattgcagttttcgttaccggatgccacgtacttagcctggataaatgtgtctaaactgggattaacatcagaggaacttcaacatcggttagtaaacggcggccatgttggcattatggcgggcaaaacttatggtgataccagatatctaaggatgaatattgcctgtccaaagaagaagttagtgatggggctagaacgtttaaagaagggaattaggggataatatgctcttactcagagaaatcaaagtcttacgccgcctgtcccaacaagatttctctgggggcgagctggctaaacaactaaaggcatctcgtcgaaccattgtccgtgatattgccgcaattaatactgagttgcagtcttcaggcattgggatgattacaacccaaaacaagtaccatctcaccatccttaatcctggtcgattaatggctttgttagatacaagtcgcgatgaagctaatgaaattctcttacggttgtgtatctccgaaacgattccaatggccgacttgattgctgagacttatttatcacggacccaaatcatggattacatctccgagctaaatgcggattacgcggatatttttcgcataagtagtcgcccaggaatgggaatgaccatcaagatgaaacggttaacgcgaattgacattgctgctgactgtatctttgaatatccacaattgttggataaagttgcaccgggtactgaccgcttgccgcaactgacagattatttaagcgagaatatttgtccttaccagacatgggtaatcgacagtcagtggcgtgcacaagtgcttgcagcctttatttgctcaccgtcttcggggacattgacggcagcaagacagtctaatcaaatcgataattttgtaaagacacgtgaagcactgttaatgggtttaggaaagagtcgggacaagattgttcaaatgtttagtgagattgcagatgacttccagttagaagcgattggtcaatcaacttttgagtcactattcacacattttgttcgcgagtgtgcttttcctaggccactgagtgttttaagtgactatgatattgccaagttgtctgcccagaacccagtagcttttgattatgctcatgttgttgcactcgatttgtttaagatcagtcatcaagtttggctggattcagactttttagccttgtatattgtccaagcagttaatcaaagagaggcaaaacccgtcaggatcctttttttggcaccgcgaatgtccttggctcaaattaatgcgacaattatccagcaaaagctgcataatatttctttgcatatggtacgcagccttaaggaagccgaaacaattttcgaccagcgccactttgacttagctattgcaaatgtgcgccatgatgttgttgagcatgcctcaattagttttgtgttaactttttcggcagttgttactgatcaagatatagctgcgcttgagcagttggtcaatggccaatattatcgagagaacattgcagccatgcttgcccccaatcattttgttggccaaattacaggggataagtttctaacagttttacagaaaggacttcagaactttgtcagaaatgatctcttagatcgagcggatgctgtaaagattattgaacgtgaacaagctggcaatcagctggtcttaaatcatatctcgatcccacatattgttacgaatagcgtgactgattatcgcttgtttgccattaaaccaaaagaggtcattacaattgatgaccaaccaatatacttgttggttattgtgttggtcggaacatctcaggctgaaaagaatacaatcttcagctatttatatcaaacattgcgaagatacgtaccggctgatattgaagatgttcaggattatcagcaggtgattaaattgctgaaaggtagcgtgtaaactttataaaataggcttttactccgggagttagaaacaaacatcggggcataaaaagtgcatgttggtctagttttccaccaacatgcactttttatgtgttgtcttaactgtgtcattgcaaatttattttttattcgagacttccttgtttaagcaacttttgacctaatgcgccgcctgggtgatataaggcaaagtctgaagcagtgaatccttttaaccttgagattgtgcaggcaagcgcatcaccgaccattagcgcagcagttgaactgcttgtaggtgcgagtcccaagtcatcagcctcatgggtaactgggatggttaagacgctttcacaagcttgggctaagtgggagtcatcctgtcctgtaaaggcaacggtcgcggctccgatacgtttgagtgagggaagcggcgcaagtgtttctttggtttcgccgctattcgaaataaggatcactaaatcttccgaggtaatcatacccatgtcaccgtgcattgcctctgtggcatgaacaaaaatagcgggcgttcccaaacttgcaaatgtggcagcaagtttaacgccaatatgaccagtcttaccgacacccatgaaaactaatcgaccagttaaatgcataattttatcgatcactgaacaatactgcacgtcattaatttgagattcgatcagttgcattgcggcaatttctcgctgcatataagtatgcaccaagtctagcttgttttctttcattctgatgacctccttgcgtcaccatcattgttgactgggttatgctcaatagcaattgttgttgttagttctttttgttgaccaactcacataaatgaaaggtctttatacgctttgatattcagaaaagcgatgtggtggcagcgctttctaaaagtgatcagagacattgttgatattgtgagaagacaaacaaaaggtgcaatcgaatccagttgaagcatgggcagttagcgcttacatttgatatgtagaaacgaagaaggtgaattcagaatgattgaagatattatcacaattccgctcattcagctgagagtaaaaacgactgactggcgtgatgccattaaaaagtccggacgtgttttggttgaaaatggtgatgtgacacaaaattatgttgaggaaattatccgttcggcagagaagtttggcccgtatttcgtcattgcgccgcatgttgcattagcacatgcacctcgtcaagcgggcgcaaggaaattagctatgggcataaccacactggatccgcacatcgttttccacaatcaggcaaatgatcctgttcgatatgtgtttacattaagcgcaacagatgctgacacacatcttaaggcgatgcaagaatttgtccaattactttcaatgggcgacttttatactacccttgatcgagcaggatctggtcaggaaattatggcgtatattaaatcagctttggcaatgaataaggagtgatcatgatggttaaagtattagttgcatgtcgtgcaggggttggatccagcttaatgttaaagatcaagttaaatgaggttatctctgagcataagtggaacttagaagttattcattcgtcactggatgaattaagtagttttgacggaccaattgttgtgacactaagtgatgtcgcagaggaattaaaagaagaagggatccataaagaaattgtcggtatcaggaatctactagataaaaatgaaatttatacaaaggtctcaaaagcattacaagatgttggcgttaattagcggcgttaagatgggggatcaattatgaagttcttagttagtctgctttccacaccagcaatgcttttggctgttgtttcgatgataggtttaatttcacagcggaaaaatccaaccgaggttttcactggtactgctaaaacagcaattggttttttaatctttggaattggtgccactacgatgactggcacactgcaaaatttcaacaagctttttacagaagggtttcatatcaatggggttattgcttcacctgaagctgcgactgcccttgcccaagacaagtttggttttgctgtgtcgatgaccttgattattggcttcatcatgaacctagtgtttgcccgtattacaccatttaaaaacgtgtttttcaccggtggacatagtctcttttttgcttgtgtgcttgccttggtgatgaaggcaaatgggttcaataatacgtggacaattgttgttggagggacgatattaggcttttgttctgcagctttaccacaattatgtcagccgtttatgcgaaaaattaccggtggagactttcaagcaatcggacattttaacatgtttggttatgcactttccggcttgcttggcaacttttttaaaaaacatgttgatgatacaacagaaaacattaagttccctaaagcgttgtctttcttcaaagattttctgatgggctttgcttttgtaatgctgattttattctatattgccgcgattgctgctggaaaaccagctgtcatgaagatctctggtggcgttgattggttagtctttccgctcattcaggcactgacatgtactgctgggatctcggttttgatgactggtgttcggatgtttctagctgaaatcactgccgcattcaacgcttttgcggagaaatttattccaggatcgcgaccggcacttgatgtcccaacgatttttccgtttgcaccaactgcggttcttgtaggcttcttaagctcttatgcagcaggactgattggtgttggcatcatgattgcctttcacttcgatatggttatcatcccggcagcacatatctgtttcttctctggcggaaccgctgcgatttttggcaattctacaggaggatggcgtggggcagttttcggctcattcatcgttggcctgttacttgttttcttaccggtgttactatatcctgcaatttcaagtatgggtgtttcaacggctatgttcccgaatgttgattataacgtggtaggctccttactcaatagcattttaggcctgtttcattagtgccagttgattagtgaatgagaagagggataaacaaaatggcacctttatcaggtatcttagttgcgatggtaacacctttagacgatgatcaggaaatcagctttaaaagaacagatcggttgttggatcgtttattaactgaagagattgcgggcattttcattttaggaacaaatggtgaggcttacgtcttagcggagaatgaaaagttggcatttgcagaacatgttatcgactatgtccatggtcgaaccaaagtacttgtaggaacaggtttgaacggaacagcggaaaccattcgcttcagtcaaaagatagcatctttaaaaccagacgcaattaccttggttgctccttcatttgttgctccctcgcagcaggaacttgttgatcattttgctgccataatccacgcggttgatatacctgttctactgtacaatatgccagcaaaaacgggcattaacattgagcctgcctcattaaaacagttgtcaaaatataagaacttaatcggtataaaagatagctcgggaaagtgggagaattttgacggttatctagccaatcgccccgaacggccattctcagttattatgggctctgacggtcgcattcttgaaagctttcagcacggcggtaatgcggctattgcaagtacagccaatctcctgacggctaacaatgtagcgttgtatcacgcatttgttaatgacaatattgaaaaagcccagaaatttcaggatcggattcaggcccttagaagtgtcttgcataaagcgacgatacccgtatcgcttaagacagcactcaatattgcaggtattacggtcggaccagcaagactgcctgcaaagatgccacgagaacaggatgcgttataccaagagattggtgatgtgatcaaggaatatgaacttcagggcattatttagcaaaggagaacgcattgaaaaaatttgacttaatccaaagaattctagctagtggcgcgcttgcagttgtacgcgcaaagccaaagcgagtgttggaaattgcagaaggtattgttggcggcggcattcccgtaatggaaattagttatactaactcggatgcgccagaagcaatagatcttgtgcatcaacgtttgggtgacagaattctggttggcgcggggactgtgaacaatggtgcgactgcaaaggatgctatttcgcacggtgtaggctttttatactcccctatctttgatcaggaggtcatgagcttagcaaacgaatatcagattccttacgcaccaggctgctcaactgttaccgaagcggtgcacgccatgagagcaggggcaacgttcattaaatactttccttatggtggattattggggccggatattattaagacaatcaagacgccaattcccgagatgccattgttagaatcaggtggtgttgatgctagcaatgtccagcagtggtttaaggcaggggtcgaggttgtaggcattggcagtgccttatcaaaaggtactagtcaggaaatcgaagcaagtgcacaggctattcgccaagaaattgacgcgtttcggtcggcagctaaataaagcgttagggctaggcaaaattggcttagcctttttcgcattaggaaaggaggaagaatggatgcttgatataaagcaattacaaatcatcgacacaatgattcagaatcctattttgactaagactagattaagcgaggaactcgactttacaaatcgtcaaatagattatgcaatcgaaaagctgaaccagcagcttgtagataacaaaatgccgcagattgatgttgatggcgcatatattaatgtcccgagtgagtcgtatcaatacttactgaatttacgcgcctctgaaaatctgacagcactctccggttatgttctaagcaactcagaacgccaattgtttcttgcactgctattggcttgccataaagggtatttagcgcttatacatcttcaagattacttgcaggtaagtcagtcgaccatatccaaggatcttagagtgctggagcaacgactcctgaactttcagcttagaattcattatgatcgtcgttcgggctacaggctagaaggctctgaggataagatacgaagctttatgattaagttagtttctaaacagttgtttaaaaaccatgctgatttgttaacgacatgtgctcaattgattcagcaggttgatgtcagtgccaaactgacgcaaatttcaaagctggctcatgccagcgaaattgattttgtggaaaatcgttttcttgaatttggctatatctttatctttatgttggcgcggttgcggattaagaaggattatttacctgctcgggcacaaaagatgaatatacagagcactcgggaatatgagcttgctgaatctttgttgaacaacgaaggcattcataatattaccgcaacagagtatctaacaacgattattttatgtcttagcattggtggcttagagaatatgcgggcagatcgcaacatcttttcggttaccaatcaatttgtccagaggttttcagacgtttctgggatcgtctttgcagataatcataaggttactagacaaatgttcactcattttagatcaatgtattatcgattacagtttgggtatcctattacgaatcccttaacggaacaggtgatcgaaaattatggggaagttttcaccttagttgctcaagctatccaaacgtttgaggacatccttggcaaagtgcctgatgatgagattgcgtttttgacgattcacctgattagctttatctacacaagtgataactcgaagaatgattatgtaacagccgtcattgtttgtcctaatggcattggtagttcggccttagcctatctgcaattaaccagtttgtttcctaatataaaatttctgaaaccttttcgttatgcagatttggatagtcacttagctgacgcagacttgatcttttcaacattttataggagcgagctttttgctaaaggtaaaccatgtttcattatcaagccgatcatgtcagctgaggaaaaatataatcttattcaggaagtcaacactcgaatgtcatcaagcacattgactatccccacgttaaactccgtgatggaaattgtcgcacgaactgtcaagaatactaagcagttaggacagattcgcagagaactggatgttaacttgtttaagccaaaagttcaccaagaaaacatgaagcttacgttgattgatgttttagaagaggaagatattcaattgggcgtcaaagtcgatacgcctgaagaagccattcggattgctgccaagccattgaaggccaaaggtgcaatcaatcagcactatgttgaaaagatgatatctcctgatgatgggcattctttagacgcttatattatttcaccgggcgttgcactgccgcatacagatcctaaaaatggtgcacaaagagtcgctataggtataacgactttagagaaacccgttttctttagccaagcaaaaagcgaaaaagtaaaattcatctttgtgttaagcgcggttaaccctactgaccacttgatggtgttacaagatttaatggatttgttgggcgatgccaattttatgaaactgttagcagataagaagacagattcgcgaaaggtaatgcagtatttacgtgaaaagaaagtaaaacagagttgatgagcgcgactgttgtactaaaactttatccattccgccatcccctcaataaccggcttcaccgtctcaccacgagctgtcaaccgataaacagtagtcagaggttcttgcgagagaatctctttttgaattaggccatcagtgcatagtgccgcgagttggcgagctaacatgcgagttgaacaaggtggaatgctggcgtttagttcaccgaagtgccacttagcttgttgggtgaagcggtacagaatgattgctttccatttgccggagatggcttgtagtagctgggttgctggacatttttttgcggtggtcgatgtgcaagctggcatttaaagacggctcctttcgatactagtgacaaaaagtgcagtattgtggcgatgtgtcagtcattataccattaacgaaacacaggaaacgattgacctgtgacgatgcttagtctcttattgaaaggatgtttttcagtgaattcgattgccccttattatcagcggcactctactcggttgtttactgaccaaccagtaccgcgagaaacgcttacggaagttattcgaacggctaatcatgcaccttcatgggaaaactcacagccgtggaaggtttacctggcgattggcaagacagcaaatgccattcgggccgagcattttaaggctgttcaggctcatcggaaaagttggactgaggtgacgccgccgcttgcttggcaaaaaacagcgcaggcaaatattgatcattggcaagcctccacagctaatttcttcaatgaaaccgaagcacatgcatttcatcaggcggggccgatgctttatcgtgctccggcgttaatttatttaaccatcccgcgggctgcttcggcgtattcagcttatgatgcaggtgcgtttggttatggggtacttttggctgctgctgcgaatgggcttgggtcaatacctgcttatgagatcattcgttatcccgaagaaattcacgcgcattttgatattccggatgatgaggtcttgttgatgggaattgccatcggttatccagcgaaaagtaaaatcaacgaattacgcacagatcgccgttcgctaggtgactttgtgcaaataagtgactagtcaaactgccctgagcttagtagcaatgctgttttttaaactccatccccacctaacccttcatcccacccagcttgcagccgatactcctcttccccaacaacctgcttagccccaaaataagcctcccgttgatgcgtcgtgttcatcagtgtccgagccatcgtcgcagtgaccacaatgtgatgttgttgctgggcatcctttgtcagcggcaagttgccttcagcgatgcgtgccagttgactgataacgtccatcagcaagttgctgccggctaagatttccccaaaacgtgcggtgtgatacgtggtgggtaaggtaagtgtgcggcctttttggaagcggacggtgacgattcggtgatgctgccggtttgtgatggcgtaatcaacaagccggtgggtcgcgatccaaccgacattgcggtgatcgggagccgctagcggcatgaaggcatagcatggaccggtgagcatcttgggcagttttttggcggtcccgtgatataatttttgcacgataacttggcgcatcgttggggagtaaaccgaactgttttcgtgcgaacgaatgaagcctaacgtcgatggcttgatcaggtgtgccgcagtggccgtgagtatcagcgtttttcggggaaggaaagacgctggtaaagggagaatcgccaaaatctcctttaacggcaactgcgaggcgtctgatgctatcgcgttacgggcgagttcagtcacgagacagtcgggatcatctggagcggttttgaccatagccgcgttatgtatggctcaattttagtttaaacttatgctaattaaaagctaaaaatgttaaacgcggtgaatttatggtacgaaattgcgacaggtgttcaggaaatggcaacaaattgtctagtattggctgattttatcgagcttaggaggtaattgggcgaggagcgaggtgggtgtgttatgtatgaagctgcctttttggtgtgagcgtgagtcagcccaggttggctcacgcgttatggtgtgacgtgacaaggtaactgaaaaagtcgatacttaatgaaaaacgcgtccggctgcgacacccggatgcgttttttgatgggcgtgagccggcgtggttagggatcggagtataagtggtcttggtcgtgatgacggggttttggccattgcgaccaagatcctgacacgcagattcctgtgccggtgaacacgttaagaagcgtgtgttttgatggaagtgcgatccgatgaggtgaaaagtcggggagcacttttttaaatgcaaaaaaagttagctgaaaatttcgcgcaatttatgtttgaaaaggcgataaacccaggcctgcacagataaatacccgcactcactaaatcgaaagcttgatagaacaggttttcactcatctgattgcgaccaagacgaatcactgcttgcctcgttaaactaaccttatcgatatcgaaacaaacaaggcgccggatcggatgaagtgatggtaacagaagcgacaggatttgatttttttcttgcgcatcaaggagtggtttatggggcgttggcacggttggggattcatcgtggccgcagtgattttcaggattggcgggatgaagggatgttggtgtatctcaactacttcaaccgttatcgcgagccgttggtggatgagacggcaatcgcaaagttcaataagttggcgtggcgcttcgtgtttctgaccttgatgcagcggctgcaaaaagcgcagcatcggcgggagttggaaaacgtaccggcaaatacgacgcatattcaaacgaccacgctggcgatggcgccggggagcttgcaacaagcgctggaattgaagtggcagttgcagcagttgcacaggttgttaaccccgatggaacgccatgtgttgcagttgcggttaagcggattgtcagatgctgccattgccgcccagctgcatgtcagtcggcagcggattttgcaggtgcgcaaacgggtgcaggtaaaataccgagcgctgagtcaaaactgtgcctcggtttaaacaaaatagtgtgcgcgattgcgagagacagtagcaaaacgctgcgttcctatccgcatgctgaaaatagctgcgaatcagcgacaatcaattaacttttatggaggataacgcaaatggataaagaattattgacgtatgtattagatcaggcagtcggtgttgtcattgccgtgattttactcacgcgtattgaacggcgcctcgacacgctgatcacacatatcgaaacgttcatggccaagcttgatggcaagcaattacggtaggaggggaaaagatggcgatgttaatggcagatgtaagcagttggcagccggattcggatagctggtttcgcaagttggctgatctgggtgtcaaggcggtggtcgtcaaactgacagaaggaacgacttaccagaatcctaaggcggcggcacagttggcggctgggcgcaggatggggatgcaggtgcacgcttatcactatgcccattttcataacagtgccgaagccgttgcagaaggacgtttcttcggcgtcacggcccgcgcgctgggcgtgtcgacgcaaagtgtgatggcagcggatgttgaagcacctgatttgaatggggagctgacggggctgacgaatgttttcattcagacggtcaaagcgctagggtatccacacacagacctgtatacaatggcgaattggatgaaaaccagacgctttgatcgcgtggcattgattcctaagaacctgtggattgcgagttatggcgttgatcagccgggcatcaataatgtcgggacctggcagtttaccaataactttcacggcttaggggtggatatgagttatgactttttcggtcactacaccacgcgcttgaccggtaacctcaatggcggcgtggcgcgcgttcccacgattcgctatcacacggttttggcaggcgaaagctggtgggcgattgcagatcgatatggcttgaatatgtacaagctcgcggccctcaatggtaagacgatctacagtgtgattcatccgggcgatcagctgcggttgaattaaagcggcgatattttgacaaacggttgtcgatgcggtgtgatgccttgcgtcggcgatcgtttttaatttgaagcgggtttctgaaaaaagattttgcaaaagatgttgacaccgtgtcactatccgtgtagactacaaattgttgaacggtgacacggtgtcaccacgcgtactcgtcaccaccaaggtttaaccgtggcggcgaaagcttaaggaggatcaacatggttttagcaacgttccaacatttagatcaaacaaaacagcaacgggttctggctgcgttggtgaccgaattttcgcagcatccgttggcacaggcgcaggtggcgcggattgtgaagcaggctgacattgcgcgtggggcgttttataaatatttcagtgatttaaaagatgcgtatcaatatgcgtttaaagccgtgatcgggcggttgcatatgggcattgcgggtccggaaatgcggcgtgatccgtatgctgccaccgcggcgttcttgcacgaagctgatgaaagtcaggatcgtgatttcatccgcatgcattttaccaaaaacagcgggttggtgacggttgggcagcccccgattccagccgatgcgattgaatgggcggtagcgaccttatgccacagcgcgatttccgaggcgctggccaacccagaacaggcggatttgattttgaagcatctaaaagcagcacttaaccagctgcaagtgaaggagtgagtcgatgtatctctcattaaaagaaatttggcatgaaaaattacgttatggtttaattatcgccatgattctgctggtcacctatctggtgttcattctcagcgcgctggcaaacgggctggcgcagcaaaatacccaggcgattgaatcctgggacacgtcccgagtcgttttggccaaggattccgacattaacttaagccagtccttgttgacgtctgaacagaccaaggatctcaagctaggtaaaagtcaggcctatgtcggaacaatcggcgcggtggcaacgagcagccagcacaaagagatccgctccacgatgattggtttggattggaatcaatatattggcaaggacatgaagctggtcagtggtcaccgagttcaaaacgaccatcaagtggtggtggacacgcaattcaagaatgaaggttacgcgctgggcgacaagattcgcttgagtaccaaaggcgatcgctacaccattgtcgggtttaccgagaacgccaagatgagtgtggcgccggttgtctatggcacgatgaccacctggcgtaccttgcacaatctgccgaccagttttaccgccagtgggatcatctccaagacggccgattttaaaatcaacaccagcgatcttaagacgtattcggccaacacgtttattcagaaactcccagggtattcggcgcaaaatagcaccttcacctttatgattgggttcctgtttgtcatttcactgatcgtcattgctgttttcctttacattttgaccatgcaaaaactgccaaactacgcggtattgcgggcccaaggtgtaccagcacggactttggttgcgaccacgattgatcaggcgttgattctagtcagtctgggactcgttttaggcggcgcattgacggcgatgacagctaagttcatgccgctgggtgtaccgatgattttctcggcgggactcagcattgcagttatcttaggcatcctgctcaccggttttctcggtgcgattatccccgtacgcaccatcttaaaagttgatcctgttaccgctattggaggttgatgatatgccagcaatcgaattaaaaaacatcattaaaaactttaaaacgccaaccagtgacgttgaagtgctcaagaacgtcaatttcagtgccgatgccggcagtctctcactggtactcgggccatctggatccgggaaaagcaccttcctaaccattgctgggggaattcaaaccccgactgacgggattgtaaccacagccggggaaaatctggaacaactttctggcaaggcacgagatgcgttgcggttggacaaaatcggctttgttctgcagtcttataatttggtgccgtatttaacagtcggcgagcagtttaagctggtcgataaaatcaaaccaaaagggaaccttagccatgcagccctttctgagttattggatgatttgggtattgcaaacttggtcaatcagtatccggcatcgttatcaggcggccaaacccagcgtgttgcaatagcgcgggcgctttatccggatccggcgattgtactggcggatgaaccgactgcggcactcgatagcccgcgggtggcagtggttggccagttgttggttgatcttgcccacaagcataacaaagcgattgttgtcgtgacccacgatgttcgccttgaaaagtttgctgatcggaagtttacacttttggatggtaagttacgtgaaggcgaaccggagtatgcggcataaggctgtgcgtctttaaccttcatggccatcatcgtgcagatctctaagcgcgccagttcatgctcacccaaaaaagaccaagctcactaaatcagtgaaagcttggtctttttgcatggcggatgattaaaagaggaaacaatgttgcagtaggactagcaactgactagaagcgtggttcacctagtgcgtgttgagcggcgaggttgagcaggctccattgccggtcgaatcctggctggaagaagaagtcagcttcagctaagtcttccaacgtgaggccgtgttgaatggctaaggccaaaacattgccttgcgcggtgacgtcgtaagtggacagaactgcgcctccaagcagccggtgcgtttgtggatcaaagacaaggttgacgcaaacttgcggattaccattggcttccggaacataagccggacgtagggaatctgcgtaaaatgcggtgtcgacttggacatttgagcgtccggcagtgaacgtattcagaccgcttgctgcaaagtggtaatcaaatacactcaacgcgctggaaccgacaacgccgccaaacggacgtgccgggtgttccgcaaagatattagccgccagataacgggcttcacgccgcgcaactgttgccaaggcaatcggaactttttgctgtgccggtacggaataaaccagcgttgcatcaccaatggcgtaaacatcaggcaaattcgtgcgcaggtatgggtcggtgttgatgaaaccgcgatcgtctagcgaaaccgtgcccttgagccattcggtggctggttgaataccagcagcttgaatcacaaggtctgtggcaatttcgccagcatcggttttcacggcgctgactgcaccatcgccggtgaacgcttcgatttttacaccgagtttcagctcaacgcctttgtcagtcagctctttagctaagatgtcggtcatgtccggatcaagataggtacctagtggccggtcaatcatatcaagcaaggtgacttctttacctgctttgcgactggcttcagcggcttcaatcccgatgtagccggcaccgatcaccgtgatatgcttgactgccggatctgcaagtttggctttgatactggttgcccaatcgtaaccgcgcatcaggaaaacatttttcaagtcgttgcctggtaccggtagtgagttcggccgcacgcctgaactcagaatcaatttgtcgtaaggataatcctgtgccgtgccgttcttcgtgtcgcggacagtaacggttttgacatcagcgttgatggccgttacttcatggttgctgaacacatgcgcaccacgtttgattaaatcatcagggcggaagttccgaacatcattcacatctgtgacctgatcttctaagaataattccatcccgcaggacataaacgaaacaaagtcacccgcttcaaacatggtaatttctgcatccggataccgatgcaataattccagaacgctttggtgaccgccgtgtgatgccccaacaacaatgatctttggcttgtccacaaaaatccctcctaggatatgtagtaaccgcagttatgtaacaacggctctatctctatattagaataattacaatctagcgtcaatagccgagaacaattaattattggacaattttattttagctttgcctaaacccaatgatacaccttggcgtttgaaaattgccaacgtgtcggtctaaggggtaagaaaaaaccgctgcacagaacattgagggttctctgcagcggtttcgtctgtaaaactagataattttaaaatgttttagcgccttcacaacgccatcgtcatcattgctggcggttacataatcagcatggctcttgacgacattctgaccgtttgccatggccacacttaccccggcaaaatcaaacatatcaaggtcattgtgttcatcgccaaaagcaatcacgtcggccggttttagccccagatgctgtgtgagttgcgccagcccccagcctttatcgaccccttgtggcataatttccagcataaacggcatgctgcgaatcacggtaaaccgattgccaaattcggcttcggcttgcggttgaatgttagccacctgctctggttcgccgagtaagataccttttgcaatgacaaaatcatctggcatctcctgaggctcgcgaaccttgatgccagcgtgattttcccatgcctgcaaaactgtgtaccggctgatgttccgatcggcggtgtagacgtcaccggctggggttaagacgttgctatcaattccggccgccgataccgaggttgcaaaagtcgagaagtctttataatcctgatggttcatgaatttttgcgcgatgattttcccactggtactctgaaccacaccgccaccttgaacgatgacatattgatcatcaccatgcagccccagcgcgtccaacgttgtccgtacccctggcagtggccgcccggtacacggcacgactttgatcccggaagccagagccgtttgcaaaccctcgaccgtggccggtgacaattgcttatgcgaattcaataatgtgtcatccaaatcgactgcgatcaaacgaatcatggcagtcacaccccttcctgaaatcagcttagcacaggggcgttggtggcaacaatatgcaaccttgccgaccagcacaagtccggtgaaaagaatgctcgggcactaagccgtcacaaccgttaaatctcgccatggcggccaacatcaatcaagcggatcgcgtctggttcaactcggtaaatgagcagccaattacctttgatgaacaaagcacgatctggtttgcgttttttgatcacgtgatcgtcatacttttccggcagtggggtgctggtttgtaagtaagcaaggacttgctgaaagtcagccttggtgaagcgcccggcttggaggagttgtttgagatgttttttgaagcgggattgttcgatgaggggcagggaggtgggcatggttgggacctttctttttcttctagcgtaacgccggatggaagaaaacggggaattcttttataaagttattgtcgttgcttgtgaaacactgcggcgtgaagctgaagaaaaggagaggcatctgcacaaaatagcatataagaaatttttgaaatcgataccaaaaatgcttgacatattttttgaaagcgctatattgttcttgtgattaaggaacaaaggagaacggtgataaatggcaacgatttcagaagtcgcaaaattggcgggggtctcagtatcaacagtttcaagaatcattaataacaagccccacgtatcaccaagcaaagcagcgctggtagcagaagcaatgaagaaactgggttatcagcctctgcaagcagcacgacaaatgcgggggtctggatcacaaaccattgcggtgacagtaccatatattacaaatccgtttttctctgagctggtagcagcaatcgaacgaacagctgatgagcggtcatacaaaaccgtaattgttcaaacatttggtcaaaagagtcacgagcgcaatgcgttggattttttaaagacgaatcaggttgatgctgtaatcatgtgtgcgatcgaaaatgactgggacctgattaaacaataccggcaatatggcttaattgcggtctgcaatgaatatgtggctgattcagatacattaatggtacgtgctgatcaagaaagtggcatgtatgctggtgctaaatacctgttaaatcgtggttatcgaaagcttgccttttgtacgggacagaaagccattcgttacaattcggaagcggaggatctcaacagcgatcggtatcgcggttatctgcgagctttacaggaatttaacttagagcctgtcatggagtggcagtttacggatatcaatacgattgctgatggtcaaaagttattgcagaggctcatggtaatgaagaaacgtccagatgctgttattgctggctccgatcaagtggccgctggtattattgccgaagctcaaactatgcaattaaaggttccggaagatctggctgttttgggttttgacgatcaaccgttaagtcgagttgtggcacggcccttaacaacgattcatcagccggttcacgaaattggggatcgaatcgcaaatatggtagcggatgcgttagaaggcaaatcgattgaagtcaaggaggtcgtattgcccctttctctggttgttcggcagtcggtctagagtttttatttaaccaaaattggtatcaataccaaaaaatggaggaaattaaaatgacagttgtattagctcgagtagatcaacgtttagttcatggtatcgttgtcaatcaatggtcggctgaagtgcagccgaagcgttatatggtgattgacgatgttgtcagtcaagatgaaaacgtgaaggctagcatgcgattaagcaaaccagctggtaccgggatgtcaattatcgatactgaaaaggccttgactaattttaaagccggcaagtatgacgcacagcgagtttttgtcattgcaaaagaacctgacacgatgttgaaattattggatgctggtattgagattccgcgtgttgatatcggtattatttttgcggaagacggtcgaactcaaatcagtaaatttgtttcagtcaatcagcaagaagttaacgatttcagagcattagaaaagcgcagtgtaccagtgaatattcgctacgtacccgctgatgccccaataccattggaaagagcacttgaagggaaaaccattcagtaaccagagctgaaacatgataggaggaaatgtcatgccccatattttgcaggatattttaattattttgctggcctcgtatgccaccttggacaaccaagggattacgattatgaattattggccagtgacggttgggctttttgcgggtttgattatgggagacttacccactgcaatgacgattgccggaacatttcagttgatgagcctcggagttgcaggtttaggcggtgcttcggttcctgattatggcttggcaacaatagtgggaatctatctctcggcacgtacaggagctggtttgggagctgctgtggcagttggactgccggttggcctactcactattcaattggacgttttgattaagattatcaataactttatcgctcataaagctcaagcatacgcacatgccaaagaatttaacaaaatgcgtatgattaactggcttggaccgttgttctttggacttaaaaactttattccgatgattttgattgttacagtcggaccttcagccattagtgccttgttaaagattattcctaaatggttaactaatggactaacgattgccggcagtatgttgcctgttgtcgggattggtatgttgatgcactatatgcccctgaaaaaatatatttgggttctcatgattggctttgtcatgtcggcttatctgaaagtgccaattctgggggttgcaattattggcttagcacttgcaatctacacgtatcaaaatctgatcagcgcttctaagaagagggaagttgcagctgctaataatgcaggtactacggatgacgatgaaggagacgactacgatgagtgatgcacaaccaaaattgacaaaaaaagaacgtcatagcgccatccttcgttacatggcgatgggagttaacaattttaactatgaaactcaacaaggtccgtcagttgtctgggcattttcaaaggttttgcggaaaatttatcctgatgatgacgaatatgtagcagcgttagacaatcacttcaaatatttcaacaccacgactgcaatggcaggtatgattcttggtgcgactttggcgatggaagaacgcgatggaataaagtctaaggatgccgtgcaagcgttaaagacttccttaatgggaccgtttgctggcgtaggtgacaccattatctggattttgttaccgacaattatgggatctatcgccggatatatggcattacagggaaatccattgggggctattatttggatcttagtggatatattgttgttctggatccgtattaagctttttgatataggatatgattccggggttaaattagtaacaacgatggcaaaccaactgagtgccttcactgaagcggcttcagtcatgggaattacggttgtcggcacactaattgccaccgtggtgaaggtctatacaccgcttcagttccaatttggcaaggttaagttggcgatgcaaaccggtattttggataagatcatgccggcattattaccagctttagtggcctggatggtttataaattacttgggtctaaaaaatggactccgaatcgggttatcatattgattctggttattgcactcgtcggttcattttttggcattctaggcgtacagccaacaaaataagtgagtcgaagaagttagatagtgaggttgatcatttgaatcagaaaaatcagattgtcggggagcaatatcgttttaccgttatcacagataaaatgattcgcatggaatatcaacccgagggtcagtttgaagatgcaacaacacagatcgtcacaaaccgtgatttcgcacaacctaaattcaaagtttatcgcgatatggacggatttgctgttcaaattgagactgattcgtttcatctttactatcgggacggcgaatttaatggagctaacttatttattgacacgaaatataactatcagactcactattctcggtggcattacggagatagtgaccctaagaatttgctgggaacggctcgaacattggatggtgcagatggttccattccgcttgcaccagggataatgtcaaaaaacggctttgcaatattggatgattcgcaaagtatgttacaatccggttcaactatccgcaatcggtcggttgctgaggttgacatttatggatttgcgtatggtcatgattatcgtgcggcattgcgagattattatcaattaacaggttttcccccttctgtcccgcgcttcgcacttggtaattggtggagtcgcttttatccatatacgcaaaaaacttacctcgacttgatggaacgctttcaaaagtcgggcataccaatatccgttgcggtactggatatgaattggcatatcacagacattccagctaagtacggaagcggatggacaggatatacttggaatcgatcattatttcccgacccggttaaattgttacagacactgcatgcacaaggtaaacgtgtcacacttaatgtgcatccagctgcgggaatacgtccgtctgaagcccagtatcaagcggttgcgaaggcagttgggattgaccctgcctcgcaacggccggtgttattcgatttgaataatcggcaatttgttaaagcctatttcaatcttgtgcaccatccacttgaactggaaggggttgacttttggtggattgattggcagcagggaaaagcacgatcgcgaactcagattgacccgttgtggacattaaacgcattgcatttcttggatcaacaacaagaaaaaggggatcaagcgttaattctctcacgctatgcaggaccgggaagtcatcgatatccaatcggtttttcaggggattcgattgccagttggcagtcgttgaagtttcagccttatttcaccgcgacagccacgaatattggttatacgtggtggagccatgatattggtggacacatgcatggtcattatgatccggagctttcactaagatggttgcagttcggtatttttagtccaatcatgcgtcttcacagctcagataatccgttcatgggaaaagaaccatggaattacgatgctgtcataactaaaacgatgattcgattcatgcgtctgcgggctcaattagttccctatttagctacggccgatatattgacccatcaaaaaggccgcgccctcatcgagccgatttattaccgtgattcggaggctgaagaggcctatcagttcaaaaatgaatacttttttggctcagagatgcttgtcgtgccgatcacctcgcctagtgatgaaacgactgggttagcaagtgtgaagggctatgtgccagccggtacttggacagacttctttacacagcaaatatacactggcccagctgtcgtgaaatttcatcgaaatagcgaagattatccggttttggtacgttctgggggaattatcccactggcagttgatccgatggcaccggttgatacgttaccgggcgcaatgacaatcaaactttttccgggtgaacgaaataagtatgttttgcgggagcagactgcttcagggatggctcagacaaaatttacttgggatccgaaaacaaagatatttacgattaaagtaagcgatcctgctaacatcattccgactgaacgagtatatcaactggaagctattggctatgagggctacctagatccgattgacggtcacaaagaccatgaactgacacttaaactgaaaccgcaagatcatcaaggcgccaaattggctcgtgttttcaccattctgcagcatgccaaacttggatttgatctcaagaagcagttgtggcaagccattaaagatatgccaagagctaaggctgctttggcgctgacaagtctcgcacctgagagtctaagcgatgccctgctggaaatacttctaaacgatgaggcttaaatgaagagataacttgacgagttagttgagcttaagagtgcttggtgtggcagttaaacgctatgaaccttcttaaggatctgctgttaactgtaccaccacacttgcaaggaggaaaaacacatggaacgcacaattgtattagcatcgcatcatagactggcagatggattaaaagatacgctggaatttattagtggtggcagtcaggatgttgtggccatggcagcgtatttggacaatcaacctgttgaaaagcaggttgatacattgatggcagctttgcccgctgatcgtgatgtgattgtactgactgatatgacagcaggaagtgtcaatcagaagtttttccgatatagaacccgtccgcatactcacatcattagtggcatgaatttaccacttgctctaggcgttacaatggagcctactgatcaatacatcagtgattcacgtattgatgctttaattcaagaagccaagaacgccattgtcaatgttaatgagatacaagttgaggcggatgacgatgatgaatgaaattccttggtggaaaaacagcgttgtttatcaagtttatccgaagagtttcaacgatagcaatggtgatgggattggtgatttaaacggaattaccgaaaagttggattacttggccgatttgggcgtggatgtgctctggctgaatccgatttatcggtcgccacaagttgacaatggttatgatatctcaaattatcgtgatattgaaccgcagctagggactatggctgattttgaacagctcttacacgctgctcatgatcggcagttaaagattatcttggacctggtggttaatcacacatcagatcaacatccatggttcaaagcggcaaaatcgtcggtgtcaaacaagtatcacgattattatatctggaaaaagccggttgataaccatgttcccaataattggggttcgagttttggtggctcggcatgggcttatgagaaagacttgggcgaatattacttacaccttttcgcaagacagcagccggatctcaattggaaaaatcccaaggtccggcaagaagtttatgagcttatgcgcttttggttggataaaggcgtcgacggcttccgaatggatgttatttcgctaatctccaaggaccctgcttatccggatggcccattaattcaaggtaaggtgtatggcagttattatgctggcgcagcgaacggacctaaggttcacaattacttacaggaaatgcatgaacaggttttgtcgcattacgatatcatgacagttggtgagacaccgcatacgacagccgaacaggcccaactatatacagcagcgaatcgccacgagctggacatggtttttcactttgatcatatgcatcttgattatggcaaatatggaaagttctcaacgaatcggtttaaactagttgatcttaaagcggtgttggctcgttgggagaccacattagcgcaggtcgatgggtggaacagtttatattggagtaatcatgatcagccgcgcccagttacacgttttggagatgaaggtcaatatcggattcgatcagccaagatgttagggacagtgttacacatgcttcaaggaacgccgtttatttttgaaggtgaagaacttggcctgaaaaatgttcgctttgatcatttgaatcagtacaacgatcttgaaactaagaatatctttagcgaactgactaatcaacatcatgaaagtcctgaagctgcgatggaagccatttatctccactcgcgagataacgcccgcacaccaatgccgtgggacgggagccaaaaggggggatttacaaccggaaagccgtggttagaactaaatcccgatcatcaacaaattaatgctgaaaaggacttagcagatagtgacggtgtctatcactattatcaacgcttgattaagctgcgacatgaagaaccgttagttacaactggcgattttgaattgttggctccagatgatcccgatttgtttatttatctccgaagaggtaaaaatgaaacgttattagtagctggaaacttctcggagtcacaacgaagatggccattaccagacgccttgcaaaataagcaagtaaccactttaattagcaacgtaccaatagctaaacgagttggcaagatcatcacactaccaccatttggtagcgttgtttataaacttcaatgagtaacagagttggtttcaatcgattttcatgaagacaaagtcgccgtttgggtgggctttgtctttttaatttacaagccgctttaacatataaccagcaaaggcttttaactcagtcgcctgatattcactcacacgtccacttccagattgatattcgtttaacgccagcttgatgagtgggcgccatttgggggataacgttgccagtgcccactccccaccggaagactttgatgtgacgaggcgttcatttttaaacgccaatgcccggcataggtttaaaatcgtatacattggctgattaataattgtagtgtctgcgttgccaacgtcataaagaatactttttaaatacgcttgggcaggaactggtgcgaaaacttcggcgattggttccccggttaaaacttgaccatattgattgacgatcatcaaatgtgccgtgagatcggggtcggttccgtgcatttgattaatatactttgctggttcgcgcaaatactcttgatagtgcatttttgaaaaatgaaaatcaaagggaacgggttcggaaaaagtagataggtcttgtttaagaagaatgtgaaattccaatccctttgccggactcaaaggccaaagcttctcaagtgttacatgcatgatactagccttagctttgttacttagcgggctattgataacaacaagaaagtctaaatcgcttactgccgggttgaaacagcccatgacataggatccgtgcaagtaaataccgactaaattggtagttaagatgcttgtataactggtttttaaaagtgccaataattgattggttttatccacgctcatttccccttcagtcggactcgctaactttttaggcactcaataacaagttcaaaataggcaagcttatgaaaaatacccatccgctagtttgacttacgggatgggtgctttcactcattgatgtgcagtcgtgtcctgagacgtttctggtaacttgatcgtttcaacgcgcacatgctggggatttcctcgaagatactcactgatttgttcggcacttttttctatgtttggttttgacattgaaaaatcctcctgctttctgattcacaacgattgtatcttaaaagccgctgattttgttagcttttaacataagtaattgacgactttcaaatagtttagcgattgaagccaaaaagtagtgtgtgaaaaggcgggagagcaaagagttactggcttctcaaatgaaaaaaccatcgcgccacaatctgatacagcacgatggtttgaaactagcttcaacaaaagactctttcttgtatttaccctttttaaactttttcatcggcacaactcggccaactgtcggtttgttatcttttttggctttcacttcaggcgttgatgactctggcgccaacgccttgattttttcatcgacggcttcagcaaaatctttgacttgttttgctgaccagagacctttattggcagttgaacgaataaacgctgccaatgcttgtaagaccggtttacgttgatttgctttgataatttccttgtcgcttaggatgaaggccagggttgttgaaaggtcttccttggtccacgcttttatttcgtgattgaacatcaccttattactttgcatgattagcaaaactagcatggtgagcaggtcggggtcttgcactttttccggaagacggtcccaagcggatgattcgatgaaacgcgaaagtaaatccaaaagtgtttgggtttgcggtgaagagaagtcaatggctttttcctcgaattccgggtcattttcgacgtcagctaatgctttttcaatttcggcatcatagccatcatcatctacagcttcgtcatcgtcgtcaaagtcattatcaccgaatgggtcatcatcatcttcataatcagcatagtcggcgtactggctaatagcagcgtgggtagtggtttcggtgagtgcatggatgagtgccgtcatgaaatcatcgctggtgagctgaatctttttctgctgaatcagccacatgatcattgcgcgaataacgtctgcatcaaagtcaatgtcagcatatggatcatctgaattcgccgatgcctctaaagtttgttccaagccatcaacaatttggggaatatcgagtttggcaatgcttgagcgaagatttgcaaacgcggtggcgaaaaatgttatgagcgtcgaacgggcttgagaagttgcatccccaacccacgtcgtctcttgaagcagcttaacaaaaaccggagtgatgtgaaaatcgtcctaatacttatcaagttcacgtcctgcgtggcgcaacattttcgtttcataagttaatttttcttttgccgttgccttgctcctttatttataagtgaggctaccattggctttagtttagcaggtgcaaggaggtgtgcctagtggagaatacgaggggattttgaaacccatgtggaacaggttgttgctgtgtcagttatgtgcgaaaaaagatgattcataacaaatggtatatatggaatgataaagtaacaactgataaactaaaaccaacaatgctacgcgacggcggctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataacaaatggtatatatggaatgataaagtaacaactgataaactaaaaccaacaatgctacgcgacggcggctctttttgaagaagggggtggtgcttatggtgtaaaaacgataagaccgcagaattctttagaaaggagcagaaatgtccgacttcgaagctttgagcctcatgatcatggccgcactattgttaatcgccgtgatcgagttggttctaaagctaatcgatcgagactaacaaaaaagccgtcacgcaagcttgcaggcccgtgatggcttaatcaagttataatcgagccgccgtcaagcagcattgttgttcaaagggtcgttggtaagcagccagcgactcttttagtacacttttattttcagtgatccgtgcagagatgtcaacatatttgtttaggatttgaggcgggaaaaagaaaaattactagcctagattaataacaaatggtatatatggaatgataaagtaacaactgataaactaaaaccaacaatgctacgcgacggcggctctttttgaagaaggggatggtgcttatggtgtaaaaacgataagaccgcagaattctttagaaaggagcagaaatgtccgacttcgaagctttgagtctcatgatcatggccgcactattgttgattgccgtgatcgagttggttctaaagctaatcgatcgagactaacaaaaaagccgtcacgtcagcttaacgggctcgtgatggcttaattaagttagaatgagccgccgtcaagcagcattgttgtttcacgggtcgctggtgattagccagcgactctttttagtacacttttattttcagtgatccgtgcagagatgtcaacatatttttctcggtgttaagaattgagaatacgatcgcgctctttacatgttaacgttttaactgatagaacaatcacaaattggcaaacatcaagttgctatttatttgtgaagagggtatgatgcattcaataacgtgacctgtttaacgagaatagcgttaaagatgttattaaatcaacacttcgagaagaagattagccttagcgcaagcgttgcagagaacccggatggtgaaaaaggggcgttggcaaaaaggtgaagatgagcttcgaatagtgattcgtgcggataacgcctgcggatcggttgcagccgttatcctgccaggtatcaacaggtactggaggcgatgtttcggcattgcaaacgagggtggtaacacggcatggccgtcccttgacgacatttttggtggtcaagggacggccttttttgaattcatcttgtgtcggttttggttgaaaagtgatgatgaggaggcattttcatgcgaagttggaaaaaattagtgctagtcggtgcggcgttgttggcgttggtcagcgtgacagcttgtggaaaaactaccagcagtacggcgacttcgagcaacaagacgattgtaattggcagcagtggctcggattatcagatctggcaacatattgcgcaatcaccacaagctaaaaaggctggtgtgaagctcaaagtcaaacaggtggcagacggcaatgtaacaaattcggcaaccgctgaagggcagttggatgtcaatgcgtttcaatcttacgcgtatttcgaacagtataacaaggcaaatccaagtcaaaagttggcggcgcttggtacaacttatttagagccgatgggattgtattccaaaaaatataagcgattaaatcagcttcctgatggtgcaacgattggtatttccaatgacccggcgaatgcgacgcgcggtttgttgctgctggctgcggccaagttgattacgttaaagccggattttaatgccttgagtaccgtcaaggatattcaaagcaatccgaaacatttaaagttcaaagaggtggatccttcagttcaggtattgcctgacctagatgcaggattgatatcaaatacgcgtgctttggatggtgggctaaatgttttaaaggattcgttggtgcatgagaagctgggtcaggatactcgtgccaacgtgaatattttggtgacggcggttaaaaataaaaacaagcccgaacttaaaaagttagtcacgctttatcacaactcaacgattcaggcctggatcaagaagactttttctggtactaaaattgaggtgaataagccgattagttatttacaaaagaaatagctttcagacagaggcggctttgctaggtataaatggacgtattttctggatctggcgctaaaagatagccgactcagcgtataataacagttgtatcgttaccgaaaaaagcgagttttccagtgaaaaggtcggcggataatgccctagttaaacaccgtccaccgtcattcacacacagactcacgctgacaataggaggttttatatatgtgctcatccatgacaattaaatcgcttcaaggggatattttctggggtcgaacgatggactataacacgagtttcttccacgagtcgcctgctggtggggtgccggggaaaattgtgagtctgcctgcgaaccagacattgccagcgcaaacggctacttggaagactaaatatgccgcagttggtgttggggttgatcaaagcgtggcgctgtttgatggcgtcaacagtgaaggtttggccggggacttgcaggtgctggtggaatgcagttgggcaagtgccgagtcactggcgaagcgcaatctgaagccgattaaaggtgaggagtttgtcacgttggcgctgacgacttgcaagaatgttgcggaagtgcgcgcacttgcgagtcagtatggactgctggacgagccgtttcagtttggtggtcaaggcgtcaagattcctttgcattacacgttcgttgatccatccggtgccggactcgtgattgaaccgactgaccatggtgccttcaagctgtatgacagtgtcggcgctatgacaaatagtccggaatacgggtggcatacaaccaatttacggaactatgtcagtcttaatgatcgcaactatccggaaggggccgatcttggcgaccaacatctggagccgattgaattaggaaccggttatggcatgtttggcctgccaggtgattatacgtctccatcccgctttgttcgggcgatgttcgtgtcacgcaacctcgacccgttcaatagcaacgaaggtatccgcgtgctttacaatgcgttcaaaaccgttttgattcctcaaggtctaggccgcgacccgaagcattcgattttaaccgattatacccagtactggtccggatacgacctgagcaagcgcgccatttttgttcaggacgccaacacgttaaccatgacgaccaagacactcgatccgaacctgactgaagtgacctatgatgatttggttaaaacggaacagtttaatcaactttaagtaagatttgcgggcatgaaaatacgaacggtgcgctatacttaagtcgattcattaggtcgcaggctcagcagattgaataagaaaaaagacgtctcaaccaagtacggattttgccatacctgattgtgacgtctctttttatgcggttaattaaaaacactgctggttgacatgattactttttgtggcgacctttctgccagtctgccatgggaatgacgcgatctgatggacctgtcgccggtgttgccgcggctgtggcttttggcggtgtcgccggcatcttggcgagcgcttctttgacctgtgcttgggcggtatccgccaaagccttgagttgcgttgccgtccaaagatgcgagttggcagttgacttaatgaagattgccagcgatttacccagtgcctgctgcttatcacgcggaacgatctttgtgtcacgcagcagtagcaacaaagcagcgccaatatcctggctggtccactctttaggttcgtgaccaaacatgttttgaatggtttgaatcaggaaaaagatgaccgcaccgaagaactcttcgtcttgagctgaatgcggtagttgatgccaggtcttagagtcgaaaaagagcatcaattgttcaatcagcgtggccatgctcgctgaatcgatcgtcatgtcgtcatcatcgtcaaaacgttcgtcacgttggccggcacgtggcgaagcaagatcgccttcttcgaccagtcccaatacataagtcgtcgtgagtaaggcgcccatcaacgcatcgacaaaatcaatgatggtcaacttaacgcgtttggttcgaatcaaccaaatcatcatgctcttaatcagctcggcagcaatcgcaatcgcttcactacgccggcgatgcttatcgctgatttgttgcagcgtggtttcgagtgcgattgaaaccgcctcggctgaaagggctttaatcgtcgagcgcagattttcaaatgattcggaaaaaaaggtgacgagaattgaacggatttcttgcggcggaattttcgcgaaatccggatcctgcattaaggccgtgtagtcgctgcttttttgaaaatcaggccagtaaagatcgatttcgcgactggcgtgtcgttgcagttttacttgatagtccatgatatgccctccatatacggtcattgcgggttttattacccttagtttaacaggtgccaggtggtgctcacataaaaacttgctgtgggtgacgagagaaagtgcagaaaaaattgacgctgaattttcatgctagttagcgggggttgtggcggggaaccggggattttttagcatttaaaaacaggcatctaaagatacattacgcatctcatatgcctgttacacttttttggtcaataaactttttaaattgcaaatagcgcgtggttattcaaacattttcttggttgcgcgcatcaaagtcttgatatctttgtcatatcgtggcttgtgtacgaggtggctcatcgggataccggtgaagtgataagccgcaatttcgcctgaacggaccgcgctttgttcggtgaagaccatctggaatggctgctcggcaaattcaccggtgaaagcgaggttggttgagtgggcgggaatgacttccggtcgatcaactttggcgcgattattgaagagggccgaagcatacggcatgtaaaccggaatgttgttgatgatacttgccatgatttcatcttggcgatcgcgaatgttgtcaggacccggatcgactttggcaagctgaccgatcagttccaatgccatttccttccccgtcattttgatgtatggcttgttaacaaattcaccataacggcgaggatacaggaagtagccccacaaaacggtttcgttaggtttttgggtggtgaagtgcggttggtgatgcaccacaatcgacatcatcacgtctttttgtccaagcgcggtgatgggttgggtggataagaaagagttcaatgcattgccagggacttgggtggtaatgcgctcgatttcgttgagcagcaagtgatccttggtggttaaggtgaagctgacccactcgctggctgcccgatccgcgaagaacttatccgggttgcctaggttgtagaagtggtccgtggcttgtttccataagctagccgcggcaccgtagtccatgttttcaacagcaggatggtcaaaatcaccttgagtggctgagtcggtgatggagccgttagtgaagaagacggcggtatcgtcatccacgaccacatgttccggcttatcggtttcggtgttcagcattttcaaaccggttaccgtgatttcatcggtcatcgcggtgtctttaaactcgaacgctgtgacgcggcggttgaggatgatgcggcagccttgatccttaaggtagttgattagcggcaacatgatgctttcaaattgattgtaacgggtgcggttgacgccgaccagatgctcgatttgggtgaactcgtaaatcatcatatgcatgtaacgccgcaactcctgcgccgaactttcaacgcggaaggcaaaagtggtctcccacatgtaccagaagttggtttggaacatatgcgggtcatctttgaagtagtcggcgatgctaacattgtcgagtttctcttcttccgaatccggcatcataatcagcttggttagcaaaaggcgatccttgttgtttaagccaaggtgaccggcttggataatgccgatgccgccttccattaaccgcgccttatcaaacgtccggtgctgagcgtcaaattgccgggtatcttcttccgccgtcaatccgggttcagttgccgatggaatgcgactcagcaagtccatcaaatcgacataggttcgataattgagcatccgaccaccgcgcgcgacgtagcctttggtattttccattggatgatatttattccaatattcgtctgccgttgcttctgccggtgcgccgtcgttggacccgtgatcatccagggaatagaacgtaatctgatcaccttgccagtgaccttcttgaattaaataaacggcggctgccatgttggctaaccccgcgccgatcatgatcgccttatgcttgatcattattttgcctcctagcgactttcaaacttcttgtatgcgtcagcgtcatctttgaacagttccattttgtttgcaaagtagcaagccgtgccacctgcaaccagcgctaatcccagcgccgtccacaagaattttttcatcataaaacgcttcctttcgctttctgacttcattatagccaggcggaaaagaagcgtctttagtcaaaatatgatgtttgttcgaaaattaacgttcttttccatgcgcctgtttgtgcacgatgaacgcaattgaaccattcaacatgagatccgctcgtttgatcaggtcacgctcgggttcttgcaaggattgggctagccacaatagaatctgacctacgatggcggcaccatagaagttacagatatcggccaccattttcgccggagtggtgggatcgatgtcgagcaccaccggcttcaccatgtcggtcgctgattgaaacaaaaactcttccagcatgtcacggcccacggaatgataggcattcaggcaaaaggcttggttggcaatgatgtaatcgagtaccagttgatacttagcctcccaagtcgccgcgccaagattttgcatgactttacggccaatatcggcttccagcgtccacttcaacaagccgtagatgtcttcaaaatggtaataaaaagtgttgcgattcacgtgtgttgccgcgcttaattcagcgatggtaatgcgatccaacggcttgtggtgcatgaggtctttcaaggtggtcgcaaattgcattttggtttggtcagatgtggccatcacacttcactcctgtggttaaaaaatatcagcttacgaatgcgaaaaaccgcctgtctgcaagggatgccgacaagcggaaatgaaagttacttgacctttagtggcttcaattgggcttcgattttatccaatgtcacgttagcttccagtaaagccgcagcggcgtaagcaccttccacaaaggccacgtcataaacgtgcatctgtttgtcgctgacctcttcggcaatatccaaattcattttggcactgccgaggtcgtaaaagacgagcaactcggaagccggattgtcgttgattgctttttgaatatggtccagatccgttccgatttgaccatcactggtaccgccagccgtggtgatcggaacatctttggccacttgtttgattaaggtctcaaggccgctggcgatggccggcacatgggagacgagcaacatgcccattgccatgaaaatcacactcctttggtttttgacggtaatttgctgaaacgcgttcactggcgcagagatctgcgtgtaaggaccttggtcgcaatggcaaaacccagccatcacgcccaaggccacttacactccgatctctaaccgcgccagttcacgctcttgcctctaggtatgcctttagcagctctccagttgaggcagcgccgggatcgatgtggccgacacttttttcaccgaggtaggaggcacggccgcgtttggcagtcatgggtttggtggcttcaacgagtttgtcaatggcagcatcgtccagcttgccttgtttgattaagtcagcggcgggggcccagacatctagcatggtcttgtcgcctggtttggcttggccgcgtttggcaatgccttttgctgccgcttcaaccagatcgccgaagtcagtatcggttttggcgagtttggccatttccagaaaagcagtgccatacaatgggccgctagcaccaccgactttgctgagcatggccatggcgatggtcttgaagtcttgggcaagatcggcagttggtggcgttttttcgaaggcagccttgatggcattcacgccacgctccatgttgttaccgtggtcggaatcaccaatgacccgatcaagttcggtgagatggtctttttgctgcgtaatgcgattttcaaaatttgtcatccatttagtcaaaatttcagcgtttaacatcagtatccccccagccaacagtgtgcgcagatgcattcagatagttcaaccattgcggatcatccagtgccagcattgtcagtgaaatccccgccatgtcaagtgatgtgacatagttgccagccttggtgaagtctgctttaaggccttgtgcgtgtaactcgttcaaaacatcacccatgaaaatgtattgttccgacagcggagttgcgcccataccgttgattaaaacggcataggcatgcgctttaggatctttaaactcaacagttaacttaccaatcaattgtttggcaagtgctttggaagtcggcaacttttcctgaccagtgccgggttcattgtgaatcccaacgccaaattcgatttcatcaggcttgaggtcaaaaccgggtttgcccacttcaggaaccgtcgcggcgtgcagtgcaacggcaaacgacttggtatttttaaccacagcatcgcctaactttttgagctcatctaggctgagaccggcctcggcagccgcgccgataatcttttcgacaaaaatagtgccggcaacgccacggcgaccttgtgtatacagcgaatctttgactgccacatcatcgtcgaccaccacggattcaacgttgatatcgtcgacactggcgagatccttggccatgtcgaagttcataacatcgccggagtagttcttgacgatcatcagaaccccttcgccttggtcaaccgccttgatcgcggcataaatctgatccggggtgggtgaggtgaagacctgaccggcaacggctgcatccaacatgccttgaccgacatagccggcgtgcagcggttcgtgacctgagccgccaccggagataaccccgactttcttcttctgcttgaacgcggcgtcattgcggacgaccgccgttgtttcaggaatctgtttcaaatattgcggataactggcagtgagaccagcaatcatttccgggacaatatcgcctggagcattgataatcttcttcatatttgcaactcccttctagttatcagtgtaacgcttgcagtgctaaaaatcaggtgggatgcaaagaataacagaaggtatttgatcgtatggctgtaggctggcaaccagtttttgcatgatgatcgcaaggcatcaaaaatcgcctcatcaagtgtgggtaacttaacgaggcgattttcgggcaagcaattaatcagcgaaatcagtaacggtttcgatggtgtaattgccgctatttttaagtaattttgaaaccgggcagcgattttcaatttcgttggtaaaagccttggccgtgtcaagatcaacacctttgaccataacctgagcgtgaactaagaattgatactccgcgcgttcgccaataaaggcaactttaactcggaccgcgcctgtatgcggcaagccgtgttccttttcaacggcctctagggttgcttccagacaggtgcttaacgacaagcccaaaagttgttctgggttggtgccgggatgatcgttcaatggactgcttgtttgaactttaaggccgccgggaacatacgcgtgcccctcgaggccttcatcgttaattgcttcggttgtatacagtggatgttgccaacgttcatctgccattattttgcctcctaaaaatttgttattgtgttcacttgttgcggagatgcgcctcgcatcagtcgtacgtgacagtgaagtacagacatatagggttaaagttgggattaatcattgaaaccgtgaacgctatttattataagcgcttacacgaacttcgcaattaatttatagcgccttgcaatttcgttaagctgatagacatatattaagattttactgaccgttaatacttctccttccacttgggattactgtatttaaggcatcaacacctgactttactatgaactgtttatagccgtctctgttcatcataagggtctttggcttggtgaaacagcttaggaaaatataaaaacagtgttgtcaatactttcaaatgtgctaatagaaaaaataaatatatttttattcatgggagtagtttaaatgaacaaaaagttgacaatgggcgactttaaggtattattcgttttacacataagggttatttactgagttgcactatgtttggggaggggctatcatgctgcaaaagttaagaagatcgaatcttgtgaatatctatttcggcgctagggggacttttctaacatgcttcacattgatgttcttttattttttattctcagttttaaccaatacattcttaataccatctgacaaatttgtcggaaatataccatcaattttaagaggcgaatactggtatatcataacaggaccgcttttccattatgaatggcatcacttaatgtggaatcttttaccgattgctgttctagggccctttattgagtggaaaattggtagttgggttttcgtaaccagtttctttgtttctggatgggttgggtcttctatattctgttttgtatttggtgagtttattcagtcgattttgggcataggtctatatctctgtgtgttctatggcgcgtcaattgcagtatatgcattgtttcctctgactatagcggcgtttttaataaaagaacctgaatattccttcattactaaggcagtggttattggcgcgttctcatatctcatactcggactttttcctaaagcagatgcatcggatgcccagagatttgtggaaattgcgcatgtaagtggatttattgcgggaataatcggagcaattgttgtctctgtaatcaaactgcgaaggaaagttgtttcttttttccttcgccgatcaacagattagacgtatattgctgtggtacggtcacaattgctttgcttttaaattttgttacctgaatccggtttttgatccggttccgggttattagcgcgttccggtgggcgttgagaaaagccggtagcatgggtgatgagcgggtggttttggcatcactgaacgcggcgtgggagcagattgaagtaactggttgtgttttgccgatttcgaactatttataggctaaaacagtagcactaaacgctcgtattgctcaatcttaatggacatgatggcgtggtaaccagccgattttcacccagtctatgattcctttgccttgataccaggatctttaaaaaccttaaggagataaaaaaccatactatctttcaaattcaagtgaataatagtatggctatatttttaaactgtatattgcatcatgatttatttgttatgagctgtttgacccagcacactacaatttaaatttggaagactttcatctgaccttaaaaggctaaaaatacaatcgttcgagcagtccaataagctgctgtactgttccatcccatttgagtgactaaaaagctttggataccatcttgcatatcaccttcaaagtttgtaagatagttgacccagtcacttaatgttttttcacccatctttgccccgagtaccttagcagcagccttgaaaacagcttttataacggctaccttccatcttgcctgtactgctggatcgtcagcaatacctgcttttgattgtagaaattgagttttttcggaatcagaccatccataatggcttgctaatgtatcaaagtttgctttgtcttcgggtgatagttcagcgtaaagctgggaaaaacttttggagctaggatgaatgatcgtgtcagaccaattgatctctccagaataatcgggggcagattttccaaacgtttgatctattaagtcgtctaatgttcccccattgtttggttggatcgaatctgagatggcagtatccgattctgcggcgtgcacacttgtaacagccgaaagcggaccaaccgatccaagaactatagctagaccaagtactgagagtttctttgcgctgaattgcataaatataatcctcctaaatgtctctattacgattttaaagcgtttgagatgcttttataagcaatgaaaatcagtatagcgaaactgattaggccaaagataaagatcgtagataaaacgatgccgctttgggtttgcttgtaaagaaatgcgagtaacatcgcaatgacgaatgttaccaaaaatgaaatccataattttagcattgatttaaacctcggaacatatatttaacaatctaactcgattttagcgagtagccgttggattttcgatcagccacctgcgataacgcgaccgccaagaggcactaagattgaaagaagtacggtcatcatcacttcttcagctccttcctttgttctgcatatagtgtaggggatgaacgctgttttttgtgttaatatgaaatcattcatatttttggctaaaaattaggagtttatatattgaagtatgcagcgggttctatttaccatgaagtacggcgacgacgagaactgaggattaaggaggttagaggaaacctccaccaatcaacgatttcgcacctggaacatgatacggttgacatgaccttaaatacgatgatgaagatacttaaaccaacttttatgtcggctgaagaattctgccaattgattgatgaacaaagcgagtcaccaaccttcattttcaaaaagattgcgcgttattatgatgaaatgaacgtggctggcttgaaacagctagtgactgtttacaaaagggataaattgctaaccacaccaaacagactggttttattgacaatccaaagctgcattgatgaattatctgaaaaaaagcacttgttgtctcaagatgattgtgactttgttcaaggatatcttctgcatccaggacgatggtttagctttgaatatattgtttttgctaacctgtcattttcaatgccggctaagattaacttaagagtttccaagaaaatggtgcgagcatacgaacagtttcatttacccagttatgatagtcttttggtaaatgtcttatataatttatcgacctcatttcttgatcaagaagaccctaaattatcagcacgctttttaaactttcttgatttagataagttaaatcacaacaatctttatatgcgacaccatataacttttctgaagctagttattcgatttcaaacaaatccattagacaaagctaacgtagaaaagctaaaggtgttcttagaagcgactaggcttattgatgagactttatttaaaaagaatattgactggattgagtcgctaaaaataaatcccgtgattattttagggaaatagagatagtaaattagacatcacttaataatcgttgacaatcagttttgatttttcctaatgaagtcatacaagttggcattttttatgaccaagaaggtttgcagtagctagaagcaagagtgaaacagaaagatcgctttaaaaagaattagccaaaatcaacttttgttttcgaacagctgatgagactgcaccaatagtcgtcctcgtgtgtagattttttgctggaagtatttgtagtgttaatctttgttgtatgaatccggtttttgatccggttccgggttattagcgtgttccggtgggcgttgagaaaaaccgatatcacgagtgatgagcgggtggccttgccagatgaggtgttccagcagcgccatcgtggttttggcatcactgagcgcggtgtgggagggcaggtcgattccgagtgcctctttgtaatgttgcagtgacggggtgtgttttttgccgataccgaacgttttacgcgccagcaccgcagcatcaaacgcttgtagaggggcaactttgatggctaggccggattcaatggcgcggagatcgttgcttaaagcgaacccgacaactaattcatgctggagcagctgttgcagcgcagttttaacaagtggcagaggttggccgtatttttccaataagtcgtcggtaatgccggtgattttaaccgagaatggcatgacgtgatggccggctggcagttgcgtgaaaatatcgaatgtctgatcaatctgatgctggcggatgcgcaacaaactgatttcggttaagtcaagctgattgcgatcggcgacgaattcggtgtcgatgacgacataatcaccgtgagcaaggcggtcaatgacatcgcggtgggttgtcaatgctggctgatctgaggcaagctcggttactaaagtggggttaagctgcaatgacttagctgcgcggcgctgggctgcttgaactagcggcatctcttcgcgggcaaattttgcggcgagccgggccatcagttgatctgcttgaacttgccgctgatgttgtagtgagaccagcgattgatccgcggtgccaagggtaatatcaaataaccgtgcgagccagatagccgcatcagaagccggagcggtagtgacatacaccccgtttatatcgggcagagcgaatgccacctgtccattttctgcccagttggttaaccccaaggcgagtagatgaacccaatcgcgaaaaggccgcatgaaagcaaacaactggcgctgacggtctaaccgatctagacgcttagccgctgcggacacagcagcggctaattgcaaggcgaggcttttgcgatgattgccaaagtctttgagcttaaacttgactggtaaaatggcactacgcgggcgcaacatataacgcagacggccaccttccgggaaccagcgggctagatcaaagctgacatcgccacgaggagagacctgattaacggtggccggctgtttagcggttggggtacgatgctggagaaccgccatcagttcgttgagtcgggtgcgaacctcggcggcgttgcgcggcttgataatcggatcacgcagcaaatgatttagctgccggcgagcttgacgcggtgagtgacttggcttgcgatgtggtctggactgcaccatgatgacagcctcctttcttagcgagattaaatctaagaacagtataccaagtgtggcggggatttacatttttggctcttgagtgatggttgagcagacacaatgaaagtacagattggttttgcgtatgttaaaacaaaaacagccatcttcgaactgaaagtgagttgcggatggctgtttggattgtctcgtaaagtttaaatgtttaacgagtttgatcttactcaatgttcaatgtatcgcggtgtgtgcctgttgcaagaagcattaaaattaacgcttcagcatcgactttataaacgagaagccaatcaggagcaacacgcaatgctcgttcgccgctgtgagcaccctttaaagcatggtcatgtagagaagctaattttacatgaccttgacgctgcaaagttgttgcctgtcaatatgcatgcagttaatcgtcaacatcactgtataaatccttcatcaaagcatcgacagtcttgaagctttttattcgccccgctttaacatcagcttctgcaacttgaagctgatcaacaaatgacattggaggtgtaaatggcaatgcaccggtgtcaccaatccgtttcaggtacatgttaatagccgaggaaatatctaatcccatgctattaagaacatggagcgctcgttctttagttttggtatcaatcctaacgctgatgcgggattttttggtcatgttcatcaactccttcagctgagaatgtacgtcacttaatgccaaattcaactataacttcatttaaccacatacattgttgatttcaaaaatgcgatgtctttaaacgaaggcaaggagctggaacgtcatgatctagatgaaacaatttagcagatgcgcataaaatcaacaaaataaagggttgtagatttacgagatctagttgcgagatattgtattggtattacttttaaaggatgggctaacattggtcgggagtacttacagaatgacctaatatacaagacatatagagacttcatattcgacaacaaaatgcgggtataaattgttgacctcggaaacggtatgggtgtaaattaagcgcggcaagatgaacttgaacgcgtcttcataaatgctgttgtagaatgtccggctggtttcattctaagtaagccatatattttggcctattgcagacaggagagaataaaaatgaagagcacattaatcgggcttattcttgttggggcatcggcgtttggcatgactagcgtgtgaaggagatgaccacaaatggctgtctgggattttattcagattgtgttcaccgcagttgtcattatctggatagtgataacttctaagggtaaggcggatcggagaacaaaggaactaatttggataattattggtttagttgttgttggcaacattgctggctatatcattgcaagtgaaagaagtcagtgggcaatcgcctataattattcatttgctttcttccaattggtcattttgtggtcttttgcgcgtaacttttgaaaacaagatataaggtagctctagcaattcgtatgtgagaattactagagctattttgttgcttgaggaaaggtacaacgaaatgctagaacggtcgcacacagaaatgtcatcggttaagtattacttctcaagaaaaggatgaactgtgatgttcacaattattttgcgtttactaacctgctagcagtcttgaagataccccccttgttttagaaccaaaattatgcgataactgttgtatggatatcaaacaatcagtcattaccgagaattttaaacaacggttgttctttgcgctgtctgatcccggtcgatataaaattgtccgcatgctttaccacgtgggccacgagatgggttgcaacgagttgaacgaacacgtggagattgacaaatcaacgatgtcatatcatttgcgaacacttcgagaaatcggcatgatcaccacacgaacgcagggacggcaaaagtttgtcacgttgaatcgagaaaaaattgaagcagcgtttccgggattactggaaaggctttaaaaataagcaaaccaatgcttattttttagcagtaattgtttgatatttttaaaactataaaatgaaccgggggctttttgcatgaaacatcgtcaactatccttacttttcttcttagtcatgtttgtgatcgggacggacactttcctggtttcaccgctgttaccgacactgacacattattatggcattacgaccagcctttccgggtttattgtcagcgcttatgccattggatacatgctgtcagcgctgttgatcggcccgatttcggatcgccatgatcgtaaaaagatcctggttggtgggttagtcgttttcaccgtggcgactgcgagttgtggattagcgaatacttttgcgtggatgttgatcacgcgctttgttgccggaattgccgctgcgactgccggtccacagatttgggctgcgatccctgttttattcccgcgtcagcaagtggtcaaagtgatgggctatgcgaccgctggcttggcagtggcgcaaatcgtcggcgttcctttaggcagttacttagcagtttggtcttggcgtttcccgttctttttcgtcggagccattgcgttgatcctgacgcttttggttatgcgtctaatgcctagtttgaacgatgcaaaggctgcaccggcatccgagagtatttatcggcagctagtcggtaatcacccggttatgaagttgttagcggcgtacttattgttccaaacggccaatttctgcggctttgcgtttatcggtacgtggtttgctaaaagtttcaacttatccgttggcgcgattggcagctttattctgttaatcggcgtaggtcagtttgtaggcagccttcttggcagtcggcttgtgacatggttaggtcaacctcacgcctttttacttgaatttatcttgttcatcatcggttatgtggtgctaccgtttgccaactcaccacttgcggccacgattattcttgcgctcatttatactattggcggggctttgttgccgctgtttatgagcacgttacaggagcatgccggtacagctcgcagcacgatctcggcgttggccaatgcagtgatgtatttaggcgaagcaattggcggcgtcatcggtggcgttttaatcaagcagtttgccggtttttccggaattgcaacgtttacggcagtggtcgcggtgttggcaatgctgttatatgcacagcaggggtactttaagcagttacagacaagtagataacttaacttgcattggaaaatgattcgtcaacctcggttttgacatcattgttttgcaaatcacgcgttgacaagttggcgttgttttaacctgacagagactgtataattaaaaggcagaacatatgtttgtatcttggaaggggaatgtcaattgccagctaataaacaaagatgcgcgtgggcggataccaccaatgatttaatgcgccaatatcatgataccgaatggggacgtccgagccatgacaatcgccacttgtttgagctgttgtcacttgaaatcatgcaagcaggattgagctggcagaccgtattaaacaagcgggcagcatttaaggcggcgtttgctgatttcgattatcaacaagttgcacaaatgacgccacaaattcctgcgcttttgaaaaatgatcaaattattcggaatcgaatgaaagtgacggcgatgatcaaaaatgccaatgccgttgcgcagttagtggccaatggtacggattttgaccattatgtttggaattttgtcagtaaccaacccattcaacatcatattgagcggcatgaacaggtaccgaatacaaccgatttggccaaacagatgagcaagcagatgaagaaggatggctttgcgtttaccggtcctgtggttgtgtactcgtttatgcaagcggcggggttggttaacgatcacgaaacaggttgctttgtttatcagcagcttggccaataactggggatttagattttggattgacgtaaccatgatttcacagcttttaaacggggaggtgatcaacagtacctataaacatggaacaatatagaatataagggtataatacgagcataataatcaagtggaaggtgctcgtatgttcaaaccaaacgaaatggctaagcgacttggtgtgaccgtcaaaactctgcaaaaatgggataattccggtaagtttaaagctcatcgaacgccgacaaatcgacgctattacactgaggatcaatatttggcttatatcagtcataatgatcaaccaaagaaacgtcttcaggtggcttatgctcgagtatcaaatgtcgggcaaaaagatgatctagctaatcaaattgattttttgcgtcgatatgctaatggtaagggcattattcttgatgaagtgataacggatattgggagtggcctaaactacaaacgcaaaaaatggaatgccttgttagatgatgtgatggctggtcatgttgaaactattttcgtgacttataaagatcgttttgttcgtttcggctacgactggtttgaacgcctagcgcaaaagttcgacacccaaatcgtggtgttgaataaccctgatctttcgcctcaagaagaactaactgaagacctgattagtattattcacgtgttttcttgccgattatatggcttacgtaaatacaagaagaaacttgaagacgatccgtctttgaagtaagtcccttagttaacttgaaaggaggtgaacacttttgattaaaacgcataagatcaaactatatcccaattcaacgatgcgcaaagaactagataaattgtttgattatcgccgtttcgtctggaatcaagcgctggaaatctggaatgacatgtatgatgcttctttagtcatgatagataagtcaatacggcctaatgagcgaaaagttcgtgatgaactggtggcgaataaggcagattggcagtttgaacgatcagcgcgagtcttacagcttgccgtgaatgatttaagtaaggcgtgggcaaactatttcaatcctaaaatgcccaatcatgacaagcctaggtggaagtcgaaaaagcgatcacgtaaaacttttaaaacggatcgtgctcagatagtcaatggcaagcttcgtttggatcagccacgtggtaccaaactctggtatgacattaaactggctgaactgccacgatggcggggtgacatcaagcaagtttgcatcgttcaagacgcagatggctactatgcatcgttgtctattgaagctgcagtcctagctgaaaaaagacccattcgacgggttactggcgttgatgtcaatgtgggcaagttcgactaccgaactgcctccggttatgccattcagccgacaatacctgcttcgctagcagcactttacgctcgtatcacgcactaccaaaaacagcttgcccgtaaacgaaccacaaatccaaagcgctttaattcagcgacctatcgcgcaacgagaaccaagttgaagcgaaactatcaacgcgttgaacggatacaaatggatttgttaaacaaatttacaaccaagctaattgtagataacgatctaattgggatagaagacttggataatcagcacatgcgcatgaatcgtcgtcttgctaaaaacctgcatcgttcaatgtttggtaaattcaaaatcatgatgcaatacaaagcggattggaacggcagtactttaattcttgccgatccaatgtttccgagtacgcaacggtgttcaaaatgtggttacatcaaaactggtgaagagaaacttactttgcacggtaatgccaaataccacactggacatgacgattacatttgctaccaatgcggtgctaggatgcggcgcgatgaaaatgcagttgataacctgatcgattatgcgaaatcaaaagtacaggggtaggctataccctaaaagttcaagaggcggtcactgtcatgatgaattatttcagagtgggaatatcgctgttgacgggactaaatgaaatgctgaatgtcaatcaagaaaggaaatatatagaacctttattggtgtcaaagagacattcttccacattttatatagcagcgtatttgattaaaatacaacaacccatttatactgatttaaaaccaaaaagaggtctgatcaatggaaacgacaatttgtaagattggagattcggttggcgtcatttttccacgagcattacaagctgaagttggcagaaaatataagatttctaaagttaaggatacatttgtgctgacaccgctgcgatctgatttatttgccgctgccgctgattggcaaggattcagagatgctgtgactgatgaagacctagcatgggatgagatagaggactaagcgtacgtcatcctaaattcagtcacagcggcagcactcatccttaacagctcaagtaacgagagacgaaaagaacccactcgcaattttcagcgagtgggttctttaaatagtggatggtgaaaaactataaaagtactttcatgataggctttgacaatagttaagtgtataataagtgtaagcctaccgatgcatggcgtaacagcctagaccactatcaagaattcgttatcatcgttgcacttgacttgaaaattgaggaacttttttcatttttactcctccaaagtaaaaataagtcagctccacccccaatggcgctgacacgggaacaccgcgtacccccaatacgcggtgtttttttgttgagcgcgagccggcgcggttagaagtcggagtgtaagcggcctcagacgtgatggccgggctttggccattgcgtctgaggtccttacacgcagattgctgcgactgtgagcgcgttatagaacgcaatgtaagttcccttaactgcttaaactaaaaatccttacctccaacaccacaaaaattagtctagtacccaaactatatcaccaaacttttatcagttgataagcgcataaccaccgctaccaacccaccataccgcggctaaccacccatcgttttccaaactcattcatctcaaaaatcaccaaaaaacacgattcacacaaggctttgcccctgcgtaaaccgtgtttttttggttgctattaccgctcattcatccacatcgcgaacggttatccgatcttgcaaagcggttggctgctctagctgatccaagattgccaaggccatattacctgttgtgatgtgactctgaccatcttcgccaactagtaaggtatcttttcctgcaatataacccgttgccggtccgcttggaaaagcctcgctggcggatataccaatccatttaacgttatcggtcatctgcaagaatcgatattcatcatactgaaacttcgcaccgtcataccacggctgactcgcagcactttccggaaaatcaagaatcatcggatgatcggcacccggcattgccaagctagcacttcccagaataaaaacggctaacgtatccgcattacgcaacaaactaatcaaatgcgtggcaaaatccaaatgtaaatagccgcggcctgagccccacggaacactcagcgcatcaacaacggcatcaacgccatctagatctgcttcgcttaaatctagtggtgccttcaccagcgtcggaacggtttggcccagccggcgcgcagctttttgcggatcgcgcacgacagccaacacatcatgaccgcgttttctcgcttcggcaacaatggcacttccggcacgtccagtcgcacccaaaactgcaattttcattttcttacctcatttcgtaaacccgaacaccctacacgagctcattttagcatgcatccatttaaaacggttgatttgaccttcttagctctaaatgagaagaaaacttccttatatgcccgtttatgcggtacacttaaaataattggacagaatgtgagaggatattatatgtcaatcgaaacgagtcttacttaccaaaagaaattctttagtgattttaccgatgcttggcataaaaaatcacgttaccgcctttatcagggaatcgatgccacagcagagaatttgcgcctcgatattgaagaagcgcctggctacatcttagcttacgacaaaagcgcccaagccgaactgcatgattttttgcaaatcgggtttattgatttcttgcggcagcatattccgttttttgaagtcaatgatcaagggacgatttattttggtaactggtatcaccgccgcgattttggtcatattaacgtcattttgcgcgcgattacccagtcaaccgatgagcaacgcaagatcctgccgcaactggaagccttttccgatgatcctgatcactatctggatcgccagttggacgccatgcgcaaggaagtttaccacgatgttgattcactgcatacacaaattgataatcttgaagctgaagcagcacctgaacgcgatcaatccgcccaaggtaacggtggcttccgcggacttttgaaaaatttcatcgatccaagtgatgaatccgatgcaccggcagcccatgcatccaaaaccgatgcctcgcaacttaaagcccgctttgataaagaaaagctggcggctgatgacgccttcgataaacgtaaacgcgaattggaagtttctgcagccattacccgttatgaataccaagctgtcttgagcacctacagttccgttgcggaatttgaaaatgttcttgccaacttgaaagatgatttcatgcagtcattaaagcttgaaggagggcgcacacatgcttaatcttaatgacacacatttggctgccctaattgcaaaaccgttaaatgtctcacagctacgtcaacaaatcagcaccgcgtatcaaaccgaagctgaccgactagccgattcgcctttatggggttcaaatgatgatgcgttaaccgcgttactagcaagttacacgggcttgatgcgtgacaaactttatcaaacgttgcaaaatattgctgccattccaactaattttttacagacattgtggtttaaagacacgactagcgatccccaccacagtgaaatcacgcttattcaggcaactgaagaagacaatcagcccctgctaaccattgttgatccgctaagcccaagcgccaccctgaaagccgtcaatttgccaaccttgttacaaattacggcaagcgacagcaacgcgctgccttacgatgccgatgaaatcaaagcactgtctgctttaaccaaggcccttaatcaaggcggctatcaatttgcaaccattgacgaaacggttttgcagccaatcaacggcttacactttaaaacccgctttgataatctcaaaccattagtcgccaaaaaaacggttgttaaagccggcgaattcagcattcagactaaccttgatcgggacagcaaagttctcgactaccaggttctggatgaagacggccatgattggaaagatttaggttctgaagaggttaaaggtgaccgatttgaatgggcctcgaccacaattccggaagaactggtcaaccatcacctcaagctggtcgtgcgggtttctgccgggacgaactcccctgcgttagacgaactgtttgtcattgcttccagtaatgcgattttgatgcggcaaggcagtcaccaaggtgtatatgaattaccgctgcccaatcaaaaactctttactgtaatggttaatccggacaataatatgatttacctgaaatacccagatccggaaactcaggtaattgaattaaatcggcaatacccatttattggcgaatggctcaaagcagttttacctcaaaaacgagcctttaactaaccgtacagaggaacgattggcattagcgcaaaccttccaatgaatggacatgctgatgagagctcagacttttttatcaggagatgatcatgatggctaacgaatttccacaagtgatgacaattggtggtactgacagtgatggcagtgccggcgttcaagcagatctgcacagtttcttcatgcgtggcgtttacggtgcgaccgttttgaccgcggcggttgccggtaattcctatggtatccaagacagcatggtgatgccgctgccgttcatcgacgcgcagttcaaatccttggctgctgacctgaaaatcaaagcagctaaaaccggaatgctggctgataaggcattggtacaagcgattatcaaaaactggcaacagtatgacttcggtgcgctggtggtcgacccggtcattatcacgaagcacggcgcgatgctgctggaacaagatgcctacgatgccgtcaaaaatgaactgattcccttagcaaccgtggtaactccgaatcactatgaagcagaacatcttaccggcatgaaactcgacactgatgctgatacagaagctgcagcccatcagctacaggcatcaggagcaaaaaacgttgtattaaaaggtgcccatgatgatccaactcaaaaagaagttcgggattttgtgttgctggaaagtggcaaatctttttggctgagcgaaccttatcacgatacggaccgcgttaacggcaccggcgatacactttcggcagtgattaccgccgaaatcggcaaaggtaacgatgttgaagacgccattcggattgccaagcgcttcactaatcaggcaattggccatccaattccggttggacacaaatacggtcccatcaatcattgggctaatcaaattgtgtatccacaacaataaaccgatgactaaccgcagaacagctcgttgagtagccttgtcaccattgcgtaaaaaaagcaggaccaatgctgcgacgatatcgcgcatacatgggtcctgcttttttatattgtgagttagccataagttgtgatgcgaatataaaaagccatggataaattcgtccgtggctttttgtttggtcagcttaatcgctttttttagtgaaaagttgcagaatgcccattaccacaagcacgccgccgaacaaggcgaagaccatcatcaccgtcttaaatgggttaatcgccatgataaacccgataataagcaaggccacaccataaataatcgtcgaccatggtgaaacattcacatattgctgttgctggcgggcgccgataatcttattaaccccgtagatcatcaagataatcccgataatcaacggtcccagactcatgagcggcttgacgattgccggaatcagcaacgccagcaagaggtaaaatcctccggcaaaaagcgatgtcccataagttccagaacttttgtgcgcagaaaatccatcaatcaatttaggaatagcggcaataatcagaacagcggcaacaatccacagaaagcttcggtagacctgatgcggatcaattaaaatccagccaccaatcaaaatcataagcaggccgcgcaaccacgaccaacgttgaagacgatcaaacattgcttgcatttttgatactcccttttttccgagcgtgagccggcgaacgcgttaatatgagcgtgagccggcgcgcttagcaatcggagtgtaagcggcctgaggcgtgatggccgctctttggccattgcgactcaggtccttacacgcagattgctgcgccggcaaacgcgttaatgtgagcgtgaaccgcgcgcttaaatcccacgttgttccaacactttatgctaattaaagcatagcatatcgttttgcaatgtccctccgtcgtcagactgaactttaccactgctcatgattccaactgcgcccatcaatttcggcttcatattgttcacggcgctcagcttgcttggcgacaaacgtctgtaaagccgcaaaaaacgctgcattttcatacgatgccgcgtctttttgatgctgggcggccgtctcgataagccattgttcatcggtcgtcactctgactcacctgcctttaattcatgtaaagtcagccgcaaccggtcaatttcatcggtttgggcggcaagttgatccgccagcatgctcgtttccgggttggcttgcaggcgatcaatataccattgcgcctgttcgtcaggatcatcagggtgaactagggtcagatattgctggtaccgcacaagcaactgttggtgagccatatccgtttgattggcaaactgtgaaatcgtcaaaggagccagcaaatccaggcccgttttttctgcaagcgccgcatacggagttaaaaattgactgaggctaaagcccaccttaccacccagctgatatgcggcttctggctggctgaaacttaccactaatcccagtgactttcccctcagcaacccaccatgcgcatcatagacaaactgcttcagccacacttctgtcagccattgatgcaaactggcaggcgccatataccagtacaacggaaactggaagacgattcgatcagcagcttgaatggcatgttgttcagcgggcacatcaaaaggcagattaacatccaaatgatgccacgctacctgcgacaaggttgccgcactggcttttaaaaactgctgggtgttacttttttcaatgtctggatgactgacaatcactaatgttttcaaattgatcccttcactaaatgctgtgccaaaaacgccactgtccccggccacgctgccgacaagtacccttctgcatgctgaccaccgggaattacctgcaaagtcaccggcacaccgacttttgccgctgcttgagccagtcgataaatcccactaacaggaataatttccgcctgtgaattagccaagtacagcggccctgcatcagccgtcaaccggtcaaacggctcaacccgggaaaattttgtttcatctgcatcgacataattcaaaatgaaccacttgtaaaatggatcattgcgcccgccttgatcaatctcggcgctggccgtcttaacaaaatccgttttcgtatcgggttgagccacaactgctggatgatccgcaaaccactgttgaatgtcgaaaatacccgaccaagaaacagttggtacaccttcagccagcccgacatcaacggctagtgatccaccggcactcgacccgaagacacccagattctcaacttgagcatgggtgcgcaaccatgaaaaagccgctaaaacgtcatcacgtgcggctggaaaaaagtctgccggtgccaaccgataattaggaaccgccacgtgataacccaatgcggcgaaccgtttagccatatcgctttctttttgcttttcaccacgaaaccagccgccaccatgaatatcaagaacggctgctccatttggcttatccggttcatagaagtcgagcttttgtaacggtgcatcgccataagtgacgtctttagttaccttaactgtcaatctgaccacctccgctttcattgatgaccacagtataccgccgctttttccaaaccagttaacaattgtcttgcactgctacaccagatgattatcccggctcagttaatcccaatgcccgattaagcttcttttgaacggtcggaagtgccattttaccaaaatcttcaaccggtacccaccgtgctggcataaattttaattcggcagcggctgcatccgctccgattaaagtcaattgccagcgttgatgggtgaaggtatgttgcacctgaggacgaccgagatcagcaaaagttaaagtcattcccgacaagtctgcaaaccgagcactgatttcatccaactgttcgctttccatagtggcttcaaggtcggcaatatcaattaacgggaacatccacaaatcagccaacatccccttacctggacgctgttcaagcaagtaaccggcctttgatcgaatcaccaacgcaaaataacgatgaatgaccggccgcggctttttggttttaactgggtagtcctgcacaacgccatcgcgaaagctggcatcaaacgcgcgcaccggtgaatgggcgggatcaggatgactggcagacatataacttgaacccagatccatcacggcctggttaaaatcacccggccgcttcttgggcatcagtggccgaatcaagtcatcgaacacttttcgggtttgcgggcgcgcaatatcggcatccactttaaacagtcgggcaaagacacgaaatgcgttcccatcaatggccggaacgacttctccaaaactgatggaagcgatggccccagctgtatacggcccaatgccagccagtgtctgtaactccgcagccgttttcggccacttaccgtcatagtcattcacgatttgtttagctgcctgttgcaagcggcgggcgcgtgagtaatagcccaacccttcccaagcttttagcaccgtcgcttccggtgctgctgccaacgcttcaactgtcggaaactgcgccataaaccgtttatagtatggaatgacggtttgcacctgggtttgctgcaacatcaactcgctgaccatgacgtgataagggtcatggtcttgacgccacggcaatgcccgtgcatggtgatcgtaccaatccaagagtgcatgctgaaatgccgcaattttttcaggcggccaatccattaatttgttatttgtcatcatagaaaatagcttaccatggagtttcataatttggaaaagtaaatcgaatcggttaaaggccaatctcactcggtgcaaaaagagcaaaaaaatcagccccacgatcgtacgcatcatgggactgatttcttacggttcaatgatcactgcaactgctgcaattctcatcgactgatttttgcttactactgggttttgcccatcaacgacagtggtgccgcttctgatcatgcttgcaatgcagttcgtgaatcttgagccgccttatgataaacattactgaatgtcaatgttgtgaccagactccttagattcagttaactttggcaatgtgatgttcagaacaccatctttgtagcttgccttaatgttgctgtcatcaacgtttggcaactgatagctccgactcatcgtgccatagttgcgttcggacatcatgacgttgccgttcttgtcggcgtgatctgtgatgtcgtccttgtgaacattaatgctcaagacaccatcatggtagttcagcttgatgttgtccttattgatcccaggtacatcaacatgaacttcgtaagcgtccttggtctccttaacgtcagtcagcaatccgttgacggccgtgctggcaatggaaggtgttgcccaatccatccagtcagataccgggccgaagaaccgacgtgccaagttgtcaaagaacggatcatttacatcattcatcaactcattattacgacgattcataacttcattagccataacagataacttcctttcaaacagagacttctgggattcaggagaacgatcttagctccggagctcttgttccttctccctcgctccacctatagttataccacaaattagcacttgtgaacgccaagtgctaaattttttcaaaaaaagtttttaaaacaggaaacgcggcaatggttcactttatttttcttgtcaatagcagctataccgatgatgtcaaaatggtctgcaatacctcgaatcttcatagctatcgtcatttacgaacttcgccattccagagagttgtaagtaatcaggcagcctccagcataacgcgttcgccagcccagaagcctgcatgtaaggaccttgggcgcaatggtcaaagaccggccatcacgcttaaggccacttacactccggcttctgaccgggctgactcacgctcactttctataacgcgctccccagcgcagaagtctgcgtgtaaggaccttgagcgtaatggccaaagaccggccatcacgcccaaggacacttacactccgacttctaaccgcgctggctcgcgcttacaaaaaagaaccacaaacaagtatatgtttgcggctcataacttaatagatattagttttcattttcaaggcgttctgcttcttcgtcaatcgtctcgaagccagacttctttggcttcttctcaggatgttcttggcgctccttttcgaccttagcgatcaaagctttcttttgttctttgctcaatgatgccatgtgatctcgcctctttttggtgtgagttagaaggtataacccttacaacttctgttataccacttaaacacaaaaatgacacagagaattttgcagagcgtgagccaacccggttagaaaccggagcataagtggcctcagatcccaatggccgggctttgccattggggtctgaggtccttatgtgcaggtttctgggttggcgaacgcgtttcagagcgcgaacagggccgcttagaaaccggagtgtaagtgggcatcagccatcttacgccgacgccatatgcatcaccctaatccgactccgtcctgtccctgctggctgcacctgcaactgatcaggaatattatcccttaattccgtcacgtgcgaaataatcccgatcaatcgcgactcgccttctagcgattcaagcgcgttcattgccacatcaaggctattagtatccaaactcccgaagccttcatcaacaaacaaagcatcgatattgatgccgccactttcttgctgaatcacctcgcccagtgccaatgcaaggctcaacgcagcaataaagctttcaccgccagatagtgtttgaactgcgcggcgttcacccacctgatcatcgtaaacatcgatttccaaacccgaatggatcttttgagttcccaaatccgtgtgcaacacaaattggtagcgctgattggaaagcacttgcaagcgggtgttggcaacatccaaaacttcctgaagataggcttgtaaaacgtagcgctccaaactaagcttcttgggaccattgccgttcataacggcggtcagtgtctgcaagtcggcataggcggccaaagcagtctgattggccgctaaaatatctgcggcctgtttgagcaatttttgggccgtatcatgtttctgctttgcttcaatgaaggcagtttgtgcttttgttgcctctacttcagctgcacttgcttgagcctcaagctgatcaagggcaggttgcggttgattgccaatcgtcttgttagcggctgccagtaatgtctgctgctttaaaacgtcatccttataacgctgcgtttgttgctgcaaaagtggtaattgccctaatttctcgcgcatggcagcaaattttgcgacaccatccgaaccaaaataatcagttactgcagataaaaagtcatcttctgcttcctggtgctcttttttcagtgtcgtgatctggtcagtagcatggcgttcatctgcatgtaagcctgctaactggcgatcgaactcacttaattgacgctgcgccgtttttaattgttcctggtgagtcttgattgcttcagtcaagacatgcgactgttcggttactgtcttaagatcagtcgtgcctgcaggtaaacttgctttcatggtcgtcagtgcactgttagcttttgccgcctcaatcttcgctgtattaagcgcactttgggttgcttgaatttcctgatcatctgcgctcacaacagtttgaccaactgttattgcttttctcaatgcatcctgcctgatctgagccgcggataacgcttgaactgcagtctgtgctttttcttcaagtattgccagctgtttcaaaatatctggctgttcaacttggggactcactgcatctatgcttgagctcacctgtgcccaaaaactgttctttgctatatctgcctttttggtagcggcagcgtgctgttcttctaggttggatacctgggcttgcatagtcgtttcttttgccgctgcttgctggcgcgcttgggtagcccgtttcacctcagcctcagtcaccagcggttcatccaaggctacagccgggtgtggatgctcgacactgccgcaaaccgggcaaggggtcccgggcgtcaacttagccgccaattgggcaatttgttgccggatctgagtttgttgtaattgattcaactgttgctcggcagattgactcgcatttgtcgcctgaatcagtaacgtctttgtgtccgttagcttgctggcaagttgttcagcttcagcatgtgcgtcttgataattagcggctaccggtttcagcgctgccactaattgtttatggtcagctgctcgatctgccaaatctgacaccgctagttggttcaactcggtttgatattgatcaagttttttctgatcatctgccaattttttttgcgcctgtacagacgctgcttctgcctgtgcaactgctgcggtttgttgggctacttgtttttcttgagccgcaattgcaacgagttgctgtttaaccgattgcagttgatcaagttgcgtcttttgggcttcaatagctgaatcttgttgctgcaaatcatttaatttcgtttgggcctggttcatggcctgctgagtggtttttattgccgtttgggtttgtactaattgcgtcttggctagagttaaatcgcgagctactttttgtacccgttgctcagctgcctcgtgttcttgaacccaggttaaccgctccattaacttgaggcggtcttcctgcgtctgcttttgttcagcaagttgtgccaaagccgcagcagtttgttttcggtcttcaaatgcttgtgccaactgcttaccggtctgaagagctgtctgggccgtctgatagcgctggtggcgttggtctgccatggtttgcaggttggtgacggttgttgcttgctgcgttacatcctgatgcatcaaggccaatttgtcagccatcgttgcggtgtcagatggcggcgtgtcaaattcgaactgtgacgtcagcaaattcagcatccgttcctgatcctgaatcgcggctccctgctgcttggtttgtgcttgcatagctgtttgccagcgttgaatcaactgggtcccaaataaatcccgcagtaaatcttctttggcattactgtcggcatctagaaaacgccgaaagtctccttgaggcagtaaaacaatttgccgaaattgtttagcatcaagatgtaaaattgcatcaagctggctttggacctgattttttttggtatattcggccacttgcttatcagcatctgcaatcgccaataaggcctttgctttgacctcagtcagtccatcaccacgttttttttgctgtatctgttgcggctggcgcactacccgataatgtttaccgtcatgatcaaaagttaacgtaattttagtcagatcatggtggctggcaaagttggaccgcatctgcatgccatcgcgttcccctgacgtctcgccgtataacgcatacactaaggcatcaaaaatcgtggttttcccgctgccagtcggtccgctgattaagaatagcgggctcgtgcgaaaatcttcaaaattaaccgtttcatctgcatagggtccgaaaaactgcatgtgtaattgtttaagtttcactgtttctgcccgctttctgcttcaccaagtcccgctttggcccacttcagctgatccgctgtcagatctgtttgcatcatctcagcataaaaattcttcaacaaactcagcggatcgagatcgcgctgccgttgttttaacggttttacggcggtgaccccattttcacggcgcagactgataatccttgggtaaatcttccgcaactgggccatgacattaggaatcacctgcgtgtcggttagatcaacgccaatataagcatcgcggtcctgctggcgataaaaatccggatcagtcaattccgcatagctagctttcaactcaatcaagtcatgttgtggcgtcaacggaataaacgtccgcgccatcgtgtcagtatcgacaatgtagacgcccttctcctgcttggcttcagcgaccgcatatttcaataaggcaccactatactgaatcttaggttcggcgtgcagcgcattatgattatgcaaatgacctaacgccacatagtcaaacgctgccaagtcatcaatcgggactgcatccaatccgccgacgttaacctttgtttccgaagcgctatgatcactaccggcagcaaaaaaatgactcaccaaaatatgccgcatatcgggtttaaactgggctttcattttggcaacaatcgggcgaatggcttgtgctacattggtaatcgttgcatcctgaaaataatcacggacagcaaacggttcaaaataaggtagcaagaaaaattgagtgtcaccaagttcaacaggagtaaatgcctcggctaattgcgtattgacgtacatcttagttgcggaaaaccatgaccggccagtacgtagacggacggccgagtcgtgattgccggaaatcaccaacaatggataattcagcttacgatttagcgttaccagcatatgatcaagcgttgccaccgcggcctcactgggtaaagcgcggtcatataaatcgccggcaatgacaatggcatcgacttgctgctgcttggcaacggtcaccaattgttcaaacaccgcctgctgatcttccaataagtcaaaatcgtttagttttttgccaatatgccaatcggctgtgtgtagaaatcgcatgtttacgcctttctttgttatcgcttacttgttacaataataagcgttataggaggaagaatatgaatacgtttatctttgatattgacggcaccttgcttgacaacgttgaaggttacctttacgggcttcaaaaaactttacgccgccatggccgcgaaatcgccattgaggacttgacttggaccaatggccgcgctggtgtcgatagtttaaaagagctaggcttcagtccagcagaaattcccgtggtgcatgaagaatggcgggaagactcgaaagcttttctcaaccatgtcacttggttccccaacatgcaaaaagtcctaacgcaattaagccgccactataagcttggtctcgtcacttcaaaagacaaaccgcaattcctcgaagaagataagaagtatctctttagtccgtattttgaaacagtggttgtcgccggtgaagccaaacgcaacaaaccctttggcgatccgattaccttagcacgtaaccggttaggcggccaacctgacacgacggtttacatcggtgatacgccgactgacgcccaagccgcagccgatgcaaaagttgcctttgcactcgcggggtggacaacaccaccatcgcccgctgtcacgccacgcattgctgtcctccagcaagcggctgatttattaaaactttcaaagcttaattaacgtatgactgctactgtatattacgcattttaacagtgacactgccactaatagtcaagttattaccaattaattctaccagataacaatgtaaccacagtcctaagcatgcaaatgtttagggcttttttgcgcttcttgagttccgttcttggtcaattgacgccaaatgaatcagtcgtttgatccgtgaaaacatcaaccgatatttgggtggcaccgtattgctgtgtgtacctgttgtcttctgtttattcgattactaataatcagctgtatctgcacatttccatggcgctttttatttctttttttataaaaacgcgcgataaaaatagtcgtaaacaccgcgactatggtcttgacgaatcatgtagccagtggtaacttaaggactgtaataagaaacaaaatcaaacaacaacgaacatttttttgtgaggtgagtcaatgttaaaagacgagcgcttgctaacaatccgtaatttagttgatcgtaaagggattgtgaccgttaacgaaattggtgaaagtttaggcgtttcaaccatgactgtgcgacgggatctggaagagcttgctgaaagaaatgagttagtccgtattcacggcggcgcacagagtacccattttaaaccgctaaccgaattgtccagaaatgagaagcggtccattcacgtcaacgaaaagcgtaaaatcgccgctaccattgctgatatcatcacttcaggcgatacgatttatatcgggcccggcacaacgaatgaactgattgcacagtacctcaagaaacctgacgtccggatcatcaccaatagtcttcccgtcttccaaagctttcaggaccgcgccgattacttctcgttaaaactgatcggcggccagctccgcgaacgatcaggagcctttatcggaagcttggcaaatgagatgttagctcacctcacaacgaccaaagcattcatcagtgttaacggtatcgctgacaatcacattagtaacgccagccccgaagaaggtcagacgcagcgaattgcgttgaacaatgcggggatgaaatttgttgctgcggatcatttcaaacttaatcggcaagatttctacagtttctacgaccttgaccaaacagacgggcttatcactgatcccggaatcagcgccgacgatcggcaacattacaacacatatacgcatgttattacagacaaaacaaaaaaaggagaatagatcatggatgtcattattggtgcagacaaagatggctttgcaatgaaagaacaagttaagaaatatttggaggaacatcaatatcgggtcgcggatgtgacgcccgaaccagccgaagattttgttgaatcttcactggcagttaccaaaaagctgctaaacagtgatgcgcacaaagccatcatgtttgatcgttacggtgtcggttctgccatggcttctaacaaagtcaaaggcatggttaccgcggtcgttgaagaagaaaacactgcccacatgacggctgaacataatggcgccaaggcaattgctatcggtaccggcattacaggttatgatcgcgcactggtcatcatccaacgttatctggataccgaatatgctggcggccgtcatcaaatccggctcgacatgcttgaaaaaatgatttaacgccgtctttcacccaatatagaaaggaagcttcacacttatgattattgctattggtaacgatcacatcgtcacgatgcaaaagattgaaatttcaaacatgttaaaagacatgggttacacggttattgatgaaggtacctatgacacgcatcgtacccactatccgatttatggtaagaaggtcgctgaagatgttgctgatggtcgtgcagatctcggcatcgtgatgtgcggtacgggtatcggtatttcaacagccgcagataaaaacgaaggcatccgcgcggccatgtgtgatgatgtcacctcagccgtctatgctcgcgaacagctaaacgctaacgtcttaggtatcggtggcgcagttgtcggcgttcacctcattcaagatattgtcaaagcttatctggatgccacctacaaagaaacgcccgaaaataaaaagttgattgataagatcgacaacatcgcgaaaccaaatcctgatcaaaaagacaacccgcatttctttgatgctgaacttgaaaagtgggctgaaggcgtctatcacgactaattaaactttaaaatcctaggaggcatttttacatgacagtcacccttactgcgggccaattcaagcatctgcaaaaactttccgacgaaaataacgttatctccgcgctggcaattgatcaacgcggttctttaaagaaaatgcttgcagctgcagcgaacaagccagctgatgaaaccaccattgtcgatttcaagaaagcggtttctgaagaactaaccaaatacgccagttcaattttgcttgatccggaatatggcctgccagctgccaaagttcgtgcaccacaagccggcttgcttctctcctatgaaaaaaccggctacgatgcgactgaacctggccgtttcccggatttgattgataaccaaagtgctttgcgcatcaagaacgaaggcggcgatgcagtcaaattcctgctatacatcgaccctgacgaacctgatagtatcaacgatcgtaaatatgcgtttgttgaacgggttggtgctgaagctaaggctaatgatttgccactattcctggaactggtttcctatgatggtacgctcaacgagactggcaccgctgcatgggctaaggttaagccggacaaggtcatcaagatcaccaaggaattcagcaaaccgcagtacaatgtctccgttctaaaagtcgaagtcccggttgatcagaagtttgttgaaggcttcaccgatgaaggcgtaaccccggtttataccaaagaagaagctgccaaatattacaaagcccagtccgacgcaaccgatttgccattcatcttcctgtccgctggtgtttccaacgaattgttccttgaagaactcaaatttgctaaggaagccggttcaacctttaacggtgtgctttgcggccgggcaacctggaagccaggcgttaagccatttgctgctgaaggcgaagctgccggcaagcaatggctggaaacggaaggtaaagctaacatcgatcgtttgaacaaggttctagcggatactgctactccttggacggacaaggtcagccacgaatagttcgtgtaagaccataaaagccgattccttgaggggtcggcttttattaaccgaaaaccgactaacacaatcactaatatgacgttagcaggcaatctgctcacgttcacttttggaggaaaactcattatgatcttaacggttacattaaatccctcaatcgacgtttcctatccactcgatcatcttaaaatcgacacggtcaatcgggttaaaaccgttcgcaaaactgctggtggaaaagggttaaacgtttcccgcgtcattcatctgcttgatcatgacatcacggccactggcttcatcggcggttattttggcaaatggctggaaaatcagttggatcacgatggcattgcccataacttctttcccattgacgccgaaacccgcagttcgattgcggtattgcacgatggcggcaaacagactgaaattctcgaagcaggcccaaccatcgcgcctgaagatgcaagtgccttcctagaccactttgataagctacttgatcagaccgatttgttgacgatttcaggctcaatgccacaagggcttcctgaagattactacacgcaaatgattgcccatgccggtgccaaaaacgtgaaggtgctgctagacacatccggtgcaaccttgaaatcagcccttgaagcacccgtcaagccgctgttaatcaagcctaatgaagaggaactcgccggcctgctcaatcgtccggtggataagactgattacgcaaccttgaaacaagctctcactgatccgatttttgacggcgtagactggatcgttgtttcattagggtcagccggtgcttttgttaaacatcaagataagttctaccacgccgcgattcctaagattcaggttgtcaatcccgttggctcaggggactcaacacttgccggtctggcgatgggcattcatgatggcaagtccgatgaagacattatgaaaaccgcaatgacaaccggcatgctcaacaccatggaagcagaaaccggttttgtcgaccccgccaaatttgccgagtattttgctaaagtcaccattgaaacttattaaactaggaaagaagcaatcaaatgtcaactctcgaaaagattcaagctctgaatccggataagacgatctatcagttaaccgattcagcgttttccgattacggggtcacctatacacagtatgacgtcagcgaactccaacagttcatggatcagcaagtccccatccccgctccgactgctgccaatcgctatattccttccaaccccgcgatggaaaagctcccggtggtccaacagattggtcgtgatgtttttgccggcctgccaatcgaagccggtgaatgtgccggacacgccgaggctttgacagcagtcgaatttcaccaaggcagcgaggtgaatgttttcttcaccgatgtcgtgatggtgatcggtaaacgcgggcagatgcatgatggtcaatttaacgcggaaaaggacgctaagctattcttcgtccctgctggcactgtggttgaattcttcagcgacactttgcattacagtccctgtgaggctcatgcaagcggatttaaatttattgtcatgttaattcgcggtagcaatcaaccgttaccagtcggctatcacaccgacaacccattgattgttaagcaaaacaagttccaagtcgttcatgccagccgcaccgacaagatcaatcaaggcatcaaagtcggcgttactggcaagctagtcactgtcaatcacctagattaaaacacaaccaaaacggccgaaaacgccacgtttcagataacacagctaaagttcgaccaagtcaatcttgcttggaggcatcaaaatggtaacaccagaagttcttaaagatgaatcaccgttgagtcgttccttacaaaccgaacactataacggcgccgtagcagttgtttcccccgataaagaattaacagcagacgcgcaggggttttcccatattgacatgaaggtaccgtttgcatcccatacaatgagcggtgccggaactgtcacccaacagttcttcggtgttttactcatgcagtttgttgaagccggcaccgtcaagctgactgacagattgtctaagtatattccggagtatcaacaggccgagcaaataaccttagcgcaactagccaccatgcaaagcggaattccagactatctaactttgatggctgcaccatttaaagccaacgctcccgacacgctgccggccgaacggttagcgctgcaaatcaatcaacataccggtcaaaacatggatttagccaaggtgctggctgtggttgatgatctccccctgaactttaaacccggcagtaaaaccgcgtacagcagcacgaacgcactgctgttgggcgaagttctagatcgcgtgacgaatgaacggccacttgaggcgatcttaaaagcacaaatctatgatccgctgaacttaaccaacacaaaactcggcacggcccacgcatttgcagaaagttatcattggatagccggcaaccccaatgtggctggtaaaggtaatgaaaaccaagccgatcgcggactcgtcacaacggtcgccgacttagaaaaatttgcccaagcagttttgacaggtcaactactaaccgcggccagttggaagacgatctttaaggccgccgaagctggatacggctatggctggtacaagctggcagacggatggctcggtaacaccggcagcgttctaggctacactggcctgctgggcattaatcaagcacaaaagaaagctgttgtcggtttgaccaatgtgcttaagcctcaagcaactatggatcaattctttaagcgaatttacactgctgccgttaaactttgactgctaaagtcaacttaaaacttccgatttattaaacaatgtacggaagattcatattagacgcgaaggacgaaagccgtttactggtctcgattagtaaactactatcgcccttcattttatgtgatgtcagcgtaaagcatgatcgtggatgtgcatttttgtttgaatacgttcattttctctagtgttagcgcttcaattaagctataatggagctaggataagattaatggaggtcctttttgatgacaaatcgtaaaaaaagttacctaatttggctcggcatcgtcacacttgtcaccattttaaacggcattttcaagaatacattcacccaggtagcggtcatggtaactgcttgctatgcactttatcagttactcaaaattgataacgtttttgatcgtaaaaaacggcgggcacagcggatgaatcaaaaatccacgaactaaaacttgtcgataatggtataccactatgaactatcatccacctgtcaaaaagacggacagatttcaactcgaaatctgtccgtctttttctctctgttgcttgaacactcaagccggccgccagccatgcgttagtattgaccttcaagctattccattactggtatcatttcagcatgcatccatccttgctcaattttggcgaggtttagttttcttattggactcaactttctttgttatcacatcagcgaccttaagcgttagtaagtaaccgattaggcggatataggctgccacattaagatcaatcttagtagcaagttccgtcaactcagcgcccactagtccgacacaaataaaaacaagccatgatttgagaaatgctagtctctgcaagtatctccacgccctcaccattttagaactccaaaattcgaattggttggtttttactatacacccggtttacggatatttgtatgccaaattattttaaaacttttatagcaaaacagccctagaccgcatcgtctagagctgtttatagcacaatcaccatcaatgatacctaacagaatggtttaaatgcttcatcattaatctgctgaattagcagcggcatgggttgcgacaaatttaacatcatcagcaacctctttaccctcatcagagtacttctgattccgtttcatcatttcatgacgataccagaagaacaatgcagtgtaagcaattaatgccaacgcagcatacagaatcatcatcatttcgcccttagaagctttaccaaccaaaacagcaatgaactgttcaatcgggccttccttggttgacgaagagattaacccagtggcaggaataccactcgcatgtaaagcacgtgctgtgtgggtaatgaatggtgctgaaagtgtgccggcccacaagaacagtggcagttcgatagcaccaataacaatcattcgaatgatcttaccacgcgtaaccaccaacagcgctggggtaacacccattgcaatgatcccacctaaaggcaagatcccgttaccaggcaataccaaagcctccagcaacatgattggtgctaaaacgttagctgcagcccaaatttcagcacgaccagccaagaatggccagtcaagcccgatattaagcatccgaccgcctaaacgtttgttagcaaaatccgcaaccccttgagatagcggttcaaccgctgcgataaaccatgaaccaataatactaaacagctccaagcaggtcgcagccataaaggccagcgtcgtaatggacttaatatcttgatgggaaatcagaccgataaagatccccagataaatcccaatggcaaagcggctgccccagaatccgatcttttcatttagcttggccgcatcgaagtcatatttatccaaccatgggaacaatttgtcaaacaacttatcaaacaccatgatcacaggattcatcatgtagtttaaatgcgttgtcgtcatcgggttctcccagtcgtccaacaagtcattgaaagtcggcttcatcaaatcggaattgataatttttaaaacgccaatgaagataaccaacacggtagcaacaaaaaggttagcaccaaaataaatagccaatagacctgtaaatgacaaatgccagatatcaaaaatatcgacatctaatgtgttggtgcgattcaggaacagtaaaatcaaattaacaataaccagaattgccaagaagaataatgtatacggtgaaccccaagtaatcgttgctaacggcgcccaacctaagtcagtaattgaaaggttaatgccggtcgatttaacaaaggcatttagcgctggctgataagtatccgtcaacaaaccgatgacactgctaatagcggtaatcgcaatcgctaatttgatgccgccttccagcgcgtggaagaaattaacgccaaccgcgaacgcaatgaccgtcaacacaattagcataattggagccgcacccaacttgatgattggctcaaaaatcttgttggccagatcaataatcgtttgcataaactttttcactccctactatgtatccgacagtttctcgccatcggatgacatgattatttcaaattttcttttttgatgacattctcgatcttgtcataaacgggtttagccatagccggcatccggtacaaaatcggtccagcattaatgactggaatgtttggggtgaaaccaagatcagtttttgcaatcggtgtaaaaatgtcatagttcttgatcatatcttcattaacatctttgaccatcaccgcatccgcttgcacatcatagccacgcttcttaaattccttttcaatcgcatccttgatttgatgactagagttaacccctgcaccacaagcagccaaaatcttaacagtcataacaaacttcctccttattttttaaaacttgttgccaaaatatcgtgaatcgttgcggtgtcttcagcatgaaacagtctgttgagcgtttcttcggaagacgttgttagaaaatccatgatctgtgccagaacatttgcctggccttccggatcattattcaaaatcatgaacagaaaactcacattgaacttctgattaggatcaatcatattcgcgaattcaaccggttgtttcagccgaatcggaacaactttcctgacattaacaaattcgccttccgtgtgcgggatcgcaacattcggataatcaggattgaccacactcatatcaatgccagtcggatacgctttctcgcgttcgctgaggtgttgatagaagtccggtttgaccgcccctaatgccacgagtttgtccgaaacctgcttaaaaattgtgtcttgatccgtaccatcttcaatgaacactaggcttgaatcaaagagatcctgttcgattgtgtctgccatcatctacacctctgttaattgttgttcgcttctgttcactattaattatagtcaagcgctttcagtagtcaagaaatactttttcagctttgcaaaataacattgtctattctgttgtttcgtcgttccttttaccacgtgtatttgactacactcgtacatttggcaaacatcggattgcagttaatattactgatatatcagacaacacaaagaaacacttttaaacaaatagagggcgataaaattgttcaacatcaatttttcaaaacttttgccatcaaaaagactgcataggttaacctaggaataatcctatttgaccgaaaaaatagtgcgccattctatagcagcgcacttgctttgtcaggcctagccttgggtattattctcgttgtgatactgataacgtgctaggaaccagattagaccgattaagagcattcctaccgcccaacctagccaaaaagggaaagttgcccaaattgctccgtcactggatgctacaagcgacataaaatgcccgccaaaagtaaatttcaagtgacttagcatataaagcgcgacaatcgcagtcagcaggtacaaccacatccatttattcgcgctccaaccatgtttatacggattaattgcccaaagaagcggaactgacccaaacagtccaatttgccaagaaaaaatcgctagaatcaaaaccagttgttcgaaatccgaaaagcgggctaaccccatttgtggaacccaatgattcaataataaaaagcaagtccccataaacagccaaaccggtaataggtgacgtatcaagcgaataaatagcggcgattttgtcttttgcattcgcgtttgcctgatgagataccaactcgtcaatccaacaataattgccatacacggttgccaattagtgatgacgacaccgcttctggaactgatcaaaacaggaaacaccggtaaaaaagctggcacaaaatcaaacttattaaccggccagttgtaccaaatataaatcgcgctaactaccgaccagacaaccattatgacgatcccctgtacactgagtggcaatttcaagaagccggttttcatggcgaacccccccactttcatgctccatctttaatcacagcggttaaatattagttcacgtgaataattcaatttaaatgtttgtaatcgtaatcgctttcattttctaaaagtatatatcaggataaacccgctgcaaaatataacggtttgcataaacttgatcttttcgattccctaactccacaaacgccatgcctcaacaagcagaaagccagcaccgataccccagcatacaaaaaagccctttgagcatccccaaagagccttttgtcgttaactattattcaaacgtccaggtattcgccaaggtaaatggttcacctggcagcaacgtgatcgcggataaatccgaaccgcttactggcggatattggcattcaagtgctaccccatcaaattgcttgatgttatgcgcaacgcctgtaccatcgaaatgattggctgtataaacaaccacgcttggtgcagtggtgacaagtgtcatcgtgtgatttttagtttgcagcttggcggctagtgctttgccgttttttaggaggaacgggtgattaatgccacgttcagatgtaatttgatcggcacgcgtatggatgacatcgcccagtttttgcccgttgcgaaaatccaatacagtacccgccaccggttgccagccttgatccggaagatgttcggcgtccaagggcttataggcatctgctggaattgtcagtacggtttcatcaatcgtagctggttgatccagtgcaaaataagtatggttggttggattaaacagcgtctcctcatcactcaatgcatcaacgcgatactgcaaagcattcgcgtttgtcagcgtgtaagtcacctgtaatttaagattgccgggataaccgttgtgtccggccggatcaacaaaagtaaagctcgcactcgccgtcgttgcagtttgctcggtgcgaaaattgtaaacttgacgatcgagcccatcatctccgccatgaatatggttcttgccttcattcatcggcaaatcgactttaacgtcaccgtgttgccaaacgtgcccccgaattcgcccgacaatgcggccaaccgtaccgccaagaaaattacgttcttttgaataatcttcgcgtgttggtaatgacagcaccatgttgtggagcccatctgcttccggtaaaagcaccttctccagcgttgcaccataatttaacagcttaactaccataccttggtcgttagtgagggttaattcataaagattttgtccctgatactgaccatattgctcaactgaaacgtccatcataacctccttatatcatggttcacggatcgcacagccatcttgcggcatcatctgacagctgctgacgccacctacaaactgctggcgcgcataatcaactcgcttttgaaattaacctgtcgcggaacccgtttagcatcattcaagcgcgcctgtagcaactcaactgcagtttgacccatttgatcggtcgctgcatgcacagtcgataacgggggcgttgtaaacttagccacggcaacatcattaaaactgatgaccgaaacacgctgcggtaccgaaatgttagcttcattcagcgcccgcaaagcacccaccgccatagtgtcattagcaatgataaatgcgtgtggcaaccgctcacctaatttttcgatggcctgtcgcattagccgataaccggaatccggggtgaattcaccgatcaatcgaaactcggcatgatcgattccggcagctttagtcacacgatcaaatgtcgcggtccgaacatcctgaaactgttcgcgtccactgcggctcgtttccaatccgccaagaaaaccaatatcatcaatgccgaccttctgaaaatgatcaatgatctgggcaattgggccagcataatcgccggtaacggaatcgcaatcaaacgccagcatattctgatcaacaaacacaatcggcaaccctaacgccttaatttcggcaacctcacctgcatcgtacttgccaagtgcaatgataccctgaacatttgcaacactttccgcgtttaattgctccaggtgcagattttgcacatgataaccaatggatgcggccctggcttcaatagcgtactgaatctgcagataatagaggtcattaagctcctcttgttcactccgccactgaattagtgccaccgttgtttgagtagcaacgcgtttgcggcgacgtggtttatacgccaacttctcggctgtttttagaacccgttggcgtgtctccggcgtcactgccagtgtagcgtcataattcaaaatccgcgaaaccgtagcgatcgacacccccgccgccttcgcaatatccgtaatcgtggtcatcgattccctccgtttccctgaccattaacaacaaccagcaactatagcgagtgacagaagcggccaaatgcctcttgcccgatcttgtcacgtttaaagacgccagcatcttccaatacccgggcgaagacttttccgactgcttcttgcaactgactttccgcattttccggtgtccaattgtaagccactttcagctgatctgcccaagtcttatgcattggcttcatctcattagcctcgcctaagagatacttcttaacttctgctaattcagacttaagccgcgctggcaaaatcgcccgacccatgacttcaattaagccaatgttttctttcttaatatgttgtacatcctgatgcgggtggaaaataccatccggatactgttcgctcgtttgattatcccgcaaaaccagatccagttgatactccgatcccacgcgccgagcgattggcgtcaccgtatgatgcggcttaccctccacaaaagcacgaacattaaccgcttcgtcagtatactgattccaaacctgccggatgtgttcagccgcattggttaattcttcgcgatcggcactgaccagccgaatcacactcatcggccatttcacaatgccggcaaaaacatgcggatgcccactgatctcgatttgcgtttcgatcggcgctttcgccatcggaaatgtgtgccgtccaccttgataatgctcatgagcaagcatcgagccgccgacaattggtagatccgcgtttgaaccgacaaaatagtctggaaacatggcaacaatgtcgagcaagttggtaaaagtactttggtcaatcaccatgggctcgtgaatagcgtccaaaaagatcgcatgttcattaaaatacgcataaggcgaatattgaaagccccaggttttaccgcctaacaagaaacggataatccggtggttagtacgtgcagcaaaattacttcggccagcatacccttctgtctgcaagcaaagtgcacacgccggataacccgattgcgcatgggcagcggcagcgatatctttaggatccttttccggtttggataggttgatcgtgatttcaagatcgccatactcggtttttgcaggaaagaccaggtttttagcaatggcccgcgtttgaatataattgtttgctcgacttagcgcgaagaaccaatctgtggctgcgcgcggtcctgcctgatatttatcccagaataactgattgatccggcttggcgttggcgtggcaaaatccattaattgggcttcaaggatttggcgtgcagcctgcgaatccgcaattttaccgttcgtttgcgcggctttgaccattaaatccagattattcagcggatccggatcacctggcagttcaagcgccgcatcaccgattaaattaagcaacttattggttaaataaaccgaatccatctgcgtgtaatcaggattcagcttgataatggtctcaatgtgattgctaattgcggtcaattacggtcaccgaagccttccggatgattctcatgccagttccaagccgtttcgataattttatcaatgtcatcgtagtttggcttccatcccagaatatcgcgagccttctctgaactggcaaccaaagtgctaggatcaccggcacgccgcggacccaccgttgccggaatcttttgaccggtaactttacgcgcagcattgagaatttccatgtttgaaaagccatgagcagagccaatattaaatgcagatgacggattgccggcattcaaatatttcagtgccaaaacatgtgcgtcggccaaatcaacaacatgcacataatcgcgcacattggtaccatctttggttgggtaatcatcaccgtaaatctgcaagcctgtgcgggtacctgcagccacctgcaagataatcggaatcaagtgggtttccggatgatggtcttcaccaatggaaccatctggcattgccccagccacattaaagtaacgcaaagcaacatacttcaaaccataagcaacgtcagcccaatgcatgatcttttccatggccagcttactttcaccatatggattagtcggcacttgcggatcggtttccttgatcggcacttgtttaggttcaccatatgtggcagcagttgacgagaagacaatcttcttgatcccaaactgattcatggcttcaagcagcgtaatcatgccgcctgtattgttatcaaaatacttcagcggatctttcatcgactccggtacaatcgaaaatgccgcaaagtgcacaattccgtcaatcttttcctggctaaaaacctgactcaaaaaatggtaatcgcgaatgtccccttgataaaaccgggcccgtggatcaaccgccttacgatgaccggtaatcagattatccaagacgatgacatcttctccatctgccagtaactgcttaactgtgtgtgaaccgatgtaccccgcgccgcctaaaactgcaattgtcatattaaaaatcgctcctttgaatgtttgtgatgcgtttacttaagccgaacatttggcctttttgcctcaattcaattgcttagcaccatcggcaatgtccgctacgtaaaagtgagcgtcatacccgatcttttcagtataagctttcccaacgttactgataaagtcctcaacgtctgcactgttgacaatagcgatggcacaaccgccaaaaccggctccggtcatgcgcgcccctaacacaccacgttgcttcaaagcattggtaaccaaggtgtccaactcaattccggtcacttcataatcaaaagccaaggagacgcctgacgcagaaactaatttgccaaaggttttaagatctcctgactgcagtgctttagcagccgttaacgtacgttgattttcaaataccgcatgccgggcacgcttaatcaatgtctcgtcgtagatcaaataagtattttcatcaaattcatcttccgttagctgcccaagactcttgacatcaatgcctttttgcaacatcgccaaagctttctcacattcgctgcgccgttcgttatatttagaatcggttaattcacgccgcttgttggtattcatgatgacaatcacgttgtcgcccatttctaccggcaaatattcatacttcatggtgttggtatccagcaaagttgcctggtttgcccgtcccatttcgatcgcaaactgatccatgatcccggaattgacgccaatataatcattttcgactttaaccccgaacttaaccaagtccagcggtgcaaaaccaccatcgaataagttgttcaaaatcgtgcctaccagcatttccagagaagcagaacttgatagcccggcaccatccggtaagttaccgttgatataaacatttaggccatgcgtataattgatacctgctgttttcatgacccgcgccattccctgaaaataatccgtccacaaaccgcgcttgtcctggaaaagatcagggaacggaatgtcaataatacccactttagggaaattggccgaatacaaacggaacgcattgtcatcatttgccccaaccgctgcatacgtcccaagcgaaatcgcacaagggaaaacgtgcccgccattgtaatccgtgtgctcaccaatcaaattaattcgcccaggcgcgaaaaaagtgtgttctgcctgcttgccaaattgctccgtaaagcctttcgtgacatctgtactgttcactgccaatacctcctaatatttaaaaacgcgtcaattatttgtcgatttttgtaaccgtttttattttactaaaattaactccaaaatggaagcgctattgtcgaatattttttcaatccgtaaataagcttccaaaactccgctgatttgtttgctggtgttttagtaaaaaattcagaaacatgatcactatatacaaaaagcatcagattatctcacctccaataatccgatgcttttgctgtttaatccatatggcaacatgtttaccaggtcagacgctatcacttggtcagttttaccacaagaagagcgcgggtgttgggttttagtttattgcttgtcttcgagttgcttgatacgtttaagcattcgaatcatgtaacgagactgatcaataagcaacatggtggtcattaacgtatcctgcccatgcaccatgataaaagtcacatccatttccgctccgcctgcttcttggcttaacaattgcgtctgttgattatgtgcttcattaatatctttttgcgcttcgtcaagtttggcctcggctccttcaaagtcacccgcttctgcagcattcaaagcacgcaaagccgcagtccgagcatcccctgcataagccacaagtgcaaacccaaccatcgaaatctcttctctcgtcgccataattcaacctccattttaaaaaagtgagcgcgagccggcgcgcttagggatcggagtgtaagcggcctggggcgtgatggccgctctttggccattgcgatccaggtccttacacgcagattcctgcgccggggagcgcgttaatgtgagcgcgagccggcgcgggtagaagtcggagtgtaagcggcctcgggcgaaatggcccgctctttggccattgcgacccaggtccttacacgcagattcctgcgccggggagcgcgttaatatgagcgcgagccggcgcgcttattccggaatcacatgcgtttggctaacttgttttaaccattcggcactttgcttgacataacgtttttgcgtcggaaagtcgacgaaaaacaatccgtaccgtttgctataaccatttgtccaggaaaactgatcctgcagtgaccaaacaaagtagccttttacattcgcaccagcctgaattgcatctgcaacggcacttaaatattttttcaaataatcaatgcgtttgggatccgcgatgaccgtatttggcgtcacttctgctggtaaggattctttcaatccaataccgttttcggtgacatagatggctggtactaacggataatcttggtgaatccgcatcaacatgtcatacataccacgcggatagatggaccagtcccaatccgttgtctcaatcccggctggcttcttctcctcgccgataccgtgaaggcgggcaactgacgatccctttgagccatcaccattatgaatcgtttccgacttgccgtgataagcgcgcagccatttgctgaagtaattattaacgccaacaaaatcaagctggtgcgccgccttcttaatagccgccatctcttcatcagtgtacttaaacatcggttgttgattggctgccagaatttctttgatcaaagccaaggtcttaggggcgtaatctcctgccagtgtgccatctaaatacaggcgattttccaacgcatcctgtaaatcagcggcatgctgatcttccgacgaatcactatatggataaggtgtctgcaaggcatgcacgataccgatttcaccatctagccccatcgacttgtacaaattaacaatacgcgcatgggcaacgatttgattatgttcggcctgaaatgttttatcaaaatgaccggtttccgctggtggaaaagtaccgctcgtatattgttgcactgccatggacgttggttcattgatcgtaatccagtgtttgatttccggaaattcttcgaagcaaaaccgcgcgtactcgacaaaatcttccagcatttcttgactcagccagtcaccaatcgcatgtaaccgttctggtgtatcaaaatgatgcaacgttacaaacgggataagatgatgcttggcacaggcagcaaagagccgatgatagaaagcaacgccacgaggttccaccgccccggcaccatccggaaaaattcgcgaccaggcaattgaaagccgtattacttgatgaccatatgcttctgctaacgccaaatcctcatcatagcgatgataaaaatcagcggcggggtcaggactaaaccgcccttgtttttccagaaaatcatcccaaagaactcgaccttttccgtcttctttggttgccccttcaacttggtaagcagcagttgcgccaccgattacaaagtccttgggtaattgtttacgcatgttttaacttcctcctataaagtatgcagacgagtctgtctaggttgatgaacgcctaaagattggactcaacaaaatccagtgccatatcgccgttgtttgtcagttcaatgtactggcggccagtggttgtaaccaacttaacgccatatttatcggtaatctttttcaaattatccttcatactttccatttgtggcgccagaatgaccatactcatatctttgatcaagtccatatcctgtccataagcccgagccgcggcggacaacttcaacccccgctccttagacagcttgtttagcgcattggctaagatgccactggttccaccaccggcacaaagcaccagaacgtcaatttcattatttttgaagaaactctcatcatgcgctgccgctggtttttcatcagccatttcggatgcttcgacctgaacctcagccgtttgtggtgcaaccgtatcggcagccaaaaccgccgtatcctgtccttcaatcacatcttctttagctttttcttcggctaaaagcgttcgatcgtacacgcgaataaacgggaagtagataaggacgtctaacacaagtgtcaacaatacaaagacaaatgccagtggagcaaaaccggttgaaactaagatcccgatgggtgccggtaccgtccacggcatggtgtagatcatgctattcatgcctaacacactgacaaagaacttaaacaggcaaacattcacgatcggcgttgccaaaaacggaatgaaaaacatcggattcataataatcggcatcccgaaaagtaccggctcgttaacagaaaatgttcccgggataaaagccgctttcccgactgcttttaattgtgccgaacgcgccgcaaacagcatcacgaacgcgacaaccagagtcgatcccgtaccgccaaaattcataacataatccatcgtgttcatcgccaacacatgtgaaacatgctgtccggcttgatattgctggagattggccgctgtattggcaatcatgatcggaacaacagccggctggacaattgaaggcccctgaaccccacagaaccagaagaatgccatcgcgccggcaatcaacgctaaccccagataagaatcactggcctggaagagtggcgacaacacttgaataatccagcgcggcaggatcgttcccgttgctgctttaaacccaacgccaaagagccaaaaagcactaacagatagccccattggaattaaatctttaaatgactgggagatattgcctggaacctgtggcggcaacttaatcgtgacgttgtttttaatacaaacgtagtaaatattaggcacaattaagccgacgatataagcgcagatcaagccctgagtgcccatgtaggttaaatcgaccccggttttaagcggtaaaatcgataaaatgacaaaggcgatttccgaagcaacaatgaccgcaaccggattgatctggtttgtcttgggtaattccagattcttgctgtcggttaaattctttgcagtcgtaccggcaacaaataatgccaacaatcccattgagtagttgtaagcaatcatcagggtatcggtcacattcttaggccagtaaaacccccaagcattaggaacataagcgatcatcatgaagatactggagaagatgatgatcggcatacaggcaataaagccatcacggattgcggacacatacttattcgccgcaatcgcttcaaaaatcggctttagcttatcgaaaaccttattcatgatactttcctcccgtgagcgtatgctgccctccaagccagcaaacgcgttatgattttttgccctgtttttgatcgtgggcaggcgcttcgttaattagccgctgaatatgaatgataaagtataagcgttcgtcttcactcatgttgcgataaagctgatccttaatctcatcaaaaatttccgaagcaatctgataagaccgcggataattttgctctaattcattggccacctcgggcacaatggcaacagcatccgtattaacacgctgcagtcggtcaatcagatactgtaagtgaatcatgaagcgatcataataattgccgttagtttgcgatctcgtaatgcgatgccgcttcaaaacgcgttgcaccagttgacttaatgacgcctcattattcttatcaaaggcctgctcgttgtcgtcttcaccgctggcattgatgaaatgcaaggcaagatttttcacttcggaaggtggaaatgctacgccaaggttagctgcaatgatctgcaacgcttggttagctacggcatactctgcaggatactgaatatgaaaatccggcaccatcgtctcttgatacgttccattctgataacgtttataggcttcgtaaatatgatcgcttaacgtaatgtaaatatagtcaagtaccttaaggtgaaattgcttttgcgcaacgtcaataatttcataagtggtcgtcaccacgtcgatcggaatattgcgaagtaaaaagtacagattctggcgggaagtttcacttgcaaggtagaaaattttttcaatttgtttagccggaatcacatcgccacgcttcttttgaaacgcgatcccccgtcccttaacaaccgcttgactatggttgtctagctcaaccaacgccacgttattgttaaagatctgatcgattttcggcatctcatcatctcctcacccagacatagaaaaaaccacaaatcacgcgctactctcagcgtcatgatttgtggtctcgcctaattgaatagtcacaatccacaatgaatattcctatcaacaaacaaattgtaccatatataaacaaaatgtaaacgttttatttgatttactttctgaattttcacagacgtttttgcataatcgttttaaaagttcacttgccatatagacaagcacattcatagataaaataacaacaatactgtaactgctgttttcacctcgcaatttttgtggctgaatcgtaccccccatccgcgccaagcattttaattgacgccttcctaaatcagacgataatgatcgagacgaatgagcaagctgttaacaatccggacaaaatattgaccgtaacagcacatctttttcaaggaggtcatcatggcaattcctgatttaaccattattgtccccacctataacttaggccggtatcttccagcgactttaaagcgcatccagcaacaaaccatcgacgtggaactttggttaatcgatgatgcttcaaccgatgaaactgctgaaaccgccgccgcgtttgtaaatggcatccccaattatcacgcaaccgccttttcccatcaccaaggtatcggcgccgcacgcaattttggtattgaccatgcgactgggcggttccttgcgtttgtcgatggtgatgatctgattgcaccgacttttgctgcgaccttgctacgcggatttacccccggcgttgtcgcaacagctgtcggctatgactggtggcagcgtaaccgcggcggccctgatcaatttcaattgctatcacaagcggcaatgtttgaacaggtctcgcatcacggtaccgaaattggcggttatatttggaataaggctttccctcgtgccagcttaaatgccgggcatattcgatatgatgaacgattacaaattgcggaagattactactttactgctgacttcgttgcccatacgcccggcatgtatgcctacaacccaaccattctctacaccaaagtcaaccgtcccgacagcacgatgcaccgattttccccggctgatcggcgccaggaaattcaaatttttgaacgtattcttgaattaaaaaaattaattcagccggactagttgaggtgagaaactggttttgagcccgtatttccgcgggtttgggctaggtctatatattcacgcttttaaatattcaccttatagttaaaataacttatgatctatataagtgtactacttgcaatcagcagcaaagtcatgtataactattttagaaaacgttttcattgtgcgcaatcatattttactggaggtagttaaccgtgacaaacgaacagcagtatattctggcgattgatgaaggaacaaccagcacgcgtaccatcatcatcgatcacaatgggcaaaaagttgctgatgcccagcgcgaatttccacagtattttccacatcctggttgggttgaacataacgcaaatgaaatctggaatgctgcgttatccacgattgccacagcgtttatcgaatcgcatattcagccgcgccaaattgttgggatcggcattacgaatcagcgggaaacaacggtcgtgtgggataagcaaactgggctgcccatttacaacgccattgtttggcaatcccgtcaaaccagcgacattgctgatcaacttaaagcggatggctatgctgatctagttcacgatgccaccggtttgctaattgattcctacttctctgctaccaaaattcgctggattctggatcatgtaccaggagcgcaggaacgggctgaaaatggtgaattgctttttggcaccattgacacttggctatcatggaagctttctggcggtgccattcatgtcaccgactacaccaatgcttcacgaaccatgctcttcaatatccacaagttggattgggatgatgagatcttacggattctcaacatccccaagcaaatgctgccggaagttcgcagcaattcagaaatttatggggatgcagcagcctatcatttcttcggcagtaccgttcccattgccggtatggtcggggatcagcaagcagcattattcggacagctggctatcgaaccgggaatggtcaaaaacacgtatggtaccggtgcctttatcgtcatgaataccggcgataagccaaccttgtcgaatcataatctgctaaccactattggctacggacttaacggcaagatcacttatgccttggaaggttcggtctttgtggctggcagcgccattcaatggttacgtgatgccatgaaactgattgagcgttcaagcgactccgaagctgccgcacgagcatccaagagtcaaaacgaggtctatgtcgtccctgcctttactggcttaggtgctccttactgggattcggatgcacgtggcgctattttcggaattacccgtggaacaactcgggaagacttcatcaaggcaacgttacaatcgcttgcttatcaatcccgtgatgttgtcgacacgatgaacaaggataccggcatgccgattccagctctgcgcgttgatggcggggctgctaataacgattacctcatgcagtttcaggctgacatccttggtattccgattgaacgcgccgccaaccttgagaccactgccatgggtgccgccttctttgccgggctagcaaccggattctggaacagcaccgatgaactccaaagtatcgtcaaggtcggtaagcgctttgaaccgaccatggacgtatcagaccgggaatcactttacgaaggctggaaacaagccgttgccgccacccaacagtacaagcacacctccaagcaagactaattcattctaaagcacgatcttattgcgccatcatttatcttatttaaaaaggagcctactcaaaatggcattttcaaaagaaacccgcacccagacgattgatcaattgaagcagaccgaactcgacttactcattgttggcggtggtattaccggtgccggcgtagcaattcaggcagccgcaagcggtttgaaaaccggcttgattgaaatgcaggatttcgcggaaggaaccagttcccgctcgaccaagctggttcatggcggcattcgttacctcaagacttttgatgtcggcgttgtcgccgataccgttaaagaacgtgccgtagttcaaggaattgcgcctcacattccgcgtccattcccgatgttgttgccagtttatcaggaagccggcagtacttttgatatgttcagtatcaaaatcgccatggatctctatgatcgtctggcaaacgttgaaggttcccagtacgccaactacaccgtcaccaaagatgaaattctgcaacgcgaaccgcatttagccgctgatggcctccaaggcggcggcgtgtacctcgactttgtcaacaacgatgcccggcttgttattgaaaacatcaaagaagcagcagaattaggcggactgatggctagtcgggttcaagccattggcgttttgcatgatgatgccggtcaggttaatggcttacaggttaaggatcttttggatggcagcgttttcgacattcatgccaaactcgtgatcaatacgaccggaccttggtctgacaagttcaaggcgttggatcaagccgaagatcaaaccccaacattgcggccaacgaaaggggttcacttggttgtcgatggttctcgactgccggtaccacagccaacgtatatggatactggcttgaacgacggccggatgttcttcgtggtgccacgggaaggcaagacttacttcggcaccaccgataccgattaccacggcgacttcaaccatccgcaagtcgaacaagccgatgtcgattatctcttgaaagtcatcaacaagcgctatccgcaaagccatatcacgcttgacgatatcgaagcgagctgggcaggattgcgaccgctgattgccaacaacggcagctccgattacaacggcggcggtgcgaacaccggtaaagtttcggatgattcctttgaagcgttaatccgtgtcgttgatgattacgaagacaaccaggctacccgcgctgacgttgaacatgcgatctccagactagaaacagcccacgccgaagctgctttgagcccatcacaagtttcacgcggcagctcacttcgccaagccgatgatggcatgatcaccttgtccggtgggaaaatcacggattatcgaaaaatggcagcgggcgcgcttgctttgatccgccgcttgttggctgaacattttgcaaccgaaacacggaccgttgattccaaaaagctccaggtttcaggtgggcattttgacccgaccaacgttgacgatacgattgctttttacacgcggattggcatcgatgccggcttgccggaaaaagatgctgccgacttggccaatcgcttcggttcaaatgtcagccgggttgtcacctacacagatgggcaggcggctcctggactcagccttaaggaaaccatgagcctgcgctattcgatcaacgaggaaatgaccttgacaccagtggattacctattgcggcggaccaatgcaattctcttccatgccgagacccttaacgagcttaaacagccagtcgttgatgaaatggcacgcttattgggttgggatgacgcgactaaagcccaacaattggctgatcttaatcaggctatccgtgaaagccaattagcagacttgaagaagacgccagcatcaaccaatcctgcgtagaaagaggtagccatatgtggacacaaacattaggtgaattcatcggtaccttcatcctggtactgcttggcgatggtgtcgttgccggcgtatcgctgaataaatccaaagcgaatggtgctggctggattgctatcacactcgggtggggcttagccgtgacgatgggcgtttatgccgcggcatttctcggtccagcccaccttaacccggccgtgacgcttgcgtttgctgccatcggtcaatttccatgggcttgggtcatgccatttgtcggtgcgcaaatgctcggcgctttactgggagcggcagttgtgtggttgcattactatccgcactgggaagcgaccaacgatcctgcgacaacgttaggcgtttttgcaaccggccccgcgattcgcaattatgcggccaacttcatatccgaattcatcggcacggctgttttgatcttcggacttttggcctttacaaagggaaaatggacagatggactgaatccaatcggtgtcggcatcctaatcaccgctatcggcctatcgcttggcgggacgacgggttatgccattaacccggcacgagacttgggaccacgcctcgcccacgccattttgccaatcgcacacaaaggcgattccgactggccttatgcttgggtaccgatattaggacccctggcaggcggcgttgttggtgccttgatcttcacggttttgccgtaacctgtctctaaaaactcacaatgtaaaaaccgccaattcgttaataaaaacgaatggcggttttttattgagcgtgagccggcgcggttagaagtctgcgctggggaacgcgttatagaaagtgagcatgaactggcacgattaagtatcggtaaacgcgttatggttgaaccctacttcattagtcgtgccactcgttcctgtaaagcaggcacaacttcagccataaaccatggattgcgattgacccaaccatagttaagtggcgagggatggacaatcggaaaatacgtcggtaagtaagcccgaaagtttttaaccgttgccgttaacgttttttcccggcgcttgcctaagtaatatttttgcgcataggcaccaataacaatggtcagctgaatatggggcattaacgctaacaaggacggatgccattttgcggcgaaatctttgcgcggcggtaaatctccggacttaccttttcccgggtagtaaaagtctaatggtaaaacggcaattttaccgctgtgataaaactgatctttggtaacgcccatccatgtccgcagacgatcaccgcttggatcattccaataggttttggttgtctgggctttgcgtcccggcgcctggcttgcgatcaaaatcgttgcgtcaggttcgatgtgatataacggatcccaaccttgagccgtaaaggttgcattagccggatcctgccgaattgcttcaaaaatcttgtcggccgttgtcacgcttgaatccctccttgccgatatttgggccatgctttgttgcgttcgaaatccgcggcgagttgacgcgcatctttaatcagcggctcaggataggccattgttgccaacaacgcaatcgcattatgggaagtggccggtccttgatgcagtaagtaatcaaatacgacgccatctttttgggtcactttttcctgaaaatgccaattgatgcactgatcccccatgatgtcggttagttcattgtcgtgcgtggcaaccacgaccaaactcggataatggcttaaccagttgatgacactggctgaggcggcaatacgttcgactgtattggtgccttttaggatctcgtcaataaacccataaacccgcttgtttgacgccactgcccttaacaaccggtgaatcgctttaatttccgcgacaaaataactatcgccttcactgagatcatcccgaaccgccatggctgtcatcaccaatcccggctgcatcgtcaacttttcagctaaaaccgtattaatcgtctgcgccaaaatggcattcaccgctatgcttttaacgtatgtcgatttccctgacgcgttggctccggtaatcaaggcatttttgttccacgctaccggattggcaactgggtgtttcaatagcggatgcacgattttcgtggccgtcatgccgcctgctgcaaacgccggctggctgctttgcgaatgagccgtccgaaaattggcaatcgcaatcgctaactccaaatcgcccaacgcctgccacaaagtcaaggcctcgtcatggttgtgatataaccgcgtcaacacattattataagcaataaagcccaacataaacatgctgctaaaatactcggtgatcatgtcgcttgagctgttatcccgcgagcgaaacacaaacgccaaccgggtaatcccccgcatcggtcgaacggcagcacgcaaagcatcctgagtgggctgctgaattttgaccaaatgttccacggtaacaatcgttcgtactaagtagcccatcgccgttacttcagcgtccaaggcttcacgcttcaaaacataatagaaaagattcaccatcaaactcaagacgatgatgctcacgccaacagccggaagtaccagcgccagcaccaagccgaccagcggcaaactgcctaacactttaaaccgccaagcatgcggcaaagcagactgagtcgtggtgcgtaaataatgctggctgttgttagcaacatcttcccccagtccggcaaatgccagctgcactttgagccgttcttctgcatgggtctggaaaaagctgatcaacgcttcattgacatcgggcttgcctaaattataggctcgcaattgtgcataaacccgctcggcaccgacactgctctgagtcgcattcagttgtttaaacacgtcaaacatatcgagatcctgccaggttaaatcatcaatctgacaatcatggttaacctgcgcttcatgatcaaggtacgccgcttttaaatagcgctcactgccaccacgtttaaccggcagcttgccccaattcgcaatcagatcgcgtttaagcctcagttgtcgttgccccgttaagataaggttgagcagcacaactgcaacaacgaaacccccaacacctaataaaatcatgactggttgtgtcatgttgaattccttccttttgccctttgatgcagcgataccagacgtttaccggataaagttgcttacattatccctcaccattgcagaaaaaacaaaaagcattgtctctccacccgggagcaacaatgcttttcattaacaattacacttaatgctcagatgccggataaatcgccgccacctgcgcctgggcagtttcgtgttgcatgaattcgtcgtaacttgtgtcggcgcggtcaactacacccagcggcccgacttcaataatatggtcagcgatcgtttgaataaattgatgatcgtgactggtaaagatcaaggagccggtgaaatcaatcaacgcgtcattcagactcgtaatactttccaaatcaagatgattcgtgggatcgtccataatgagcacattggctttactcaacatcattttggccaggtatgatcgtaccttttcgccgccagataaaacgttaagctgcttgagtacttcatcaccggagaaaagcatccgccccagaaaaccgcgcaggaaagtgttgtcctgttcttcttgcggggcaaactgacgcaaccaatccaaaatgttgagttccggatggtcaaactccggattcaggtctttaggcattgcggctcgactggtcgtcacaccccagttaatcgttccgctgtccggctccaattcgccagccagcaactgcattaaaacggtggccgtcacgtcattgcggctaataatgccggttttgtcaccggggcgcaaaatgaagctcacattttgcaacaccggctggccatcaatcgtcttggaaacattttccactcgtaataagtcgttaccgatggcgcgttcaggttcaaacttgatatacggatacttacgcgagctgggacggatatcgtccaatgtaattttttcaagttgcttcttgcgcgatgtggcttgcttggatttagacgcattcgctgaaaaacgggcaacgaattcttgcagctgtttaatctgctcttcttttttggcattggcctgactttgcagttgcaaggccaattccgagctctgcttccagaagtcataattaccgacatacaattcaatcttgccaaaatcgacatcacacatcatggtacaaaccgcattcaggaaatgccggtcatgggaaaccactaaaacggtgtgttcatagtcagccaaaaagtcttccagccagctaatcgcctgcgggtcaagtccgtttgtcggttcgtccagcaacaacacatccggcttaccgaaaagcgcttgggcgagcaaaaccttgaccttctcaccttcgggcaaatcagccatgagcttctggtgttcactttcgctaatccccaaagactgcaaaagctgcgaggcatcactttcggcattccaaccgtccatttccgcaaactcgccttccagttcggctgccttattaccatccgcttcagaaaagtccggcttggcatacaaggcatctttttcggtcatcacttgatacaagcgttcccacccttgcaaaaccgtattcatcaccgtttgatcatcaaaggcaaagtgatcctgcttcaggctactcatccgctcattcggcgacaaactcacggtcccggttgtcggtgttaattcgccttcaagaatcttgagaaaagtcgatttccccgccccattggcaccaataatgccatagcaattgccaggggtaaatttcaaattaacgtcttcgtaaagtttcctatccgagaacgtcatcgaaacattatttactgtgagcaatttcatacctcgcttaaaagatttctacatatattagcagatattgaggggattcacaaatgtagagcgtgaacaggagcgcttagaaatcggagtgtaagtggcctccaggctaaatggctggtctttggccatttagcctggaggtccttacacgtagatttctgcgactgtgaacgcgttttagaacgtgagcgcgaaccggcgcgcttagggaccggagtgtaagcggccttgggcgtgatggccggtttttggccattgcgcccaaggtccttacatgcaggtccctgcgccggtgagcgcgttatgggcgtaaaccagaacattagcggcctcagacgtgatgacccgctcttggccatcgcgttcgaggtccttacacgcagatccctgcgccggtgagcgcgttatgggcataaactagaacataagtggcctcagacgtgacgaccagagctttggccatcgcacttaaggtccttacacgcaggtacctgcaattataaacacctttaaagtgtgaaccagaacatctacaacctaagaattcaagcggtgacacggtgtcacccgctttttaccttttcttttgcgtaatctaataatcgaatgaacaaattaccaaatccaccgaaaaacaccctgccccgcaaagtcagacttgtgttaacctcaaaccatatcttttccacgacagtcgccatctggaggaacctatgaacaacttagtcacattgatgctgatccttgctggcataacgctgcttttattacgcaatggcaccaaacgccaacgccgcgccaaccgtaaacttgcaatcacccttttgttagttggcattgcgagtggcggctacacttatacgcaacaacacccgcaaaccaattggctgccagctttaactagtagtagcagtagtagcacatcaaccgctaaaaccggcacgtcgcagcaaccggttaagcaattagcacaacttaccgaaaacggtcagccggaaatcacaatcaacaataatgatcccggttttacgcaatccgaattgacgaccagtaacggaccatggacgcgttttagcgacttggattctttaaaccgtgtcggtaccgcgaatgcccttttaaaccaaagcatcatgcccaaagtaaaacgcgagcctttgacttggaatccgactggctggcataacaagaaggttcatggtgaatggctctataaccgcagtcatttgatcggttttcagttatccggcgagaataacaatcccaaaaatctgatgacaggcacacgtcaactcaactcacctttaatgcaggcgcatgaagatgacattgcgcattatctcaaacaatcccctcaacactttgtccgctatgaagtcaccccgatttttcgcggcgatgaacgcctagcccgcggtgtggccatgcgggcgcaaagtattggcgataacacgattcgctttaatgtgtatatcttcaatgtccagcctggtgtcaccctcaattacagcgatggaaccagtcagatcaattaagcagcttaaaactcaattgaaataatgttgggattatctgcataaaacgtcaacaaacgtcgcatatcctcattggctttactttcaacatgcaacgtcatcttgacttcatcgccttcatgtttaatcgaaacgtttaggaccttaatgtgatacttacccagtgtttgtcgcatgtgttccatatcgaacccttcattacgaatgcgaatggtcaaaatgccattatcgccacctggtaaccaccgataatgatgatgcagcaacacctgaatacacagaaccaaaacagtcgcggacaagccgataatataaagcttggcgccgattgccatccccactgcagccgtcgtccagacaccagcggccgtggttaagccattgacattattgtgccgcactaaaatcgcaccggcacccagaaaactgaccccactgacaatttgcgctgccacccgggatggatccagtgccatatttttcaaatttaaaatatcaaagaaaccgtatttagatacgatcataatcaacgcagaacctagcgccacaatcatatgtgtccgaatgccggcgtttttgaagcggtttttgcgttcataaccaatggcaaaaccgcaaaatgccgcgaccaacaaccggacgactaattcaacctgattcagtactgtcatcgttaaaaatcacaacctttatgattactttaccacctagctatgtcgatttgatgaaaattacgtaaaaggacagcttacaattaaaacacatgcggctcatgaagccttccagccacactgataacaaccccttctaacacctcacgtgcgccctcaacagtcgcatgcaacgaacgcgttttttcatctaatatattagcagaaccggcgatgaaaaggattgcattccggcacggctatgctaaactgtttctaggttagaatgattctagtttggaggcggaaatatgaccattgatttacgggacgttcaagatgtttacaaggatgcaggctcagacattatctttgccacgtttgatctaaaacgagaagaccccgctagtgacaaggcaatgattgccgacttggcggagcatctgccagcttttatcaacagcatgaatattcgttaccccgaggcaaaattagcagtcgctttcgggttgtcgcgcaaggcatgggactatctttttcccgaagccgcacgaccaaaggaattggaaaattttcaatctatcgttgggccaaaatacacagccgtcgcaacaccggctgatttattcttccatatccgctcgcaaaactcggccgtaccgttcgaactaatgagcgagattatggccattattgaagccaatacggtaaccctcgatgagacccacggcttccgctactttgaaggacgggccattatcggtttcgtcgatggcaccgagaatccaagcgccttagacacgccggaatatgccgtcattggcgatgaagacccggcatttgaaaatggctcctatgcgtttgcccagaagtatcagcataatctagacgcatggaacgacctgtcaaccgaagatcaggaaaaagcgattggccgtaagaaatttaacgatcttgaactagacgacgaagccaaactggcgaactcacataacgtggtttctcaggataatgacggcggcgtggaacataaaattgtccgcatgaacgtgcccttcagcaacccggctgaaaagatcaacggcacctactttatcggctatgcccgccattggaccgtcaccaaacggatgttgcaagggatgttcgaaaaatccgaccggctattggacttttcaaccccgttaacaggcgaactcttcttcatcccgtctaaatccgtattggggaaaattgctgacggggaactataatttagcacgataccgccatcaggttaaacgctgatgacgattggatgctcagcctctgccttaacgacaaatttgttgttgaggcttttttaatgttgacatgactagctgtttttcatgtggaccaatcagtaaaaaacatcaaattccaaatcatcgtcaagcattcatgtcatataagctgacgttcaaaatatttttttgccgtgccataaatccttttaaatcaagtcttgtcaccacgataacgcattcggtctagatcaataaagccagcacttacgccgtagccggcaaaacccgtgctacaataccgccattcaagatgaatgaggtggcacagatgaatttagccgatacaggatttgtgatcattgcaagcgttctggtttggtttatgaccccgggacttgcttttttctatggaggcctcgtctctaagcgcaacgtcattaataccatgctgtcagtcttctacattaccgggattgcgattttactgtgggtggccgtgggttatgaattgagcttcaatggtaatcttttcggggtgattggccaggtacagcatctctttcttagcggcgtctcgcttggtacggcaacggtggctaggattccaaccggcgtttacattctctttcaaatgatgtttgctatcatcacgccggctctgtttgtcggtgcggttgttggccgcatgcattttaagttcttgacttggtttattgtcctgtggtccctattggtttattacccgcttgtacatttaatttggagtccggatggcttgttggctgggcttggcgtgcttgattttgccggtggaaccgtcattcatattaacgccgggattacggcactgaccttgtctgcctttcttggccggcgcgcggatgagcatacggtgccttacaatcggccgtgggtgttgctaggaacagccattctttggatcggttggtatggctttaatgccgggtcggcgctgggggtcaatcaggcggcaatgacggcggctttgaccacatcggttggcgccgcagcagccttagtcacctggatgatccttgatatttggcaaacaggccatccaaccttaataggcacttgtaccggcgctttatgcggactggtcggaatcacgccggcaaccggctacgtgaccagttttggtgcggtttgcatcggtgtggcatcaacgttagccagttactggttcatcagcaaaatcaagccacgactcggtattgatgacacattagacgcttttggctgtcatggtgtttccgggatcgtcggtagtgtcctgaccggtgtttttgccagtaaaacggtggctccaggcattgcccacgccggactcgcatatggcggcggctggcatctgctgctgattcagctagccggaaccattatcgtgattgctttggtcgctgccatggtcacgattattacgagtatccttacccagtttgttgccatccgcgtatcgccagccgctgaaaaaatgggactagactacagtgagcatgccgaaccggttgacgaagaagtcgcagccagctgggaacaacatacgccggttagctcgtttccggatgagttcaaaggccagctacatggctttgatccccgaccacatcaaaatgatcagtgaccgctgaataacgtatcagccactgatggcgatttgatttgaaggtaacgggtgatatttagcacaccaagtcactttaattgttttttcctcgcatcatggttacaatgccgctagtttaacatggcatgatgggggaatcatgatgatcggatacggatttagtcatgcaggcgggccggaagtgattgatgcgattgacttgccgacaccacaaccgggacctcatgaaattcaaattaagactagcgcaatcggtctcaataaccgtgatcgcatggcgcggcaactaggcggcagtggcttgacagtaccgggatacgatgttgccggtaccgtcagttcgatcgggagcaatgtttctcggtttaaagtgggcgatcgcgtggtggcgcgaacaaccagtgcctatgcagaaatcgtcactgccgcagctgacatgagcgtcttgttaccagcttcgattactccggaaaaaggcgtagcggtcattacccctggtgtcaccggttaccgcatggtggaactgggcaatgttaaagctggtgatactgttattgttaaaggtgcctctggcggggtgggctcggcagcaattcaactcgccgttgcgcgcggggcctcggtcatcggcattgccagcagccgtcatgaagtcgcggttgagcggcttggcgttgaacactttgtcgcttacgatcagggtaatcccgtcacccaactgcgccagactgccgatgtcgtgattaacgctgctatgaacgggcttggtggcgatgatgatgtcgctatgaccaaagacaacggactgatcgtttccgttagtcacacagaacctttactcagcagaggcattcgttttattcatacccggccacttggcggatccgaggtaggcaaagctttgcaactgctcattgatttgatggcacaaaacaagctcaacgttcaggtcggctatgtgttgccatttacccgcgaaggttttgtcaaagggcaccagttgcttgatgatccgcagcatgaaggtagaattgtcattcgcgtggatagataaatcgcgctataacaattgtgcagctcctaaagctctgactgaaaagatagaaggtcagggcttttatatattgagagaattgcaagtgattccatttttattggttgatacagccgtacaggactaactagaaacaaccatcacaaggggttataatgtcgttatttctatcttatccacttctaagtcgcgacttcttttcaggccgcgattcctcaaccccaaggagcccctcatgacttttaaattctgtcctatctgtggccacgcgctcatcccaaaattggcaggcgatgatgggaatgtgccttactgtgaaacttgccaacgcttttggtttccattatttgccgattgtgtcctcgtgctggtcgtcaatgaatttgatgagattgcattggtgaaaatgccttatttgtctgagaaatatgcctctatcatctcaggttatatgcagccgggtgaaagcgctgaggagagtgccaagcgcgaagttatagaagaactcggcatccatctggatcaactcgactacgctggcacatattggtacaagaaaactagcagtctcatgcatggctttatcagtcatacttccaagcagtctttagtcacttcacctgaaatttccgaagccgaatgggtaccggcatcgcttgcgcccgaaaaaatgtttcctgattcaccggataatgccgctttagccgtctatcgtacctatctgcaaacaaaacaacgtcaataaaccaccaacttgtttcatcaagtcagcctgaccaatagcaagcagacaggttaatggggcctgcttgttcgcgccaatcagcttgatcaataaccaaccgcagccgcccgttgttaaagtcgtttcgcttgttgtcggcaaacaccggtggtaggctaaaacacggtgagactgtgatacatggtccgctgtacataagtaacgatcaagcaactcataaggaggcccatgatggctcaggaaattttgattaccaccaccgagaacattcccgggaaacattacgaaatcattggtgaagtttttggtttaaccactcagtccaaaaatgtgattagtaacatcggcgctggcttgaagaaccttgttggaggtgaaatcaaagcctacagcgatatgctgcatgaatcgcgagaaaaggcaattgatcgcctgcgtactgaagctcgcaaagcaggaggcgacgctgtggtgatgatgcgctttgattccggatcaatcggcggcgatatgcaaagcgttgtcgcatacggaacggcagtcaaactactcgactagccatctcaccacaacgcgctccccggtgcaaaagtcggctcgcgtttacacaaaagccagattcagccgcggttgaatctggcttttaaaatcaacaagaacgttatcccctagtgatgagaggaatcaaagaacatggcatttttagattatcaccatcaggaaaaatggccgaatggttttggccaacttcaatcgcccatcaatcttttaccggcaactccagctgacccgtcaacgttgaaaattgaaacgccgtggcgggtgacgcaagaaattgatgaccaggttacgatccggcttaccggaaccggtcgcacccgaattgatcaggatcagtggcaattgatgcaggcccatattcatgtacctgccgaacaccaaatcaccaatcaacacgctgccgaactgcatttcgtccatcagtcagcaatcggtgccttatgcgttgttgcggttctcttgccgttgggtcctgacaatgttgtgcttgagcaaatactcgatcattttgccgcccattcaacccaatccattgcccttagtctggatcagctcattccgcaacaagggacggtatatcgctatctcggctccttaaccacgccgccgctgacagaaggtgttacttggtatgttatcgatcaaacggcggttaccattggcacgcagcaattacaccgttatcagcagctttttgcagataaccatcggcagcttcaagcgcgttatcagcgtccggtcctgcgcagcacatttaccaaattggctgactaaatcggtactggccgtgcctgctatcaccggtggttgactaaataccgttgttaaaaggggtaagtcgcaacatgacacgcaaacaatcacgtcagcaccgctggggatggcgcttacttttgatactctttctactgttggcagggagttattgggtttggtggcagctaggcagtcgtcggattcatgcccagacttaccgacaaacatctgttgtgaccgtgtttgttcccggctatgccagtaatggcctaacttttggcccgatggtgacccgcttcaagcaggaccgcgcttccaatcaagtgacgaccattaccatcagcgccaccggcaaccgcacgataaccggcgctaaccggtataccggcaagaatccgttagttaatgtaatttttgaagacgccaaagccccggaaaaggaaacccgacaactgactgccttgttacattggctacgtgccaagcacaacgtcaccaaagtcaatcttgtcggtcattctatgggcagcaacctcagtttcagatacctcacgacccaccacgctgatgctcagccgcatgtagtgaagtatgtttcattggcaagcgagttttaccgtgaccccacacctcaattacagcaattccctaaatcagtccaaaccctcgtcatcggcggtcaaatctttggtgcaagtggcgactgggccgtgagcatcgctggcgtcaagcgctttgaaaaggccttgcgcgcggcaaatattccaagtacgctttacatctatcacggaacgccgcttggtgcctatcacagcagtctgcaccagaatccttacgttgatgcaagaattttggcatttctgttcacctgacgcgaatttcgagttagccgctgtgctgtttttacttcaaacaactggacaatgtttaaaacgatgctagtgttttcggactggcatcgttttttttggtgcccattaattgaacttatttcaaattcttgtcatgacgaattgcagttacgctcactttccttttgtccacgaagttaaatatccgctgtcattcaccgtcggcatctgaccactcaccttgcaattttgaccacttatcggcatcagcgggacggattcgctcgcactggctatgcttgaatcatcaaacaaaaatggtgatagatatgatccttctcgaaacaacgaatctgacaaaaacatacggtaccaaaaccgttgtcaatgatatcagcctaaaaatccaagctggccaactggttgcctttttagggcctaatggtgcaggcaagtcgacaaccatcggcatgctgacgggattaattcaacccagcagcggcaagatcacaatgggcacagccacgccgaatcaagcggcttatcggcaacaaatcggtgttgtcttccaagacagtcgcttagatcggcagctgactgtaaaagagaacttggaaatccgttcgcaaatgtataccaaaactgatccggcctggtttgatcacttggtcgaccaatttgatttgacgccaattcttaaccaagcttacggcacattgtctggtggtcagcgccggcgtgttgatattgcgcgcgccttgctcaatcatcctcatctcctttttttagatgaaccaacaacgggcctcgacattcaaacccgccaaaccatttggaccgccatcgcttccttacgtgcgcaatcacagttaaccgtaattttgacgacacattacttagaagaaaccgaacaagcagattttgtctatgtcattgatcagggcacgattatcgccgcgaacactgttggccaactaaagcaacagtatgccggacatcagcttattgttcgcacgcatgcacctcaacaagtacaaatagccgcaacccaagcgaatctccccgcccagatcgatggtgacacagtgcgggtgcaggttagccatccccaagcagccatcacattactgacaactatacaaccgcagctcattgactttgagtttcgtacggctgatatgaataccatttttgttgctttaaccggaaaggagattcgttaacatgtgggcatttgtcaaacgcaatttgttactattctttcgcaaccgcgccggggtcttcttctcggtactgggcgctttaattgcctttttactgtatttagtctttctcaagaaaagtatgagcacgctttggccactgacacatcccgaaaaattgctggatccgtggttaattggcggcaccttaaccatcaccgctgtcacgaccacacaaaatggtctcgcgcggatgattgttgatcgcgaaactggccgacttagcgattatttattaactcaagcttcgtatttacgtatcgagttgggctatctgattagcgccgtgatcattggcaccatcatgcagttacttatgttctttactatgtctggtgcttttttatggttagaccacatcgccattttctggcaattgaccggccagattatcgtccttgccgtgtttagcagcttagtctggacggctttcaaccttttgattcttagtttcgtgtcccgggtcaccacaatgagcggcatttcgacgatcattggaaccgcagctggtttctttgctggcgtctatcttcccattggttctgttccaactgccgcgcaaaatttgatgaaattgacgccttttccctacaatgccgcaatataccggcagttactcctacagcaacccctagagtccactttttccgttcaccagacaacggcgcgtcagacctttgaaaaaatgctcggcatccgaattgatctgcatggcctgctttcatcaagccaaacttacctgattctaactagcttcacgctgcttgtcggactggtcatcattctgatagccaaagtcagtcgaaaaacagcgcttgtccgcgtataattaatttgattatcatggttgctttttccaatattatcgcaacaccgccatgattcgtttcactatcatgcatgcactttttacgggaggggtgtcaatgaaagtttcgtttaagcaagacgcaacgatgcagccagacgacctgcaagtttacgtcaaggctgcgcaattgtcaccagctgttttgcagatactgcaacaaattcagcaactcgccgacagccacgcaaccttacccctactcgttggcgaacgcgttattgttttgccgaccaacgagattgtggctatcgaagtctacggcgatcagctttccgtccatacccgtcaagaagtctatcaaagtcgcggtcaactcaaaacggtcttggccaaacttgacccgcaagcatttatccaagtaacgaaaagcagtcttttgaatattaattatttaacgtcactagaagcgtctttttccgggaacatgacagccttcatggcgaataacatgaagttaacggtcagtcgtaaatatcttcctgcgttaaaacgcttgttaggattgtgaggtgcccgatgaaaatcatcaaagatcttatcacggatagcgttatcggtatgatgatcggtgcgactgtttatctaggtgcgctcatgctacaggtccaactgaccccaccaacgccacgcaccatcgctggcttgtttgtgatgagcgctttaatcgggatgctcgcccttatttttgacaatgaatccctcagcctgcctgtagcctatagccttcattttatcggcaccttcgccattgtcatcggcaccaactatctcatgggctggcaatttctcgtcggatcggcactccctaactttctaatcgcctttttgatcatttacgtcctcatctggctggcgctttatctttcctggcagatcacagctagaaagatgaaccacgtgttaaaaaaacgtcaaggaaaatagtcttatcctactaagtgtcgaaatattcccgacactttttttgctcccactgctactatcgacacatcaggctgaaaaataatccaatccgatttttaatcagtatgtccgtttgcgcaccgtctaggcgatacaaacgcgttcacctgtccagaaaccaggctggttcacgctctccaagcctgcaaccagtgttttccccggtttggtgctaaaataaaatgatcgaatcggtcaagctaggaagtgagtcgctgtgaatcaagtcgttatttttggcatcatgttggccacggttatcgttggcaatttgcttgctcgccatgtcccacagattcctttgccattcttcttgattggtcttggtgcagcgttggcaattatgccatccctgcgtagttttacgattgatccatcggcgttctcctttgctatcatcgcgccgctgcttttcaatgaaggtcaaaatgcctcacgaggacaaatcggccggtcactgacgaatattgtgtcacttgcagtcggcttggtgatcgtgtcggtcgtgatcttaggcttcggcgtccatgcacttttcccggtcatcccattgagtctggcatttgctttgattgccattgtgaccccaactgatgcttccgctgtcagtgccgttgcgcaggccaatccgttgagcactagtcaaatgcagttgttaaataatgaaagtttgttcaacgatgcggcggggattgtagcgtttgatctcgctctgtcggcctatatttccggacaattctcggccactgacgctttactcgacttcctgtttgttttctttggcggtattttattcggcgcactggcaggtatttttattgtcaatctcagagcctggctaatccgcattggtgatgatgagccattaattatggtcggaattcagttgctgacgcctttactggtttattttctggctgaagaactggcactttccggtattttagcagttgtggctgcagggattgcccaaggcgttgagcgtgatcgcttgcggttgaccagtgcccgcatgcaaattatcagtgccaatgtgtgggaaatgattgctgccgttctttctgggctggttttcgttttgttaggcgtttcgctgccaaatgttgtgattgaggcattacgcgggcaggcagggttattcggcttgctcattggcatcggtgctttcatctacgtggccaaatcctttgttcgcttcatctggagtcggacgttattgaaaatgggcaagaaacatcgatggcgcaatgcgttgatcatgatgctcggcggtgcaaatggaaccatcactttatcgctggctttttcgattccgcaaacagttgccggtcaccattttgccctgcgccaaggactcattctcattgcggctgttgagattctcctcagtctcatcgttccggtcatcgtactgccgttttgcgtttctaaaccgccaaaacgcaatcgccaatttatctggttacggcggatgctggcggcgggcattgatgcgatgcgcgatgagaccgaacatcacagtgaagcacaaattgtcgccgatgccttagctcaggaaatgatcttaaatgacaatccttcgcggcggctgcaacgaacgatttttgaaggcaccatcactgcggaaaaaagtgccattgaaaccttacggatgaacggcacgattactcgcgatgaagcccattattataatcgcttcattgatctcaatgatttcacagcggatcaacgactctggaaaaatctttggctccggtttcgtttttcgttcaacatgggccggatgtataaagcgtttaatgaagcccaaaacgcctttttaaccaccccgctcaacctagagccgatctattggaaacgccaatttgcggctcacggtgaagatctcttgcccattgaacaggctggatatacggcggtcatgcgatatttgcaacggatcgaaacaattcaaaatcgcagtgcggttaataccattcggcggttctaccgcgatcgtcatcgccgggttcattccgagtcatttgacggggatgctttgtacgcgatgtttcttaaagcctttcatgccgaatacgagttcattcaacaggcttttacggatgggaagctaagtcgcgacctcatgcagcgcctccaaacccgaatcacctttgacgaaatcacctatttgaaaaatcaggacagttttatcgactagactattttgcctttctttcatttcagaatatgccccttgcaaaataaaaaaatcggctgcagagaaaattctctacaaccggtttttattttgcaattaactcaacgaacgatctcttttaccgttttgtctttgagcctgagtctaaagccatttcaagctcatcggcagccgtctttgtaacactttcaatcttggctagaaccttaccatatggctttggatccttattgatgtagcgtaacaagccggccatacgtgcagtcatgtcgtaccagctttggtttggcatgccggaaatttgaccgacacgggcatttggcaacacatcaatgagttgttccaccgcattcttgacaaccggtaaagcaccgcgcaccagatccgaatcggcgtaggttgcatcaaagatcagctgcatgaaccgatccggctgggaatgcttggaaggggttgcggctcgttccgcgcgaacccccatgacaacctgttgcaggcccaataaagtaagacgaacaagctgatcgtgctgcgaaatgcctaattcaggcatcggcgtgatcccgatcagactgagctcatctttgcttaaccgcaacgcagcattggcaataaagtcggatagttgtaacccaagatgttcacgcgagtccgcaaattcaaaccgaaccttaattggccgttccagtgacagggtcaagtaacgactaacgatatcggctcccatcacgagctgattgccttccaactcatttcgatgatcgatcatgatcacaatatcatcaaatatggtatggacatcacgcaagacatggatggttgccccgatatatggataaagatattccattgatggtgcaaaatccgggtaagttgttttacgtgaaaagaccgtatacatgcccatgttttcatgcttggcagctttaatcagttgcgtcaatgcatcaacctgtttgccgcgagctttaacttcatcccctggctcccagccgtaaggataaagcgcgttccggaaaccggctaagctttcatcgtcgccttccggtaaaatggcggcaattcccatatgcatcatccgcggatccggtcgatgctcttcaaaactttcatcaatgaaaagacgtaattgcttcccggttaccagtggcacctcatcatgcgttccgtaattggcgcgcgctgaccgattctccgctgactgtgtattggcggcattgctagtactgtttgcagcgctaccgtttgtgctagaccgatcagctgacgtggatcggatgacgcttggcgtgtgggttgtcactttattaacaacagcaggagtccggtgttgactggcatcttgattgctaagcgattgtgaattgcttgtagaagctgattgcgtcatgggttgccaattttgcggatcagcattggcagcgaagcgattctgtcttggccgtcccggtcgccgcgtaccgttttgtttgttgcgatcgagccgcacattgcgccgatcacgccgaaccggttcgtgctcgcttgtactgttgtaccgcgttgcatctgtttttccggttggcgtatgttgcttggtatggcgcacaccgttttcgtggcggtcagtgctttcagacgtgctcattgaattagcagtagactgactgtttgctgcctgcgcctgacgtttgttggcctcgctttgtgcttgctgggttgcgacatcaggctgctggcgaatggtgaaacgatgattgcgcgttgtcggccgtttggtggtcggctttgactcactcgcagtgttaacaccactggttgacggtgattgccgggtattgcgattcgcttgtcggccagtcgttgttgtgcgggcaactcgtttagttgtccggcgcggtgattgcggactggctgaattttcctgagaatgtacagctgccttgttctgatcggtggcagcaatacttgttggctgcgtttgcgcttttgcctgtcgagttggcgtctttgttgcggcttgcttcgttgtgcttggtttcgttgctggcgctttggcagtcgtctgccgtgtgcgcgtcttagcggctggagtcttagcggctggtttcgccgcagctgtcttctttggggtccgttttaccgtggtctttgctgcttccgggacttttcccgatgcgatgatgctttcaatctttgcggtcgttttacgactgacgttatgaccacgcagcgcctttcgcagggtcggtacggatacaccaatcgcgattgaagcggcgttggtattcaatccatgctttgccatataagcatttaatgatgtttttagcttattatccaaaatatttcctcatatcctacttaaatttaagtgttccgttactagtttaacgcaaaaagtcatacgcgaacattgccttaatcaaacgccgaaatcagcccactttcctgagttctaacctgattgacggcttgcatttacgtttttgacatgtctacgttttgggttcacctgtttgcgaaaaatagacttttcttgtatagtcttctcttgtatgtcacaacaatgaaagaagcgaacttaacatgcaacgaaaactcagtggccgccatatgcagatgattgcgctcggcgggaccatcggcgttggccttttcatgggcgctagtgccaccatcaaatggaccggcccttctgtcttaattgcctatatcattgccggactttttctttatctcatcatgcgggcgttgggcgaaatgctgtacgttgatccggcaactggttcatttgccaaatttgccagtgaatacatgcacccgctttttggttatttaactgcgtggagtaatatcttccaatttgttgtggtaggcatgtcagagatgattgccattggtgaatacttcaaattttggtggcctgggctgccggcatggctgcctggcctggttgcgatcaccttccttgttttggcaaatctgatttcggtgcgaatgtttggtgaattggaattctggtttgctttgatcaaagtcgtaaccattgtgttgatgatcatcgctggtctcggcgtcattttatttggactaggaaatggcggtcggccagtggggattagtaacttgtggacccacggcggatttttcacgggtggctttactggcttttgctttgccttgtccattgtgcttggttcttaccaaggcgttgagttactcggcatcacagctggggaagcggaaaacccgcaaccaacaattgttaaagcggtcaaagacaccatcggacgaattctcatcttttacgttggtgcgattttcgtgattgtagccgtttatccttggaatcaacttagcgccttagggtcaccttttgttcaaacctttgccaaaatcggcattacctttgcggcatcactcatcaactttgtggtgatcaccgccgcattatcaggttcaaattccggcatttattctgctagtcgtatgctttacacattggcagatgccaaacagttaccgcgaatcttcacaaaactaaatcgccatggcgtccctttttatcccgttgtttcggtcggcggcggcattttactcggtgtgcttttaaacgccatcctgccttacgtggcaccagcagcgaaaaatgttttcgttctcgtctatagttccagcgtcttgccaggaatggttccctggtttgtgattcttattagtgaaatcaagtttcaaaaagttcacgccgataaaatgacggaccatcctttcaaaatgccattcgcaccatacagtaattatctcacacttattttccttgtgttcactttatttttcatgttgctgaatccggaaacaagtatttcattagtagtcgggattatctttttaagtttggtgagcttgcattattttatctattatcgccatggaaacagcaaaacaaaggcggtaatggatcaagacaatgacctttaaagctatgtcctgattgcgctgaatgcaaatttttcaaactttcacttgccagaccccctcaccttgcatcttttctgacatttttctatgagtgtttttatttcacggctaatttgtataatgaaattgtatgaagcagcctgtgtttgctcatccggaacaagtggcaaacactcgcaaaggaaaggggtttgcttttatgaaaacgatcaatattggcgatgtaacagttccaattgtcggaatgggcacctggtatttaggtgaaggcaatgctgaacaaagcgcacgcgaaacccaagctttaaagtacgggttagatcacggcttgcgggtgattgatacagccgaaatgtatggcaacggcgcggcggaaaccttgatcggcagctttttaggtgattacccacgggccaatatctatctgatctctaaattctatccgtcacatgccgacaaaaagcaaatgcgaacggcgctgacaaatagcttgtcgcgacttaaaaccgattatctcgacctttacctacttcactggcgcggggctaccccactggcggaaacccttgaaggcttacaagagctgaaaaaagagggactgattcgccaatacggggtctcaaacttcgatgttgacgatatggatcagctcactttggaaccgggtggcgagcaagtcgttgccaatgaagtcttgtataacctacaatcacgcggtattgactttgacctacttccacgccagaagcaggcagggatcactacgattggttactcgccttatggttccggcagcggcaaatccatcaagctaactccggaactcaccgatttggcaaaaagcaagggcatttcgactcaccagctcctgcttgcctgggtattgcgcaatggtgacgtgctatccatcccccgcactggtgaagctagccacatggcagaaaacattgccgcagcagacgtcacattttcaccggacgaattagatctatttgatcaagccttcccgatgcctcgtcatcacgtacccctggaaatcatttagtcaaaacaacgcctcaccccaattactgctgtgttcagtcagcggcgagcgctttcacgtcagcacgaaaaacgttatactaataacaatcattttccaagaaaggatcattgttgtgaaaatttttgttgtcggcgcccacggtcaaatcggccagctattggtgcataaattactggatcgaggcgatacggtcacagggggctatcgtgacccgctcacccagacacccgatccggagaaaaattttcgagcagtcgagcttgatctgtcatggccggtcaatcgattagcaaaccttttcgccggtcatgatgcagttgtgttcgctgcaggatcgcggggaaaagatctactcggggttgacttagatggggccatcaaaaccatgaaagccgccgaagccaaggatgtcggccgcttcatcatgcttagtgcacttgatgctgaggatccggcacactggcctgcacaattgcacgattactacattgccaagtattatgcagatgagtggttaatccacaatacggatctggattatgtcattgtccagccaacctcactcacgaatgaaccggcgcaaggaaccattacgctgcagccgcaacgcccatcaaccattccgcgtgccgatgttgccgatgtcttggttgccgcattagatagcgatcgtcaccgcgagacaattaaaattgccactggcccaacaccaattgaagaagccgtaaaaagttgacgcagcacaaaacacgtggtaattttagtttaacgttaaatcgaaagtgaggtctcgtccattgaagaacgccaattgttgaaatgtccaagtcctgtcatcatcaacgggattcgtgtggactttttgacaatcgggcgcgatcaatggcggacactccgtctattttggtcagccttaattttgggggctgacctttttttatctgagcgtgaaccggcgcgcttaggaatcggtgtgtaagcggccttgggcgtgatggcccggtcttggccattgcgcttaaggtccttacacgcagattcctgcgccggtgaacgcgttatcgtgagcgtgaaccggcgcgttatcggccagcattttcacgctcatcacaacccgatttcaaaaagcaccgagcaccacccgtcttgataccacaggcacatcccggaaaggacgtggctgtatgtctaccatccaaatcaaacatctacactttgcttacgatggccaagcaccgatctttactgatgccggtttcgatcttgatacaaactggcatctcggcttagttggccgtaatggtcgcggcaaaacaactttgttacgcctattgcaaaaacaacttgattatcgcggtacgatcaccgtaccactgccgctgcaatattttccccaagcactcgatgaatctcaggtgacattggatgctgctcaggcgtttaaccatgtcgcccagtggcagcttgagcgcgaactcaacttattgcacgccgatcctgcgattctttggcgaccgtttgctgatttatccggtggtgaacaaaccaaagtgcgcttggctttgcttttcatccagactgatggctttgcactcatcgacgaaccaaccaatcaccttgatctgcgcagtcgccggcaggtagcagcttatttgcagcaaaaacccggcttcatcgttgtgagtcatgatcgcgattttttagatgctgtcaccgatcacaccttggccattgaacgccagaaaatcacgctatatcaaggcaactacacgacgtttgcaactgaaaaagcgcgccaggatcaaaccgaaattgcccaaaatacccatttaaaaaccgaaatcagtcggctcaaacaaacggcttatgacaagaaactctgggccgaaaataaagagcgcagtatttacggcgatcggcacgttaaaaatagcggtcataggggtcgcggctttatcagcgcccgcgcagcaagaaccatgaaaaaaagtaaaaacctggaacaccggatgaacaaagaaatcgaagaaaaagaacagctgctcaaaaatctggaaaaagtcgatcctttaacgatgaatccgcagccgacccaccagcaccaattgattgtggcggaaaaggtgcaactcggttttgatcaaccgttattcgagccgatttcgttcaccttacaccgtggcgatcgcattgccattgttggggaaaacggcagcggtaaatcaaccttgatccgcgcattgctgggtcagtttaacgggatcagtcgcggcctgttaaagttggcgcccgtatctttgagtctggtacgccagcagtatgccgataaccgcggtacccttccagactttgccgaaacccaccagcttagtcgcgaagcattgctcaataacttacgcaagcttggtatgccgcgcgctgattttgccacgccgattgaacatttgagtatgggccagcaaaagaaagtggaagtggcccgctccctggcaacgcctgcagcgctttacatctgggacgagccacttaattatctggatacctacaatcaagatcagattattgcggccgtctgccaatatcaaccaacgatgctctttgtcgaacacgatgaacattttatcgatcaggttgccacaaagatgattcgcctacacccgttgctataaacgaaaatccaaagctatgcgcgcgcgagccacaataacaccatgttaagcggttccatggtatactcacgatgaaagctcaaagaaaggatggatagcatggcagagcgttctttatatcatacctatgtccgtaacgaaaatggtttggttggtgaaagttatgttgaaggcaaccaaggattagcactgggcgtttccagctcgctcattgatgcgccgggtaccaatccggagcagtttatcgcctttgcactgtctacttgtttcaatgccaccattcgtatcgttcagcatcgcgaaggcaccgcagaggattcccaattacgcacccgtgtcgatatcgtccgtgacaaaatcggctacaaattcattgtggatgcccagattctcatgccaagccacactcgcgaagaagcccaaaagattgtcacccaggctttagacgagtgtccggttgccaaactgttgaaagaaaatgaaaatgtcaccttccgcattgtcgatgaattcactgatgagccaactttaggtgaataagcgcaacgccttcagtaaggtggttcattccttcatcgggtgtcatgaattgaatcgcgccatcccagtttagcgtgaaccagaaatcagcaattgttgatttctggttcgcgtttttttacttttcctacaagaattcacgacttagcgaaactcgcccgtttagaagtttacagtgaaaggtaaacggagggcgtttaagatgaataaatcatttaaccagtcaagtatttatcggtttggtttgccactttgcttaggacttggtagtttagcattcttggcaatcggtatttgggcaaccatcttgttactattcacatctaaaatcacgacagttctcatactggttttattaggtggttggttcgtaatcggctgtatcatcacaggcgcggtgttgttatggcaactagtgcgcaatcctaagctcgttaaccgtaacgttcaccggcttcagtggcttcttgggctcattgcgatcatcattgcggccatctcgttgccactttcatatttttgggcggatacgggtgacgcgccgggggttgtgtttattggtttgtttcttgcggcaatgccgtttgcttgttgggttttggttagtgtttggcggtggacgttggggtgaggatttattttttggttttgcggggatcttcggctgcctgtgaaaggtttgagaataagcgataacgcgcggagattggtttttttgtaggcgattgtttggtttgactttgcgttctataacgcgctccccggcgcagaagtctgcgtgtaaggaccctgggcgcaatggccaagaccgggccatcacgcttaaggccgcttacactccgacttctaaccgcaccggctcacgctcacacaaaaaaaagacccactcagtttcctgagtggatctttttcaacgaaccaagaattaaagcttggtaacgttagcagcctgagggccacgatcagattgttctacatcgtaggaaacagcctgaccttcgtcaagactcttgtaaccttcaccgttgatggcgctgaagtgtacgaaaacgtcttggccgtcttcaccagtgatgaagccgtaacccttatcagcgttgaaccatttaactgtacctttttgcatgaaagtgaatctccttttcaaaactaacaacaacagacaaccgtaatcctaaaaaggaaattcatgttacatgatgtttcccgttcaagtattaccatgaacagagtataacacgttcagcaagaaacacctaatttattttcgaatttctggcaaatttatttgcgatcggttaattgccacgagtggtgtagaccaaattagatccggccgactacatgccttgtgcatacatcgcatcggcaactttcaagaagccggcgatgttggccccggcctcgtaatcacctggaaccccatactcggcggcagcatcggcactggctttgaaaatatgctgcatgatctcgtgcaactgtccgtcaaccgtgtcgaagctatcacttaaacgccgcgaattttggctcatttcgagtgcggagactgccacgccgccagcattggccgctttggccggaccgtataaaatgtcgtcatgctgataagccgcaatggcatccggatcactgggcatgttggcgccttctgccacggcgatcacgcctgcagccttaaagcgcttggcctgcgctccattaatttcattttgggtggcacacggcaaggccagatcaaacttaatcgttgcatcccaaaccgaaccttcataatatttagcgccgtcaactcgctcggcataagttttgattcgaccacgctctacttctttaatttgcttgacggtggcaagatcgatcccattttcatccaccacgtagccatttgaatcggaaaccgtgagcactttaacccccagcgcttttgccttttgagcggcataaatggcaacattcccggcaccggaaatcactgcctgcttaccggcaagcgtttcgccattagccttgagtaattcatctgtgtaatagatcaagccgtaaccggtagcctccgtgcgtgccaatgagccgccataactgagacctttgccggttaaaacgccgcgttgtgcccctttaagtcgcttgtattgaccatataggtagccgatttcccgtgcgccaacgccaatatccccgactggcacatccaggtccggcccgatgtatttgctcagctcggtcatgaagctttgacaaaaacgcatgatttccgcatccgatttaccttttggattaaaatcagccccgccttttgccccaccgattggcaaggtcgtcaggctattcttgaagatctgttcaaaacccaaaaacttcacgatacttaaattgactgatggatgtaaccgcaagccgcctttgtatggaccgatggcggaattgaattgcacccgaaagccgcggttcacttggatttggccttggtcatcctgccacggcacggcaaattgaatggcccgttccggttcaaccaagcggccaagaatgttggcttgtatatactccggatgtttttcaaaaaccggaacaacggtttttaaaatagttgtcgctgcttccaaaaactccggttggtgcggatcgcgttgtttgagcgttgcgagaaccgattcgacataagctgttgctgaagtcataaatacccacctttccaaaaacggtaacaagtgttgttttaaggttaacagaaaaatggcagtttgataagaattttctccatgtgccctcagccagattaagtctttatcaagctgaaagcctacacctctgttacaatgaaatcggatacatgttacctattatgattgatttggacacagctatcgtccaatcgttgcgtgaagcggctacctgtcaaggaggggtttaggatgcaacatagcggaaatattattttaattggtgacggcgctatcggttcgagctttgcttttaactgtttaacgaccggcgttggtcaaagtctgggcattattgacgtcaatgagaagcgggttcaaggcgatgtagaagatctttcagacgccctaccatatacgtctcaaaagaatatctacgcagcgagttacgaagactgcaaatacgccgatatcattgtgatcacggctggcattgcgcaaaagcccgggcaaacccgactggaactgttgtcgatcaatgccaaaatcatgaaagaaatcactcacaacatcatggccagtggtttcaatggttttattctcgttgcctcaaacccggtcgacgtgctcgcggaattagtgctggaagaatcggggctgccgcgtaaccaagtgctaggatcaggtaccgcgctggattcagcccgtctgcgttcggaaatcggcttgcgttacaatgtggatgcgcgcattgtccacggctacatcatgggcgaacatggcgactccgaatttccggtttgggattacaccaatattggcggcaaaccgattctcgactggattcccaaaaatcgccaagcaagtgatttggctgaaatcagccaccgcgtcaaaactgctgcatatggcatcattgaaaagaaaggtgctactttctacgggatcgccgcttcgctcactcgcctaaccagtgcctttttgaatgacgaccgggcagcatttgcgatgtcggtccatcttgacggtgaatatggtttatccggcgtttccattggggtgccggttatcctcggcgcaaatggtttagagcgcatcatcgaactggatttaaatccggaagaccacaaacgcctggctgactctggtgccattttgaaagataatttaaagaaggcacaggaagcctaggcaataaccagcatttagtacctttccaatgggtattggtaataacaatcaaaatcggccttacagacagacaaatttgtctccgtaaggccgattttttcatttgcttatcaattctttggccatacacgcttattctgcccgtcgtaatccagcattcagctcaaacagccatttactcgtccgacttggcttgctccagtgcttccgtctccttttcaacttcggagcctttggttaatgccgagtgtcgcatgccataaaggaagtagatcgcacaaccgattaggaaccagacgcctgaatacagctttgcctgaatgtccaatccgagaaagaccactagcgatccgagaaaagcaaccgctggcaacactgggtaaaatggcatccgaaaacgtggcttggcaatgtcctgcccctcacgcggacgcagccggtaaatgccaagcgtgacaaacatgaatgcgatcagagtccccgcggaaatcagctgggcaagaaacgcaaatggaaagaacgcaccgataataacgccaatagtgatgagcaccgccaaagcgcgattcggcaacttgcggctattcaatttccctaaaccatgcggcaacatcccgtcacgcccaaaactgtaaagcagccgagatcccgccatcgccataccaatgagcgccgtgaacatacctaaaaccgcgatgctttcgacaaccgttgcgaccaccgcgtgacctgagtggcgcaacgcccagccgaccggttctgcattgttggcgtaatcctgatacgggaacatccccaacaaaaccagtcccaccgaaacgaataagaaaacggcaatcaagagtgaccccaaaattccccgcggcatcgttttctccggatcaatcgcttcagccgaattagccgcaatcgaatcaaacccgatataagccaggaaaatcatggagacgccggcataaataccttgccagcctccaaatggtgtgccatccgcgttaagatgatacgccgggaagaacggatggaagttttctgggtgaatcgcggttaaccccaccacaagaaatagcaggatagccagcactttcatgacaacgagaatattttcgactcgcgcagcactggacacgccgcgcgacaacaaaatcccgaccagcagcatcaccaccacggcaaccaaatcaacaatgccaccgttagtaccaaaaggatgcgccaaggccgcgggaaaattcaccccgatcgtcgccaataagccgcgaaaattagccgataagccagacgcaacaaaggccacggcaataaagtactcagctaacaacgcccagccggcaatccacccgaagaattcaccgaaaacaacattaatccatgaataagccgacccggcaaatggcatggcagctgacatttcagcgtaggcaaatgccaccagtccggcaaccagcgccgcaatcagaaaagaaattgacaccgctggcccggcatgtttagccgcaacgaccccaggtaatgtaaagatcgatgcggagacaatggtaccaacgcctagcgccagaaaatcacgcacgcgcaagactcgcggcaaatgcgagtctttgtcttcatacacacttggatcttcttttcgaaacaatcgttgccatactttccccattggaacctccgttgacttgtttatgctctttttacgtattttggtaaaaaacccatgaaaaataggttagcacatttcagtaagactggaaagcgctgtgtttttaatgacatttgttatcacaacattgaatgctcgccggccaagtttgcggaatgatgagccgccaaatcttaagcttttttaagcaaacaaaaactgcctaagcgtggtctgtactcacttagacagtttctatttgcctactaacgatgcatggcacttatcaacagagtaagcattcatgaacatttgtggctgctaatcatttatcatcttctgccactggcgcagcggacttaagcttctgtttgcctgccgccttaacagcagcacgcatgttaaccgggtgaccttcacgccgatcatccgcgtattcagccgtggccgtgaacagtaaatccgacgcagagttaaccgccgtttcaaccgagtcttgtacgacaccgatgataaaaccaatcccaacgacctgcatggcaatatcatttgaaatgccaaaaagcgaagccgccattggaatcagaagcagtgacccaccggcaatacccgatacgccggttgccgaaatggctgacaggaaacaaagcaacaaagcgaggaaaatgctgacatgaacgcccattgtattagcggtggccaaggtcataatcgacacggtaatggccgccccgccagagttggctgagccgcccagtggaatcgaaatagcataactatctttattcaagcccaaatcttccgaagctttgaggttaatcggaatgttgacggcgccactacgcgtgaaaaaggccggaatcccactgacttttaacgtccaaaacgtcagcggataaggattttgccgcgtcagcaaccaaaccatgaacggataaacgaccagatagacaaacaccatggtggccaccagcaagatcagcagttgtccataagccatgacccctctaacgccggtcttactcaatgattcatgcaataagccaacaatcccaaacggtgcaaactggatgacattttgcgctactgagctgacggtctctgccagctcggttaccacttttttggtcgtggcactcgtcaagcgcaagccagaaccgatcaacaacgaccagaacaaaatagcgagataattaccttcaaccaacgctgaaatcggattcgccacagcattagtcaataacccggtcacaaccgttcctaaatccttaggcgcactttcggcaatcttcatcgcccccggtaacaccagcttgatggggaaaagatatgaaacgacaacagctgccaccgaagaaagtaatgtggcacttaagtaaaggacaatgacagtgccaaaatggtttttcgaccctgagcgatatttggaaattgcggacataatcaacaggaaaacaagtaacggtgcgattgccttcaacgcgccaacaaacagcttgcctaaaacatcgataaaggaccaggagggcaccaatacccctaacactgccccaaccacgattccgatcacaattttcagaatcagcgacacatctttgtaccgtttatacatttctggcccctcctccatataaaaattaatatttaatgagaacacttcttagtgtgcccgaatctttgaccaactgcaagttatttttatcgatagcaccgcaaatcttttgttagtccgactgtcaccaatccaaacaaaaacaccgacgtcaaaatggcatcggtgcttttacttaagacaaaagttaaaccatgttttcgtcattaaacgaatgattactcaagtgaacacatgcttaaccttatcaaatattattcaaccgttttacctaaacgcttcttcttaggtactgcttttgcggcattcgcatccgcatctttgtaaccaaaaaggtaaaccaatgtgaacgctgcaaccaaagtgacaagtgatgcaatccagaaaaaccagatgttgttcggattgtgagcccagcctggtgctacgaatgaaggtgcacctaggaaactgccggtaaaaccatacatgttgacatttaataagccgttgaccaaaccaccaattgcggcgccgatacttgaaaagatgaagacacggccatattttaggttaaccccgtacatagctggttcggtaatcccgcagcaagcactgataaaggcggaaattgacagaccttttaaggccggattgtgcttggtcttaacccagactgccaatgcaccggcaccttgggcaatcatggaaatggatacgatcccattcagcacggactcgggatgtgccgatgacaattgcgcggtgatgaccggaatgacggcccagtgcaatccgaagataaccagaacttgatagaagccggcgataatggcatcggaaaccatcggcgttaagctgagcaatgcctgaataccagctgtgatgccattagacagaaccgtgatcagtggcccaaccgccaagacaaccgtcataccaaccaagaagatttcgactaatggtgtgaaaatcatgcgcagtaccagcggcatccaactcttaatccacggctcgatttttgccgccatccacgctgcgaagatcatcgggaagatggaatacgtgtaattggcaatgtgcaccggcaagccgaagaagttcgcgttgatgcccatgcctaacactgtgccggtcactttgccagcagtggcgattttagcaattgacggataaatcaggaacgctccgataattccgacaataaccggatccgatccgagtttctgggcagcggtgaagccgacaatgacaggtaagaagtaaaaggctgcatcgcccatcgcattaataatttcataagttggatttgtggttttcagaccgccccatgttgttaaaatgttcaaaatcccttttaacatcccgcttgcggctaagagtccgataacgggaatcatggaaccggtaatggtgccgatcaatgcctgggcccaacgtttgatcgtgccaagtgcactggtatctttagcttccgcttgggtttcttgaatggccttcgcagttccttctgcattcgaataaccggggccgagttgtttaatcacttcatcgtaaacatccgtcacggcttggccaatgacaacctgatactgaccattcgcccgcgcaacatcgataacgcccggaatgttacgcacggtgtcatcatccggtttttgttcatcttttaaatagaaccgcaagcgcgtgatacagtgaatcaaactgttgacgttttgggcgccaccgacatccgcaatgatttgccgcgctgtggccgcatacttgctttcgttcttcggtgctgccggtgcttgttcaaccgcggccgctttaggtgtcatcaccgcaacttcttcgccgcgtttgacttcgccgggcgtcacgtccagctgatcaacgacttccttcgtgttggtaatcgccacaatgacggtggtcttcttgccagcttttttgattgcatccaggtccatggacccaatcacatcgccggctttaacccgtgcatccatcgccgtatcaatttcaaacggcgcgcctttgagttcgaccgtatcgatccctaaatgaatcaataactcggcgccatcatcggctttgatcccgattgcgtgcttggtatcggcaatcatcatgatccgtccatcgaccggcgccgcaatttggccatcggttggctcaatgccaaaaccgtcacccatcattttttgtgaaaaaactggatcggaaacatcggtaatggccatcgccaatccggaaaccggcgccattaagtgcaatttctttgtcattgcttattcccccttatctgactgcaacaatgcaatcgttgcgtatggtggcaacgtcatggttgcagttggtgttaaatctgcttcattggttatcaaaacgcgtgcatgctggaaacgtggcggtagcggtaccgtaatggctttatcactgaaattattcagtaccagcaagtgggcatcgccagcaacccgttcgtaagcgtacaagcgatcaatttcagtcccaaaaggcacataactgccattgctgatcacttgatactgcttacgtaacgcgatcaatttttgatagaatcggaaaatttcaccatgcgccagctcagctttgacattaatttcgcgctgattggttggccgcaaccacggtgttcctgtggtaaatccggcgttggccgtgtcatcccactgcattggcgtccggctattgtcccgagccttggccaaaatgatggcaaaagcttctttttcggacttgccagctttcaaaagtgcctgataagcattcttggcttcaacatcgacataatcggccatcgaatgataatgcggatcggtcatgccgatttcctcgcccatgtagatgtatggcgtcccgcgacttaggtgaatcgcagcagctagcatttcggcacttttaacgcgatattggccaacatcaccaaaccgattaagcgcacgcggctgatcgtgattattccagaaaagcgcttgccagccgccgccttgatctaactgttgaccccaagtgtgcaaaatgttgcgcagtgccttgaagtcgtacggcattttgctccacttttcaccgttcttataatccgttttcagatggtgaaattggaaaaccattgataactcgtgattttccggcttggtataggcgattgagttcttaatggtggtcgaactcatttcgcctaccgtgacgctatttagatcctggccaaaactgttggcggctagttccttgatataatcctgaacaatcggtgtatccgtatataatgttttgctttcgacttccggtggcgcatcaaccagctgatttgccttgccaatgacgttgagcacatcaaagcggaaaccgtgaacccctttggcgcgccaaaaattaataatagcggctgcttcttgacggacggctggattatgccaatcgagatcagcctggcgacgttcgtataaatgtaaataataattgccagtgtcgccaaacggggcccaagccggaccgccaaacttgctctcccagttagtcggcaagctgccatccggctttggtggtcgaatgtagtaataatcctgatagtgcttgtcgccagctaaggctttttggaaccagacatgttgtgtgctggtatgattgagcaccatgtccaacatgatgtcgatcccggcagctttaagtttttgcgccaactcttcaaaatcagccatcgttccaaaccgcggatcgatttgccgataatcagccacatcatagccgttgtcatattgcggcgacacaaagaatgggttgaaccagatcatatcgatgtgcagtgccttgagataatcgatcttttcaatgatgccgcgtaagtcgccgacaccatcaccatcgctatcgtaaaacgacttgggatataactgataaataactttcttatgaaacgccatcataacctccttgtccttgcttttaacaaaagtaagaactgccagcgtttacggtcggatccggcgagcaaaatcatgaaacttaaaacgatctgcccggtgacgtgattccgtatattgaaacttcgtggtgtccgtcaaactgctgcaactgcgtaccacgaccacgactgcagatggtggtattttcagataccgttgatcttcttccgttgccgcttcaaccgtaatttccttagttgcataggcaatggtcaaccccaccggtccttcaagataagcatatagtgagtctttagccaccgactccggaatcggcggcacgactttaggatcgaggtaatcaatatcaatgatgtctggctcattttccaaataccgcacccgcttcagtaggcgcatctgtttgacttctaccgttggatccacatctttgaacgacttggcgggcaatgttgcaaagtgattggttaaaaccaccgttcgcgtctgtaagtgaaattgcgcggctaattcggcataactgaccacgccggaaaccggaaacacgtattcctgccggttgataaccgttgaccctttgcctttttgcgattgaataaagccatcatccttaagcagccgcaacgccttacgtaccgtgtcgcgtgatgcctgatacatgtcttgcagcgcactttcacttggcagcaatgagccggtagcatatatttctgcttcgatcttttccttcagatcctgatagatagcatcgtacttgcgcattgtttttcctccagtaaccgttttcacttacaatgcttattctacttgtacgtacaggtatgtcaacaaaaaacgcttaaaagcttagatttaaatgtagaaaagcttcacaatccctatatggcaacgtttttaggtcaaaaaaagacccacatttgagtgtggatcaaattttgcttatcatttcgatacatgaaattttatatatacggtaagtatcatcgtcgaaaacgctcttaaggccttttccattaaccatcttttaatgccttaagttaacctgtacgtcatgactgccaaactttattccgtaacatccttaacttgggcgtccgcaaactggtgccgaatacgaatcgacaatcccaaggcaatcagttcaagcacaataaagatcatcagactgacgctatagttgtggaagtactgctcgctaaagctcagcagtgttggtccggcaacccctgccgctgcccaggcagtcagtacgtagccatgaatggcgccgagttgtttggtaccgaaaacatcgccaagataagctggaataaccgagaagcccgcgccataacacgacattatcaagcaaagtgcgatgccaaaaagcagtggtgaacgcaagactaagatacctgccagcatcgcgacatcaacgataaagatcagggtgtaagtcagtgggcgcccgattaaatcagacaacgtagcccatgcgagccggccgaaaccgttaaataagccgacaaccccgaccatcactgccgctgtggttgccgacatcccggtttgctgctgagccatgggtgatgcgaccgccactaagccaatgccacaggtgatgttgataaaaaacatcagccagagataccgaaaagatcgcgttttgactgcttcgttcgccttcatggctttcccggtcagactcacacttttggcaagatcggctgccggtacttcatgaggatgcggcttgcggattacctgtgcggatcccagcataattaccatataaaccgcgcctaaaacatacattgttgcgacaactcccagatttgcaatcagctgctgggcaactggacccgtcagcatcgccgcaaatccgaagcccataatcgccatgccggttgccagcccgcgtttatccggaaaccaggcaataatcgttgaaaccggcgtcacatacccagcacctaagcccagaccgccaatcacaccataaccgatataaagcaacggtaacgagtgaatctgaacggctaaaccggttagcaaaatccccgagccatacaagagcgctgccacggtgcccgtcaaccgtggtccaaagcgctcaaccagtcggcccatgaacgccgcgctcatacctagaaaaaagatggcaatgctaaacgcaatcgtaactgctgataatgcccagcccgtttgtttagcaattggaccggtgaaaacactccacgcatataccgagccgatcatcaaatgcaacaaaataccgccaagtgccactaaatatctacgcttgctcattggttacctccacgatgcttttttatcagttcaatgtcggccatcgttctgatataacaagcgtatcataagattcgaatttaagatagccactgtaaccgttttatgtacgaatgataataaaaaagactccgaaaaagttcggaatcttaaaggtgttattcaaagaccatctgattgtgatataactcggcataaaagccattttgcgctaacaactgttcatgattgccttcctcaataatccggccgtcccgcaacacgacgattttgtctgcatttagaatcgtcttcaaacgatgggcaatgacaaaactcgttcgaccctgaatcacattatccatcgccgcttggatcttagcctcggtcaccgtgtcaacattactggtagcctcatcaagaattaatagccgcggatcagtcaaaatagtccgcgcaatcgacataagttgcttttgcccggcagaaaagacactttgctcatccgacacaaacgtatcataaccatcaggcaaactcataatgaagtcatgaatattcgcttgcttggcagctgcttctacccgggcttgatcagcagtcggatcaccgaagcgaatattatcgcgaatagtcccggaaaacagctgcggatcctgcaacacaatcccgacgttttgccgcagtgatgccaatttaaaatcgcgtacatccacgccatcaaaagtaatcacgccagaatccacatcgtagaatcgattcaacaaattcataaccgtcgttttcccactgccagtcggaccgactaacgccaccatctcgcctttttcgactttgatcgtgaccccgtgcaggatttctttgcccggaatgtaactaaaatgcacgttatcaatcagcagttcatgtttcagaccatcaagggtacggccattttggggatcgacttcatccggctgttcacgaacttcggtaatccgccgcgcgccggtgatggccaactggatcatattgaataagctggtcaactggacaattggctgataatattgctgggcataattgacaaacaccacaaccattgccaacgcagccccttgactcaaggagccattcagcgccagccaggatccggcgaaaattacaatcgccgtattcaacaacgacaaacccatcaacaacggattcaaaatgccgctccagatctggccgcgtaaattcgacttacgcaccgccgcgttatagggttggaagcccgccacactttcttgctgtagcccattcgtaatcagcattttctggccggtaatctgttcgttgatatagccattcagtcggccaatatcgtcttgttggcgatcaaccgacacactcgcctgatgcatcacgaaggcagataacccgattgcgaccggcgttgaggccatcgtaatccacgcaagggtcgcattctgcgtgaacatcatccaaataatcccgataaactgagcgccacttagaaagatttcaatcaacgcctgattcatcgcattgaaaatattatccaggtcgctcgtaaaccgcgagagaatgtcgccatcactatgactgtcaaaatagcgcactttcatccgttgcattttccgaaacaatccaacccgcatcgttccagtggaataaccgctgatttttgacaacagtaagctcgaaattaagatagaggtcgcatcaatcacatacagtaagacgaaaatagccaacgtgtggttaaacgccgcaaacgatgcctgagcgcgcgtcgccggattcatccactgttgcacatacacggtcagttcttcaatcgcccgccccatatatgtcggcgcgacaacaatcgcccaggtagaaatcgcgattaaaatcgttgtaatcaaaaattctaaccagtacggtcgcaaataatgcgcgtaaaatttacctgcgtttttcaagtctttcatgagctacaccccctcttccaatgccttctgggtggcataaatttctcgataaacccgattatgctgcaccagttcgtgatgggtgccactgccaaccaaccgcccgtcatcaagcaccagaatacgatcggctttaataatggaactgattttttcggcaataataatcgtcgttgtatgcttcaattcatgcgccaaggcctcttgaaccaacttctcggaccgcgcgtccagagctgatgttgcatcatccaaaatcaaaatcttcggatgaccgatcaccccgcgcgtaatcgaaaggcgttgcttctggccaccggaaaaattcgacgaccgttcttcaacttccgcgttgtatgtctgcggcagccgttcgataaattcagccgactgcgccacccgagccgcccacttcatcgccgccaaatcagcattaggattgccttgctgcagattttcggcaatcgtgccggaaaaaagcgtcgagcgctgcaacacatacccgaccgtcttgcgcaaatccgcttcggtgacggcacgaacatcatgcccgccgactttaacgattccggtatccggatcaaacaaccgcggaatcagctgtgccaaggtcgttttaccgctaccggtcgccccgacgatgccaatcatttcccctggcttaaccgcaaaatcgatatcacgaattgtcggcttttcatcacctggatacgtaaaagtcacatcgtcaaactcaacggacccgtctaaatcccgttgcggtccgtcgacaaacgtcatacttggcttagtatccataacctcatgaatgcgccgcaaagaaaccagcgcccgcgatgcaaacgtcagcataaatccgccgttgataatggcaaataaaatctgcatcaggtaattgataaaactggtaatggccgctaaattgctcggctgactggtaatattttgcccaatgagccagatactcaacgccatggctaaattggcaaccagaaagaaggctggcatcagcaacgcaaacagattaccgatcttaacactgacatcgcgcatttcgtcacttgattcggcaaatgttttcgtctggttagccccttgtacaaatgacttcaccacccgcatgcccattaagttttcccgcgccaaggtattgacccgctcaattaattgctgcatgcggccaaagtatttgcccatatgactaaatgaaaagaagctgacgccaaacaacagcaccatcatcacggcaatcacccaccacaattgcggcaaagtgacaatcgcaagaataaccgcaccgataaagagaatcggaatccgggtaacctgctggaaaaatcccatgataatctgctgaacctgattgatatcattggtcatgcgcacaaccagattggacggcgaaaacttctccacatccgcataagccaagctttgaattttggcatactcgtctgcgcgtaaatccgtcgccacacctaacgccacacgtgccgaatagatcgtgttgacaattccgccagcaatgccgacaatagctagcccaatcaaatacaggccattgacccagaccgtttgcttatcatttttcataatggcgttcatgataatctgcaacaaatgcggctgccaaagcgtcgcgaaagccacgacaaaaatcgcaacaaccgaccagatcgcgtcccaacgatattttttgatatatggaaatagtaccttcatttctttttcctccgatgacttgtcctaatagcttaccgcaaaatggaagacaagtcagggtaaatgcccggttagtaagtgccaactttttctcggttctactctaattaagtgatttccgatactccgagctggctccgcggtggtgatggctggcgaccgcgcagctagagtggtgggcacgacttcaaacccgcaaagaccgcggtttcgaagctcggccttggtctaaagcggagaagcccactccgcttaagaccaatttcaccactgagcccgccactgctccgccagctcttgctttctatcataattttcgaacaaggtaaccaatcacatcgctgttgggagttcttaattgacaaccaaattgataactatataactaataaacaacttgacaactatcacaattgtcagtatgctagtcgcaacattgaaatgcggaaagatgagtagctgttcattttttgtttagagagtgtccattttggtgaaaggacatctaaaaatgccagcgaatatggtcttggtgatgcaggtgtgccgagcaatggcaaagcacacatggggacgcccattattgcgttaggtctcacagtgaatactgtcggactgattgaggaaagttgtgtgagcagctttcaaaccaaggtggtaccacggtaagccgtccttggcccagacaagctatgtctgggccaaggacggcttttttattttcaaatgtgccgtacgcctaaatgaccgcatcttttggcaaggtttttgataaaagctgacatggttggctaatttgcacagctgatcagtattcgtttccacagcactgacttttaacgcgttcaccggtgcaaaaaccggttcacgctcatttacctaggaggatttttatgacaacaacgattatcggctacccacgcattggcgaacatcgggaattaaaatttgcaacccaaaaatatttcaagcatcaaatttctgcccaagacttgcaggaaaaagctaaagcactgcggaaagctcactgggaaaccattcaagctgctgggattgatcagattccaaccggtgacttttcattcttcgataacactttggacgttgcaaatcttttaaacattgtacccaagcgctaccaagacctgaacttatcaccgcttgacacctactttgcccaagcgcgtggctatcaaggagaggccggcgacgttaaagcgctggcgatgaaaaagtggttcaacaccaactatcattacttggtacctgaattcgatcacgatacccagatccaagtaacggattggcagcttttcgcgcaatttgaagaagctaaagcgctaggcattaacaggcgcccgactttgattggcccgtatacgttactgaaattgtctcgcttcattgatgttgtgcctgatgactttgttgccgacctgatttctgcgtacacgaccatcattgatcgcttgcatcaagctggagctgactgggtacaacttgacgaaccggcgctggtttatgaccaaaccgatgccgaccttgctttattcgaacggctttataccccaattttggcccaaaaaaaggctaccaaaatcctggttcagacttactttggcgatttaaccgattcgtttgaccgtattcaaaagttgccatttgacggcttcgggctggattttgtcgaaggatatgccaatcttgatctgctcaaacaacacggcttcccagcgcacgccaccttatttgcaggaatcgtgaatggtaagaacatttggcggacacattatgccgatgccttggcaacgatcaaacaactggcaaccattacggacaagctggtattaagcacctcgacctcactcttgcatgtcccatatacacttcgcaatgaagcccatctgaaacctgaagaaaagcaatatttggcctttgccgaagaaaaactcaacgaactgcatgagttagatgccattttccacaccggcgcggatcatgctgcttatcaagccaacgttgcccttttcagtaaaccgcgttatcaggaaaataaagccttgaatgccaaaattgccgctttgacgccggaagattacaaacgcacgcctgagcgcaaaacccgacttgctatccaagcaaaagaattcaaactcccgctgctgccaacgaccaccatcggctcattcccccaaacagctgaagttcggcgcaatcgggccaagttccgccgccacgaaattaccgaagacgaatacaccgccttcaaccacaaagaagaaatcgaatggctcagattccaagaagaaattggcctggatgttctcgtgcacggtgaattcgaacgcaacgacatggtggaatattttggcgaaaactttggcgggttccgctttaccgataatggttgggttcaaagctatggcaccaggggcgttaaaccaccgattatctggggcgatgtcgtccgcaccaaaccgattaccgttgccgaaaccgtctttgcccaaagtcaaaccgatcatctcgtcaagggcatgctcacgggcccagtcaccatttacaactggtccttcccgcgtgaagatttaagtcaaaaaaccagtgtggaacaaatcgccttagccttggaagatgaagtgctcgatcttgaaaaacacggcattaagattatccagattgacgaaccggccttacgcgaaaacttgccgctgcgtaaaaaagactggtatccgaaatatctggactgggcagttccggcatttcggctagttgccagcaaagtgaaaccggaaacccagattcacacgcatatgtgctattcgcaatttggcgacatcattaaagcaatcgatgatctcgatgccgatgtaatctcctttgaagcggcccgctccgactttagccttttggatattctaaaagccacccacttccagactcatgttggccctggcgtctacgacatccactctccacgaatcccgtctaaagacgaaattgtgcatattatccacgaaattctcaagcggctgcctgctgaccacgtttggatcaatccagattgcggtctcaagactcgcgatgtccctgaaaccaaggccagcctcatcaacatggttgccgctgctaaacaagtgcgtaaggaacttactcatgaaaatcagccagtgctttaaagatcatcaagtcatctcatttgaagtgtttcccccgcgtaaaaatgcgacgaacatcgccatgcgccccatcctcaacactttggacgcggttaaagccgccgatccggactttgtttccgtcacatttggtgctagtggcaacaaaccgcacatgggaaccttggaagtggctaagttgatcaaggatgaattcaaccttgaacccgttgcccatcttcctgctgcccaactcacgcgcgcccaagtcgatgctgagctgcgtgggtttcaggaagccggcattgacaacatcttggctttacgcggcgacatcccaaaatccggacgcgtcagtgaagacttcccttatgcctgcaatttaatcgaacacattcaccaagttggcgactttgatgttgtcggcgcctgttacccggaaaagcatcccgagtcaccagacgttgtgagcgatattcgccatctcaaggaaaaagtcgatgccggagcaagccagttgattagtcagcttttcttcgataatcaggttttctatcaattccgtgagcgtgcggcattagccggcattaatgtgcccattgaagccgggattatgccggtgattaatgaacaccaaattgagcgcatggcaacaatggcaggcgttcacttacccccaaagttcgtcgccatgatgcagcatttttccggtaacaaggaagccatgcgggatgccggtatcgcctatgccatcgatcaaatcattgatctactggtccatggcgttgatggtattcacatttacacgatggacaacccgactgtcgttaaacgcattgcagccgctactcagaccattcgtaatgcttaatcttccaagagcacacactttgcaacccgttttctttgccgtggtcagttaaacccacgcaaagaaaacgggttttgtgcacaagcgggaaaacgtttaagcaaccttcatttcaaaatgactcaggatcgatgcacagtccaaatgatttttgaccaaaccttgccattcccagttagccgaataatgatgtgagaccagaaagaatgattaaatttcatttgacaaattgccataatttcgccattctcaaagttaacaactagttaaaaagaaaggagattcatttgtcgactaaaagtatcattatcagtcaggatctttgcggtgtcggtcaggtttcgatgggcgttgccttaccacttgtggccggcttgggtttaacgccgtatgtcttacccactgccttgctttccagccacaccggcggactcggcgcgaatacctatctggatcttagttcggaaatgtccggtattctcaaacattggcaacaactgcaactaaatcctgacgggatctacctcggctacttgggccaaggcgctgctgatcaatgggaacgttggctgcctaagttccaatctcaccttatcctcatcgatccggtgatgggcgatgatggcaaacgttataagggctttgattcacagtatgttgctaccatgcagcgattagcgcagcgagccactgttttaaccccaaatgtgactgaagcacaactactgctggaagaacctttaactgcaccaaccgatcctaaagcggtgagcgctttggccagacgtctttacacccaattcaacagtgccgtcttaatcaccggcgtgccgtaccataaccaagtggccgttatcggggtggatgcacaaggtggcccacttgcactcgctcagcccaaagaacccgggcattatttcggcacaggcgatcttttcgccgctgctttggcaagcgccttgctaaaaggacaaactttacgtcaagctgcagcgatcggcatgattgccgcgcaaattgccattaaagccactttggctacgaataccaatcccaaatatggcttgaatttaactggggtcatttcggctattagtaaagaactgccgtagagatttcggctattgtggcattattttttataaactagattccaccataacgcattcgccagcgcagaagccggctcgcgcttactttcctataacgcgctccccggcgcagaagtctgcgtgtaaggacctcaggcgcaatggccaaaacccggccatcacgcctgaggccacttacactccgacttctaaccgcgccggctcgcgctcactttttttggaggttttcccatgcaagtttcacgacattccttgaaaaacattatctttaccggcttgtttgctgccattatttacatcggcatctcccttttgcgtattcccatccctgcgatggtcgggcggccgtttattcactttggcaatccgctcatggtgctcgcaattttatttcttggtgggcggcttggcggatttgcggctgtggttggtcttggtggctttgatttgcttaacggttatgctgccacctcatggctaactgccttggaagcaatcgtcatggccattgttgtcagtgcgttggttaaggctttcaagcatcaggacaagccgcagtatattatcaccattgccattgttgccgggctaaccaaaatcgtcacttcttacttaaccggtatcgtcgaagcactcatggtcggaaccatcttaaaaaccgcggttgttggtgcctttttaagtcttcccgcaacggtcatcaattccattgccacagcgattatcgtgcctatcctgtactttatgcttcgtccactattcaaacggtttaatagttaagctcgtttatgttctttaatcagcctttattgtggactagtccagaagtctaagcatttatctaacactgctaaatctcagcagtgttctttttatacccgaaaaatacgttataaataagtcgtttgcctatacacgcataattttttctgtcataatcagcgcaagcattgccgtaccattttcgatcacatcattgactaacgccgatgacatacatacataacaacgcccgactaaaggaggccattatgatggcagaacccattgtttcattgaatcatatcgtgaaaagttttggcgctaaacaggttctcaaggatctcagcttctcgattacccccggcaacattgtcggttacattggtcctaatggtgccggtaaaagtaccaccgttaaaatgatgctcggcttgctccagcctgatgccggtacgatcgaattgttcggtcaaccactcaaacctaatgcgacagcctacaaacgccgcattggctatgtaccggaaagtgccgatgttttcgatgcgctcactgcccgtgaatatctcagcctgatcgggcaactgtatggtctcagtgccgccgatgccgagcaaaaagcattcgccttagcagaactggttaacttgaaagatgcattcgatcggcgaatttcctcttattctaaagggatgcgtcaattggtgctgatcattgccagtctattgcatgatccggatatactcttttgggatgaaccgcttaatggtctggatgccaatacggtgctcgtcatcgaagaagttttacaaaacctgcgcgaccgcggcaagacaattttttattcgagccatattctcgatgttgtccaaaaattgtccgatcgcatcatcttgcttaatgacgggatggtggttgcagatggaccgtttaagacccttgctaaagaagcggataccaacctgcaacagctgtttaacgatctgaccggatttgccgagcatggtcaaaaagcccagacattcgtggatattgtgacaggcggtgattctaatgaaacggctgaataaagcgcaagccgaaccggtcaacacagccgccatgccattacccaaagtgtttgcttggctaaatcgctttgccccggcgctggaaaaacgcggtatccaatttgatcagttgcggctcattttggccaccaaaaatttactggccgcccgcgagccaagtggcatgggcagtcttttcagtcagcgtaagcgcggtaaagatgccagcctgagaaccggttttctctggaatctgcttttcggggtcattattggcctgatgatgtttctaccggcctcggctttgacactgttcacaatctttttctccgttcaactgctaacaagttttctgaacatcctaaccacttattcgagtttaattcttgatccgcgtgatcgaaccgtttttgcttcacgcggggtcaatgatcgcactttgagttttgcgcgcatccttaatgtttgcttctatcttggcatcacattattagcaatggggattccgggaattgtcatcaccggtcttcactttggaccactggtagccgtgggtgggctgttgggactgatactaagcggtatcctcagtttagtgatcgccttatttgtttatttactggtattacgctatttcgatggcgaacggttacgcaacatgctcaacttagtccagattctattgatgatcgggatttacgttggcggacagttacctaatttattaccgcggggaatgtcgtcagtcaacctgtcactcgctcctgaattcagttgggtatacttgctagcagtgccagcatggtttgccggactgccgatgctttttgcgggtcaagtgaatttattaagtatcgtattaaccattttaagtatcgtcgttcccggcgttctcacactcgtcttcttacattattctggcgcgttcgagtcctatctggaaaaattgaatcaaggcgatgcacgtacccggaaacttggttggtggttccgcggcattagtactttaatgacccggcccggggatgagcgaacttatttcacactaggctggcgggtgcttggtagcgaacgtgattacaagttacgcgtttacccgcagctggcgtatggcattattctgccgttgatttttatcagtaccgagattcgcgatatgccgtttgcaactgcccagcactatattgcatatgccggtatgggcgtgatcgtggcattggctcctgcgctggttaacttacgcttctcaagtcagccaaaagcgatggcggttttccaatacgttccgttcacaacccacggcttattactacgcggcgtggttaaagccatgttcgcccgactcttcctgccgccactgttgctaatcaccttggtcacaaccatcatgggtggttggttatccttgttggccggcattagtgtgatcgtgttgacttatggcttcacgctcatgatgggctggccactggttggcggccaatttccatttgccagtgtctattctgccaatgccaactttagcggtggtgcggttgggtgtgtcagcatcgccattggcctgattgcggcaatggccgtcattttcatcggcggctttctggccagctggctcttcccgctatgcctcattattttaggcgcttctatcggggcactcctcggacatttctatcggaccaacttacgctatgagctcagaattaatactgaaaatgactaacaaacctgcctcgcaaatgcgcttgacgtgtttgcgaggttttttaatggcctgatttaacggttggcttgttcgaaagtttgatcaacaaggcacgaactagccaagtagcagctttttgcgtagaatggtctggatagtttattttggaaaggaaacccgccatgtcgcgcactgaaacccaccttgtgaaccaaaatgatcagaaactaaaaggcgtcatttttgctgttgttggcgccatcttttggggtgctagcggtatattcacccaaatgttatttaccaacgccggggtgcgaccgttatggctagtcggcatccggttattttttgccggattattgctggttatctggagttcgctcaaagacttacggcaactgggcactatttggaaaaatcggcatgatgccatgttgctaattctcttcgcctttctgggtatggtgccttcccaactgacttattttctcgccattagtgccggcaatgcagccacagccacgatcctgcaattcctggggccagtttttatcttgctatacgtcgcatttgctacccgccaaatgccgcggcgcattgatttcgtgagtattactctcgcgctgatcggcacttacttgttggtaacgcgcggacggctcaccagtctgagtctggcaccggctgcggtcttctggggaattatggccggcgtgagtcaggctttgtacacgttgttacctcgcaccttgcttgccaaatatgacgcgcgggcagtcaccggctggtccatgctgctcgggagtttgccctttttgccccaatatgtactacgccgcaatcctgtgctgacattgcctaatcttggtgccattgcctttgtcgtaattttcggcaccatgttcgcttacctgctcgttttaggcagcttgcattacatttcaccagtcgcaacgggcatgctcagcgcgtttgagccattgacagccaccacactagcagtcacccgcttgcacattgcgtttggtccggcagagtggctgggtggttttcttatcgtgttaaacaccttgttgcaagccctgccgtttaataagctgcaacatgtgcagcgccgcttaatccggcagctttcgcgaaagaaaagtctttaaccgcgtccaaaaaagcaccttgaccttggatataaaaggatcctgatctgcagtgattatcactgcagatcaggatccttttttctaatcagcgatgcttactcgactcactgaggagcgttgcttaataaccaggttgcggtggcttgatattgtccggctttagcagtagcagtttgctcaatgcctagataagccgcaatattgccggtctgtgcgcctaatgtccaatcagtaccgcctgctgccatattcttcaccagggttgcattgttgttatctctgattgtagccactttgtccgttccggtggcggttcgatccgccaagaccagcgttgctttgccaccttgctgactaccatgatcacctaaaacatacggctgcccgacaagtgtaaacggcgtcagttgcatcatcaaatgccagccttgcttggtcggtcgggtatccttgatgcttaacactttccctgtcgagttggctggctccagtccatgctgattggtcaaccactggcctgtttctaactgattcggggatgccgtatcgggattaggaataccgttcaccatgtccatgacgttcggattgcgataaccacccgcgccatctttgagttcaaaaataaaactcggcactttttccagggttaaatcaccggtttccggatcaaggatatactccaacacatctttaccggcaggcgtttttaaatcataagtttgcccgtcgccactgaccgttccgattggtttatcatgaaacagcgtcgatttcagcaagccgtgatgctttacccgcgccggtagcgaaaattgcaatttggctgcggttccggccgcaactgacggcatttgcgtaacgacaatccgattgccgtcgctctgcacttttccttgaacggtaaccgtgcgactgccaatcgtaagcgttatcggcagctggtcgcctggttgcgccggcgttccatctgctttgagataatcaaaatactgtcctttgggtacatccatggtgatggtgccattggtaggccatgctgcttgcatagttgcttggacgtccaccacataatcataatgaatggcatcttctaccttcaaatgcgtgttggcatcaactgtttccgcgcctcgcattaacgcaaccgttcccttaaccttcgccacttccggtaaagcaccgatagcaaccacatgtggttcatagtaattactggtggtaccggtgaaacctaaataaagttgccgcggaaccggatcgtctgcattttgggcaaagtatttttgaatatcagcacttgtccaagtgactttctccgaaaagacatagggtttgccattgcttttctgaaccgtgacagtataagttagcgtgccgcctccccggttatccttcttccagtctattttcacttgatgccatttgccgtttgccgccgttgatgcaagggtattctgtcggccaattccggtttggacgccattaaaaggaggatcgcctttaaaatatagccacgacatccaataaggattagaaattcgatacatattggcttgtcctggatagcccgcgccaaaatagtaatcggtataagcactatattgatcataaccacctgcagcatcaccaccattacgccgagtatcaacatataaggcaaaactatttggtaatgctgtattagctatttgctgggaggtgctgcctgcaggtaaatgatcgacaccccagataccaagcgatgatgggtcaatttgttttggtgcagctggtctagctgccagcacaaacgccatcccttcaccaattgtggttttattacccagataataatacatggtgtatgacgcatctttgtccaagtcaaacataggcgccgtactccagatggcaccggattggttaggagcatctttattaatttccattccgaccgcactgcccgtcgcagaatcgataatcaaacttgaatctttttgagttggttcaaagagcccggtaacatcagaaaatgatggcggtgcggggtaccctgacgatgacggccacccagccgcggcgtgtgccgacacggaaggggccaccatcaaaaaactaaccagcaagcccaaccaagtaaccaggtagccgcacttcttcatgatcgtcactcctttctaaagtgagcgtgaaccggtgcggttagaagtcggagtgtaagtggccttaaacgtgatggcaagctcttggccatcgcgtctaaggtccttacatgcagacttctgcaccggtgaacgcgttatgatgagcgtgaaccagcgcggttagaagccggagtgtaagtggccttgggcgtgatggtcgcactttgaccattgcgaccaaggttcttacacgcagacttctgcaccggtaaacgcattgatgtggtttaaggttgcggcgcattggcaagtgtccaagtaattgccgcctgatacctgcctacttgagtggtaacattgatcgggcttgaaaccaacgtcaactccgtaccagcgccaatagtcacctgattattaccctgcccttgcccggtactagtcgcgcttgcagcatctgcctgccaaaccaccgtctcaggcgtttgttgatctttggcaaacttcaaccgcggcgcttgggcccctgctgggtgaacggcattcaaatcaggattactcgtcgtcggattcgtccccaccagatcaatataaccttccaaaaaatgtcccttaccatccgttagcgcgtccatctttgctgttaacgtccatcctgcgctggtgccacgataatcacccacctgcaacaacccagacgcgttaccgtcattagcattcgtactatttttaaccggcccctgattaaccttattgctgcgtaacgcatgctttgtgaactgtccgctaacaatttcataaacggaaattccgccaaaatttaagtcaggaacttgctgtaaaacgatattgcctggatcaactgtcaattgagccacggatgattttggccctaagtcatctgccgcagctaccggataggctgttgagattccagctgctattaacaaggtggtaagactaaggatttgctttttcattttcatcccccttgtcttttcgcccgcgccagaagctcaggcccatgatgttgatgagtaacagcatcatgccaatcaccggtaacataccctgctgacggttttcaccagtttgcggtaggcgacgcggcatcggtttatgggatcgcgataaatcatttttaagtggctttggtgttaaaatgtcgctgccaggcgcgttaatgggattagcgggttgtggtcgatcatctatcacgatcacctcgccgatggaagttgctgcttgtacctcatacacggcaacactactcaagccaatgaagcccattaaaacaacaagcttgatccaaaaacgccacgtactaaatcccatcggttagcacctcctttttcaagcaaaccttggctaaaaaaccaattattcagcgttaaacttggcaaaagagggccagtcgaagatcactgtccctcttctgacgtttgataatcagttacccggcgcatttgtcagggtccaggtaatcgcagtttgatacttacctgcataggccttaacatttttggtcagtttcagtaggttctgcggggaggtgaacaatgaggtgtttctgccttgtccttgatctttagccgcttgccagattggaaccgagctacctgccagaactaattcaggatttgttgcgagcgctgccggattattatcggtttcgtccgctttgatatcacccgccaatacaatgctgccgcccagggtttgacccgtttcattcttaagttcgcctgcctgagcttccaatcgccaacctgcaccagttccgcgatagtctgtaatgttcaagattccctgattattaccatctgccgcattcccagcaggttcattcttcaccggtttgtcagtgaccgtattattcagtaacggtaaagtttgatcgccagtagctaaagcttcaacactgacactcttaaacttcagatccggaacttttaccagtgataaaatatccttcgaaccatctggattatctgggtttttcggatctgggttagtcggatccaccccgacccgaacttcaccaacggaagtcttcttcgatggcgtgtcagcctcgcctgcagccaatacattggtgactggtaagatcataccagccaacgataatgcagtaagacccatcgccatgtagttaactcttttcattatattatcctccatattcttgtttgatttgtttttcctctctatgtctattatagtattctcaaaacaatcgtaatgcaagcgttttcttcaagcattacaattgttattgttatagtttagtatttaaacgttatttatgtcattttcttccttgactagacagcattatgatacttgcgttcgtctggttttatgttcttgatgtaaaaattaaataatttagttttttcttccttatagagtcaataacaatattattaattatttcaaagttttaaaatatcatttatcaaagattagattcctaaaaattgatatcgtttgattaaaagcatttatttaataattttcagcgattatattcttcccttcatttttgcacaattatatttataccaactaaaagtgccgtattttgattttcccccattcacgcaaaactgacattttcaaaatactgccgctgccgtgacattgaatcaatcttatatttcccgtaatcaaaaaggaccgtgcaactaagaggttgaactcttaatcacacggtctttaattaaaatatagcgcattgcgtttcttcgcggcttcagtgtttgatccagaataaggcgtcttaaccaaagtgactaacactcgcaattaaaacgtggatgggtgcttgagaaacgacagcaagtgttgctaagacaatggaaacgactagtagtgaaaatttcggtgaactttttttcataaccaaacccctcaacttaaatgacaaccttcagcaacattggatatgcacatcatatcctcatttgcaattcatttcaatgccattttaagttgttaaggcatgggggcatctgataatgtccaagttaccgttgaccgatattgtccggtacgaacggatggcgttttttgaatcgacatgaacgcttgcgtttgcatttcctctgttccgagtgaccagttgctaccgccaggagccatgtttttcaccgtgacagcgttgccattatctcttacccgcgcaatttcagttacttttgcttcattatctttgttctcagcgataaccatttccgctttgcctccgcttgtgttgccgttgtcacctaagacgtaactgccgtctgctaatgtgaatggtgataaactcatttgcaaatgccagcccggtttattcggtcttgtgtcagtgacgctgaggattttgcctgttgctccttgagaaggtgtctttgaatcaagcgtatttagccacttggacaaatcaagttcggaaagcgttgtcgggaacggtttttggcctggaataccttgaataaaatcagcaactgtcggatttacgttggttgcttcttcgctgccttcctgaaaaattttttcaaaaacaaagcttggaacactcttcaaagtaacagcacccgggtttgctgcaagaacatacttgatagtcttaccgatctgatcagcagtgttggtaaagttataggtttcagccgtgggcgtcccgccagttaaactgccagtggcatcatcgtcaactagaagattactagtcagtgtatgattcttaacaaccgccggcacactaaattcaagctggctatttgtattcttgggaaggctccctagactagtcattaccgctgagtttccatcggcttggacagtcgcttcagccgggatcgtttgtccatttaccttaatcgatacaggcaatttgtcgcccgcaatagcaggcttcccatctggtttcaaataatcaaaatacttgcctttgggtaactcgatctggctaaccggccactccaaaccattgagattttcaacattaattgagtaatgataagtgagcttatcaccaatacttagtaatgtgtcttgtttaactacctcgtcaccgtgcttaagcgttactgcacctttgaaatcgttgaaatcagccaggcttttgatagcaacaagatgcggctctgacgtatcagtcgttgtgttcgtggcacttgtgaaacctagaaagagttctttgttactcgtaccggtactggtagtgccaaagattgcaccaatttcggcttcagtccaagtaatactacgtgcattggcctttccttttaactgataagttagggttcctcccccactatctgccttttgccatgatacgatcaagttatgccatttatcatttgtaacacgaccatttaaaccatcagcgtaacgtgtcggtttaccgattgcattgtcaaaaactaattcagtttgccaaaaaggagctccaatgttatacatgctagcatgactcggatatccagatccaatatactgttcgatactatttgcatagtggacatgtttgtccaatccgctcgtcaaaggattaacgcttttctttgtgtcaatcacaattgcaaagcttttgggaatccccgtcaaagcaatctggtctggtttagcatcatttttttcggaaatcccccaaacgcctaatgaggatttaccgttacccagtgtacctggctttgcactggtcagtacaaacgcaagtccgtcagctcccttatcattcttattaccaagataaacttgcatatccaatgtgaaatctttatctagattaacaaatgactgattgctccaaatagctccgatactatttggcttatctggatttatttcaaggcctactgtatcagtattaacgtcaataacttgagattgaccacttccaattttgctaaagattccattcaaactagtgaacgttcctgtgtccggtataggatatgcctcctgcgtacccaaccccggacttggccatcttgatgttgccgacatcaccatctgcagcggcccaagcaccatactgatcatcacggcaaggcaagttatgataaagattttctttttcatttttgacctccttgccgtgaacggccgagtacgagtagcgcggacaataaaacgatgatcagaatttcaaccccaatcacgacataccatacctgcacgtcatcaccggtttgcggtaaacgttccgtagtggctgctaggtgtcgtggctgctgtcctttatcttcaggttgacccggctttccgggctcgggaactgcaggttgctcaggattgggcgctggcatttctccggtgagttcaacttgagccacagaaacctcggcatgcacgctctgagttgcggtacccgccatcatgagcagtgccagcaaaagtagcatcatcaagaagttagttttcttttgtttcatcagtctccctccctttgcgtcgctgccgccaaaccagccacagcaagacgagaatcaccagcgccaggacgattgcaataatgatccataaccacggtttttgtggtgtttcccttcctagtttctgctcaatggcttcagattgctgacgcgtaatggtaaagttgcggcgccagtgccaggtcttaccaaccgctttggctgttaaatctagcgtatacgtgcccggcgaaagcgcctctttggaaggaagtgcgtaatcaaaatgcgagttcggggcaaatgaccagcctttctccgtccggcttagataaggcttatctgaaccttgacgataaactttgccatctagcgtcatgtcgccaaataaacgcggcttggtattttgaatagtggccaacaccccggcccgattatcctgtgaccctggtttaaccgccatgaggttaagatcgggtgctacttcggtcgttgaagtttgcaagaccaccccgatgagcatggcgaacttgttgttaatcgccatccctccgccaccgcttttatggaccgttggatcttcaacatacaaactgccgagaatctgacccgtgaagccttttgccggaatcttgacatcaaacgtcaccggcacctgagcatccccagccagatcaatggttttgggttcaccggctaattgtgaaaacgtgtactcagccgaatcatccttgtggtcattggggtagtagccaatcgtgccattagtttgcgtaaacgcactcaccggactgactttaagtttcttagctgtcttcgtcgtatttttaacataaatgagcagccgctgggtttcacccggctttaccaatagattgaagtacgttgattgatcgatctgattttgcggtaatgcggggctgattgtaaaacctgcgccttcagctgcatgcacttgctgatgggtgccaaaccacaggaagctcaagcaggccagcagacctagtaaaagtttttttctcataatcttatccccacggttatgaaaagggcagcgactgaccgctgccccagaaatagttgcttaattacttaggtgcatcggacaaggtccaggtgatcgcagcttggtactgaccggctgttgcggttgggtttttgtccagtataagcgtggttccactgttctcagtgatcgctgccgtatttttcccttgcccctgtccattatcggtagcagtcgctgcttcagctttccaaatcgtaacagcagaaccggcgatagggatttcaggcaaagttcctccaggattaatagcgttaacactggtgttgtccgtctgaacgtttgtactagcgagcttcaatttccctgccaaaagttttccagcagtgtttttcatttggccgagctgagcagttagtgtccatccagcgttgctccctcgcaagtcagttacactcagattacccgtgttatttccatccatagcatctgttccatttttgaccggaccattaccaacagcattgtcgactaaggctggtgatacttggcccgcagccaaatcggcgatggcgatctccccaaagttaagatcgggaactgcatcaagtgtcagctctcccccttttaagttaatttcagccacagaagttttagtctgatcagcagcaaaaacctgtccaacagggagtagcataccagcaagtgtcaacgcggaaatacccgctgcaatataattaaccttcttcattgtcttattccctccgtattgttcttcctgtagtttactatctatcttactggtttaaatataacatgatgatgtttgagcaatcaaagaatacgtttacttgttaactcggttctcaatcgcgttgtatcccttaatctatcactcattttttacaaatactcgctcctaataaagcttcactgcgactcaataagcgaaatatactattctcggcattatctaacgcttgttatcgtttaatcaaaaagtcggttttactcatctgttttaaaacgactcatttggactttcggcagaaattaacccgagtagcagttaggactctgtaaatcttttgcttgcgcctttccgatcaccaaaaaatttctacccacccaaggcttcaaaatctttgatatttcacaacttttgcctttttttcaattttgctttcaaaattaattttcaattagtgattgacatgaaatcaaatcatgctagactaaaatgcaaatacaaatgcaacgcgaaagacaagtagttgtgttcatggattcagcgagcttcggttggtgtgaggaagcattcaggacatagcgaatatccctttcaagcaggacaccgaaccttcagtaacgtgtcatgggggcacccattacagtgctagcatatcgtcatttgaccgtatgcgatgaagaccaggccgtttttggctatggtgaattaaggtggtaccgcgcaaagtcgcccttagcaaatgctaagggcgacttttttcgtctatctccgttgtgagagcatgcttgaaccgttcacgtatctcaattaaggaagtgatgcaattggaatctgacattagtcatattaaaccgatgacaaccgctttaaacgttacgcaacttaaaacatttttattggaggcagttcaatggaattatctgaaaaaaaactcaaaacccgtgattatgtcgtcattgcatcgcttttgtttggccttttctttggcgccggcaatttaattttcccgttacatttagggcaactggctggggccaattggttcccggcaatgctcggatttttggtcaccgccgttgcattaccattacttggcgttttggccatcgccgcaacgcatgctgaaggtgtttatgatattggccgtccacttggccgcttctttgccttagcgttcatggtgctcattcatgccacgatcgggccaatgttcggcacgccgcggactgccactgtttccttcaccaccggcgtcttaccgatgttaccaaaagcctggcaacaaggcggcttgcttgtcttttcggctttattctttggggctgcttttttcctgtcatacaaggaacgcaaaattaccacagctgttggtaaagtcttaaatcccgtcttcttactattgttattcttcgtcttcttcatcggtttcttacatccaatggggaatccggctgcccaaacagtaacggctgcgtacaaaaatggcggcagtttcatgagcggcttcctgcagggttacaataccatggacgcgcttgctgccttagcctttggtgtgactgtcgtaacggcggttcgcggtttaggcttgaaaaacgatgatcatgtctccaaagcaacggctaaggctggggtcatggctacgagttggatcgcgttaatctacgttgccttgatcgtcttaggaagtatgtctctggcccactttaagcttagtgctgaagggggaactgcttttaatcaggtggttacgttctactttggtactgctggccacgctgtcttggcaaccttgctaacgctgacctgtttgaccaccgcggtaggtttggtcgcggcattcgcgcaggacttccaccggcatttccctaaagtcagctatcaggtctggcttggattgacaagttttctgtcattcttaaccgccaacttcggacttgaacaaatcattgcatggtccgttccaatgctgatgttcctatatcctttctcaatggttctcatcttactatcggtctttggcaaagcgttccatcacgatccactagtttaccgaatcgttgtagcattcaccatcgttccggctgtgctcgacatgtttgcagctttccccgccgttgtcagtcaaagttcgttaggcttggcattgcatagcttccagcttcattttctaccattttccgcaatgggtctcggctggctcgtgccggctggtgtgggtctcgtccttggcctcgtcgcacatgcagtcaaagttcgcagagcagtcgcagcaactcatctcgaagctgaacaaaactaagctagtacacgatatctgatcaacccaaaagccagcttaatttcaagctgatgaccggatattgtttacaaatgccaaatccataaaaaggcaggtaccgaagacttcacttctaagtcttcggtacctgccttttatgccgctatcataatccttcaaagcttctttattcttgcgaagctgaactatctggcataatgacgagaactaacattatttggttaagcgtcttgataacgtccttaaacgttatctgaagcggtttcaaaaaatctttttgaagcatccgtttcagcatatcatcagaaaagtttgccttaatgtacttcttaaccggcgtcaatgaagcttttataaaagtaagattagtcgtcggcgtggtcatgatcaaccgattttcaaagctgattgggcattgttgccggtgtgcaacggattcgattaacgcctgccacagtcgctccaatgtgttatgcggtttatcagaaatcgtgaagtcatcagttccctgggtaacagcctgaactccctgatccatcttcacatgaatgttgtcgtgcgtcgctgcctgcgctgctaccaccatagcttgttcttcagcagtatgtttcgtcttcggttggttggaacctttattgctctcctgctcagttttaattgtaggtactgaactgctagatgcttcactcttggcatctgtctttttagacccagcttctgttgttgcgttcgcatccctgctactcgtggctgaggaattctcagacacttgactgctctccgatgcctgctcctcttgttgactgccggaatttgatgccgagctgtcattgataaccgattcgctggtctctgctacggtaatcaccggcgtttgattagcttccgatgatatatcatcttgtacacaagtttgatcgtccgtattcttttggtcagtatcaatcttttgtgtggttgtgtccgctgctgttggcggcgctgatgcagcaaaagccgatgcctgatcagccattaccgttgatacacccaagccaagcatggcagctaagccgaacgcccatgcctttttcatcttaaccctccgcttaaacactaaaatattagtatccctttaactactccgacattaatataccgcatcttacaaacaaagtcactggactttagacctaaaaatgtaccacggctttatgcttaagtttggatcaaccgtctgccaagttcgcctttttgaatgatcatccgtcaactgactagtgggtagccgtctccaatgtgcatcgtttaatgagaaaagcgcatttttgcctaagccctggtcaaagcagttctcatcgtatatcaaccttgtacagcttacgatttgtcaccggctattgacaacagttgttttttagcctaatgtgatgtcaatatcttagaagcgaaaagatgagtacccaggcgaagatcctcagcgagttgtcattttggtgcaagacaatgatcgggaactggtgaagatggtcttttaaagcattcagttgcaaacggcgaccgcaagcaactgacgggcactcccgttactgagttagagtatcacacatcaagatgtgtcgtacttagagcgagtcgaccatttcgactaatcaaggtggtaacgcggaaagaatccgtccttgtctattaataggcaagggcggattttttgttccctcctcggcctcaatgaagtttgaagtcaaaatgctatatcgggttgcccgactaaagaattcgcttgagtatcaacatctgcatatattgttattttgggaggaacgttatgtggaaaattattaccgatgcagttccgcaaatgatagcagccggcattaaatacaccattccaattgcactcgtgtcatttgcgatcggcctgatcatcgcgcttgtaaccgcattgacgcgcatatcggttcgtaaaggcattttgattcgaatcgcaaaaggaatcgccgttttttacgtttggctctttcgctcaacgcctttgctagtgcagttattcattgttttcttcggcttacccagcctcatcatcccgggtattttcccgcatggcatcaagttagatcccgtggccgcgggaattataacgttctcacttaacacaggcgcgtattgtgccgaaacgatccgcgcctcgctgttgtcgattgattccgggcaatgggaagcggcttatgcaattggattgccgcggcgactggtactgcgcgaaatcattattcctcaagcactacgaacggccatcccgccactgtcaaatagtttcatcagcctgatcaaagacacatcccttgctgcctcgatcaccattgtcgaaatgtttcaagtcagccaacaaatcgcggcggaaaattaccaaccattactgatgtactcaatcgttgcgcttctgtatgccattgtctgcactttcttagcttggggtcagcggcatctcgaaaaattcacatcacgctacaatgccaatgcacaaaccacgcaattataatccgctattttgaaaggaagaacgctatgttaaagaaaaaattgtggttcctgttgccgcttgtggccttggtaaccttcacgctcactgcttgcaccagcgcatcatctgacacgtcaaaaaacagtgacgtcaccgccgaactcatcaacaaaaatgagcttaccatcggccttgaaggaacttatgcgccattttcttatcgcaaagatggcaaacttgaaggcttcgaagtggaactggggaaagccttagccaagaaaatcggggttaaggcaaaattcgtgcccacccaatgggattcgttgattgcaggattaggcagccagaaatttgatctcgtactgaatgatattagtgaaacgcccgcacgcaaaaaggtctacaacttcaccaccccgtacatgtactcgcgttatgccttaataacccgcagcgataataccaccatcaaatcgcttgccgatattaaaggcaaaacatttgttgaaggcaccggcacgcccaatgccgctttagccaaaaaatacggcgctaagatcaccccgtctggcgactttaccgtatcgcttagccttgtgaaagaaaagcgggcagacggaaccatcaacgcctcggctgcatggtatgcctttgccaagaataactcaaccgcgggcttaaagagtcaaaccctcaaagatagtgtcgttaaacccgatgaagtagctggcatggtcagcaaaaaatcgcctaaactacaagccgcactttcaaaaggcattcaggaactacgcaaagacggcacgttgaaaaaactgtcgcaaaaatattttggcaccgatttaaccaccaagtaatcatgccattcagccagcaaacattgcccgtcaatctgcttcattgacgggcatacataaaagaacactattcattaaaggaggtcgggttttaatgacccaattcaataccaaactcgttcatggaccgcaactaaatgtcgaccaagccggtgctatcgtgccacctgtatatcaaagtgccatgttccgctttgctcctgatggtcaggaaacccactgggactatgcgcgcagtggtaacccgacccgtgaatacttggaacgtcagattgctacgctagaaaatggcgatgccggctttgcgttttccagcggcgttgcagcgattgcaacggtgcttgcgatttttcccgaccacagtcacttcattattggtgattcgctctacagtggcaccgatcgcctcatcaaccagtatttttctcaacatggtctgacgtttacgccagtggatacgcgtgatctggcagcggtggaagccgccatccgccccgaaaccaaagcaattttcttcgagactttttccaatccgcttctcaaagtcagcagtatcaaggctatcagtgccctcgcccaagcccatgatctgctaacgattgtcgacaacacgttcttaaccccttattaccagcggccacttgacctcggtgccgacatcgttctacacagcgccaccaaatacctcggtggccacggtgatctcatcgccggcctcattgtctccgctcaccccgacatcagcgagaagctcgctttcctgcaaaacacgatcggcgccattttaagcccgcttgactgtagcctcgtcacccgcggcattgccaccctctccgttcgccttgatcgtgaaactgcaaacgcccaagccatcgccgaatttctagcgcagcacccagacgttgcccacgtttactaccccgggcttaaaaacgatcccggttacgcattagcccaaaaagaaaccacgggtgccagcggactcttgacgatcaaactagccgacaacattgatcccttaaagttcgttaacagcaccaaaattttcgactttgccgactcacttggcaccatctccagtctagtcaaactaccttggtttaagctcccggaaaacaaacgcgccgattcaggtttgacaccgcaacatgtccggattgcaattggcttggaggatcagcaggacttgattgacgatctggcgcaggcactggttgcagcggaaaaatagtagcaaaaagaatatctattacttttgctaatagacgcgaggtgacaaagtgaaacaggctcagtcgttaagcttgaaatactggttgatcattttctgtacgattatcattctcagtccgattgcttatatgataagcacctgggtgggaccatcagcaacctacattcgtctcatcgctatttttctgattgcttggttggcagtaaaaatagctaaatactttacaaccaacaaagagacgaaatagtgcgttgtcctttcttaattaccattccgcagaatatagcataatcaactaacaacgacattctcaactttgacatattttgaaacgaatttggcataagccattcaaagtttgaagagtgccaacattcaaccatactcaacaaaaacatctagttagttcacttgcagtcggatctggccaaatatatcagcggacgtaaaaatgtgctctgtctatcactgttacactgacggtgataaacagggcacattttagcgttcgtttagatatcttatcaatcgatactaatcttcattatatggccatccaattgaaactggttggttaagatcagccgttccatctgtttcaagcgattgcagcgcctgcaatgcaagtcgcaacctgctcgtgtaaccgtgccagttatcgtcatcccgacctgcgtttaaagccggcacatacggtaaaaagttaacgcgtttggctgtgatcgttaatcccgccgccttacaaatcaacggccattccgtatccgtcagcaaaccatctgaattagccaaaatatatctggcagccatctgactcaccgcacagcaaccagcagtaatatccagatcaggcaaagcaaacacttcagaagccgccttattcgtaattgcctcggtttctcgccaagttgccggataaccccgcatgttttctgaacttcgaccaataatctgataaccatcatcaactcgaagctgggcaataaaggtcttaaactcagatacatttgcctcgatccctgtcactactttatcaaaatcgcagtaaaaaaaagaagcgcggtaacgaacctgacgcaatccaaaatcaagcacccgccgccgcgcatcagccgcgccacgaggttcaatgatgcgaacatgaacgctgggaaaagtttgcaataatttggtaatttcacgatctgtaatcgtactaactgtcagataagcagccgagaaactatcactaactactgccagaacccgttttaactgcggcaaagacacattggggtggtgaaccgttgcgagtaagactggttgcatgctaaccacaactcctttgcacgttactgttgacatgggctaggactaacgaatcttatcgaaaccgagaattaacaaattccggtttctccatctcgtgcttgccagttgtgtccccttttcgtcccccttaacgtaatcctgacactttctaaggtgagctaaatcaatgagaacactgatataaaggcattttcatttctaaagtacgctaataaacgctaaataatgcctccaccgagattcgaactcggatctgtggtttcgaggaccattatgctatccattgcaccatggagacttacagattccattataacaatcttgttcaatgttgacgcacgcaatcttccctgccgctcattttctcaagacaaaaagcgacgatcaactgactcaattgatcgccgcttctgtttttcgcttacttataactattggttttactaatcatcaaacttaaacaaatctgtcgacaaataccgctcaccattatccggtgctactgtggcgacactcttgcctttgccgagtttctttgcgatttcaatcgcaccgaaaatgttggcgccagcggaaatgcctggtaggaagccttcttcatgactgacgtggcgagccatgtcgatagcttggtcgctggtgacttcaatgatgtcttgatagaggttcgtatctaagacgtctggaataaagccggctgagatcccttgaatcttgtgcttgccgccatggccttcttttagcattggtgactccgccgcttccagcgcatagattttcacatctgggttaatcttacgcaaagcccgaccaaccccggtgagtgttccgcctgtgccgacaccggctacaaaggcatccggggtgccaccatcaaatgaacggatgatctcttgtccggtcgtgcgttcgtggacgtctgggttagcggggttctggaattgcattggcaagaagtagccattttccttgctcaatgcttcagcttttttgatcgctcccggcattccatcggcacccggcgtcaaaatgagttcggctccgtaaccacgcatcaaggctcgccgctcaacactcattgtttccggcatggtaatgatgaggtggtaaccttttgcggccgcaaccagtgccaggccaatgccggtgttgccggacgttggctcaacaatggtgccgcctggcttcaagacccctttatattcagcgtcttcaatcatcgctaaggcaatccggtccttgactgaaccaccgggattaaagaattccagcttgacataaacatccgcggcgccttcaggtacaacgcgattgagcttgagtagcggcgtattgccaattaaacctgtaatattatctgctgctgtcaccataataaagcctccctaaataatcggcgaacggttttcattgcgatgatccgcgatgtggcgaacccaattgtcaaaaatcgttcgctgcgttttcttccaattaaacttcggatggtcataatcgtttttgtgatggtaatagtgtttagcccgtttatagctaatctcagggtgtgcggccacttcccgcttgtattccgaatccaggccccaccggtcatattcaatatgcgaaaagataaacgtttgggtgtcagtcggttccgtcaccatgaagagtttccccttcgttgttgtcgcattgatcgttaagcggggatcgttacgaatatcgcgtacatccatctcggcataccgagcatgtggggacttaaagccttcttttaaaccttttaaaaatgggtgcggttcaagaattgtttgcggataaacgccgaataacttgtgcggaagaatcaacttgctgacgccgaaaaagtaatttagcgccaccatcccgccccagcacaggtacatttggttgggcacatgctgacctaatgtctttagcagcgtccgcacctcggcgatatagtgaacctgatcaaattccagcgtttcaatcggggagccggtgatgatgaacccgtccatcgttgccgcttcgtgaatatccagcggctccagaatcgagctcaccgcttccggtacttcccgaccagcgtaatgggtcatgggatagtaaaaatgcaactcaactgggatatcggtgtggctcaaaacgtgttgcagccgcgttttggtatcggctttgtcgtgcatcacgttgagaatcccgattttaagtggtgcttctgtcaaggttcacctcccaacccggctaattgactcgcatgaaccggcaaaattttgaaacgattgcttgcagacaccgttaagcaaaatactgccgatgtctcacctgcacgaacacatcaggaggatatcctgataaagctgatagcgccaacatcgcttgttaccaataaggtttgccatattttaataccctccctttcagtaactatatactaactaaatgtaagatcgatagcaacctttgaccttattttattcgcgtcttcttttcgaataattagtttttaaatgatcttcgtctagccaactttaaccgttcataagtaagtgatatcccgcgctacaaaaagtggtcatacctatataattcaaaaatataaacccggagaattccaccttattaaaataaacatgcgcctccgggtgttaaatagttcatgttgttttaaaatgtaagtagttctaagtacctttaaggaggttttttaatatgcgcacgcacacttcaccttccatcgttaaactagccgcagttggggcggttgcggggttggtttccggtttagtcaaattagggtgggaaaatattctgccaccacgcacaccggaacgcgatgcgactaatccaccgcaaacttttctacaacagcatggcttgacaccggcagaaacacacgcaacttacacctattcaggccaccagattccatgggttagtctgctggttcattttggcttttcatcaagcttaggggcactttatgcggtagccgggcattatgttccgctgttcaaactgggatatggcagtatgtggggactgggtgtttgggccggcgcgcatttatgggcgatgcctgcactaaagatcgtcccagccgcaaaagatcagccagctgaagaacatctgtccgaagctgtgggacacatggtgtggaataccgtcaaccaaatcgttatcagcgacatgttgcgggaaaaacacgcctagtcttttgccgatgctgaaacggtgatcatcatgagcgcgagccagctcgggtaaaagtttgaggaccgttttatactcgcgttttatcatcccgctttgaatttttcccgcgtgctgattcggcgttcaatcgcatctaagaaaggagcggtgtctgtgtcaaaaccctctacttcttggcaaaccaaatggccggaacgcattagctatggtttaagcgatgcagcagataatttggtgtttcaggtgatgacgtcttatctgttgtttttttataccgatatttatggcttacaagccggcgcggttgccttactctttctcatcgcgcggattgccgatgtttttgagagtccgattgtgggcttgatgattgaccatacccgttcgcgcttcggtaaaagccggccgtttttcctctggtatgccttgccgtatgcaatctttgccgtgctaacgtttgtcacgccagggtggtcggcaaatggcaaactcgtctgggcctatgtcacttacctcatgcttggcttcttatacacggcggtgaatctgcctattacctcggtgttgccgacgttgactcagcagccacaggaattaaccctgctaggagtcatccgccagttctttggcagttcggtgcaaatcattgtcgccgtcttcaccttgccattagtcgccttcttcggtcgcggcaatgatcagcgcgggtttctcttaaccatgacgctttttgccggcatctcgctcgtcctgattctgaatacgtttattcatatccgtgaacgatttactcaggaaaaaatcgctcaccaaccgctaaaagttgtggctaaaattgcggtgcataatcgcccgtggctgctgctatcattgattatttttacgtactggctgttgaccgccattaaaaatcagaccacggtttactattttaagtacactttacacgatcaaggcttggtatcatgggccaatagttttactttttcttcgctaatcggcgttttattgatcctgatcattgcaggccggtatgggaataagcacacgatgcgtctgggtatgatcattggcttaatcggccagctggtcatggcaggtggcgtttatgcgcggaacttgtggattttatttccgggcattttgattaacagcgtcggccaagggatgattgtcggtttagtgtcgattatgttagccgataccattcgctatggcgtcaccctcggcgctcaggcggaaggcttatttgcctccagcaacgatttcggcgttaatctgggactcggcatcggcggcctcatcactgccggactcttcgacctcaccggatacgtgcccaacaccagtcaaaatgctgcaacgcttggcatgattaacctgaattatgtctggctgccgttgctgttgtatggcctgttgttgcttttgattcacttttatccggaaaagcagatgttagctgcgattgaaaagcatcaggcttaagtcgccaccaatgatatgggctgatgttttgcccgctcacatgccaatgcattttcccagcatcgcgctccccggcgcagaattctgcgtgtaaggaccttaagcgcaatggccaagaccgggccatcacgcttaaggccacttacactccgacttctaaccgcgccggctcgcgcttacaaaaaaagattcaacgacttccctaaaggtagttgttgaatcttttttatctcactgagcatccagatcattttcatgaagccgagcaataacaggtaaaatcagccctaatgccaacaaaataaccggcgtaataatattcaagcccatctggaaccaccatgtgccggggtcattaagataactgattttcggtaacattcccaacaagcaggcaaaggcggtgaagaagaagcaccagccgccaatgagcatgcccaagcgtttatttttaaccagcatatagtcggcctggaacttttcgagatgttgatttagcaaataatacgcgaggaaaacccacagatagcgcaacggcatgaccacagagttcaagttaagcagccacttgtaaagctcgttcatgttgccaatgccaaatgccggaataatgatcagtaagcttaccagaataccggtcatccagtaaccattaatcggtgtgcctttgcgattgatccgccgcaattttttaggaataaaatgcggatcggcgtcactcagcaagattttcagcggcgcatcaatggaaaatgccaacgcggagattgaggccaaagcattggcgattgaatacaaaatgacaaacaaaccgccgacgtgataatacttacctaacattgcaaacgctgtgtatggaccattcgccatgagatcggtcggaatgttgtggctgttaaacaacatccccatgccaaaagatcctagcaacgcgcaaaaggcaaccatgcccgccagcaccaacatgcccaacggaaattccttggaggcgtgcttggtattgttgacgtatggcgatatcttttccgcgccgccaactgcaaagactagcatggaaatcgtcgtgaagtagttgaggtcaaatttaggcaaataagtatgaatgtcgcccatgttcggggtcgccacatggacgccttttaccatcaatggtgcggtcacagctagaataatgaaaagaatcgacatcagaaacatcgccgtgcccgccatgctgccaatgcgattcaaggtggtaagcccgcgcgaagacagccaaaggaaaagtaagaataacgccaggcagatcaaggaaacggtcatggacgaaacggtgttgacaaaatcaccgttgcctttaaacagccagctcaaggcaatcaaaatcgcttgcggcttctgggctaaataagggatgtgcacgacccaataagtccacgccgcatagtacgccaatcgcacactgccggtttccttgatccaggaactaacgccaccggcttgatctttaaacgttgatcctagctgccccacaatcaaagcatagggcacaaaataaatcagcataatcagaatccagctagtgacaacggaaaggccttgctgtgcatagttattgaacacattgccaagaccccataccgatacgaacgcgattaaggccacgttataccagcgcagttgtttctttgtgtctgccacaaacatccctccaaacggtatcctgctcgattaagaacagttactcgcctttcagtgtaacggtttgaccacctctctttcccgtgaaattgtatagataaggattagatttttctaaaagcccggttgcggtttcgttatttcatgccgtatggatactcattaactggaagtatgaaggcataaaaagaccgccactgtaacgctgagtggcggccttttgtcatttctctttagctatcagccaagacgactaatattttacttaacagctttggcaactgcttcatgcacagcttgttgctctgcttgaatcaaatcgacgcgactggcaatgacgctggtgtccatggtgatttcccgcgttaggccaggggtcggtagttttggctcgaagaatttcttgaattcatcgagtcgttgcgtggtgcggaaaataccggcgataacggtgatgtaggttgtgaattccatgtcgccgccaaccgttttttcaagccaagcccattcgttgcgaacccaatcccatgctgcttgttcaccggcgtgattactcaagacgccgcggaaccatgagcgcaaatcttgcggcttaatggtgtcggcattttcaaattgatccacaattttagcgattaactcggcatccggggtgctggttaccgctgcaagaatgtcggctttgtagcttgagtcggttgtctgcttatacgccgtcagtaactgatcgaacaaggtagcactgccgaagtttttcacttcattttgaaggacaaacatccgcacatcagccggtaactgaagcaggtgatccttatttgccgtaaatagatcgtgaccttgcgcaatggcgtctttattcttagcatacaacgccatgcttaggacataaggacgggttagttgatcatcattggattcgccggcttttggtgtccagcccaggcgcttgaactggtcggcgctgagttggttgaagaaggttttcagctgcgtttcttcggctgaatccgggttgacgaattgtttcaagtcattggccacccgatacaaggcgttgatgacgatggcactgtgactctgggcaaaccgcgacagcaacggcacaatgtcggcataagcattttgccggccctccgccaataatcgcagatcttgaagcacctgccgctgatcaatcgcattgagttggtcaagatgcgccaaaatatcggcgagtaaggtggcgtcgtatttcacgatgaaatgcgaattattgcccacatttacgcggaatggttgaccgcttgcttcgcgcaactgggtgtaatcgcccaaagttacctgcttatccgcaaaaatctgcggtgcggcagcataattgctattgagcggaatctgccactgcctgcctgcatctttgcctgcaccaatgaagaattgttgctgggacaaggtcagtttgccatcaaccaccgctgctgtcaccactgggtagcctggttgttccagccatgactgcataatggtgccgacatctaacttagccgctttacccaaagctgcccacaaatcagcaccggcagcattgccaaaataatgagcctcaaagtatgccttcaaaccggcccgcaacgcatcatcaccgattaaggaacgtaccatgaccagcatccgcgccccttttgcatacacaatcgcgctgtcaaaaagcgaatcgatttcagccggatcttctacttgaacatgaactgactgaaccccatccgttgcatcacgttgcaacgccattggtacttccagtgtctggaatgtttcccaaatatgccagtccggctgcaaggcatcaaccgcaacatattccatcatgttggcaaaactttcattcaaccacagatcgtcccaccacttcatcgtcaccaaatcaccgaaccattgatgcgccagttcatgcgcaataacggtagcaacccgctgcttggtttccagcgaggtattgtccggatccagcgtcagcaacgcttcccgataagtgacaagcccccagttttccatcgcgccagccgaaaagtcaggcaacgccaactgccaggaatgcggaagtggataaggggtctggtaaaagtcttcgtaaaattcaatcgagcgcttggcaatgtctaatgcgaaatcaagctcattaggttgatgtgctttggtagcaaagaccccgattttaacgccgcttttggtggttgtctgcttattttgcaattcaccaaatgcaaaggcgatcaggtaagtcgacatccgaaccgtggtgtcaaaataatgaacgccattttcttcacgaacttccggcatgttactgataatcgtttcaccgggatgttcatcaaatttaatcgctaaatcaaacgtcgccttggcttcaggctcgtctacactagggaatgcctgacgtgcagccgttgtttcaaactgggtcccgataatctgcttcttaaccccgtccacttcgtaataagaaggataaatacccatcatggtgtccgtcaacggtgcggtatacgtcagtgtcaacgtcaccttgccagcttgcggcaaagtaatccgcaccgcttcggcaggatcatccaccgtaaacggaacatccttgccgtcagcctgaaccgcactgaccgtcaaatacttctgatgaaccgcaatttcggtttgcttggcatcaccggtaatcgtcgtcttcccggaaatcttcttcgtctcccggttaatatccaagtaaagattataatgttccggttgaaacaactgataaaaatgcgttgctacagtcatgcaccaattcctccttgtgtgtgagcgcgagccggcgcggttagggaccggagtgtaagcggccttaggcgtgatggtcgcactttgaccattgcgaccaaggtccttacatgcaggtccctgcgccggggagcgcgttatgatgaaacgcgcaccgaagcagttaatcccctacaccggcaaacgcgtgatgataacgttaatcacgcttattatacgccaagtggcccaccgcttgtagcagaaagtcacacgctcaagccgcctgcatgcagcaactattttcaactgtttaccaaccgccgccgcgccaaaagaaagctaatgatcatcaaaaacgccgcaacccctagttgtaaccaattatcgcttaacggtcgctgacgcattaaggtcaacaagtttaacgcccctaattgattgctaccaatacaaagcgcaaagtagacggtcggaattaaatacgccaccgcaagtgactgagagcaacagtaactaccaagcgtgatgctcccgataaataaactcttaaccgacgcattgcccaacagaacgccagcagccaatgtcgttccctgaatctgatatagaccaagcagcgtaacgttcagcactgccaacacgccaaaataccaagcaaatcgcaccgcgtaaaccgtccacaattggatcgatttactattgataactgctgctacccctgttgtttgctccggtaaaaataagctgccaaaacaaaagatcgctagcaacggcatccacaactcagtcggcatcgcagcttgtgccagactctgcggtgtcagcgtaaaaacaatcggaatgagtccccagccgagtaccgcaatgaggctggttttcaagacgttggttttaatttctaatcggacgaagcgacctaaacttgagtgcatgtagtttacctccccgttgtgcagccaagatccaagcagttaacgccatcagtccaagcgccaacaaagcgtatccgagccgattttgcaacagctggtttagctgggcatagtaatacgcgccattgtgcagcgaattatgccgcgggatcaataaccatccgtagttaccactcacgcggcgagcacctgccatcatcgttgccaaccaccagccaatttgaatgccaaaaccaataaaattgccaaaaatcgccgcacttaaatagccaaccgcactgctgaccatgagcgttggtaacacccagataaaggccattttcacaatcgcggtataatccaacgacatcccttggtataaaacggcgacctgaatcgttagcgcaatagcgatcgcaatcactggcgcaaataaacttcctaaactcgcaacataccgcgtcaataataaacgcggcgtggtcatcgccttggcttgaatcaccgccaacgcatgatgccggcgatcggcagtacaaaaagcaatggccacaattgtcggtaaaatgcccatcatgattccggcaatatccgcaaacaatctcgcgaacgctccggtgacccgatcacgttgccgaatgagctgctgatccgcgacgacttcggctttcgtcatccggcgataagcaaaattctgaatattttgtgaactgtacgcagactgtccacccaagagccgatcaacctttgccaatgttttaaccaagggtgcgcgcgtgtctgcatcctccgcctcagtcatcaactgccgaacttttgcctggtctgccgcgcgtaacgtcacttgttttgcaaaccccaacggataagtcgtatacaaattatgccgataatcgtagtgcaactgatccagactgtttgtcttgagcgtctgataatcggtcgccgtaatattttcgtagctcgctggtgatttcggcagggtggttaagtttcgtgaaagtaatggccagacattcatcacgataaatgccacgactaaaaatgtgtaaataacaaacgttaaacttcgcgtctgccgcttaaattccatccaaagcagcttcacaatgacccctcctcacacaccgcttaccgtcttcaccaacgcttgatgatgctgggtttgtaaatacagatacgcctcctccaacgttggcgcaaccgattgccaagttgccaacggagtacgagctaaaaagcgtacccgaatatgctgcccgtgcgctgtttgttcactaatctggtactgcgtcttaaactgtttaagctgcgccaccggtaagtcaccgacaaaaacatgccccgcagccgcatcaataagctcgtcagtggtcccattgaaaaccagtcgcccatgatcaaggatgccaatacgattagtcgttgcctcaacatcggaaacaatatgagtagacaagagtaccaaacgctcattagcaaaatctgccaacaaattccgaaatcgtatccgttcttccgggtccagtcccgcagtgggttcatcaacaatcaaaacccgtggctcattcacgagcgcctgcgcaatgcctaaccgttgcaacataccaccagacaacgccttgactttcgttttcgcctgagctgtcaaatgaacagctgccagtaaccgctcaattcgccgcttctgctcgcgagccggcacctcagctaagattgccaaataggtcattgcgtcaataactttcatggttggataaaacccgaactgttgcggcagatacccaattttgcgccgaatactgcgcgcatctttaagtggtgtgccatccaccaacaccttaccggaagtaggttgctcaagtgttgtcaaaatcttcatcaacgtggatttaccggcaccgtttttccccaataatccatacattcctgactggatattcaacgaaacgtgatccaaagccggctgttgtcggccacgatattgcttcactaactgctcaatctgaatcgttgtcatcaaaaaaagcctccttattcatgaagcgagccagtttgttcaaaaccgcgctgtgagaaccgcgtgcagtaaaggcacccgttttttctcacctgcaatttctaaattggcagacgcatcatgttgataagcagactgtaacaagtaaatgacaattttctgacaactcagccaatttacctaaaatcagatcaatcagtcgagctggaggcaggcgttaaaaaaccaaattcggcaatggtgctgacgccttgggtatctggttgattggcaattgtaaaatgaccccgatgcgccgcgcataattgcgtacagatgtacataccgactccgagatgttgggcttgacgatcattggaaaaatacggcaacttggctttagcttgttcacccggcgtcaacggcggaccatcattatcaacttttatcgtcaacccgtttgccgttgcggttaagtgaatcgccacctgctcagcggcaaaccgacaagcattggtcagttgattatcgaaaacttcaagtaccacatccggtgcaattgcaagcgactcgtttgttgtcagctggttctcgaccttccaagtaaccgttttggtagccggaacaagtttgctggcttcttctttaagttgttgttccaaggcggccggcgtcatcgcctcaccggttagctgacggttttgaagcgcggaaagatgactcatcgtttggataaaagccgtcatccgatccaactgctggtgcatctcagccaagagtgcctgatccggctgctcatccttatccgccatggtcaaaagttccaggttgccttgcaaaaccgtcaatggcgttcgcaggtcatgggcaaaagccgcattcacctgtttttgatcctcaaccaactgccatgcttcttcaagtgcttggcgaagggcctggcgcatcgcttcaaatgcgcccaccaattgccccagttcgtcggttgtcttggcatgcagttcaaaatccagatcctgagcctgaatatgtgccacccccgcctttaactgggctaacggcggtgcaaacttaagccgataaaccatccgcgccatcgcattcataaccgcatataaaacggcgaagctaccaataattgctccgccaaaatacaaaccgacaccgcctaaaaaccagtgagtcgctaaagccgtcgttaagtgaaacatcaggagatgccagacttgtaaaaatagcaacatcatgatgccggcgacaatcgttcccagcagaatcatctgtaaaagtgcttttttaatcgatagcttcataaagtgtgcttttaattttgccatttatatcccactccccaaaccgttacgatgggcgatgttacctgacaggcatcaaagagcttgcgaatgcggcgaatgtgctcggtgatcacccgctcatccccttgtgcatcgtagccccaaatcttttcatacaactgctcgcggctaaacacctgccccggattcaggcttagccattcaatcagttgatattgcttattttcaagttttaggcaagtcgtatccaccgagacctgatgcgcatgataatcaatcatgatccgcccaaaaacggcaatctgcgcctgtttgtccggctgatgggcccgtctgacatgtgccttgatgcgtgcacctaattccgtcagactaaatggcttggtcacatagtcatcaccgcctgcgcctaacccctgcaccttatcctgatcggtaatacgtgcggttaaaaagataatggggacagaagtgatcgcacgaattcgactggttaaagtaaagccatcaatatccggtaaattaacatccagcaaaatcaagtcgggctgctgcgccaattgactcaaggctgcttgccctgcatctgctgtgagtaatcgaaactccggtagccgccacgcaaagtatcgcttcaacattgccaaaatagcagtatcatcatccaccgccagtaccttcgtctgcatgccttcaccctccattgccccaagcctattagctccgcacttatatcggttatgattcattgcaaaacaagtgtttcctaattcaactctacctgttgccgcaaccgcttgcaacaaggcatctgctgggtgatattaaaaaagcactgccagctgctggcagtgctcatgaactaacattaaattccaccctaaacgcggccagattaataccgaatccggaaagtcttaggtgccactcggtaaatcaccgcggtaccgatcccgacataaagcagcgtcaccgtaccaatgagaattgcataaccatagccgtaaaaatgaatctgcgtaaaaagccacgccacccaatacattccgaagcttaagaaccgatacagcggcgagacaacgtccatatcatccgtaaatggctgcagcaggtagtaaatgaagagatcgtgaaacgaaaagaacaacatcagcccacagatttccagcaacaagaccagataaaagttaacctgatctgctaccggtgcgattaactgcagtgcaaaaatcaacaggaaaaccgtgaacccagtcactgcattgtactgaacaatgtgccaaaaccgataaaagaatcccgctaaaatggtcttgggctggcggtaaaaaggataatacaacattgccgcgtcacaattaacaaataacaactgaacaatttggccacccagcgaggttaaatacatcaagaagaaaatgccgccatagatcggtgtcagatcgcctaagttatggacagcgaaaagttttaaagcgatcaaaagccctccgccaagtccaataacccagaacaggcgggtccgcaactttttccatagctggcggcggtaacgggcaaacaacaaggcattgagataattactgccggaacggttttcagacttgagggccacggtggtatccagcgtcagtttcttttgcattgcagttcctgccgcgagaagttgctgctttttggctgaggcaacaagatttaacgtccgcaccgcatcctgaatggaggccatgattaaggaattatcattcggaaaacggtaaatataccacccagtcagcaccacgccagcccagccaatcagaaagcccagcggtgaaaaaacgccaaccgtaaaggcggctaattttccggttaccactaagccaatggggagtcccagtaaactcagccagtacccaatctgcaccagcaatcccagccgccagtgtgcccaaagcaaccgcggaatgaaactcggccataaccacccgaaaatggcaatcggcagtccaaccaaaaacagccacatatgctgcgtcaacaaggcgagcgcaaacataggcaatagtggtccaagtacaacgccactgatttgatccatcagcatcaacccgcgcaccagtgccggccgatccaaggcaaaataatcacctaatttaaccgacttgaggctcagcggcaaattgcggaataccaagccgcgaaacatgagaaagcccaccagataaaccagtaccgcgatcatgacgcgcagtgaaagatcggttgccagtggatgcacataatcgtgatacgcactgccaaccaaaaacgctaacccgattagcaaaagcgttgtcaccggttttagcaaaatcgtgaaaaagttaaccgcaattgccatgagggttttcaaagcacttggccggtaccactttgtcgggatctttttacctagaaacggaaatcgccgcaaaaagtagatgaacccattcaccatcgtcgttgcattgacctgcgcctgaaaccagtaatatcgccaagcatcacgcatctgcctgcacctcatcacttaaacgcgcaatcacagcctcttcaaattcctgactgtgaatatccagaccttccagttcgctcagctttttatcatgcagcaacaccaccgcgtcacaaatggcctgtgctaactgcataatatgggtcgagaaaacaactaccgagtcgaccttcatcgcgacaatcatctgttgcatttcatgagccgccaccacatccaccgtcgtcagcggctcgtctaacagtaatacgggcggcttaagcattagtgacaccacaatctgcaacttattgcgcatcccctcggaataatcgcgcaacaacttattggcatccgcctgcgacaaccccgccaatgaaaagaaatccgccgctttaacgctcgtgtgggtttgctcaagacgctgccgattaatcgccataaaataatccacaaactccaccccggtcataaacgccggcaaatgcggttgggtataaaccatgcccaccgatgtgtccgcataatccgtgatcaatccttgaccatcatcggcatcaattgcgatcgtgccatgatcatgcggcaagttacgcacaatcatgttaaataaagtcgactttcccgaaccgttgcgccctagcaagccatagatttttccttgtttaaacgtatagttagcatctttaaacaaaacctgctgatcaaacgccttatccaaatgtgcaatttccagttgtttcatgggctcaccttcttagcaatccaaagattttttctaagtatagcagaccatttttgcctataccgcttaaatggcaaaactaatttaaaaaacggatgtaactttacttaaggtgtctgccaaggctaatgccgtttgggccattcaaaccagcgacgtttggactgggttgcttcctctgcaggcggctccagaccatgttgccgttcataagtgcagacagcctgataaagatcctgccgaccaataatcaacaacgcattataagctaagccgtgataaacaattgatcgcaacctttgataatccgttgacgaaatcggaagcgtgatgtcagccagcacttgcttcaattgattttcactcttcactcgataatgcgtcatcaccgcggaaataacgttgccgctgatgagaaacacaatactgaccagcgttagcaattcgcgaatcgccgcaatcattttcggcccaaacaaactagccgtcagtgtcggcgataaatcaagtccttgactaatctgatgcgcaatgcctgccatcgccgtattgccaaactccgccagcagaaaaatgatcaccgtgctcgtcgcattaatcgcaggaatataattcgtcaacacccgcaactgataattcggcaccatcacaatcattaccgcagaaatcgtgatgctcaacagcaggtaatatagaatataatcgcggaaagcactgaagtcaggcatgattccggttatattcaggccaatcagcaaagccaacggggcaaacagctgcaaactcacaaaggttcgaattaagtgcgtggcaaatgcctgaatggcgccaataatatacaccgtgatgagcaccatcagcgctaatgtccagccaatcgtcaccacaaaatcgcttactcgcacaaatcccagcccatctaaaatcagtcctgacagcatactcaagacataactataaacggccaacccgcgaaaatgtcgcgcctgatcggcaaaaacgcgccgcttcaacaaatctagccggttcttcggatcagaaacaatcataaactgcagcgtttcaatttgatgccacaagtgccgcacctcacgaaaaggcggcaaccgaaccattcgaatccaaagcagacttaaaaaggccccgattgcgatgatgaccagtttaagccagagttttgcagcttgatcaaggccacctagggcaagccataggtagaaaaaggttagggttgggatgagaatgcggtaaactttcttagtcataaaagctcctcagacgtcaatgcgttttactcaatttaaccgtaagttgggttccatttattatgtcatgaagtccgtatcattcaattattttgcttatcatgcaaaacgaccgcacactaacatcaattgaatcaccttttcagatgtgtaaaagatgcactattaacgaatttctggtatcaaagatatataatttcagctaaagcaaaacgaggcgaattcatgacaatcgaaaccatccttttcttactaggcatgagtctacttgccggcattctcaacggtattgtcgggatggcagcactcacgctttatccggtgctattgtcagttggcgtggcgccgattacagctaacgctaccaatacaattggacttttatttagcggttcatctgcggttgctgcttctcgccacgaattaaaagatcactggcatcaggcgcttgtcatcacgttgcttaataccattggcggcgtttttggggctcttattttaattcatagttccaacgcaggattcaaaagagtcgtcccgtttatcatctttttggctggcgtcttgattctaatgccacccaaacccgcaagcagtaacagttctacgcgtcagcacttgcggtggttgggctatgtgctggtgatgttagtcggtatttatgttggctattttggtgccggtgccggattgctgatggtggccgtactttcgcgacttgttgaaggcccttatgccacctacaatgccatgcgcaatcttgcctcacttgtgaataacctagtgacatccatcatgtttatcttctcaatgccaattgcctggggtgtcctaatcccggtctgcatcggcttatttgcaggtggttttctcggaccggtcattgttcgcttgatcccatctcgcattattaaaactgcagtcggtatctttgcacttgggcttgcggttttcctgttctatcaggcgtatttatagcataaaaagcatcgttggggaccatttaaaaatcccaacgatgctttttaatgttcatcttcagtatgtccagtcaggcggtcgctttttgtcgtgcttgataagcctcgccccaggttgccatcgcttggatcactggtgccagtgtctgcccgaattctgttagtccgtattctgtggctcgtccatcggcgtcacctggctttttagtaatgacatgatccgcttctagctgtgctaattgtaatgccaacatccgttcagttactgatgggatggctttattaagcgtactgaaccgtgtcgcgtcaccctgaaaaagatggtataggatcacacttttccatttacctgaaataatgtcaactgtattttgaactggacacccagccgcacaatcataaagttcgcctgacatcataggacttccttttttaagttacttacaatttactcacttactattttagaacatgcccgctaacatacaaggtgaaacttagcgaaaggaagctacttcaatgaaagcaattggttttacgcaacatttacccattcaagatgctcgtagtttagaagatctgaccctttctaagccaacccccactggtcacgaccttctagtgaatgttcgtgctgtgtctgttaatcctgttgacacaggtacacgaggagcagggcacgcgcagttggctcagcctaaagtgttgggatgggatgctgttggtaccgtcaatgctgtgggtcaagatgtcacgcgctttagagttggtgatcgggtcttctacgctggtagttataaacgctccggaagcgatgccgaatatcagttagtcgatgaacgcattgtcggtcacgcaccgaagaacctgaacgatgcccaagcagccgccatgccactaaccagtctcaccgcatgggaagcgttgtttgaaaagttacatatttcgccggatgcaactgcagaaaatcggcatcatacgatcttaattatcaacggttccggcggtgtcggttccatggcgacacagttagcgcatctggccggtctgcaggttctggcaaccgcttcacgtcccgaatcacaaaaatgggtacaggatcatggtgctgatcacgttttaaaccaccgcaagccattaccaccgcagctgaaggcagccgggtttaaagatgtcgattatatccttaatctgtcgcatctagacgagcactggtccgagatcgccaccatgattcgtcctgatggttgggtcgcggctattaccgaaaatcgccacggcatcaacttgcagaaactcactaagaagcgggcaacatttgcgtgggagtggatgttctcaaagtcttggtatggctatggcctagattcgcaaggcgccattcttgatcaagttgccgcgcttctcgacaaaggcacgctgcaatgcaccttgactaagacactacaaccgcttaatgccgcaaacctgcgtcaggcacatgcactcgttgaatccggacacatgatcgggaagattgtggttgctggaccatgggcataatttgctggcatatagacgcctaagagtgatcaaagcaggaccaaatcgctaagcattgcggctgaaacagtatttaaaacttcacaaaagttagtgtatgcgtctaaagttgactaacaaaagcgagcgactcactgccgctcttttttgttggtctgtacgcaatcaatagtctgttctcaacttaaccgatcactataaaccgggaaagactgatactgaccatagtctgtcaatggcttcatgtgttcaagcgtcgacatgtcggtttcattgatctcaaagtcaacctcggcattcgccttcatatgttccggtttgaccgtcttcggcagcggtaacaggcctagctgcaataaatatcgcatccctaattgtgccactgaaacgtgatacttttccgccatctgcttaattgcctgatttttgaacatttcaccatgtccaaacggtgaatatgcctcaaccagaatatgatgttgtttggcaaattcaattgttttaaacggcgtctgggtaatgtgtgctaacacttggtcaaccattggcgcaatctcggcatgatccaacagattcctgagatcggtgggatcaaaattagacacaccgatcgccctcagtttgccagctttatacgcttcttccagcgcccgccatgcttccaggttgccttcaaagtaacggtcaggctcatcgtattttgcccatggcttcggtgcgtgaatgatcatcatgtcgatataatccaaattcagtttttgcagcgactcgtcaattgctttaactgctgcatcgtgttccttgatctctgcggctaacttggtgttgacgaaaatgtcctgccgcgcaataccggctgcccgcacgccttcgcccacgccgacttcattaccataagcttcggctgtatcgatatgtcggtaaccagcgtcgatcgcctcgtgcacggccgttgctgcagcggcattgtctgcaatcatccaagtgccaaaaccaattttagggatcttaaccccattggctaatagatacgtttcttctaacaagttttcatccctcttttgactttcgccgggtgttttcaacgaattgaaaaagcaccctagcatgatcaacttttttgcacttgttttgataagtgctacactcagcctagcccctaaagtcaactttagggcaactattttttaaattatctttagtcatcaccattggaggttcatatgtccgtatcttattcgattggcgaagtcgctgccatcacgcatctctccgtccccaccatccgctactatgataaagaaggtctcattcccgatctcaagaaagatcctgccggggttcgctgttttgacgaccacaatctcggcgcgctggaaatgatcaactgtctcaaaactgctggcatgtcgattaaagatatccgcaccttcatgcagtggacgctggaaggcgacacgacactggaaaagcggctggactttttcaatcatcttcatgagtccgttgaaactcaaatgcagcaactgcgccaaacccttaacacgattgaatacaagcagcattattatcgccaggccgttgctgatggcacggaaaaatacgtcaaaaccggcacagcccatgaaaaagtcgcggggactgactaaaaccgctgacgattttgaaaatgtctctagtttagacacccaatatgggatcaaaaaaacgcctgcatcgcgatgatggcaggcgttttttgatggattcaggaatgatttaaaaatcttctagccgcgttgtgaccttacgccgttttgctgccacccagaggccaatgaggaaccaagcgattgcaatgtacgggaaggtgttcattggaaatgccggaatgggccaaagactggtgtagataggatagatgaggaccagaatcccaatgacaggagcaagcacatgtttgaacattgagcggcctttatctttgcggaaataaacaatcgcgccaatattcaccagcacatacactgtcagcaagcccagcatcccaatcgtaccaaaccagttgtacatatcactggcactaacgcccaagccgattgcaaaaatgacatacacaatcaacgccagccccgtgatgctatcaagcgcatgcgtcggcgtctgcttgtccccggtttcttccgccaaccatggatgcagatacccacttttcccaagtgcttccagcatgaaggccccagcattgagtgcgccgaagtaacaggcaaagtagctcaccatggcggcaaagtccataaagatcgccgcgttggtgccgagataatgggtcgccaggaagttcattggcgcggtacttttggcaagatcgccaatgtgtgccgagccaaaaccgatgacttccgcgtaactcaccaagaaatagaaaattgccgcaaagcttaccgcacctagcagcgcaatactgatcgccttgcgtggattcgtggcgcgcggagcaatggttgctgaaccttcaaacccggcaaatgacatcagagcaaacaccatccccatgcctaagccagttgccatgtggggctgagggatcaacggctgcaccgaattaccgctgcgaccgccggagaaaataatcacgacagtcaacacactcaacactaaagccgccagcaattccagcaccaaggtcaaacgagtggagaactcaatgcctttatgactgagccagccccctaacaacaggacgataatattgtataaattgactggcaaatggatgcctaagtgacttagaaagacattggcaaagtttccgacaatggcgccggaactgaacacaaaggtcacgtaggtcagcaccaacaaccagccggaaatgaagccggccttttcgccaagcgctttggcattgtaagcatatgccgaaccatcgccagggatgcgcttgcctagctcaacaaacgaaatggccacaaacaagacaccaatgccaccaagcaagaaagcaattggcatattgatcccggcattgcggcggcacttgcggtgttaaacgacatggcgccagtgggagcaaccatggcgattgaaagaccaaagacctcaagtaaggttaattttttacgtttttccataatgggtttgtttctcctctattagcaaactcgcttttagcggtgcggatctgtgggcttaaactcatcctcttggtggtagagcttagccgcggtttcccagcagatggcgttgatccacgcttttttctgggctaaatcgacaaatggcaacggtgaaaaatgcgcgatgagtgcctgcttaaattgctgcgccgctaagccgtacatttccggatacgtgctcgcatcagacgcaaatagtatccgggtatacggcgccagttcaactgcctcattgaacacccgccgcacgccgctgggaccaagattgtccaacagcgaaatatcaaaatacaaatttggaaagacactggcgagataaccagcctcccgctgatacgggtaacaatgtaataaaacgactttaagcccttttttcgcaaacgcatttaaaaagtcgcgcatcaacagcgggttacctagatacatatccgtatccgcgtcgccataaccaacatgaaactgaagcggcaggtcttgggcgataattagcggcgccgcgtggtacaagatgtaatcaatcaacggctttgacgtcagccgggtttcaccagactgtttccaggtatcaaaccctgctgccgcttccatcagattaaccggctcaatgtgcaagcccacgcggtaagccgcaatcgacttaaatccgacaaaaccacgttctttagcttggcgaatatcatcacgcaacgcctgccaccacgcagcaaagttatcatgctgcaacatcagcgcttcagcatgcgtctccagccgataaatggctttaaccggaaccccagtcaatttagcggtttcatctaaatccaaaatcgcatcatcgggcacaaatccagtatcaatcaacaactcctgaaaatgataatagctaaaaatgcgctgattataggttgcataccccggatcattcatcgctgctaacgggtgcttggcatcaagggcaaactgctttgctaaagccaaaaagccatgataagcaaggcggtttttggtatcggctaagggataatcattatccgcttcagtcgaaacctgtgccaatcgttcatcccgatccggcactttgccattaatcaaaaagtgacagtgatggtccaacaatgggacttggtcgacaaattccgttaagtcgtccaaaatgaaacctcctcaaagaaagtgagcgtgatccggcgcggtagaagtcggagtgtaagcggccttgggcgtgatgacccgggtttggtcattgcgaccaaggtccttacacgcagacttctgcgccggtgaacgcgttatggtgagcgtgatccggtgcgggtaaatgaaatcgtacggatcggcgctggcttaaaattttcctacaatcaatacaattcccgatgcaatgcggcaatcttttccagttccaacttgccatagtagtggtcatcttcacgcttgatttttgcataagcatctaccagctgagcgccgaacaaatcctgaaatagcggatccgccacaaatgcatcaactgcctgacctaatgttcgcggcaagcgtcggataccttttgccgcgcgttccgcatcgctaaggctggccggatcgacatcgcaatagtcaccaggttgcagttggtgggtgatgccatcaagtccggccgctaatagccctgcaaacgctaagtatggattggccgtggcgtcactcgcttttaattcaatgttcatcgagctggctggatcgctccaggccgttgacggaattcgcacggcggcttcgcgattatcctgaccatatgtcgcataagcactactccaatgtcccggggcgaggcgttgatacgaattgactgacggacaggttaatgccagcaaaccttgaatatgtttcaaaatgccccccacaaaatactgaccggtctgcgacaaatgcatcggcgcatcgtcatcaaaaaaagcatctttttggtcttgccacaacgaaaagtgaatgtgcgctccggagccagccgaatccacaagcggttttggtgcaaaggatgcatagagatcgaaatccttagccgtatttttgataatccgcttataaatcacttcattatccgcggccgttaccggatcttgcggcaacatgctcaattcatgctggccaatcccgccttccggataatacgcattcggcataatcccgacttgttgaagctgattaatcgctttgagaataaaaggataagcaaagtccattgactcagttgaaaaagcaacccgcggcatcgcaggctcccgatgatccttgtcgccagtaaataactcaaactcgttttcataggtcattttcacactgaacccagcatccgcaagctgctcaacaacacgcttcaatatcgaccgcggatctgatgcataaggcgttttatcgaggttataaatgtcacccattaaagtggctacttgcggcatatatggcagcacatgggccgaagccggatcgccaaccagccgcaactccccgattggcgtcatatcctgcaccggtaaaatcgtatcgcgctcgctgacattcaaggttgccttggtcaagccaatgccatctgccagtttagctttcaaacttgctagtggaatcacctttcctcgtgtcaggccgttataatccacatacagaaactcgatcagctcggtttgcttttctgtcaattgctcaatcacagcttcttcattcattgctaacctcagccccttttcatcatgcttgccgtcttaaacaacacccgttacgtaacatcactcggcttcaatcttacatgattattggtgaaatgaaagaatttctgaaaattgcctttcgaatctcctctaaacatcttgttaagaaactggcattactcttaacgacactgctcaacttagacacatctccccttgcatcctacagcaaaagtaaatctctataagaaagttggtttgtttatatatactacatatgatatatttgatgtatataaagccaactcgaaaggagagcctcttatgggtgttgcgagcggcctcaatgcgttattacaggaacatcacacttttgttagcggcacagccaagcgttttggtgtctcctcctctacgcttaatcaagccgtcaaaaatggaaaaatcttgcgagaggcgcgcggcgtttatgttgagaacgggtacacatgggatgactttgaagttttatcgcagcgctatacaaaaggcgtctttgctcttgatacagccttgtttctgcatggattaaccgatcaactgcctgaccgattcatcatggcttttccacatggttacagtaatccccgtttagctgagcatggtattgtgccgatttactatgtccccgaccgttattttccaggtatcacatcagtccaaacgcccaacatgggactagtgccggcttattcggtggaacgaaccttacttgaattctgggaacgatcagatgttgccccatactcgcgcaaagaagcaattaacaattacatgtacgaatatggcaataacgtcaattcctataagcggcttaaaaaacttaaagagcaactatatccgcagagcgacatctttaaattactggaggtactagcctaatgccgccgtatgctaatctatctccccaaatgattgctaatcgcattaacaaatcagcagattctcttggagtgccgcgtcaggacctacagctgctctttcgactgcaggaacttttgcgccagatttctgaatcaaagtacagaagtgattttgtctttaaagggggctttgagattatgacattaatcggcgcccccttacgaacaacaactgatctcgacgtaactttaaatcattacagcttaaacgctgacgaactcaaaaaaatcttttttgacatctttgagcacgcggaaggaccaattcattttgaaatcacgcaagtaaagtcagaaatgaatgaaaataaatatcccggattccgcttgggtgtcattggaacaatgggaaaaacacgatcaaaactgaatattgatatttcaacaggtgacgtgatttaccctaatccaataaagtttgtgcatactaactttattgacgcgcatgacaaaattacaataaacgcctttcctcaagaacaaatcatggctgataaattgataacgatctaccaaaagggtcccaacaataccagagccaaagacttctatgacatttgggctctcagtacactaatatcaatcgacttagaccatcaacagttgatcaaagcctttcacgaaacagctaaagcaaaaaagatcggtaatctcacgttaagtcagggagaagccatactcgaagaactcaaaacagcacctggaatggcactatcttggaaaagctatcagcaaacaaagaaatttgcgcaagatatccgctttactcgcgtgttagacagtgcaaggaaacaacttacccaaatttttagcgcgccgcaaaccgagaaatagaaaatctaaaaagccgccatccaaactggagacggctttttagattcaattttcaccatgatgcgtgtgctagctggccagctgatttacttgcgatgagcagcgattcgatccagaaagtcctgaaagacaactaactgctgcggatcttcctgttgccacatgttttccggatgccattgaacgccgaggaagagatcggtatctgtggattccatgccttcaatcacgccatccggtgcaaccgccgtcactttcaatcccttacccaccgctttaacagcttggtgatggcgcgagttaactttaatcgttgactgcccgtaaagcttggccaatttgctgccagcggtcaattcgacatggtgggtcgcaaattgccccagtgtggcttgtgggtgttggattttcaactccggatactgactctcaagatcctgatacaacgttccacccatcgccacgttcataatctgaatcccgcggcaaatgccgaaaatcggcttgtccgcagccaacgccgccttaatcaaggcaatttcaaaacgatctttctggtacagcgtcatcccaatcttcggatgtggctcttccccgtaaaacgttgggtccacatccggtccacctggcaacatcaggccgtcaatcagctgcacataatcttgtgccagctggtcaaccttgctgacatcatccggaaaagcgatgatcaacggtatcgcgcctaatttaatgaaagcttctttgacatcatgtggtgcataagccggatgattgttcggcatgataggattaatttcaatgagttcatcggtgggaataccaatcttaaatttcacgcgaggtcccttcgctttcttcttattttcattttcaaaagtataccccgttatttttgacgcgacaatattcaagtctctgcctgcatcttaatttcgaatggtcaagcggttttagtcgtagccacaattaacatcatcggtcgccgcagctcatcagccataccgggaatatcccgcaccatcgcggcagtgggcgtcggttcaatcacacgatccaagcgtaagtgatgatcaagcagcgtattcaaataggtcgtcaacgtccggtggtatttttgaatgcggtggtccaaaaactcggtttcacgctgaccttccgcaaaatatcgatctaccggccaataaaggttatgcccgcgatcatctttgatccatgtctcgtcaccttgagccgtaaaaaccggatgttccactgacatgataaactggccgtccacgggtaatttggcactgattttttgaaccagacctgcataatcagcaatgtaatgaatggccagtgaacttaagatgacatcaaaagatcctggcaattgatcaatggcctgcatatccatttgttgataaacgatgggttgatcgtgggtcatcgtcgcggcttcggccagcattttggcggaagtatcaattcctagcaccgttttggccccatgctcagcggcgtatcgacagtgccacccatagccacaccccagatcgagtacccgtttaccggtaaagtccggcagcaccgttttcaactcgtgccactcgccagcgccggctaaaccttttttcgagcgatccatttgactataagccttgaaaaaatccggatcatcataaatagctgtcatgttttgcctccatcgttgtctgcttattgccatcatcgcagtcctgtcgcggtgacgcaaccgcgcggctagaaaactgcccgtcaaaaatttgattcgggttacattccaatgatattttagtttgaaaatcatgacgatgcatgctaccgttggctcaatacttatcaataggaggcagccatgcaaattactgcgattaccgctcatccccggccgattaaactcaaaaccccgttcaaacttgccttaggagaattgagtgcgatcacgactctcatcattaaaattgaaacggatactggcatgaccggctttggcgaggcatcaccatatgcaccggtcaatggcgaaacgaatgaaaccgagcaagctgctttaccaacatttgccgcagcactagtgggcactgatccgcgcaatctcgaacaagtccatgcgcgcatggatgcggtgatggccggtcacactgccttaaagtgcgggattgacgttgcctgcagcgatattttgggaaaatcggctggcatgccgctttggcaattgttcggtggcgactgcaacaccattaccaccgatatcacgattcccatcggctcagctgaagaaatggcagcaacagcccaacaatatgtacacgccggattcaccgccttaaagttaaaggcaggtaacgatgaacttgccgatatcgcggctatcaaagcggtcagtgcagcagtcggtcctaacgtttccattaaggtcgatgccaaccaagcttggaccgccgcccaaacccgccgcatcatggctcaattgcaacttcccaacctcatcgccctcgaacaaccattaccggattggcaactcatggaagccccagcacttcgccaagaactcgcggtgccgttgatgcttgatgaaagtgttcacaacgcacatgatgccagtgccgcggttaaactcggtgcaactgacctgatcaatattaaattagccaaatcaggcggttttgcaggcgccaacgctatcaatgccatcgccgcagcagccgggattgggtgtatggtcggctgcaacgccgaaacccgcctaggaaccgccgcctccgcccactttatcgcagcccacgccaatgttcgttacggcgatgtcgatagcttcatgctgctagaagaaaccgattggctcactggcgggtttgaagcagacggagaaaccttaaccttgtctgatcggccgggattaggtgttgaagttcatttatagaagaagtgtgaattttagccaaacatataaggagaattttacgtgcataatcttcaaggttatcaactaattaataaaaagtatcaactaaatggtgccactgttttggtcgacgctcaccgtatgctgtcatactggcaaaacggtatggctgactttgccaagcatcagccgtttacgctcaacaccactagcggcttaggctcactgagcaaacagttcacggccaacagtatcttattactaaatgccgcgggaaaactgaatatcgatgcaccgctgtcggactacttgcctgaatatcgtttcgccaaacaaatcaccttgcgtcagatgctacatatggcgagtgggattccggattatacggagctactgctggccgactatgcaaaaaaaatgcccgatgcgagcgaatcgcatttaagttaccccatcctagaagatctcaacggcaatgacgcccttcagcagattatcgaattgctcaatcagcatcccctcgactttgcgccggatgcaaaaggtgcctattccaatagtaactactaccttctgggacatattattaggcaggttgcgaatatgccattgcgtgactttctcaaccaacacttctttgagccattggcgatgacgaagactcaactgggcacgcaacatgctgatgccaatagttacgatgatttggactttactaacggcaaaccagtcgcccttggccgcggccactaccaaggtggagatggcgcggtggtgagttcactcgcagacttggccatctgggcgcgggccgttttacagcgccgcattttgccggaatccgcgtgggatgaggcactgacgctgacccacgacttttacggcatgggttggatgaaatcccgaacacagcactggttaagtcacaatggtcatattttcggttactgggcgttttttgatgtttcatttgaaaagcaattagcacagattacgctgaccaacatgtcgcctggtgttgagacactcaaaaaatggcaagaggagatggccaactggcgcacatcgttatagtttaaaggcaataatttacgccaagatagcaagctgatattagtttatttattaattaaaggtgtaatatttagtataaagagtaaaataaatcaataaacatcggcatccccatctgctttaaaagtaaaatgcattgcatccaacttgccttagaattataatgtaagcgtattctattgaaaagcaggaggatcgcctcatgaaagttcaacccgaagaagtcatcgccagtatggaacaactgagcgtaaagctgagccacaaccatccgagttccgagacggcgagatacgttgccaaaagtttaaaagagctgaaaaacagccacggaactgccttcaccggcgcgctccaatcttttttcaattttgcgccttccgttaagttgagtgatcgcttttcgtttactgttgaagaaaaagcgctctgggataaagtcttctcgtttaaacagctcggcaataatctttggccgctaagtttataggctttgatacgcaattgtgatgttggaagctgcggcgtgttaataccgttaacaaataactcatgcacaagctagcaaaatccggcagactaagttcagctgccggattcccgttatttgctcgtcaaccactccaaacaaaaacaggcacggcttaagtcactgtccaatttaagccatgcctgttttcattgttgcactcccataaattttagaagaattgccgcataatatctttcaatggcggcatggaaggaatcttccaataattttcaagatactgggagccatacttcatgtagcctttcgcttcttcaccaacaatctttcctggtagtggcgcgtcgtcttgaacataggtattgatcaaaaccggcttgtctgtttcttgataggctttggtgagtgcctctttaaattcagcattactgtgtgcggtatagccaacgccaccagcggcctcggcaattttggcgtaatccatgtcggccaaatcaatttcataattcaactgaccggcgctttgttgttcgtattcaatgaaggcaagcttttgattattcaaaaccaccatgatgattggcagcttatacttgaccgccgtgacaaaatcctgcatgaccatggcaaaagcaccgtcaccggccacgctgatattttgccgctttggaaatgcctcggcacctgcaatcgctccgggtagcccacagcccatcgtccctaaccacgcagaaatcgtatacttctgcgttggctggacattcagaaaacgggcaccccaagacgttgacgtgccgacatcaatcgagtaaaccgcatctttaggcgccgtttggtcaattgtcgcaaagacggcttccggtgaggcagggttcgtatccagtagccgtttttcggccatccatttgtcccaactctccatattcttccggcatgctttcaagaagcgatcatcatcacgcaaagctcctttggcattcagttcggttaaaaaggcaccgacatcgccgtccacggcaacatcaaccgaataccgcttgcctaagttctccggctgcgtatcaatctggacacacttagcctgccctgcatctggcaaatagggggtgtatggataattggtcccgatcataaacaacaggtctgttgccttcatggcttcatacgcaggcttcgtcccgagcttgccgacattaccgaggctattcggatgatcgtctgccaccgttcctttcgccggcatggtctgaataaacgggatatggttcgcttcaacaaatttttgaacggcttcaccggcattttccgccccacggccaatcaaggctaaaggtttctgggacttttgcaaaagcgaagccacatcatccaactgcttaggatccacttccggtacattcaaggcaaacgccgctgcactgtcgcggtaactggtggtttccttttgatcaggcaagtcgtctggaatcgtcaacaccgcaacgcctttttccgtgaacgcggtgcgaatggccgtgtcaacgatctggcctaaattatctgatgccatgacagttttgttgtaaaccgccacgtcatcgaatagcttaggcgtgttgacttcctggaaaaagccttcatttaagttactggttgtgacttgccctaataatgccagtacaggaacatgatccattttggcatcatacaggccattcaatagatgaatcgcgccgggcccgccgattgacaagcaaacaccgaggccacctgtcagcttagccgttgatgcagcagccagtgcggcgacttcttcatgacgtacctgaacgaacttgatcttatcttgttggcgccgtaaagcatccacggtggtgtcaatggagtcaccaggcaagccaaacacatgcttaacctgccaatccatcaagacgctgactaactgatccgctgcttttgttgccatatcaagatctcctttggttaatttattcgtgtgaacaactcaattgttatcaatctgttactacctttaccttagtgctttgatttccagggtcaatcgttctaagcaaggtcttatttgtggggacaccaaaagcttgtgaaaagctctttttattcagttattttttgaagattctaccatcacaacccactaaagaaagcgatttatgcgtcggtcattttaaatcagcttgtgaaatccactacgttaccccgcagctcatctaatataaaatgagaaaaatctcatttcaacctgtaacaatcgctaatcaccgtcattgtcatgacctttttcattgttggctagttggcttgagtaagcagattctaacctctgaaaatgccgagtcaatcaatggcgttttttctgaaactacggtaaatttaatggagccttggtaacggtgggttatcaacgtgaccgttttctttcaaaccggtcagtaaaaccgtcacgttctcatcattttctcgcccttttcttttgtcatttatggtagaatacaacagttgtgaattgtatatttcgtaggaggatatctacatgccattagttaacgctgcagagcttgtaaaagctgcacataaaggtcactactgtatcggtgccttcaacaccaacaacttggaatggactcgtgccattctcgccggcgctcaagaattgaacgttccggttatcatccagacttccatgggtgctgctaagtacatgggtggctatgaattttgccaaaccatgatcgaagctgccgttaaagccatggacatcacagttcctgttgtgattcacttggaccacggtaactatgaagcagccaaggaagctattgctgctggctacaactcagttatgtttgacggccacgacctcgactttgaagataacttggaaaagaccaaggaaatcgttaagctggcccacgccaagggcatttccgttgaagctgaagttggttccatcggcggtgaagaagacggtgttgtcggcgaaggtgaattagctgatgttgaagaagccaagactttggcagctaccgggatcgacttcctggcagctggcattggtaacatccacggccaatatccagacaactggaaaggtctgcacttcgaccgcttacaagaattgaacgacgctgttaagatgccgctcgttctccacggtggttccggtatccctcaagaacaagttcaaaaggcgatcaccatgggcatttccaagttgaacatcaacaccgaatgccaacttgcctttgctaaggcaacacgtgaatacatcgaagctggtaaggatcaacaaggcaagggctttgaccctcgtaagatgctcaagccaggcaccgatgcgatcaccgataccttcaaggaaatcaccggctggattggcaacaagccagttaagatggttcctgaagcactttaattttttaatcaaagactatttagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctactttttgcctcgataccgaagtatcaaggaccctgcacatttaaacgaaactttgttcagttttcaaaggactaccttgtcaaaagacaactttgacatattatcacaagcgatcaacgcttgtcaataactttttttgatgttttgttgcacatcagcgttgctcatttacgacgctttttatcataccaacggtttgcgctatcgtcaacaactttttcaattaaaaaaaggtatccggatattttttatcgaataccttatatcattcgtaaaatgatcgtgagagcaccacaaaagtgttggaactttcggaaaataaaaatgccgcccaaaatggcgacattatcacataactacgggcgcaatgttgggaacaaaagaacatcgcgaattgacggtgcatcggttaacagcataactaagcgatcaatgccgattccgagtccacctgttggcggcatgccatattccaacgcttcaacataatcgtcatcaataccttgtgcctcttcattgcctgccgttttttcagctgcttgcgcttcaaaacgctgacgctgatcaatcggatcgtttaattcggtgaaggcattggcgtactcaccgccaccgacaaaaagttcaaaacgctcaacaaatcgtgtatcttttggattcttcttagctaacggggaaacttcgattggatggccggtaatgaaggtcggttgaataagcgttgattcaacaaactgatcaaagaaggcactgataatatgcccgaccttccaataaggttcgtagtgaacttcatggtcatcagctaacttacgcgcttcatctacagtcatttccggccagaagtcaacgccggttttatccttgatagcgtctaacatgttgatacgggcaaatggtgcatctaagtcaatgtccatcccttgataagttagtttcccggaatcaaggactttgtgggcggcaaatctaaagatgccctcggtttcgaccatgacatcggatagatcccaataagcggcgtaggtttctagctccgtaaactccggattatgtttcgtgtcgatgccttcgttgcggaaaacgcggccgatttcataaacacgctccatgccaccaacgatcaaccgcttcaagtgcaattccaatgcaatgcgcaaataaagatcgatatccaacgcattatggtgcgtgatgaatggccgcgcattcgcaccaccggcctgattatgcaaaaccggagtctcgacttcaagaaatccgtggttatccaagtattcacgaacagcactcacgattttggtgcgtttaacaaaccgatcaaaactgtcaggattcgaaataaggtccaaatatcgcttgcggtacttctgctcgacatcggttaagccatgccacttatccggcaatgggcgtaatgctttggctagatgcgtcacgtgattggctttgacagtcagctcacccgagtcggttttcatgacttcgccgctaatacccaaaatatcgcccaaatctgccttcttaaagatcatgtagttttcatcgccaaccacgtctttacgaacatagatctgcattttaccgctgcgatcacggatgtcagcgaacccgactttacctttaccgcgtttggacatcatgcgtccagcaatcgtcacttccggcttttcttcgagtagcgtttccttgtcgtcttcgccaaattcttcacgtacctttgctgcagagtgcgtgcggtcaaaccggtgaccgaatggatcaattcctgcttctcgcaaggcatccatcttttcccgccgcgcaatcatttgatcgttcatttctggttgctgtccgttatccttagccaacacaagttcctccgtttcaatttataccactctttgatgatgacaattttaccgctaaaaagcaaccttctacgcattaaaagacgttcgccatgattaattgtcaatcaatcatccttgaacgccttttatcatcaaaggttttatggcttaatggctgccttgacgctgacgggcgcgcgcttcagtttgcgccacaaagtcatcaaaaatatgattgacttctgcttgcgtatcaaccatattaacggctgctttggtctttgccgagcgtggaatgccttttaaataataggctgcttgcatccggaattcacgaacggcctggtgttctccgtgcaggtcaaccaaccgttgtaactgtaacttggcagtggcgattttttcgcgcggtgttggttccggaatcagctcgccatgatcaagataagctgccatctgcttcaagacccacggatttcctaatgctgcgcggcccaccatgactgcatcggcgccaacctcatcaagcatccgtttggcatcttgtggggttcgcacgtcaccattcccgataaatggaatgctcaggtgttgtttgacttcttttaagatgttccagtcagcatgtccagaatatagctgcttgcgtgtccgcccatgcatggctaatgcggcagcgccaccgcgttcagctgccaatgcattttgaaccgcataaatgtggtcttcatcccaacccgtgcgcatcttaaccgtgaccggctttgaaaccgcatcggtcacagcagccaccatttcgtaaactttctccggatctaaaagccagtgtgcccccgcatcggttttggtaactttcggtacagggcagcccatattgatgtcaatgatgtctgcagccgtgttttgatcgacaaacttagctgcattcaccaacgtttccttggtgccaccaaaaatctgaatggaaatcggatgttcacgcggatcaacaaacagcatacttaacgtctttttatttttgtacatgatgccgcggtcactaatcatttcacaaacgaccaaaccagcaccgaattctttggctgtcacccgaaaagccgcattcgtcacaccagccatgggtgcaacaacgagtcggtttgggatctcaacatcggcaatgtgccacatacaagccacctctttcttgctttcgcgttgttaactttacttaaaataagcaaatactgcaactattcatgccgggccaacaaagcttcaagatcggccacactgtaatgatattgattaccgcagaacttacaggtcgtctcggcaccgccgtcttcatcaatcatttcctgcaattgtttccgcggcaaagtggccataatatcgccaaaatgtttcttggaacaattacatgcaaaccgcaatgcttgggtatccaggaagcgaacgggctctttgcctgcaacacgttggataatctgctcgggagtcaggccactttttaataactccgatacaagcggtagtgttttgacgtttgcttccagttctgacaattcggcatcggtcgcaccgggcaacgcctctagcatgaaaccgccagcaaccttaatcgtgttatcggcattgacaaatacagagagtccgactgccgcgggaatctgctcagacttagctaaataatacgtaaaatcttctgctagctcacctgaaaccagtggtacctgtcccgtaaacggctcgccgattccgatatctttcgtcaccgcaagcatgccgtgtttgccgactgcttttgccacatcgattttaccgacgagattgaggggaagattcacgtgcggctcctgaacatacccgcgaacggttccgagttgcgtaccatctgtgacgatcgagccaaccgggccatcccctttgatacgcacagtcagcaagtcattcgtgttttttaatcccgatgcggctaataacgctgtggcaattaaagttctgcccagcgcagccgaagccgcactccaggtgtcatggcgtcgttgtgcttcgcttaccgtttgcgtggcgtcgactgcgaaaattcgaaaatgggcgttgcgcgacaatgcactcgcgatgtagtcactcatgttggattgatcctcttttctgaaagttaaacgtggctattctaccaaaaattgccgttattgaaaagccggcgcagaaacccacatgtcaaaaccttgatggcgatggtcaaagtccgatcatcacatttatggccacttatgttctggcttatgcccataacgcgctcaccggcgcagggatctgcgtgtaaggacctcgaacgcgatggccaagaccgggccatcacgtccgaggccgcttacactccgatccctaaccgcgccggttcgcgcttaataaaaaaacaccaccaacatttggcagtgtttttatacttaggcttgcggattctgatgatcgtcatcggacgggttactgccaggtgttgtgtcgtctggcttttccacactgtccgtcgtattgtcatcatgcgcatcttggtctgtttgatcagcattcgactgaccctcagacttagcatgtgcttcttcgtctgcttgcttttctttatccttgtgttccaaggctgctttggattgctcaaaagttgcggccttttcacttggaaattcgtcttgatcgcgttctggcatcttgccgtcattgaacaagctgagaatttctttttcattcaaggtttcgtacttaagcaatgcttcggcaatcaacttgtgctggtcacgatgggcttggataatttcgtaggcctgtttgtgggcctcgtcaataatccgccgcacttcatcatcaattgccgttgcggttgtttctgagtatggcggtgtttggccatactgagcacccaagaacggctgcccttcagtctcaagctgaacggttccaagccgatcagacatcccatactgtgtgaccatactgcgtgcaatttgcgttgcctgttcaaagtcattggaagctccagtggattcaacgccgaaaataatttcttcagctgtgcgaccaccaagtaaaccaacaatttgttcggtcaattccttcttggttagcaggaattgatcgtcttttggcagcataattgcatatccgccagcacgaccacgcggaatgatggtaactttgcgcaccgttcgtgaatcgcttaagactaaaccgacaatggcgtgcccagcctcgtgatacgcaaccatcgtccgttctttcgggctgatgacgcggtctttcttcgccggcccagcaatgacacgatcttcagcttcatccacatcagctgcatcaatctgcttcttacttcgccgcgctgcaaccaacgccgcttcattcaacaggttttccaagtcagccccgacaaaaccaggagtctgacgggcaatttccttcaaatcgacatttggtgccagcggtttgttctttgcatgaaccttcaaaatggcttcacggcctttaacatctggtcggccaaccaaaatcttccggtcaaaacgacctggacgcagcaaagccggatcaagaacatcggaacggttcgttgcagcaatgacaatcacgccttcattacccgtgaacccatccatttctaccagcaactggtttaatgtctgttcacgttcatcgtgaccgccgcccataccagcgccacgctgacgaccgaccgcatcaatttcatcaatgaagatgattgaaggagctgcttttttagcctgatcaaaaagatcacgaacacgcgaagccccgacaccaacgaacatctcgacaaagtcagaaccggaaatcgagaagaacggtacgccggcttcaccagcaaccgccttggctagtaaggttttaccagtaccaggaggaccctcaagcaaaaccccggctggaatacgggcacccaatgccgagaatttacgcggatctttcaggaactcaaccacttcaaccagttcctgcttttcttcttctgcaccggcaacatcagagaagcgaactttattggcatttttatcggcttgtttagcccgcgacttgccaaaactcatcacgcgaccggagccgccgccttgacctgcctgattcatcatcatatagaagaagatcatcatgatgacaatcggtacaactgtaatcaacaagctaaaccaaacaccggactgcgattcctcctgcgtattggtcttgacattgttggcattggtcattttttggatctgactcaaagttgcatcattcgtcggaatataagtcgagaatttggtaactttggttgactgattgccaaaaaagctcagagagttgttcgtaccggaagacttttcagccttcttgtattcaccgctgaccttataaacgccaccagatggctggagcgaatagcttttgacattgtccttttttaattcggacataaaggtgcttgtttcaatttcttgggacgatgttgtcccattatcgcgcatataatacgcaaaaccggtgaccagcagcacaaaaatgatgatatacgtcagcgtgctactgaacaggccgttttgttttttcttcatttagaacctccggcaacattcaattagttccttatatactaccacaaacacggcgcttagattaagattttgccgcatagacttctggctttaataccccaatataaggtaagttacgataacgttcggcataatccaagccatacccaaccacaaattcgtttggcactgtggttcccacatagtctgcctgaacatcaacaacccgtccttcaggtttgtccatcagcgcacaaatgcggaccgattttgctttgcgggttttaaaaatatcggttaagtacttcaaggtgcgtcctgtatcaacgatatcctcaacgattaagacatcgcgatccttcacgctggcatcaagatctttaataatcttgacctcaccgctagattcagtcgcatcaccataacttgacacgtccataaaatcgagttccatataatcatcaatttcgcgaacaagatcagtcatgaacatgatggcaccttttaaaatgcacaccactaacggattcttccccgcgtaatcacgcttaagttccgcgccaagtcttgtcgtgatggcgtgaatatcgtcttgagaatacaaaacctttaaaatatcgggattcatcatttatcctcacttctgtcaacatctggcaatttcaccagtacaacatggagtatatcagtttgagcagggagcgacaatcgttctaaaggctgaccttcaatccaaaaaatctgatgaccttgcgctaataccagtaattgatcgcgtgttcgggccggaacctttgcattgataaaaaatcgccgcagcttctgcttcacgccattaggcaggtaaacaatatcaccggcctggcgggtccttaatgtaatcggcaagcgcacacgtaccggaataccttggtcaccagccacttttgttcgtagctgaaatgtaccgcgagcagtttggcatttttggccaatacgagaaaatgttgccggcgctagttttggttttggcaccaacttcacaattttggccgcttgaaccgcaatcgtcacgccagcgccaagatcaaatcgtcgttcgcgagtatcattcaggcttttcaggatcggcatgagcagtccgtggttaactctcggctgccattggcgtagcaaggttgccagcagcatcagctggatcgtgcgcggctgatttgctgccgcgcgccaatcaattgtcaccgaattaatccgcaaccgctgctgccattcagtcagttgcatttgagccagtgcaaccaggccagactgttccgttgtaaatctttggacatgccgcaacaactcgggattttgctttttaaatgccggaatcacttgatggcgcaactgattgcgggcataacgcgtatcggcattggatggatcgtcgcaaaaatccagaccgtgcctgcctgcataagctcgaatatcatctttactaaaattcagcagcggacgcaccaaacgctttttacgccacggttgatccggacgaattcctacaagggcggccggatcaccggagcgtcctaaccgaaacaggaccgtttcaagttgatcatccgcgtgatgcgctgtcatgatcaccgtggctgcctgagaatcggcactcgcattcaagaagtcgtagcgtgcctgtcgcgccgcagcttcacttaccgcagtggcggccgatcgctgccatgttccagtcacaaccggaacatgataacgcgctgctgcagccgccacaaatgcttgctcctgtcggctttctggccgcaaacgatgatcaaacgttgcgacaacgacatccagattcggtgctcgaactgccaggtccaacaagaccatcgaatccacgcctccggaaacagccactaacacccgggtatgcggcgtaaactcaaactgttcaaaaagctttggactcatgtgtctgctcctccgcttagcatactcggccaagcatattgatcgcataaccaccatcaaatcggcttggcaacaaaataggcccagaacaaataaccgtttgtcccagacctgatttttttaactacgccgaccgcctcggccgccgcgtttgccttcggtgttgcggcgaagaacacttaggcgatcttcgctttctttcaaatagccggacatcatcgcatcaaaatcgccttttaccggttgggctttgtggccgaatcgattgccactattgcgtgcgccgccttggaagcggttattgccagcatgtggcgcgggtgcgtgtctgttttcgtgataatgatcattttcacgttgttgcggtttgtcaactgctttccggatagacaggccaatcttaccatcttggatcgaaaggactttaaccgtcaccggttcgccaacatgcagcacatcatgaatatctttgacataagcgtcagagacttcgctaatgtgcaccaatccggtcttgccatcgcctaactcaacgaatgcaccgaatttcgtgatcccggtgactttaccagccactttcgtaccaacttcaactgccataaaaaaagaagtcctcctaattaaatgtatctataagtatagcatgagtgaaaagacacgcaagcacgacgtattagcctagccaaagcaactgaatgcagtcgtcaaaggcaattcgccatgaagaaaacatttcagcgtctgtgctccccgccaatgcttgccacctcatcaagaataccactgaatctcaaaccaacaactctaaagtagccaaatgactgcagggacgcgaatataaaaaacgaccggcacttgcgtttattgcaacccgtttatcgcgtcattgggtaacgtttaagtccggcactttgtttgctttatccggcaaattaaaaataatctctcccggtttcgaatagaggtatttttcacgaatcagcttggccgtgtaatcgtcattatgcaattggtcaacctgaactttaagggcggctttgttcgcctttaatttattcaaattagacttggctttggcaaccgcctgatttgtttcccccagtgtcatttgcgtgcgcattaaactgacgccgcctaagcccaaaatagcaaccatcacaattagcaaattacgaattcgtttcatatgtaccgcgtgtgcccgcgacttaggcacacgtgtcgacttttgcctgtgttcacgtgtatatgcattatttaattgactgatattatttttcgccatctgtctgcaccctcgttttcaccagccgtgtatcactacttcagtaaatcaagtataacaaatcagaggggctgctgttcaataaatcggcattaaaatgtttctttataatcttctttcaaaaccgtgtacatatcggccgcttcgttctttttcgttgtttcaactaaatcgtccgcacgtacggtcaatgttttgttaccgaaattaatcaccagcgtgtcgccaactccaacatcggtactcgacttggcaactttaccgttgatcgtgatccggcccttatccgcaatttccttggcaacggtgcgccgtttaatgattcgtgagactttaaggaacttatccaatcgcatgtctttttacctcgcttttattcgtcgtaacaatcgtaaatactttttcccgcctggcagatctagcatctcgcgtaacgtcaacaatcgcagccatgttccggcaatcaagaagaccacgacgccgatgacaacgccaagcaacgtgacaccgactgccacagttcttgagctcagcggaatccatcccaccgtaacatgcacaataaccgtcataatcccggtcacggcaacaagcttgggtacaaacagccgcagtgcacttctgcctttgatcgtctcaggaactgcataataaatcaagcacaggatcacacccaaggccaaaattgtcgccccgcttgctcctgctgttccaaagcgcatcaccagtggttcattgctcagcgccttcaccacaatgccgagtaataaggccacactgatccctgtataccgatcaaggctttgcaaaatcgcattatacgcgttgatcatggcaacaacggcaatggcaagtgcatataactgcaaggcataagtgccagccgtatcgccaaacaataatagattaatcgccggcatcaagacaatcagtcccgaagccgccgccagcgcaaaggctaagttgaaatggactaattcggctccgcgctgaatgaactggcggcgctgtcgtaattgccgcgcctgagtcagactgggtagcaacgttgtagacaaagacgctgccaccaccaaacccaattggaccagtggctggccgcgatcataaaccccttttaagctcttggcagttgccattgcaatccctgaaccagtcaaacctttcgtcaccgtgaagctgtcaatcagctgtagcaagatcaacaaagccgcataaagcgtaatcgccccaccttcacggataaaccgactaattaagcggccgtatgcgtgaagcccgggaaattgatactgctgctgaccaaaaacttgccgataaggccgccataaagtcaaagcagcggcggccccgccaaaaaatgccccactcatggcaacagcgcccatttgataaacgctccagtgatattgcagaaaccaccaagccgctagcagaatcaccgccacccggacaagctgttcaaccacttgactcgttgcggtttttaccatatcaaaagtgccttgaaaataaccgcggccagttgccagtagcggcatggttaagaacataaaggccaccatttggattaacggcaacaattccggatccgccatcgcctgcgcaattgcggccccaaaaaattcgagtcccaaaaataacgcccacgaaatccaagtcaaaatgacccgactttgatgggccactgttcgtttggcttcgagactgtcagcttctgcaaccagcttggagatataaaccggaaaccctgacaacgcaaacgtcatgcccagtccataaatcggataaatttgctgataggcgtaaaacccagtgtcgccaaccatattctggaaaggaacgcgataaacggcgcttagaatctttgcaatcaaggaactaagactcaagatccacgcaccgcgcatcaaatgtttcatttgttgattatgcatggtgatctcctatcaacatcgctgcatcgctgtgccaaaataacgcagcgcacatcgatatccagcagttcatcttattaggcggcaggcttttttcccggctgcggattcacaaccgccagcaatcccttcatgaaagcagttagttgccctagccactcgtcttctttcatggttgctggcacagcgagcgttaccgtcagctttccatcggcaattgctacttgtgctttcaaagtcgtagccgccaacgccttgaagatcggttcgccttgtgctttagcagtcgcttgcggggttaacaccaccgtcattttctggtcgtttttctggacgtgatccacccaagccaaatcagcgaaacgtttcagatgtgcgattgccaaaagattcgtcaccggctgtggataatcgccgaatcgatcaatcaaatcttcactaatctcggtttcggcttcatcactgtctgcttcacgaatccgtttgtacagttcaattttctggcgcgagtcggcaacataatccgttggcaggtatgcttccagacccaagtcgatttccgcatcggttttttgaacggttttaagtccgcggcgtttgttaaccgcctcttgtaacatctgcgtgtacaagtcatacccaaccgaatcaataaatccatgctgttgtttgcctaacaagttccccgcaccgcgaatcgacaaatcacgcatcgcaatcttaaagccgctacctaattccgtgaaatccttaatcgcctgcagccgtttttcggccacttcattaagtaccttcatcggttgatacatgaaataagcgtaagcaacacggctggaacgcccgatacgtccgcgtaactgatacaactgggacaatccataatgatccgcattttcaataatcagcgtattggcgttcggcatatcgaccccggtttcaataatggtcgtggtcactaatacgtcatacgcgccatgcagaaaatcatagatgacattttccagctgggtttccgtcatctgaccgtgggcatacccgatgctagcgtcaggcactagctcttccaattgactcacggttcgctccatatcctccacccgattatgcaggtaaaagacttgaccaccgcgttccatttcgcgttcgatggcttcccgaatgaccccggggttttgctccatcacaaaggtctgaatcggatagcgatttgtcggtggcgtctcaatgacacttaagtcccgcacgccaagcatcgacatgtttagcgtacgtggaattggcgttgccgtcagcgttaacacatccacattgcttttcagttgcttaatccgttccttgtgcttcaccccaaaacgctgctcttcatcaatcaccaacaaaccgaggtcacgaaatgccacatctttagaaagcagtcgatgggtgccgacaacaatgtcaatcgtgccgtttttgagtcctttaatcgtcattttattttgatgcggtgtctggaagcgcgataacaagccgattttaaccggaaaatcggcaaatcgatccttcatggtgtcaaaatgttgctgcgccaagatggtagtcggtactaaaattgcgacctgcttaccatagtcaactgctttaaatgctgcccgtaacgcgacttcggttttgccaaagcccacatccccgacaagcaagcgatccatgggtttgggtttctccatatcccgcttaatttcttttgccgatcgcagttgatcaggcgtctcgggataaggaaactcatcttcaaatttttgctgcagatcatcatccggcccgaaagcataacctttttccgcttcccgttttgcgtacaagtcaatcagctcgtcggcaatgtcttcgattcgagccgccactttgcgtttggtcttttgccactcggtaccgccaagcttattgacgttaggcgttttgccatctgcagaaacatatttctgaaccagatttaattggtcaaccggaataaacagtttgtcattgttgcgataaacgatggtgatgtaatcgcgatggacaccgtcaacttcaagcgtctccatgccggtatattgcccaatcccgtggttgacatgaacaacataatcgccaggctttaattcattatagctgcggaggcgttccgtatttgccaacgtctgatggcgagcccgccgccgctgccgagcattgaacagctcgtgttctgtcaccactaccagcttcaaatccggcaattcaaagccgttcttcagactgccatcggttaactgaacttttcctgaaagcagctgattaggttcggtcaccacattactaatctcaaaatcatgtaaagtagcactcagcttatccaaacggttcttatcggaaaccaggaaaaccacggtctgcttttgtttcacccaccgatccgtttcggttttgagcaatggcatctgactaaagaattgttgaacattgcgactcggcacgttagtcaagctatccaaccgcaactgacccattcctttttggaaaaggctcaagtaaagccgcggatgccgatcacgctgattaagcgcttggatcgtaggattaggtgttttaggcaacaaacggccttcctcttgcagctgtgaataccattcagccgtatcctgcaccaaattcgtatcactatccaacaggcgactgtaatcatcaaacgctaccagcgcatcaccggcaagataatcagtaatgcggtgatgttccggatacagctccggcgcatacaatgccaggttttctggccgttctaatgcttgtaactgctggctggtcgtcaacaagccatcggtaatcgcttgctttgccgctgcatccttgactttcgctttgtaagctgttgcctgcttaccgattcgcgcaccggcatcggtcagcacctgatcggaagcgatcatgtcagtagccggtgcaatgacaatctgatcaagctttttcaaactgcgctgggtagcaatgtcgaagctgcgaatcgagtcgatttccgtatcaaacaactcaatgcgaatcggatcatcctgatttaatggataaatatcgataatcccaccgcgaatggcaaattggccgggcgcactcactaatgaatcacgccgataacccatcgccacaagctgcttggcgaccgtttgcggatcaagctctgaatccatatcaacaaccaactcacttgccgcccatgcagccggtgcgggtaaaattcgcttatatcctgccaggctggtaacaataatgcccggttggccgctttgaataaaggtcagtgcgttgatccggtcgttgcgggtttccggtgaactgaccgccacttcagccgccaatacatcttcaaccggaaaatcataaacaagcgcatcgcctaataaactactcaaatctgctgccaactcgtctgcatgaaaccgattattttcgacaatcagcagctgctttttttgctgctgcaagagtgcgccaaaaaagaccgtcttggccgaacctgatagtcctgtcaccaaatggcggcctgtctcgagcttaggccataatgccgacagttccggatctgcctgcaccatgtcgattaaattcatcgctccacctgcttctttcatattcttcaagtttacccattaccccaagcttcatcagccagcgaggggcaagttttaattaaacttattcatcaactgggcaaatggcatgccgtttagccaatcttccaatgcatcatccgctttagtgatagcagcatcaatcactggttgatcggttttggcaaatggggtcaacacccagtccacaactcgctgccgctgcgggtgctgaatgccgatctttaaccgatagaattcgtcacttcccgtagcgctgataatgtccttgataccgttgtgaccgccggctgatcctcgctggcgcaatcgtaacttgcccaatgtcagatccatatcatcgtgtaccactagaatttcgtctaacctaatctggtaatacatcattaactgccgcactgcgcgtcccgacgcgttcatataggtctgtggtttaaccaggaaaactttttcatcatgaacacgtgtcgttgctgtggcagcatcgaattcaagcttgttaagggtgagccccattcgctgtgccaagccatcaaccaccatgaatcccatattgtgcttcgtgcctgcatattgacgtccgggatttcccagacccacaatcattttcatattatctcctcatcgtatcgagcttaaattcatgcaatcctgcttggtttaccggtgatgctgacacttaaccaagccaagcgaagaacaccaaacgcctaacccagataaagaagttagctgcttggtgttgcttcgccgaatgttaaatgctgcatgtccgcgcactgttttctattagtaagtagtataacacatgccggctgactgactgtatgtctccctttctgcgaactgttaagttttgttaattcgtgaaaatagatgttgcaagcgtttacgttcctgaaagccagcttgtctcaggattcacaagccttggcattgtaaggctcagccccgctttttaacaatgacaaaatcatgaaaaagtcagtcaattttgtttcagtgatttgataatgtgttatactcacaatgaaatgcagtttgcatgcacataagaaaggatgatatcaccgtggcaagtattacggataaggatcaccaaaaagttattctcgttggtgatggcgccgttggttcaagctatgcctatgcaatggttttgcaaggtatcgctcaagaaatcgggatcgttgacattttcaaggacaagacgaaaggtgacgcaattgatttaagtaacgcgctcccattcaccagtcctaagaagatttattctgctgaatacagcgatgccaaggatgctgatctggttgttatcactgctggtgctcctcaaaagcctggcgaaactcgcttggatctggttaacaagaacttgaagattttgaagtccattgttgaccctatcgtggattctggctttaacggtatcttcttggttgctgctaacccagttgatatcttgacttatgctacttggaagctttccggattcccgaagaaccgggttgttggttcaggtacttctctggacaccgctcgtttccgtcaatccattgctgaaatggttaacgttgatgctcgttccgtccacgcatatatcatgggtgaacacggcgacacagaatttcctgtatggtcccacgctaacattggtggcgttaccatcgctgaatgggttaaagcacatccagaaatcaaagaagacaaactcgttaagatgtttgaagacgttcgtgacgctgcttacgaaatcatcaaactcaagggtgcaaccttctacggtatcgcaactgctttggcacggatttccaaagcaattcttaacgatgaaaatgcggtactcccattgtccgtttacatggacggccaatacggcttgaacgacatctacattggtacacctgctgtgatcaaccgcaatggtatccagaacattctggaaatcccattgaccgaccacgaagaagaatccatgcagaagtcggcttcacaattgaagaaagttctgaccgatgcgtttgctaagaacgacatcgaaacacgtcagtaatcttcaccataactgattttaaaccggcgtcaaccgtgatttaatcagtgagtatcaaagtggatcaaccccagagatgaaaaacgtctctggggttgatttcgtttacgccaccacaaccgatgcaggtggcgtcaaccaataccgaagatggccgactcaattcccatatcatcaccagtctgtgcttttcaaagtcattggcttgcgcttcgtttcataatgtttttttaagtttaccgttcattaactgtaagtggtatgataccgcagttccttcaccaccgttcgagaggcgttgcttttatttccggcgttggtatcttataataagtaaaaataacgtcatttttaaggaagtgcttgttacgaaacaggaacaaacaagaagcaggaggcagcaatcagtgaataagaaaaaatggtggctcctcgcgctcggcgccgtagtcattcttctaggcggattctatatcttccgaagtatgcactaccgcgatcattttttgcccaatacagaagttctgggcgttgatgtttccgatcaaaccgttagcgcggcaaataagaaactcatccaacaatttagtgaacgccaatatacctttgttgaagatgataaaaaagtcttgaaagtcaaaggcagtgctttgggtatcagtcaagacttcaatcaaggacttactcaagtgctgaataagcaaaatccttggcaatggacaacttccatttttgcgggccaaaaagcccatgccgaggaagacccgtcaattaataagacggccttaaccaagtttgctcagacgactgctgacaagcttaatcaagggcgtcaggggccggaaaatgcaaaactagtcgcggatggcactaaatataagattcaaaaagaagtcaacggtacccaaatcgatgcggataagcttgcaacaacggtaacgaatgtccttgataatcatcagcaaaccgttaatctggccgctgcgtacaagaagccgactgttaccgcgtctagtagcagcttgcaaacaaccgaacgcgacatgaacaagctggcagggactaatgtttcattgcagattcagaccaaaacggtgaccgttccgcaagcaaccgtgatgagttggatcataaacgataatggcaaggcaacggtttcaagtcaggccgttaccaattacgtttctgccttatcgcaacagtacagcaccatcaaaaaaacgcgtcaattcaactcgcaacaacaaggaacagtgagtgttcctgctggcacctatggctggagcattaatgttagcgccacaaccgccatgattgttgccagtgtcaaagccggacaggatctcaataaagaaattgtccacaacggttccggttactcaacagacggcgacattggcaacacgtacgttgaagtatccaaagaaaaacaacatgaatggtatattaaagatggtaaagtcgtcatggactccgacattgtcaccggtaagccaggtcaagacaccccatccggcgtcttctatgtctggtccaaacagcgtaacgcaacgctacgtggaaaaaacgacgatggcagcgactacgccagtcctgtttcgtactggatgccaattgattacaccggggtcggcctccacgatagtccgtggcagcctaagtacggcggcgactggtacaaggaacacggatcgcatggatgtgtcaacaacccgccagacttcatggcaaagttgtatgccgcagttgacgaaggcacgcctgtgatcgtgtattaagacgtacctgataaaatgaaggtacaagaaatggcttgattccaaactactacggaatcaagtctttttttggccatgattggacgtacatgtttatccaatcagaattacagctgtcacctcgaagactagcggtgctctgagtcgtttccctttggctcgtctgtctgtaaatatgcttttaacgtcttgatctgcgcctcatactcggcaatgccaaccgaaaaagaaagatgctgggttttagtcatgtttggccattcttttagccgcaactgtaatttgtcaatttgcattcctaaccacccaatttgctgttgaatcatcgcttgtaaggctgtatccgattcgtattcaccaaagtagagtcgcatcaagaaatctgaatgacgggtatccggaacaactgacgcatcaagcgagtcttcaaaaacctttttaccttcttcagtaatggcatattgatttttatttggtcgcccactttggacgaccatttttttggaaacaaggccattcttctctagacgtcgcaaggttggataaatcataccaaaagaagcgtcataaaaatgactgaaaatatttttaaagacttcgttcaattcgtaccctgttctcgaatgtttatatagcaagccaaggataatctgctcattattcatgctaaaacctccaatgatgttgtctatatcttaccacgttaatattaacggaaacaatattaattcttgacatataaatgagggcgcgttaatatccttttatattaatcccgttaatataaacgaaaaaaatatggaggcgcaacatgattaaatcagaatggttatctgtcttaaaacgaccaatggtgatcgttgttcttttcttcattactcttattccggcaatctattcaggtgtctatctctcttcaatgtggaacacctacgagcacacgaaggatttacctgccgcaattgtcaataacgacactggtataaccgacaacggtcaagcggttaacgccggaaaagatcttgtcaaaggggtgctcaagtcagattcaatgcattatcacgtcacttcaaaacaagaagctgaccgcggtttgaaaaatggcgactattatcttgtcattgaaattccaaatcatttttcaaaagactcccgatcacttttaacgcaacatcccacggccatgaatatcacgtacaaagtgaatccaggaacagatttctttgcctcacaaatagcaaagggcacggccactgctattcaagccaagctcaaccaacagatttccgctatttactttaaaaatctaacggcaggggtcgtttctggaacccaaggcaacgcaaaattactaactgccattgatgcacttaatgccggcagtcaagccttatccactggtctgtcgcaacagaaaacggcgatcaccgcactcagtaacaaccttccgagtacagcccaaccgttggcaacgcagctaacctcatcgaacattgcactatctaacgctgcgacctcgctaacagctggtacggcaaaggttcaaagtgccttaacccaatcacttaaaacgcagcccagactagccgtcgcctccaagaatattcacttattatccgcccctgtcactttaacccgtgttgacatttcccatacacctactaacggcgtcggcatggcaccattcgcgattgcaatcggcctttatgtcggctgcatctcgcttagttttatgtacgacatgtactcaccaaaaacaaaaccaaccaaagcaattgcatggtggtggagcaaatatagtctgctgttagttctaattgggattcaagtaggctgtcaggccatcgttgtcatgagcctaggactaaaaccgttatccattggcaacacttgtttagcaatgttggtcacggctatcaccttcataacctgtgtttttggcctaaataccattcttggtgctttcggcaaatacctggtcaccattttattgattcttcaactaggtgcttcgaccggcgtctatccgttggaaacagccaatgttttcacccgtatctctagcccattcttgcccatgacctatggcatccacgccatgcgcgaagcaatttcaataggcggtcaaatgacccacgacttggttgtcatgttagtagtcacccttgtcatcaatggtttagtcattgtcaaacttgagttggatcgtaaacacgaaaagtttagcgatcttgttgatgatgtcgtgtcatccatcaactagtctcgctggcaatcagcaaaaaagcagatcgcatgtcatcatccaggaggcgtcacaaggaatatggccactaaattaattttgatcgtgtattgtcacccttacacccacagctttaatcatgctgtgttaacgcacttagaaaaaaacctcaccgatcatggtcttcattatcaactcatcgacctatacggcgatcactttcaacctttttacgatattgaagagttgcgcttgttccatcaagggcaaacacatgatccgcttgttaaacattatcttgatcaattaaaaacagctcaagggatcattttcgtcacgccaatttggtggaacagcgtccctggcatgctcaaaggtttcattgataaagtgatgaaggaaggcgacggtttaacgcatactgtcaccaaaactggcgtccgcggctgcttgactaatttaaaacgagcctatgttttcaccacttctacatcaccaacattttggttccgtaccacatctggaaacagcattcagaaaatcttcatcaataaaacgctgaaacaattgggcattcagaaagccaagtggtataacttcggcaacatcagtcatgcatcgaaaacccaacgcgatcattatctggtgacatgccagaaacgacccctgctcttttgaaagtcagagttattgaccggcactcatcaaacatagctatcaggtcgctgacagtcttcttccgcatgaacaccccagaaaaacgttacaccgccagcgaactatggtatcataaagcaagattagaacattttaataaagtgatagttgtttgatggaggaaagcgcatgttaattaagtcgttagtattaaaaaaggaattcctgaccactgtcaaggaaacggttacccttgaagaagcgctgaagatccttgaagactccggctttcggtgtgtgccgatcctagatgagagcggcacgatcttccgcggcaatatttacaagatgcatatctatcgccataaatctcaaggcggcgatatgagtttgccggttacttatctgctgaagaatgcaaccaaaaccattccggtcaatgcgccattctttaaggtcttctttaacatcaaggatctgccgtacattgctgttttagatgaaaatgccaacttctatggtattttgactcacgctaaactgcttgggatgctgtcagaagcttggaatgtcgatgtcggctcttacgttttgacggtcatgtcaactggtgaacgtggagacctggcaaaaatgagtaaaatccttgctcgctacgtttcgatttccggttgtatcacgttggatgctaagcgtgacgagtttgtgcggcggacgcttttcaccttgccggccggtacagatgaaaatacattaaatgaaattgtatctcgactagagaagaagagcttccgggttgtcgaaattgatgatctccaatccggtcagccgcttcgagtagacgaagagctttaatctgcccaatcacgtgcgccatcagtacaaaacaagcgtgtaagaacctcggacacaaccattaaggccacttagccgttcgtttccgactagccgactcacgcttacaaaaagctcggcagcattgactgtcgggcttttgtgatggttgaaaaatgccatgatgatacgagcaaaggtgctggaatcgtgcactggtttggactttggcgatcctttataatacagtgaacagtgaagttgttttatttttattgctgcaaatgcatcaagtgcgaatagaaaggatgctacatgtgaaacgaataaccgaactgatgcatcatcttgccgcgatgatgcattaccttcattcacatcatctgaaaccaaagtaccggaatcgcctgcttttcattgctgtcttcataacggtgtgtttgatcgcagtctttaccggacaacatgctaaagagtcagcttcgacagcgtcaagctatgcatcggtcacaaaactcgccaagactaaccacacgccgagttacaccgctgctgaaattactcgggttacgcctaagaagattgactggaaagcaccttccgaaagtcggccttatcctgacgtctccaagcatcccaacctctctttgcatgtaaacttgaaaaagcagcgggtatttattaaagatggcagcaaaacgctttatacaatgtatgcatccacgggcattgacgacacaaccccgcacggtgactttaccattcaggatgagcgcggttatgaattctttaatcctaacgagcaaatgggtgcacattattacaccagtttttacttacatggtacctatctttttcattccgtaccgacagatgtcaacggtaactacattcaatccgaagcagcaaagttgggtaaaaagccgggatcacacgggtgcgtgcggctgagtatttctgatgccaaatggatttatgaacatatcccaacaggaacgccggtttcaattcattaacagatgcctatcaaaaaagtcccctgtagcaacttattcgttgccacaggggacttttttcaaaggctaaaccgccaacctataacgcttcacttgccaatgtttgcaaggatgcatcgactttttccgcacacatgcggccttcgtgaatcccccaaataaccaagctggggccgcggcgacaatcaccagcaacataaacctgggtatcattggttgtgaagttagtattcttggcagtaatcccaaatgcatcaaaaacatcggcttccggaccggtaaagcccatggccagcactaccagatcaactttgactttcttctctgttcccgcaatcggtttaaaatgatcgacttggctaatctcggcttcactcacttgaccatgctcgccaaagaaagcagtcaccgtagcggcataggtggtcacatcgccgccaaagagcgcttttgcctccttctggccataaccggcttttaacgtcatgggccactctggccactgattgccagcagtacgcttgggtggtaacgccggggtaatttcaagttgcgtcacaccggcacaaccttggcgaatcgcggttgcaatacaatcattgcccgtgtccccgccaccgagaaccaagacgcgtttacctttcaattgggtattcgcttgggtaccatctttgaggactgtctgagttgctgtcttgagaaaatcaactgcctgaacaataccgcctaactcgcgccccgggactggtaactcacgagcctggcgagcacctgtgcaaacaataacccggtcgaattgctgcttgagttcatctgcggaaatatctttaccgacttccgtattggcaactaattcaatcccgacttgcttcagtgtttcgatacgccgctgaacaacgatctttggcagcttcatgttgggaatgccatacatcaaaaagccaccgaagcgatcatcccgttcaaatattgtcacggaatggcctaattgattaagccgccacgccgcggaaatgccagccggaccactaccaatgaccgccacttttttcccggtacgttgcagcggatttccggatgcaacaacccagccatttttgaacgcctgctcgatgatgtacttttcattgttacgaatggtaacgccgggaccgttaagtgcttgaacgcaggaaacttcacagggtgccggacaaacgcgtcctgtcatatccggtaacatgttggagcgactcaaccgttcaaacgcgcgcttgtcttctgcacggtaaaccagatcgttccattcgggaatcagattgtcattgggacacccgctgaccgcgcgaccgccaccataaaagacgccatgatgacaaaatggaatgccacaattcatacaccgcgctgcctgtttacgtcgttcctccatgctgacgtccagttccaacgcatcaaaatccttgacccgctgcataattggacgcatgggattatctttgcgctgatacttcaaaaagcctttgggatctgccatcacgttgccctcctcatatcattcgtaggtacttctttagtcgtgcttttatcaaaatcatcggctagtgtccattgcccatcgccgtgtcaaaagcctgctcaatgacctgttcttcagacaactcgggcttggtaaacttttgaatgagatcgcgcatcttatgataatcacgcggataaactttcacgaactttgttttctcggtttcccagtgtgtcaaaatcatttcggccgtctcggattgtgtatattgcacatgctttttcaataaatccagcagcacactatcatcgcctgcttcatctagccggtacaagtccacgagctcctggctgcaatttttggcaaagtcatgtgtccagtcgtaaacatacgcaacgccaccggtcatcccggccgcaaaattgcgccctgtgcgccctagaatgacggcaaccccaccggtcatatattcgcagccgttattgccgacgccttcaacgaccacttgtgccccggaattacggacacagaaacgttcaccggcccgcccgttaaagtaagcctcaccgcctgttgcaccaaagcatgcaacattgccgacgatcggtgaatgcgtataaagttctcgcgcctgttctggtgccgccacaatcaaccggccgccagaaagccctttacccacatagtcattagcttccccgaccagtttgatggctaatccttgcgtaataaacgccccaaaactctggcctgccgtaccgtgatagttaaactgcagctgccccggtttcaacccattattgccaaaatgcgcggcaatccatccgcctaggcgcgttccaaccgcccgatccacattattaatcggtaaatcaatcgaggtggcattttgctgtttaagactggtttcagcaaaccgatccaaatccggccagtcatatttcggcttaaatggattggcttttttacgcgcaatcggaaccgtcttgcctaacattcggtcataattcaatgtctttgccttgccatatggcacatagcgaggttttaggtgttctccgtgtccaaccatttgatctacggtgcgataacccaaagccgccatttgttcgcgcagatcttcggctaaaaattgcatcatatgcatgacgttttccgggcgtccggcgtagagtttgcgcaattccggattctgggtggcgatgccgaccggacaggtgttgagattgcattttcgcatcatcacgcatcccagcgctaccatggtcagggtgccaaaactgaactcttcggcacctaacatgatcgcaaccgcaatgtcgcgcccggttaagagtttaccgtcaacttccaaagtcgttcgctgccgcaatcgatttaatgccagcgtctggtgggcgtctgccaatcccatttcccacggcaagccacagtcacgcgtggagtttcgaggagcggcgccggttccgccgtcataacctgagatgacgaccgtatccgcgccggctttcaccactccggcggcaatcgtgccaactccggtcgaggacacaagcttaacgttgatcttggcataaggattgacttgtttgagatcgtaaatcaactgggccaaatcttcaatcgagtaaatatcatgatgcggcggtggtgaaatcagctgaacaccggcaatcgaaccccggatgctcgccacccacggatatgccttgccagcaggtagttgcccaccttcaccgggtttagccccttgcgccattttaatctgaatttcttcggcactcatcagatactcggtattgacgccaaatcgtgccgtggaaacctgtttgatcttactgttgcggttgacgccatctgccccgacatggaaccgattgcgattttcaccgccttcacccgagttgcttcgggcgcccagccggttcatcgcaatcgcaatggtttcatgcgcttcttctgaaagggcaccaaaactcatcgccccggccttgaagcgtttcacaatggcactgaccggttcgacctcactcaaaggaaccgcttgttggccgcttggcacgatcgtccacatcgaacgcaaggtgaccggagttgttttggcttcctgttctacttcggctgcatactgctgataggcctgatagtcaccgcttctgaccgctttttggaactggtaaatgctcttagggttataaagatgcgcttctccatccgccttgaattggaagctgccgcctgaaggtaaatcatcaatggcatgatgactgaaagccagttgatacttctgatagtactcattttccaactgattcaggttaatcccgccgattcggcttggggtgcccgtaaagtattgggcaacgacatcatccgccagtccaaccgcttcaaacagctgggctccttgatagccggcagtcgtcgaaatccccatccgactcataatcttaataatgcctttggtggcagcagcacaaaatgacggcagctgctggtcatagccgcgctcacgcaaggtggcaaatgcgccataaggatgaatggccgccgcaccatacccgaccaagcaggcaaaatgatgaatttcgcaagcttcggccgtatccaccactagcgatgccgctgtccctttgccttggcgtaccagataattgtgcaatcccgacacggctaaaagaaccggaatcgtcagctggttatcggcaactggccggtcagtcaagattagaatcgtcgccccgttatcaatcgcattttctgcttgggtaaacaattctttgagcacatgtgccaggcgatcaggtcggtctgtcaaatcgtaggctaaagataacttagcgaccttcaaaagcggcaaatccaaactaagtactttggcgtatgcttgatcatccagaatagggctatcaattttgagtttgtgacaattgtccgcagtatcgcgcgtgcaatcgccatcgcggccaagaaaaccaaatgttccaatgactactttttcccgcaatggatcaatcggtgggttagtcacctgcgcaaaagattgtttgaagtaggtgaagagtgattgcgggtggttacttaaaactgctagtggcgaatcaaaccccatcgccaagacaggttcgccgccgttttcagccatcgggatcaacgctgtctgaatgacttcatgcgtatacccgtgccgcaaccatagttttttgagctgatcaggtgcaatgtcttctttaggctgaacctctggcaattgatcaagtgtgagccgattagcattgatccattgttggtatggatagccttctgcacaatgccgttttagctcatcggttttgaaaatccgtcctgtacttgtatcaagcagcagcatttctgcaggtgccagaatccccttttcaacaatatcgccgggatcaatatccacgaccccggattctgatgcgacgaccagttggcgttggttggtcaaggtataccgcgatggacgcaatccgttacggtcaagaaatgcgccgacttgaatgccatcggtgaaacataaagcagcgggaccatcccacggtgccataaacgtcgcattatattcgtcaaacgcgcgctgttcatccgacatttcggtacccgcaccccaggcttccggtaccatcatcagcaatgattgtggaattgaacggccgtgtcgatataagtattccatgcagttttccagcttagcagagtcggaatcggtttcgtcataaatttcgatgccgtggcttgtcatccaattttcggcgcccttaagcgtattaatctcaccgttatgcgccagaaaacgaaacggttgtgcccgatcccagctgggaaacgtattggtcgaaaaacgcgaatgaatcaggcagatagcactttgcatttgtggtcgatgcaaatccggataaaaaagactgacttgatacgcatgcaacatgcctttatagactagcgtgcgactggaaaaagaacaaatgtacattgattgccgatcaaaggtcttttccaactggcggcgtaacgcatataaatgatcctcaaattcacgcccggcctttgtgtcagccggacgttgcaccacaatctgaacaaaacccggcattgcttgttgcgcagccgggccgcaattttcataaataaacggcacattacgggtccgaagtatcggaaagcccgcgtcgtcaatttgatcaaccacagcctgcagcatggcggcctttttggcttcatcatggggtaagaacaattgggcaaccgcatagtcacccttagccggcagtgtcaatcctgcttgcgtcatttcatcgcgaaaaaacgcatccggcattgccatcaggattccggcaccgtcaccggtatcaggttccgcgccagtacccccacgatgattcatccgctgtaacatagtcaatgccttttccacgatttcatgactggcatgaccatcaacttgggcaataaaacccatgccacaagccgcatgctcatattcaggcaaatacattagattggtatcatcttttaatcttttcatagaatctccgccttattcattaacgtccggtccttatcagcgttattgttctcatattattctaatcatgtctcattgacaagatttttttgaccgaacacgcgtgatgattgcgcatatttgttttgtcatgcacaaattaaattgccgtcataaccacaaaaaaacggctccaagcaggcaacttgctgctttagaaccgtttatccgctgtaccatgacacgcttataacttcaaataagtcttcaagattccaaataaaccctgtatcacgaaagaacttaggcaccatccctatttttgcgccatggccgtccgaaaatgaacaatccgatcaagtgccagcatcactggggcagaaagagtcatgacaatgaactcagacagcatcagagatccatatgttggcaaaaacatggtggcaaacttcaagtgaccggtccaaataatctcaactgcaatcaacgccatcgtcagggtcatgaccgcaatattcaacgcaaaacgttgccataattgctttagcttaggcgccaaccaagctaccaccgataacccaattaggctctgaccgccaccaaagacaacatccagccagcctaatggcgaaaaaatcgcgttaaaaatgacgacgccagaaaccacgccgatcaagtagcgacgatcaaagaccactaaatgattcaagctttccgagagtcgaaactgaatcgccccgctggcaagattaaggctggccggtcctaacgataaaacaatataaatagccgccaccaaagcatttaaaacccaaccgcgaatacccatttttgtttgcttcatgccgtttaccgctcccttacttaagcttggttatgtattacttattctccataacacgctccctggtgcaaggatctgcgtgtgaggaccttggttgcaatggccaaagcccggccatacgtctgaggccgcttatgttctggtttacgcccataacgcgttcgccagcccagaagcctgcgtgtagggaccttgggcgcaatggccaaagaccggccattgtgcctgaggccacttatgttctggtttacgcccataacgcgttcgccagcccagaagcctgcgtataaggaccttgggcgcaatggccaaagcccggccatcacgcccaaggccacttatgttctggtttacgcccataacgcgttcgccagcccagaagcctgcgtgtaaggaccttgggcgcaatggccaaagcccggccatcacgcccaaggccacttacactccggcttctaaccgggctggctcacgctcatcaaaaaagcgcctctttttcatcgaggcgtttgcttagtttttattatatgttttcggcttaggcaagctgacgagtccgaccgatatcgccagtgcccgatccaccgctgccattttggcacttgaaagagcggtaacgcgtgcctgtaaccgttgcttatcaattgtacgaatctgttcaagcaaaatgactgaattacgctcaaccccgtcttgcttggcgcgcaaaccgacatgggtgggcattttgggtttttggattttggaggtaatggcagccacgataacagtggggctataatggttaccaacattgttttgaataataagtacgggccggttgccgccttgttccgacccgacaaccggcgataaatcggcgaaaaatacatccccgcgtttgactgttacatccatgctttggcccccttgctgcttatcgaatatgggcgtatgcctcactttcgcaggcggagaaagcatggctgatttccgtattgatttgtcccattgccacatagccagaaatcaattgattgatctcaggtgcttgtgactgcaaaaacttcgccactgcttcagtaatgacatcctgaacacccatatcattcaactcgcaataggcatccaaacgcgctttgatagcactatcaagcgcgaccgttactgacgtttccttcttcatgacaacttcctccaacttcccaagttcatggtgatactttagcacaaaatcagctgatgggctacctgtcaaaaaaatcgattcatctaagccagttacttaaaaccgatattaacgcgcaatcgggttgatactttgacgtttcaaccgcgatgttaaattgcaggcaatttcataatgaatggtgtggctatacttagcaacgtccagaagcgtaatctcctgatcgccactttgcccgattaacacaactttggtacctgccggataagcttttggcaagcgaatcatgaactgatccatgcaaattcgcccgacgatttcacacggatgaccatcaactaagacgtgaaagccctgtaaccgccgcagccagccatctgcataaccgactggcaccgtcccgataaactcatcacctgtagcgcgatacgtcaccccataagaaatcccatcgccggcatgaacttgcttgcaaaaagttaattcgctctccagtgacaaagccggctcaagcggaaacggtgtggtcggaatcacatcacctgatggattcaaaccgtaaattgccacaccataacgaaccatattgccgttacatgctgcatgccaaagacttgttgccgaatttgacacatggacatagcgtggccggtgcggtaacaaagccaccatatggttgaatttggcaacttgctgtttgaagtaagcatcatcaggatcatcagccgtagcaaaatgcgtgaagatcccttcaattgtgaacgccttgggatgcgcttgaatgaaggcaacggcatccaaaagtgtctgatcatccgtaaaaccaatccgccccataccggtatctaaagcgatatgcagccgcaatggtggtaactccggttgcgcctctaaaactggcaaggcctgcttgagccagtcaacactactgagcggtaacgaaaccatctgcgcagccgcaatggcagcatactgactcggaacgattcccaacaccagcactggctctgtatagttagccgctcgtaaatccaatgcctcatcaagcaacgccacacaaaaaccgctggcaccggccgctttagccacatgcgccacccgcaacataccgtgtccatacgcatccgccttcaccacagcaaacagttgcgtctgcttcttcaagcgcgctacctcatgttgaacattatgcaaaattgccgtttcatcaatcaaaaccgttgctggtcgcaagttaccgatcgtcacgttcaggaccttctttttctaatattacctcggtaaacaccaaagtctcactatgggaaatggaaacaaatgcctttccgggaaagggatgtttcgtcacaattggcttgccgagttcgttattcaaaacttccacatcttgcaaggcaactttacccagccctgtcccaaaagcttttgagtaggactccttagccgaaaagcgaccggataaatactccaccgcccgccgaccatcgagttgttgataattcgccaattctttcggcgtcaaaatcttagcagcaaatccatggttcttctcttgagccgcttgaatccgcgccaagtccgtcacatcaactccaataccataaatcatggccgcctcccaaaaatctgtgataccgctattttaacatttcaccaaacaaccgcctagtgagcacgaaaaaacgatcccggaagatgcagacttgcatcaccaggatcgtttttcagcgctggtcattgattcgcatgaatgaccggtctattaacgtactggtgattattcacccgtacggattttgaaattacgcttaacgtttttacgtttgtcgccaaagttgcgcttcttgtcataactgcgcttgccatcgcgattaccttgatagccgccatcgcgccgcttgcctttgtagccgcctttataaccgccacgattgttaccatggccgtgattgttgcggccgcgacgtggtaatggacgttctggtgtaattttaaccggaacggcactcgcatcgtcagggctgactgccttgagatacgccgaaaccagctgcaacggggtgtagttttccaacaaggtttcagccattgcttcatacttttcggtatcgttagcttcaacttgttccttgatggttgccaagccgctggagatctggcccattaatgcttcttcagctgtcggcggcttcatcggtaacatccgcttcttggtgagatcctcaatggtgtgcagatattcaatttcatttggcgtgacaaaggtaacggatacccctttatgtccggcgcgtcccgtccgaccgatacggtgaacataggaatccggatcttgcgggatatcatagttgtaaacatgggtgacaccagaaatgtccaacccacgagcagcgacatcagttgcaaccagaaaatctaattggccgctcttgaactgccgcaaaacgctcattcgcttttgctgggttaaatcgccgtgaataccttcagcccgatatccgcgcgcctttaatccccgtgtcagttcgtcaacacgacgcttggtccgtccaaaaatcagcgccaagtccggatcctgaacgtcaaatagtcgtgtcatgacatcgaacttttcatagtccttggcccgaacataatattgctcaacggtatctgctgtcagttccttagccttaatcttgacaatcacaggttctttcatgaacttgttggttaaacgcatgatcgctgccggcatcgtcgcggagaacagtagagtttgacgctcagtcggcatttgttcaacaatcttttcaatatcgtcaatgaagcccatatcgagcatttcatcggcttcatccaacaccaaggtatcaaggtgttccagctttaaggtatgacgaccaatatgatcaagaatccgaccaggtgtcccaaccacaatttgcggatggtcagcaagctgacgaatctggcggcgaatatcagcgccgccatagacagcctgaaccttgatcttcttgtcgcggcctaaacggtaaagctcttcttgggtctgaatcgccaattcccgagttggggaaatgaccaatgcttggatactccggtcggctttatcgatgtgttgcagaattggcaagccaaatgctgccgttttcccggtaccggtctgggcttgaccgatcacatctttgccttccagaaccagtgggatcgtctccgcttgaatcggcgtcgcttcctcaaaacctgactgggcgattgcctttaagagatcatgatccaaacctagttctttaaacttcaaatgagttcctccttgagaattcttgcacgcgtttacccaagcgtgttttcaagaaatccgcgggcgtcacgtgcattttcagtaaatgacaaaaaaacatatcccaacaatagtagcacgtccactatcgaaaaacaaggacggcgattgcgagatatgttaaccaggcacaggtaatgcccactttcatctattaaaagtagtaaaagcttttagtattttcaagaaaattaaacttactgatgcccctcaatatcttgttcaaagtccgattcacgcatgtccgcctgcgaccagcgcagccaaaacagtttccagatgcagaccatggctcgcttttagcaacaccatgtcatcgtgcccgacatcgttttgcaaatcgcgaatcatggtacttttggcatccagcgggtaatagtgtacttgatcttgcggatactttgtcgttaacgcttcggcaagtgcctgcatttccgaaccgtataagtaaacctcctgaatttcgtgcggatcaagtgcatcggctagtcccgcatgcaacgcccggctttgatcgccaagttcaagcatgtcacctaaaacagcaatgtggcgtcctgccgtctgaaattcgctaaaatcatggatgactgctttcatcgcggttgggttggcattgtaaacatcgctcagaatctgctcgccgacatcgccaattaaccattgtgtgcgattagccgtcacctgaaaatgcgccagtgctttttgcatggcttccggtttgacatggaaacgccgacctactagcaacgcagccaaagcattgaccacattgtattcacccataataggaattgaaaaggtcaattccggccactgttcgacggtaaattcggtatgattgcgatggccgctaatcgaatgggcaaaaagcgtattttccggatgtaaaccaaatgtttcttgtgattgggtgacttgcttagcgcggctcaccaataacggttcgtcaccgttaaaaataaaggtgccatcctctttcaagccatccgtaatttccatcttggcatctgcaatcttagcgcgcgtcttgaaaaattcaatatgggcctcgccaatcatggtaatcactgccacatccggttcggccaacgatgacaatgcatgtaattggccgggccgatccatccccatctcaagcaccagcacttcggtattgggctccatactgagaatcgtcattgggacaccgatttcattattgtaattatccggcgtcttcacaacatggtattgcgttgccaaaatcgccgcagtcatgtcttttgtcgtggtcttcccattgctgccggtgatggcaacgactttagggttcactttcattagcaaataatactgggctaacttctgcatggctgccagcggatccgggaccaccaatgttggcagtttagtcgtcattggcagatggtcctctgccacaaaagttgcgactgcccccgcagcagccgccgctggaataaactcgtgcccgtcacgctcgccatgcaatgggacaaataacattcccggcttcaatcgccgcgaatcaaatgccaccccggttgccacttgcgaaccgactgtttcagagagtggctgggcttttacgacacgtgcgatctctgccaatgtcattttcatcattaactcgactccaattcttcaacttcacctcgtttttcaacaagatgacaaacatttttcaatcaaaatcacggaacaatttgcaattacaacaggttcttcctgcctaaaaacacgaaactgccccacaacaggcagtttctttagcgctcggttttttcttgatttctatcgggatctagcaaccattgattcttttgccgcattaaaactagcttaccgagtttacgggccgtctcatccggaaaaataccatccggaataaaccgctcatgcagcgccagcaacggaatcgtgatccgttcacgcgaaaactgaacgtgacggaaatcaaataccacaccatcttcaagtaaaggtagcagctgcgtataggcaccgtgcgacaaatgtgaaaagtgttgttgtcgcagccgcaaccaaaatggctgttcattggcaattcgtcgtaagtatttattgatcgccgcagctaaaaaggcctcaaataagctttcatgccgtaaatacatattgaccgtgccattacgcatcggcaaataaaccagctcattttgcaatttatagtaaaacggtgagttcagatgcgttttcgcatgacctaagtatagcagttctgcgatctcattaggggtcagttcctgcaaaaaccgcgaacgcgaataatccaaccagcagcgggtttgcccttccttactacgcaaaaaatcccgcacttgatccttgccattgataatattaaaccaagtgtgcggatcaatctgttcctgttcattgacaggtggcaacaggagcaaatgttccggcagtttttgctggctattcagcaaatcactcgccgaaatcccataagtcaaaaacaaatgggctaatggttcatggtgaacataaatcagtgcattccgcatggttaaaaccccttaatactcccaccactattatacgactttcgcggctcttcattcatgcagtatgatgaatttaaagcgcacgtgacatcgacaaactgcacggttaggcaccggccctctctgcagctatgaaaacacgctaaaaagcgcacccatcgcctaggtactggcgctaacaagaaaagaggaggttgcaacatgctaccatggccaaaaaagatcccacaacctaatttaccaacaattccagaaaccgacctcataccttcgacttatttttcaatcattcaaaatgggattttccctaaaaattggtggttgtcgacatcggagccgacaagcgatggtttgaccggcgtcggccttcatgcactggcaacacccggtccggcaatcacctcagacgacctgccatcagactttttgccttttgcccacactgctcaccaatacttcggctttgatttgcatcatgaggttcgccgaatacgttacattgacaccgaagtcgaccaatggctgacggttgcgccggactttgatacgtttctcaaacgcctgcaaccgcacccgattcagctacctgagctaccggtcgacccacagattttcggtcacatggccgtgatggcaacggcttcagattggccggccttatttgatcacgcccgcgaatttatgtctggcgaaacactcggccaatggttaatgtggctagccgccagcgatgatccggctaaacgccaagctgctgcagaagagtaccgttttctcgtgcgctatcagcccaacttgcttacgcccaatgtcaccatgaacctgcaacatttactgcattaagtagcaccaggcaactcatttatgacgagtttgatgcggttgaaaagcaaacgtcttcaaccagcttaagtcacgtttaatgccaaaatagccaaccaacgccaaccctaatgaacccagaaagtccatcaataaatcacccatcgtatccatgagcgcagcccgaccacgtaatagttcaccaccagcagccatatatcgctgcatgttcatacccaataatccatcaaatgtaaactcataaaactcccacaataccccgatggttgttccaaacgcgagggcaaataaagccatcagcaatggacttgtcgcggccaaccgttttgccggcgtcaacgctgtaaaaatagcaaagccaagcccagcaagcatcgccgcactgaataaatgctcaaacttatcccagtacggtacgctatagcattgcaatcctgtacccagtaaaacactcaagaggataaaaatttcaaataagtaaatcaaactcggcggaaaacgaaaatgccaccagtgctccatcaaacgcggcaaactaacaattaagatgcctgatgccacctgagcaagtagcatcatctgaccatgaaacaaagaatgaccactaagataaagcccgccgacaatcagtaagtaaagcatatcgccaccgatgtttaaccaatacaaaaaattcgatcgtttagtcatcattttcctcttttctttgtgattgtgaaccagcttggttactcctggcacacgcagaagcaacccgcgctttttgtttatgtctgtttccggctcccacttccatcaatatgggggtcgggagtgcgccatttaagtcgtgggttttggctcaggagcaaactcgagaaacgaagcccgccattttctggcatcagtgcaattaatatgcttttgtaagcgcttggtgtagactcagctttaggaggtgattccatgccaatcaaaacgttacccgaagatcaacttattgccatgagccagtccgtcgtcaaagaagtcgccaaagcgtttaactttccttattatgtcaatgatctgacgcatgatgcaaattttgacactgatcacactgcgaccaagctcgaatttgagctcaccttgttgaacgaccccgatccagagcgtaccatcagtttttacagtgacgccagcgccgatccaattatgggcggcgccgcttctgcacaagtgacgattgtatctgatatcacgtttatttatctaaacgacgggtacaaggattcgtatctcattatcatccatgatggtaaggttgttcaaaatctcaaattagaacaacagattctgtcaggccccgaaattgaaaacttaatcaaccaagttatcccgcaagcccaataagtcttagcgtaagaaaagcagctgaaaggctgtttttttgttatcctcggttttgttaatcacgtaaccttcagtttagccgcaaaaaactttatcgaagcaaaatatacctctcgacagaattcacattttaacggccgatttagggaacccataaatattttatattaaaaatataatgcccacgctcaagactttgagaacacaaaaaaaccaccattaaaggtggaaaagtttgggggaacttttttgggagtgtaagttaatgtgtaagcttaaggctaaaatacctctgccttattgatttaagtatatcaattccttaatgatatgtaattccattttcaacaagaaatatgtttaataaataaaacggcttatgcttatataagttgaagctaacaaaaaagcaacctcaaaaggctgcttttttgcttatttcttgtcgaagccgtacttcttgttgaaacgatcaacccgaccatcagcctgcgtgaacttctgcttgccggtgtagaagggatgtgaatcagatgaaatttcaacccgaactagcggatattctttgccatcttcccacttaatagtttcttttgaagttttggttgaacccgaaataaatttgaaaccagttgctgagtccataaatacaactagatgataatctggatggatgccttgcttcataatcaattactccttttgccctaaatcattgcctgatctagagatactctgactacaactctaacagtctatcacgcgcaaacagcaaacgcaatctcaatctactaattcaacatctgcacctaaaccacgtaatttcatcacaacccggtcatagccgcgcaagatattgtcgaccttcgtaatcgtggtggtgccttcagccattagcccggcaatcatgagacacgcaccggcccgaatttcctcggccgcaacttcggtcccttgaagatgatcgcagtggtgcaaaataatcacgtcattttcaatcgtaatgtcagcgcccatacgtaacaattccggtatatgccgaactcgtttgggataaatggtgtcgataatcaagccttcaccatgcgcttttaacataagtggcgtaatcggttgttgtaaatccgttgcgaatcccggatacggcattgttttaatttggaccattttcaagtcgccggatggatagacgaaaatgctatcctcgcccacatccatcaccacacccatttcttccaacttagccaaaaatgcatctaagtgttcggaaatgatgttcttaactttaacgccttcgcctactgcagccgccatggctaggtaggtgcctgcttcaattcggtcgggaatgatcgtatgcgaattatgcgcctcgagcgttggcaccccatcaatgcgaataacgtccgtgccggcaccgcgaactttgccacccatattgttcaggtaggttgctaagtcgataatctccggctctttagcagcgctttcgatgaccgttcgtccctttgctgtcaccgccgccaaaatgacattgatggtggcgccaactgaaaccatatccagaaaaatacgggcaccatgtaagccttcagccggcgccttaattgccatcgccccgtgttcattgctcactgaagcacccaacgcttcaaatcccttaatatgctgatcaataggccgcggaccgatatcatcgccaccaggcagcccaacaattgctttgccaaagcgccctaataacgcgcccataaaataataggaggcgcgcagactcttaatcttaccgtttggcagcggcacatcattgatttcggttggatcaatcgtcagaacattttcggtaaaatccgatttaacattcatatcactcagaatcgccatcaaattatagacatcctgaatatgcggcactgaatcaagcgtcaccggggtgcgcgacaaaattgcagccggaatcaaagcaaccgtgctgttctttgcaccgccgatcacaacttcaccggataatttctttccgccgtggatcagcattttttccatttgaattaaatcctcacttaaggtcgttcatttcaagtaggctgaagctgacctgcattttatgcttcaaatatcaatcacgaacactggtaggcaagccatgacccattcgccatgcactcaatatacaattttaatgaatcagcacgcaaaaaacaaggactaaaagttagtgagcgcgaaccggcgcgcttagggatcggagtgtaagcggcctcggacgtgatagcccgggtttgaccattgcgttcgaggtccttacactccgatccctgcgccggtgagcgcgttatgggcgtaagccagaacataagtggcctcagacgtgatggctggccgggctttggccattgcgcccaaggtccttatgtgcaggtttctgggctggcgagcgcgttatgggcgtaaaccagataagtggccttaagcgtgatggccgagctttggccattgcgcttaaggtccttacacgcagacttctgcgccggtgagcgcgttatggacgtaagccagaacataagtggccccagacgtgatggcccgggtttcgccattgcgtctgggggtccttatgtgtagatttctgcgactgtgagcgcattatgggcgtaaaccagaacataagccgcctcagacgtgatgacccgctcttggccattgcgctttaaggtccttacacgcagacttctgcgccgctgagcgcgttatggacgtcagccagaacataagcggcctcagacgtgatggccagggtttggccattgcgttcgaggtccttacacgcagatccctgcgccggtgagcgcgttatggacgtaaaccagaacataagataagccccctcggccccctcaaccgtgacgactcgcgcaatccttctcccaaatacaaaaacagcctcaaggacttaacctcaaggcagttttcaaacgcaaaaatactaatttttaaaatcgccagctgattggatgaaggctttgaacagtccttctggcttgtttggccgtgattggaactctggatggtactgtgaggcaacgaagaacttattcttcggatactcaatgatttccatcaaacggtcgtccgggctaacccctgaaaagaccaagcctttctcctccattggcttacggtacttggtgttgaactcataacgatgacgatgacgtttctcgatttcatgagcattgtcataagcctttgctgcgacggatcccggctttaagacacatggataaaggccaagccgcagtgttccgccaagattcttcacgccgacctgatcacgcattaaatcaatgaccggatccttgacatcaggatgtgtctcggttgttccagcatctttgagtcctaagacattacgtgcaaactcaatcgaagccatttgcatacccaagcagatgcccaagaatggaatatcattctcccgtgcataacgaatggccgcgatcttgccttctaatccgcgatcgccaaaaccaccgggaaccaaaatgccatcaaaaccttgtaacagactttctacattgtcatcattaacgtcttcagcctgaaacatttgcaagtcgatatcggaatcccagtagtaaccagcatgcttaagtgcttcggcaacagagatataggcatctttcaacgcaacatacttaccaaccaaggcaatcttagtttgatgcgtgagatgttgaaccttgtgctcaagcttagtccaatcagtcatatcggctggcggaacatcgaagccaaagtggtcaacaacaatctgatccatcttttgggcttgtaaggctaacggaattgaataaagggtcttggcatcgcgtgattcaatgacggcattttccggcacatcagtgaacaacgcaattttcttcttcatctcttctgtaatcggtttttcggttcgtacgactagcatgttgggctgaatcccgatactgcgcaattctttgacgctatgctgagtcggcttggttttcatttcatctgccgcgcgcaagtatggtaccaagcttgcgtggatatagaaaacattttccgagccaacatcacgtttcatttggcgaattgcttcaagaaatggcaaggattcaatgtccccgacagtaccgccgatttcggtgataatgacatcggaatcgctatgcttggcagcgcgcataactttttccttgatcatgttggtgatgtgggggatgacctgaaccgttgcgccgagatattcaccgcggcgttcgcgttgcaggacttcagaataaattttcccggttgtgacattgctgtacttgttcaggttaatatcaataaaccgctcataatggccaaggtcgaggtcagtctcagcaccatcatcggtgacaaacacttcaccatgctgataagggttcatggtgcctgggtcaacgttgatatatggatcaaatttttgaatcgtaatcttcaaaccgcgattctttaacaaacgacccagggatgcagcaacaatccctttacctaatgacgatacgaccccaccggtaacaaaaatatacttggtcatagccagtctcctttttaaattaatcgggaaaaacaaaaacaagctccctattcatacgaacagggagcttgaaccgtattggctttacacttctgtaaagcgcccaaaatgtatattaaccaattgtacgagatccgtcaagcattaatgaaaaaaagtaagtatcaaaaccatgaacgaaaaactcaaacctaactgaataaaaggatacgtcaggtcaacgatgctccatcagtgaattttatcagtctcctgaggcccatgtccatcatctcgcctgaagcttggtaaaaacacgctcactttttcactcaatttcctaaaatatatgagcctaacatttgtgaatagcaataagattgttacaataaggttgtggtcaattgaacgcatgtaaaaacaattttgtaaatgaggaattggtaaatcaatggcagatgttgtcattttaggtgccggatatgcgggcattcgggccgttaaaactttgagtaagctcgcgccaaaaggaacgacgctcacagtggttgaccaaaacgccaatcatgaagagcgcacacagcttcatgaagtagcagcaggtaccgtgcctgcaacgaaaattacatttaatatccagcaggttcttcccaaagatgttcagtttatccagtcaaaggtcagcaaggttgacgtgtcgagcaagctagtgatactggaaaatcatgcgccgctgcgttacgactatctcattatcgcgctcggcttccgctctgaagactttgggctacctggcgccgcagaaaacgccttgccactggacaatgtgacctccgccgaaacgattgccaagacaattgaactgcgtgtcgccaattacaagcagtcacaagatcccaaagacttaacggttattgtcgcaggcgcagggttcaccggggttgaattattaggcgaattgacacatagtctgccggcattagccaaaaagtatgatacgccacctgtcaaaatcatctccatggaaatggcaacgcgtattttgccgatgttcgatgaaaagttagcaaattatgcaatggattatctaaagagccatggcgttacgatgatgaccggttccaagattaccaaaatcgaacccaatgccgttgtttatgctgacggcgatcaggaaaagaaggtcgaaggcaacacgatcatctggacagtcggtgtttcaggcagcgatgtgatcgccgattccggcttcaaccaacgccgcaatcgcgtagttgtttccaatcacctgaatctaaccgaccatcctgaagtcttcatcatcggggatgtatcggcagtgatgacagacgctggccgaccttatccaaccacggcgcaaatctcctcccaagaaggcgatcacgccggcaagaatgtcgccgcagcactaaacggtcaaccgttaacggactttgtttacaaatctaagggcactgtggcatcgcttggcagtcaagacggcatcgcccaaatcggcaagagccacaagtacaccggcttcattgccaaggtactcaagcgtgtgatcacagataagtcactgcttgaagacgccaatttgagcacgatgttgaaacaaggacgttggccgctttaaacgttcaggtaaaagcaacaagcacgtactaggtcaatgatgatcacaaaaaagcagcgaatatcgctgcttttttgatgcctaaaggtatggtattaagtcattccccctgatttgcatttctatcgttttggttaacggcttcctccatcttgcggacagcatggttatattcagtaatgagtagcctgatggtaatgtaatcaaccttagattcattatctgaaagcggtatttccatgacctgaatccgcaacggcagatttgattgttcaaaaaaatcggatagtgccgcaagaaactggagtgcatgcatgaggttgtcataagatgaaagattgttaatgaaataaatgacaaaggtttcaatttcttctttttctagaaggttatctactttagaagctttagcaaagttattgatggctctatcaaaatatgtcatagcgttcctccaactaatagcggctaattaaaaacaatcttagaaaccgaatcgttttccaccgtttgcatttttattagtttgattgacagccttctcaagcttttgaacggcatgatgatactcagatttgagcagctttgtgacgatgacgtcaaccttagattcattcccggaaagtggtatttgtgtaacctgaatttgcagcggcagacttagctgttcaaggaaaccggccattgctgaaagaaaatttagcgcgtgcataaggttgttgtaggatgaaaggcccctaaccttaaagaaaacaaagtcatcattctcttctttttctagaagatctgaaacctgacatgttttcgcaataaaattgacaatcttatcaaaatatgtcataaaaaatctccgcaatcatggtgactgaacgttaacgatcctagaaactggttccaacgtcagggataacactcaataagcatcccgctgaatgtacagcttgccccgacaagccggtatcgccaacattcttttattcgttttaacaatacccaaaacttcgcctatccaaagattaaataaataattgtttcaagatataccaattatattttttacgtcaacggttttgaaaattttctaatgctgctcatgaacgccttgaatctggtcgtctaggcgtcttattacgataatctttatttttactttgccgaaatgtcgtaaaccactgatcaagcattgccggatcgattttcaattcctgttgcgcagtacggctaaacttttcccaagcagccttgtttgccgcttggtcgccatgagcactgcgcaaatcgcgaatgtattcacctacaagccgccggaatcgcatctgctgatctcgattcatcttcaagtaattccgctgccctgttgtcgccatctgctgcataccggtgagttcgcgggcatcgctgtcgattgtaaaaaatgagcggattggaatggcaatgtacaaaatataagcagctttaggtaaaaataccgccagtaccataattgcggcaatcatcaagaaattttccaagttgtgggcgccgtaaatgctcgtgtagatttgttgcatttcagccttattactagcttgctgatgcacaattgttcgtgaaataatgcgaaaaacggtaatcactaaaagatacagtgcaccataaataaccaccgaaagcacttcaacgtcaccagacatcaagcgcgtcaatgccggtaccagcgaaagtaggaaaactaaaataaattcccagatgacaattcgccgcgggatctgtttgacctgactaaacaaagttgcttgctgataccaaatatttgctacaaaacagaaactaactgcataaatgccaaccgctagaaaaaacgcgctgatatgtgtatgattttgccaactctccgccggcaattccaaaaccatgatcgtaataataatagcaagaatagcatcgataaacgtatccagacgggttttaagatcctctgaaatcataaatagcctcctgagtgtgtgccagcgtacttagaatcgaagtgtaagcgagccatcagcttggatcattgtggctgaggccctcacacgcaaatttctgcgctgggaaacgcatcatgaaaagcgtgagtcattacactatgatggcagtatcagcttttcagaaaaaatgtcaagctcgtgaaaacaaaaaagccacaccttaaaaaagtgtgaccgttaagccattaatgtttatcgttgtcgtcttcatcgtcatcattatcgctgtcatcatcgtcatcgccggagaagtcagctgtgatgtcatcggtgtcgtcatcgtcatcgctgtcattgtcgccaaattcagctagctgaccttcaatgccatcgggaagtccatcatcaggatcatcatcgctgtcatcgtcactatcgccggccttgccgatcttatcatgaaagccagtgctgtcatcatcatcgaaatcatcgtcatcgctatcagcgtcgagatcttcatcttcaggatcatcgtcgttgtaatcgatcacgtcatcgtcatcggcaacatccgccaagaacgcattaactttcttacgtttcttgcgacgcggcacttcttcttcgtcttccggatggttaacttcttcatcaacggaatcgtatggataccaagcgcgcaggccccaaacgttatcgcctaaagaaatgaagctgccatccacattgagatccgtatagaattgcggcaaacgttcacgaatctcttcgtcactcttaccgagataattctggatctcattggccagatcaacgaacgccatggtatcccctttttcttcgaggatctcatgggctacttcgatcattgataattctgatttatcggcattggcaaatgctttgagtttcaaccgatacacgccctttccacagtctttacagtctgttttctatcatacccgctcaggccttaaattgcaatcgcaaccgataatttcctaaatgttggcgattggcaaaaagctcatactcaacataaatttcacccgcaaccggttccgtggtcattcgcacatcaatccgaggtgtcaccgtttcaaccggaataataccgtatggcgtccgatagcgggtcaaaacccgtttttcatccgcaaaaaacagtttcaactgggtatcgccattactgctgccacgcgaaagttgaatatcaccgtcttcgcgcagtttcatcgtgaccggcatgctcgttcctgcatcctcgtccacttcctgatagcgaatataaagtgcgttccccatctgtaccaacgttccaggttcatcaaaaacatgtgtctcctgatcatcaccttgcgtcacaaacgtttcaaggtgaatctgaatcggcactccttgtgaaagatccataatgtcaatcctttctatagagtattgtacgctcacaggtcaagagggtcgagtacagagcgtgagccagcccggttagaaaccggagcataagtggccttgggcgtgatggccgggctttggccattgcgcccaaggtccttatgcgcaggtttctgggctggcgaacgcgtttagaaagtgagcgcgagccggcacggttagggatcggagtgtaagtggcctaaggcgcagatccctgcgccggggagcgcgttataggcataaaagagaacacgcgcccaagaactctacacgccagacttccgcacccccaaacacctttatcccaatgaaaatggctttgtgcctgacgtgttcggtcaccttcgctataatataggtaatctattattatgaaagaaggcgcacaatggacctaacgtcgctggctggtcagcaagcagccatcttccagcaagacttcaccaaagatgaggcgctgctcagctttgcccacaccaatgcgttattagcccatcccgagctccatccaccgctgatgctgcatttctggacggctgaacaaaccgtcattctcggtatgcaagatttaaagttaccacaattggggcatgggctgccagtcctgagcagcgaacaatatggcgtctttgtccgcaattccggtgggctagcggtgattgccgacagcggcgttttgaatgtctcgctttttttacccaatgaaacgcgcctgaccatcgatactgcttatgagcttatgacgtcactatttcggacagcatttccagcgctgaaaattgccaccagtgaaatcacgcattcctattgtcccggcaaatacgatttgagtgtcggcggccaaaaattcgccggcatggcccagcgccggaatcaggccggggtggtcgtgatgctttattgcagcattttcggtgatcaaaatgctcgctgcgatttactacgtcgattttatcgggctggacatgccagcgccagtccccatttcacttttccgcttatccgttcagaaacgatgaccacccttagcgatttacttgatcggccactgacgcgtaatgaggcgattcttgccatattgaatgccttagcaacttacggcatcgcagccgacatgaactcgatgccggcaatattgcgcgatcctgcttaccatcaagcgctcgctgcagccaccgccgatttacgtacacgcaatcgcaacttaaaaaagatgggagaacatcatgcaatttgaaaaattaccacgggaaaaagtttttcgcgatccggttcataattatgttcacgtccaacaccgcgtgattcttgatttaatcaataccccggagtttcagcggttgcggcgaatcaaacaactaggggtctcggattatgtctttcaaggagctgagcatacgcgctttgcccactcacttggggtttatgaaattgcgcgggagatgtgcgacaactttgtcattaactatcccagtcaaacgcctggtgatggcctttggaatgacgctgaacgtccggttgtcctgtgtgctgcactgttgcatgatattggccacggcgcctactcacatacgtttgagcatattttcgggacagatcatgaggcaattacccgcgctattctcacggatccgcataccaatgtcaaccgtatcctgcgtggtgtgagtgcggaatttcccgagcaggtggcttcagtgatcaaccatacttatcccaatccgcaagtcgtccagatgatttccagtcaaattgacgccgaccgaatggattacttgctgcatgatgcctactataccggcaccaaatacgggctttttgatctttctcgaatcttgcgggtgatgcgaccttattctgatggtatcgcttatgaagccaacgggatgcatgcggtagaagattatgttgtcagccgctttcagatgtatcaacaagtctattttcaccccgtatcccgcggcatggaggtcattctcttccacctactaaaacgggctaagtttctgtatgagtccggacagtttgaacccgggttttcaccacgcttactggtgccttttttcgagcaatcctttagcttaaccgactacctcaagttagatgacggcgtgctcaacacctactttacgtactggttagattatcccgacagtatcttaagcgactttgcggatcgcttcttgaatcgccgcccactgaaatcagtgacatttaccgatcaaacggccgcgctgcttccaaaactacgcgcgttggtggctcaagccgggtttgatccgcaatattacaccgctgaaaatgatagtttcgacttgccatatgatcaatatgatcctgcctcagcgaacccgaaaacccaaatcgaaatcatgcaaaaagacggcactttagaggaactgtcaaccttatcaccattggttgctgcgctgagtggtcgggcaacaggcgataaacggttttattttccaaaagaaatgctcgcctctgaagatagcagcctcttttcacctatctatgaaaagttccaacgttatctgctcaacggtggtgtgattgatccacacttaacggattagcaaggtgggcttcactgtttgggttgctgggcgagccacttagccacggcccagcgatgtgttggccgtttcaattcggccaaggccagatcgatcggcatgagcatcaatgtattgaaggtttcaagtggatcctgtacaaaagccagttcatcacaggcaaaaaacgtcgccggatggtaataggcggtttgacgatgatgggaataaaaatactcagacgatttgccgagctttttggtcacatgcacggttgccccaaattcttccaacaactcccgtgccagcgtttcttcgggggtttcgcctttttcaacgccgcctcccggtaagaataatgcatggttcggcgcttgcaaaatcagcaaccgcgcgccgctatgatccggaatgacgccatacgcgccaattcgggtgtgataatctaactttggatcttttcgaccaaacacaggatcaatcatattgcatccctccgcttttaatcacattataccctaatcaatttctaacctctacacaaggagacttttcgatgtcagctcaggaaacgttatttgtctttaccatcccccttttgctgggaattatttttgctatcagcttcaccattgaaccgcggcgtttgcttaacggctggctgttcaacttattcgccgtggtatttttgatcgctttggcagccgcgattctaaaatccggtaacctactacttattgctgtaaccggaacgctttttgtgattacggtcttaattgtgttcttgctgtttgccttgcacttattttggctgctatggaatgctatccttgtgtggcggcgtgaaggccattcgttaagtaacatgttgacgctttatattgccatcggactgttgttgttggaaattgctgcttcgtttggccgccgttttattcccgaacctttatacgtcgccttggcagtcttctttggcttaggcgggttatatgtcttattaacgctttataacttcttgaccgcgttaatcctgtacaatctccggccacaaccgcataatcgaacttttctcatcgtgcttggcgccggactactgcatggcgatcaagtgtcaccgttacttgccagtcgcattgatacggccattaagttttatcacaagcaattaaaaaaaggccgccccgctccaaaaattattttttccgggggtaaaggcgcagatgaggctatttccgaagcactcgccatgcagcgttacgctttgggaaaagggattcccgaggccgataccttacttgaagatcagtcaactaccacccttgaaaatatgcggttttcaaaacggttgatcatccaagagattggagaagctccttataaagccagcttctttaccaacaactatcacttgcttcgagcgggcattttcgcgcggatggcgggtattgctgctaatggcgtcggcggtaatacatccttttattttctgcctaatgcggttattcgtgaatacctagccttggtggttttgtacaagcgccggcatgccgtggctttcggcgtgattgttctgatcgcgttagggcaattcatccgggcctggcaactgggttgagcgcttaacgtgcagagtaggtggcaatttcggtacactaactatacgagggggttatgttgatgttaaaagaattccgtcaattcatcatgcggggcaacgttttggacttagctgtcggggtgattatcggtagtgcctttaccggtctggttacctccttgactaagaacctgattaacccgattttatcaatctttgccggtaaaaccgatcttagcggtttatccgttacgttattaggcgccaaatttacatacggcaattttcttaacgatgtgattaactttttgattatcgcctttgttgttttcatgatcgttcgcagtgtcaatcgtttcttgcccgccaagccgaccaaagctgccgggcctacccaagcggaattgctcacggagattcgcgatttattaaaggagaagaacgaccattcgcaggtttaattgattaaaaaagtcaataaaaatcaaatggctcaaggaagacgcagcagcgttatccttgagccatttctgtttattcccatcatttatgaaccttcaataacctgctgcgaaaacaactcagaaaccgtccgcatagcattctttacggtcactgtcgcaagtggatcctgtgccatgcttgctgaagttgtctgaagccaagcgccagagtccatagtatgggtgccgtcaagactagcaatacctgaaacacaaatttgacaatcacaacgccaatagtgtcaataccgccgctttctaggattgttgccattaccggtgtcgtcgcgtaaataaagtcttgataaagattcatattcttttccatgtcagctacataatctttggttgaacggccagtagaagcaaatcgttgggcgctgtggtcaatttgatcaaggtagcgcggtgccaagaccagccagctgatcaataaataaccatcaccgattgtgggcgtgaaatcgaacccacttgttttcttaaggtgaaagaaaagcattaacaagccatacgctgcaatgagtctcagtcgtttgtgcataccagccaccccacacatcacctaatcaagctaccgggtcctatctgaatgctgatatcataagccgaacgatcacttttgtatagggttagcccaaatgaattgccaaaacgccatgttttttctcttgttgcggcgtataaatgcgataggtgtcagcgaccattttagccacggaatcggttggtgcacttcccacggcggtaccctgatattgctgataaagctgggaaaaggttccgaacttttcaagctgagtgactttcttggtaacttgttgctgagtggcgagatcctcgaacacaatttgatcaccaacctctagctgtgggcgcttttggtcattgaggcgaatttctattgttttagttcctgcttgcaccaacagaaactgatcatgcgcgagtcccatttccataccatttttctccttgtcatcacgttgctaagtccccgcgccacacctgagccatcaaaaaagcacaccttacagtgaaggtgcgcaaacttgatgttacttggtgaatcgattttcgaataatggagtcacggagcggttttcctgaatccgcatgattgcgcgtcccattaatgggccaacagaaacaacatctaacttatccatgtgtttatcagctggcaagttaatggagtccgttacgaccaccttttcgatggccgagtgggtcaaccgttcaactgccgggccggagaaaattgcgtgggtggctgcgaccaagacttcggttgcaccggcatctttcagcgcttgggctgcaagggtgatggtgcccgcggtgtcgatcatgtcgtcaataatgatacattgtttaccggtaacattgccgacgatgttcataacttcagcaacgtttggccgtggccgccgcttgtcgataattgcaatcggcgccttgagaaattctgctaatttacgcgcccgggtcacgccgccgtgatcaggcgaaaccacaaccgtatcagcgccgtcataatggttgcgtaagaagtagtcggctaacaatggtgcaccgacaagatggtcaaccggaatgtcgaagaagccctgaatctgggcagcatgtaaatcaagcgctaagacccgggttgcaccggcacgttcaagcatgttggcaaccagtttagcagtaatcggttcccgtgaccgcgctttgcgatcctgacgtgcatagccataatacggcatcacgacattaatcgtatgtgccgaggcccgccgtaaagcatcaatcataatcaatagttccatcagattgtcgttaaccggactggacgtggactgaatcagatacacatcatcgccacgaatactttcttcgatgttgatttgaatttcaccatcgctaaaccgcttcactgacgactttcccagttgcacaccaacctcggcagcaatcttctctgccagtggtttgttcgaattcaaggcaaaaatctttaatctcgggtcaccgtattgctcagacatatgttcctccacgaaatattataggctgcgaataattgttccacaaaaatcttagcggattgacgaaaaaaagcaagcatataaaacgaattataacctaattccaatctggatcgttcgcgagcggcagtcgtttccagtaatcttctttggtcgtttgacgcgcacgggcaatcgccattgcgtgaaacggtacatcttttgtaatcgtcgaacccgccgcaatgaaactatgatccgccacttcaactggggccacgatgttagagttagaaccgataaaggcatggtcgccaatcgtactattccatttttgaacgccatcatagttaacaaacacaacgccgcaacccacattaatatcgctgcccaaggttgcattaccgacatacgtcaagtgaccgactttggtgcgtgcaccgatcttggcttttttaatctctacaaagttaccaagatgaacgtattcgccaatgtctgcatctggccgcaaatgtgagttggggccgatatcactgtgtgcgtgcatcaccgcgtgttcgatggtggaacttgtcacggtaacatcatcttccagcgtggcatccagtagttctgaatgggtaccaatgtggcaatcttcaccaatcatggttttacctttcaaatagacgcctggttcaatcacggtgtcggcaccgattttcacatccgtatcaatgtaagtcgttgccggatcaatcagcgtgacgccattacgcatatgctgctcgttaatgcgctgctgcatgagccgggtcgcttgtgccaatgcaacccgatcgttaacgcccagagattcggtgtaatccggcatttgataagcagcaaccttttcacccgctgcccgtaaaatgcctaagacatccggcaaataatactcgccttgtgcattgttgttcttaacctggtgcagcgctttgaataacgcctgattatcaaaaacataaaccccggtgttgatctcggaaatcaatgcttcttccggagtagcgtctttttgttccacatttttaatgacattaccgtcagtatcgcgaataatccgaccatagccagtaggatccggggcattggcagtcaaaatggttgcattggcgcctttagcttcatgataagcaaacagatcattgagagtcttagccgtaaacaaaggcgtatccccgctcataatcagcgtggagccttccttttgccccaacaatggctctgcttgtaataccgcgtgaccggtgcccaactgttccgcctgcaacacgaattcagtccgctttccaagtgtcttttcaacttcttcggcaccatggccaacaatggtcacgatagcgtcaggatgaatggcttccacctggctcaccacatgctcgaccatgctcttaccacagaccggttgcaaaaccttataatacttcgatttcatccgcgtccccttaccggccgcgagaatgatggtgaatttctttgacatatgaatactccattcctaattatcttatttcataatagcccagccagccgatactgacaacaactgagcgcgaaccggcgcggttagaagtcggagtgtaagcggcctaaaacgtgatggcccgctcttggccattgcgttttaggtccttacacgcagacttctgcgccggggagcgcgttatgggcgtaaaggtggatgtacgtcctaaaacgtgatggcccgagctttgaccatcgcgccagatccttacacacaaaaccctaccctctcctaaaacccaaccaaaacaaaaaacaggcccgtcgacatcccaagcctgttttccaaatactattcattcaacctgtcatgcttttcatccacatccgatttcgcatcgtcaacctgctgcttaacctccgctggcacttcaaacgtactaacttgagtcgtatcagcccacgcatcatagaagaagcgaaaatgccgtgagcccacttcccaaacaaaattaatcatgaacagaaagaccaaaactgcaaagaatcctaacgcagccagattaatctgagttcgttgaaacttagcaaaatacgcaataaagaaattgttcaaccctaccaagctggaaaacgccaagccatatagcagtccttcgcgcaataaaagccgccaaaatccgacagcttgaccatcagtacgcacaattttaatgcgcaccaatccttttccaagtgtctggccgttgttaaaggcaggccaaatgacgaagacaaaaaatagcggcaaaacatcttcactcaaaaagtccggcaattgatccaaccctaacaaatgaaataggaatttgatcataagtccgataacttggctgaataagacaaaatcgactaaaaaagcggctaatcgtcgggcaaaagtcacccgcgcaccacgagcctggcttttggcgtcaatggtatcgcgggatggcaacgcccgcatcagaatcggcgccagcaccccgccaaccaaaccacctgtcgtgttaagaatcaaatcgtccacatcaaatagtcgataaggccgcggataaaagccatataatccggacagctgtgtcagctcgaagaataaactcaacccaaaactcatcacaatgatctgcggtacgctgcgtttaaagtagtaccgcaaataaaagccaaatgggatcgttaaaacgatattaaagaaaggttgaatgaaactggactgcttgagcgcggccagccaggtgtgaggattgctcggcacaaagacggtcgtatgaatgaaataccgcagtgccattagcggcgtcagattatacttcgccccagtaaactgtgcgacagcctcacgagccggcaatggcagaatgatcagaaaataagccgacagcaggtaaaatacaaacgaataaatgacaatcgcccgccaccagctaaacgcaccgtaacgccgataaacaaccaccagaaacggtagcgcaagcagcagcgctaaaaacggaaatgtgactactgctgttctaaccggtccaaggtaagcactcattgatgactcacctcaagcaactgccgattctggctaagaaaattaccggctgtggcatgcagcgtatttgcctttgtatccactttgtcaacgcgaataagcgaagtgtaatcgttcaccatgcgatcgccgtcaaacttgccctcagcaaaaaccgtaattccgaccatttttgcgttaaactcatcgatcaacgccttcatgccgttaacggtgccgccgcctttcatgaaatcatcgacaatcaagacccgcgaattagccggcagactgcgcttactcaactccattttttcaatccgagccgaggatccggaaacgtaattaaccgaaaccgtcgaaccttccgtgatcttggagtcgcggcgcacaataacaaacggcacattcagatattggctaacactttgcgcaatcggaatgcctttagtggctaccgtcatgaccgcatccacattggcttcgcgatactgggtcgcaatcagccgcccgatttgacgtaaaacactcggtgtaccaagtaagtccgagagatacacataaccgcctggcaacagtcgatcagtctcggaaagtcgcttggccatggccgcaatgaaattttccgcctcatcttcacccatgattgggatataacgaaccccaccagcggcaccgggcacagtttcaaggatgccggtttgtcgctgggcaaaagtccggcgtacgatagccaaatcctcactaatagatgacttggcactttcatagcgttttgagaaaaaagtcaacggtatcagtgtgtgaggccgttccaacaagtaccttgtcatgtcgattaatcgatcgctgcgtctaactttcattattccgctcctaactccgaatatttagctctgtattaacattgtgggataatcttatccagtataaatgcttttaacgaaaatttcgacccttttacgacaaattctcaccgaacgttcgcatttgtccctagttcactcagataatttttaagtcgtctcagtagccttgtatttatttctatattagaatggttacaaagaggggtggagaaatcatcatgaactgttttgaattacatcatatgacctttgcaccaacgcaaacagctattttaaacgacatcaatctggatattccttgggggattgatctgaccattgcgggccattcgggttctggtaaaagcaccttgttgcgattgttggcgactttattgacgccaactaacggaaccattctatacaacggtaaagcccaagccgactacgatccgatcgcttatcggcgtgaagtttcttactgcgcccagcaaccggcattatttggcgccacggttgctgacgatctgcggtttccatttatgattcgcaacactgaaatgccacgcgaacaagccgaagccgcgcttgaaagtgtcgatttggctaaaagtatgctcgatgcgccaacgcaaaacttatccggtggtgaacgccaacgagtcgctttgttgcggcatcttttcttcccgcctaaagtgctgcttttagacgaggtcacaaccggactcgacccggatactaaaacgattattcatgaacttctgaatcgccaaaatgaaaaaggcatcacgttgattcgtgtgacgcatgatgaaggtgaactgcagaccgccaagaatctcatgacgctggttgccggtcaatttgaggaggttgccaaggtatgaatagtcagttaatcgtttcgccgttagcacttttgttggctttagcgctagttgtgattgcattggtcattaacctcaaagaagatctgggcatgaccaaggatctgatcgtaggggttctacgcgcggtcatccagctaacggttgtcgggtttgttttgacctatattattaaagcggatgccgtttggctgactttagccatggtagccatcatcattttcaacgctgcctggaatgccaaaaaacgtgccggcaccattcctgctgcgtttgtcaccagcctgttagccgtcaccactgcaactgggttaacgctgctcatgttagtgtcggtaaaggccattcggtttattccggcacagattgttccgatcagtgggatgattgccagcaacgtcatggtcgcgatcggtttagcctaccgcagcctcaacaccgaatttaaagacttacgaccacaagtacttgaacgtcttgcattgggcgccaacctcaaacaagccagtcagacgctcatcgtcaatgctatcaaaactggcatggcgccaacgattgattcggctaaaactgttgggctcgttagtttaccgggaatgatgtccggcttgatttttgccggtatcgatcctaccaaagccattatgtatcagatcatggtaaccttcatgctgctaggcgccaccagccttggtagttttatcgcggtctatcgcagttacccccgcttttataatgatcaaaagcaattacgttagcggccttgtcctccgaaaataaaaagttgctgcagaagcgaatctttttgcctctgcagcaactttttatattgatgcgcttttaccagctatcagtaaggattctccattttgttatccggtaaatacggcccatattcaacttgaatcgtggtgtgggcaatgtcaaagctttctcgcaacgataaactcagtgcgtccaagaaggcgtcattgccttcagcagttgttcgcaccacatgtaccgtcaacgcgacatcagttgtactcagcgcccagatgtgcaggtcatggcaagatgcaacggttggataggcgttaaccaatgttttaaccgccactggatcgatttccttaggcaccgcggccattgctaaattaacggcatcccgcaataaatcccaagtcccgatcaaaaccacaattgcaactaaaatggacatgaccggatcaagccattcccagccagtcagcaggattaatcccccggctaaaacaactcccagcgacacgccagccatgtgcataaacgcaccacgaatgttcaaatcatgttgcgagccgctatgaaaaagaattgcagttgcgccattgaccaaaatcccggcaccagcgacgaccatcatccagccgccttcaaccggggcattttgtgacaatcgggtaatcgcctcgacaataatcgcacccatcgccaccagtaaaaatgccgcatttgctaacgccgctaaaatcgacgaactcttatacccgtatgtacgctggacagtcgggtgccgattggaaagccactccgcaaaccacgctaagcccaagcctaggacgtcgctcatattatgaatggcatcggcgaccaacgcaaccgagccaatcccgattccaaacgcaacctcggcaataatgtaaatcaaattaagcagaataccccagaaaaaggctttgtttggctgaacttgttccatcttatcatcagctcctcagtttccttttccatcatggtttagtgctacctaaaaatcaaccccttagccgatgactattcgttgacaggcaaaatggccgcaacagataaacctcacgacaaaatcccttcatgctgttgtaaacccgcatcgcccgagaatgcttctgacaaagaccaaacacagttggaccgctacctgacatttgagcgatttctgcgccgtacttttttaaccgctgtttcaatgcggtcatttcaggataacgacttgccgtaatggcctctaaactattccccattccgctaatcatttggttgaaatcatggttttgaaccccggcaacgacttcaggtgtattggggtgcaaaaggccggcctgatagtcaattgcattaagaatacttggcgttgacactgacacccgcggcttagccaaaacaacccaaaagttcggtaaacttcccaatggggtgaccacatcaccgcgtccggtaaccaaggccgtctccgagtaaacgcagtaaggcacatcgctatcaacctgtaagccgatgcgagccagctgcgagcgactataacctaactgccatagtgaattcaagccacgcaaaacggcggctgcgtcactcgaaccaccgcccaaacctgcagcgacgggaatgtgtttttcaatatgaatccgcgcaccttggcggatattggcatggcgttggagcgccaatgccgctttataggccagatttcgcggatcttcaggtaaaaaaccgctatctgtggaaacctgaatgctatggctaggcttgatgctcacgtaatcagccaaatcaactgatgtcatcaccatctgccactcatgttcgccgtcagcatgacgatacaaagcatccaaacttagattaatcttggccggtgctttctcgatcagttccatctaaccaccagtctctggcgatgcatgtatttgcaggtagatcagcacactgcaaacgccgatgcatgcatcaaccgtatcgttattattttcagtatactgttttgcgtccggattttcattgccgcgtgtcaaaaattcgtcaccttgtacagatcagtctttcaagaagatagcaaaaggcctcgatgccaatgacatcgaggcctgctcaaagtaaacgatttaatcgtcggttagtatctgaaattatgacgctttttcttcgccttcgaaggtgatcttgattgacttagtcagaagatccgcgtaactataagagacacgctcgaacgcattttcattctggtcgagatcgaccacaaaaatagccggataagtttccttcaaggtcccccgacgccgagtaaccttcttgcgtcctgcttgtgcaacgaccgttaaattctcaccgattttcccatcgagcttccgtttgatgcttgctagtgtgattggcatgcacttcacctcttgcaatatatcataacatgaatgcaagaaatttgcaattataccatgtgtttcttatttcggcaagatttttataggaagtaagcgcgagccggcgcggttagggatcggagtgtaagtggcctcaggcgtgatggcccgggcttggccattgcgcctgaggtccttacacgcagatccctgcgctggggagcgcgttatgggcctaaaggagaacgggtggccttgggcgtgatggccgggttttggccattgcgcccaaggcccttatgtgcaggcttctgcgccggggagcgcgttatgggcataaaggagaatacgtggcctcaggcgtgatggcccgctcttggccattgcgcctgaggtccttacacgcagatccctgcgccggggagcgcgttatggacgtaaaggagaacgcgtggccttgggcgtgatgacccgggcttggtcattgcgcccaaggtccttacacgcagactcctgcgccggggagcgcgttatggacataaaggagaacggatgacctcaaacgtgacaacccgctatcccgcaatacccaagccttcaccccgcaacgcctcatccaaccgtgcaaaatccgtaatcgccaactgttctgcccgcgtctccggtgcaatctccgccaccgagagcgccgtacgaatagcggccttattcggtttaccaaacaaagccaccagattattccaaagcgttttacgccgagacgcaaacgccccacggacaagccggtcaaaactgtctggattttttaccgctgccaagggttctgggcgctgggtcaacgtaacaatggccgaatccacatttggtgccggaacaaacgcatgccggctgacggtaaaagctgtcgccacatctgccaccagttgcacggcaatacttaaactgccataatccttcgatccaggggtcgcacttaatcgcgctgccacttctttttgcatcatcacggtcatgctgtgcagtggtaaatgtgcccgcaacaagtgcagtaaaatcggcgtcgtaatgtaataaggcaaattagcaacaacttttagcgtgtggttcccatcaaaatgtgtcgctaccagctcggtcaaattcgtttttaaaacatcttcgttgaccacggttgtattaggataatctgcaagcgtctccgcgagaatcggcagcagacgatcgtcaatttccaatgccaccacctgatgcgcctgatcagccagaaactgcgtcagtgcaccaattccgggaccgatttcaatcacatcatcttgctcggagacatcagctgctgctacaattttttgcaaaatctgcgggtcggtcaaaaagttctgccctaaccccttacgcatatgaaagccatgccgcttcaaaatggcattggttacggctggttgtgccactttttcatgcatggttattcgctccttcgttcaactgggcaactgcggctagaaaatctgcgcgactgatttgaaattcagtcagccgccgtaaaagctgtttgccatttgtataaccgatgtgcagctgttcgcctagctgttcccgacgctcgcgagcaccggttccaccgatcaaatgcgctgccaataaatcctgctgactgatcacttgcggagcatcgggcacttcagtaaacaagtgctggagtgcagcccgcaacgccgctggagaagcatgctcaaccccaagcgaccctttatgatccggcacgccttccgcccgcggtaaaaatgcatgggtaacacctggtacggcacgcgaaatggttttgcgaatcttttcaccaggaaagtcaggatcagttaagacgatcacgccccgttttgcttgggcttgccgaatccgcgccaatgttgcttcatcaatggcactaccgcgagtttcgatggtatcgatcctgccaaaagtttcttttaatcgcttagtatcatcgcggccttctacaaccacaatttgtttaatcgttgtcatgcgtcttcctttaacttgaaaattcggtgggcattatcccatgtctgtttagcaatcgtttctggggtggtttcgcgtagtttggctaaagcctccaccacatagcgcgtatagcccggctgattctggcggccacggtaaggcgttggcgttaaatatggggcatcggtttcaaccaacaagcggtcactggggattatcttggcgctggcatgttcttccggagcatttttgaaactgacgatgccggaataggaaatatacatccctaagtccaaaaaccgccgtgcccagtctgcttcaccggtgaaactgtgcataatcgcgccaaattcctcaacatgcgccgtttttagaagcgtataggtatcttcaaaagcatcgcggctgtggatggacaccggtatatgcagcgagcgcgccagttccagttggcgccggaatacccgccgttgaatttcacgcggcgaagtattccagtgatagtccaacccgatttcgcctaacgccaccactttaggatcagctaattgttccagcaatacggcttctttagcggcatcatagtccttgcttgattccggatgccaaccgacaattgcatataagttggcatattgatgggctaattgcagcgcgccggcgttcaacgtcgtatccgagccgacaatcgccattttcttcacgcctagctgccgcgccgcttcaatatagcttgcttccttgccatgataaggcgtgtcattcaagtgggtatgggaatcaaaaatgtccatcaacgcttactccttttccgttgctgccagtaattgtggcaacaactgctcaacttgggtcggttttctggccgcaaaaagccgttgtagtttggcaaccggcgactgggtcaaagttcgaattaactgtgccattcgtaacggttgttgtttaagctcgggattgaacaacataaaggcccagctaaccggtaaaatccgactcacatcggccaagtctttgaaggcaaccgggatttcaaaatgtaccaccactaagcagcccgtctgcaccaatgagccttctaaatgtggtatcgcaatattaggcaaaccactggcaatctgattcaattgcataccggaaggaaatgtctgctcccgggcaatcagtgccgcttttccctctgtctgcatcacattgcgggcaaccagtttgcgactaatctcatcaaaaaaactttcttgggttggcgtctctaaaaagtaaactaatggggttgtactaaactcagccaagcatttcacctatctttacataaactcaatatggttagagtatagcacgccaagccaagcagctcgcaggtggttttgggactaaagcttctattattgactgactttctttgagtttcatgaaaatgatcggcgaaaaatgtctattattgtcattttgttctatactaatcgtgtactgaacatttaaggattacctaggaggtatttttacatgtctgttaaacttactgctggtcagttagagcatttgaagcaattgtccaatgacaacaacgtcatctcggctttagccattgaccaacgcggttccctgaagaagatgcttgcagctgcagctaacaagccagctgacgaaaccacgattgttgatttcaagaaagctgtttctgaagaattaaccaaatacgccagcgcgattctgcttgatccagaatatggcctgccagctgccaaggttcgcgatcctaagtccggcctcttgctttcctatgaaaagaccggctacgatgcgactgaacctggccgtttcccagatttgattgataaccaaagtgctttgcgcatcaagaacgaaggcggcgatgcagtcaagttcttgctgtacattgaccctgacgaacctgatagtatcaacgatcgtaaatatgcgtttgttgaacgggttggtgctgaagctaaggctaatgatttgccactgttcttggaattagtttcctacgatggcaagaccaacgaaaccggcaccgctgcatgggcaaaagcaaagcctgaaaaagttatcaagatcactaaggaattcagcaagccgcaatacaacgtttctgttttgaagcttgaagttccggttgatcaaaagtttgttgaaggctacaccgatgaaggcgtaacaccggtttacagcaaggaagaagctgctaagtactataaggctcaatccgatgcaaccgatttgccattcatcttcctgtccgctggtgtttccaacgaactgttccttgaagaactcaaattcgctaaggaagccggttcaacctttaacggtgtgctttgcggccgggcaacctggaagccaggcgttaagccatttgctgctgaaggcgaagctgccggcaagaagtggctgcaaacggaaggtaaagctaacattgatcgtttgaacaaggttttggctgatactgctactccttggacagacaaggttgaaggctaattctttttaactaattaatcgtttaaaaaccagccacagatgcggctggttttttatatggtgagcgtgagccagcccgtttagaaaccggagtgtaagtggccttagccgtgatggtcgggctttgaccattgcaaccaaggtccttacacgcaggtttctgcgccggtgaacgcgttatggcgagtaagggccaacgcaaagataaatcaccgacaaccattgcagcagactggcacagtggtagactgatagatgaatgcgttttcttattttaggaggttgttaagcttgatcacaattgagaatcaacaatttaaagccagcattgccgaacgcggtgctgaactgcagtcactcgtcaacaaaaccgataactatgattatatctggaacggcgacaagactttttggaatcgccacgcaccgattctgttcccggccattggtaaatctaacgaagaccaatatcggctaggtgccaaaacatttccgatgggccaacatggttttgctcgtgactatgattttgaggtcagcgatcatagcgactcagcggcgacgttcacccagcaccaaaattcagaaaccttgaaaaagttcccgtttaaatatactttagccgttacttatatgctaaccgaagatggtctgagcattcattacaccgtgacaaatgatgacagcaattcgatgccgtttgcgttagggttccacccagccttcaacgttgcactgaaggcggatggcagctttgacgactacgatctgacggttgaaccgttgaatagcccgttgcagcgctttggtatcgggccggtaccgtttcgcaatggtgacgttgaagatattgcaggcgcagaaggcaataaattgccactcacacatgatctgttagacggtgggttagtgattcttgctaacagtgaaatcagcaaagcaaccttatcctccccgcatcacaagcacagtctcacgcttgatatcaatgacttcccttatctcactatctggagtcctgaacataaaaaggctccgtttattgcggttgaaccgtttgacgggttacctgaccaagccggcgaaccatccgattggtacaccaagcttggcaacaccacactctctgcaggtgccaataaacagcttgccttgaaagttgaattgcactaaacaatcttttgatgccgcctgaagtttatgcagacggcttttttgtgcacactttttgtacaaacaccatcactaagcggctgcaaaatagttgcggtacaatagcaccaaagcggtgaaaggaatgaagggttcatgcacattgcagtcattgatgatcaagcagcgactagagaagcaacggtcaagctcattcggcagttagcgcaaccgtcacagccattgcaggtggcggcttattcaaatgccgagcagttcttgtttgcagaaaaaccagccgatctgctgttgcttgatattaagttgggatctggcatggacggcatggcgcttgccaaaaaaatccgccaacatgatcccgaaaccgccatcgcttttgtcagtaactatgatgaattcgtgttcgatggttacgacgtgaacgcgattgactacatcctcaagccgcttacggtagcaaaactcaagcacctaattgaaaaggtagctggccagacgcagccaaaactcttggcattgcaaaccgctgccggtctagtacgcgtgccaatgtatgacatcagcgccatcgaagtcacggatcaccggcttcaagtccatacgcaaaaaaatcactatctggtaaacggacagttaaaagactttttaccgcgcttagatgacaactttattcagatttaccgctccatcgtcattaacctgaatttcctctcgcagctggataaacgaaccgttgtgatggcagatggcaccacttatcccgtttcccgccagcaggcaccgctagttaaacaggcattcttcaagcattttcgggggttgacccatgacagcaattagttggttctggctggtcgcctttgggttgctagtagtaggttgcatgtcgcagttatggtggatttttcggcgccagcaaaactggccggtgcgctggttaaacctcatcattgtcatcgtatcgttgagcagttggtggttatggccgcttccggttgtccgcggcttgctttttaccatcactgtgttagcaggcagtttggagttcatcttgattcgccaatttctcaacgaccaggatgcggtgtttgcccgcagtcttgataaaatgatggctcaatattcagaagaagtacaagaactttatgcgaatatgcgcggctggcggcatgattatcacgaccacctccaagctttaaaagcctacttagacaatcaagatactgctgccgcgcgccaatatctaaatgaactggaagacaagcttgatgcggttgatccactcgtgcattccggtaacgccatgcttgacgccatcgtaaatgctaaattgacgttggccgaacgactgcacattccggtaaacgaaaaagtcattgtcggcaacaccccactgatcaaggatgttgaccttgttgtgatcttaggaaacttactcgataacgccattgaagcaatcagtgaacagccaccccacgaaaaacgtcagctacggctttacatcggcatcgttaaacagcaattttacatctcggtcaccaacacccggccggccgatcaagtcattgactatcaatatgcctcaaccaaaagcgataaacgaggattgggcattcgccgggtcaataaattagtggcaaaatatgacggcatgatcaatcgtcagtatgaagcttcggtttttgtgaccgaaattgccattcccattcacgcagccaaaccgaccactcacgcataatttgcgtcagcgagtcggttttttggtaggttaaagtcaacgaggtgaatgcgatgaaaaaatatagcctatggaataaccttcgctggtactttgccaatttacgcaaatccaaacctgctttggcatggacggcaagtggcttggctcttgacaaggcagctgcggctttgctgggcgtttttacacctgcactgttggtcggtgccattaccaatcatgctaccttaggcgaattcgcccggctggcagtgttaaccggactaggattggcactgaccagtgaaatagcgtatctgattatgacccatgacggtgttgcaagttctgcagttcgaagtgacattggaatggacttccaccaaaagcagtgggatcttgattacgatcaaattagtagcggcacactccaagaactagcccacactgcttttaaaaaaggattgagttacacgttagcgggagccgaagccatctacatttacggtcgtggcactttggttgacctgactaccttgatcgtctttctagcgacactgtcgtttgcggttccgtgggttttcgcactggttttaatcagtgcggcaattagttacgccggtatgagctggtatcggcaatggtatcaacaaaataacgtcaggtggaacaagttgggacgccaacaagattacattacccgcaatgcctatgctttggaaaatggaaaagatatccgcatgttcggcatggccgactggtaccatcaccatctcgatcgcctgttgacgttgcaagatacctggcaacgccgcaactcgctccgacgcttcttaggcgaacaggcggggcaactggccggcttggtgcgggacgcaattgtttatggcaccttaattgcggcgattcttcgcgggcgtctttccatcgcccaattcaccttgatgtttggcatgaccaatagtttcatcaccttgctggatcaattactcactgattttaacggcttgcaaaatgccagcatcgacttacaagaggtacgcgaatttatggcactacaaccgcaaacgccggcacggacactgacaaaagcggagcaagctcaattagccaagcgtcctgtcaccatcacgttttcgcatgtgacttaccgctatccggaagcaaaaagtgccagtcttaacgatgtcagcttcacactcacagccggtcaaaagttggccattgtcgggatcaacggagccggcaagtcaacgttggcccggctgatgatgggactgctgcatcccactgaaggcaccattaccattaacggtttggatgcgaagctaataccgctagcagctcggtttgctttgttcgcaccggtttttcaggaaaccattgtgctggctcagagtttagccgataacgtagcaatgaccaaccactcagacgcaacccgcgtcatgagcgcattgaaagccgcaaacttagacgcactcgtagcaaccttaccgcaaaaagccgccacccccatgacgcgatacaccagcgatgatggcgttgaattatccggtggtcaggcgcagaagttgatgctggctcgggcattatataaagacgcaccagtgctcattttagatgagccacctgccgccttggatgccattgccgaaaatgaaatctatcaggattacgcccaactagcggccggtaaaacctccctgttcatctcgcatcgactggcttcaacccgcttttgcgatcgcattttattcatggaccacggacaggtacttgagtccggcactcatgaacagttgatggctaaggccggccactatgcccacatgtatcagattcaaagcaagtattaccaaccagctgcaaaggaggtaacggctaatggcaacttctaatcattctgaaccaaaaccttcaaagcaaaccgcaaaccgggcactgcgagtggttcgcatcatccaccagctcgataaattagccatcccgattgaatttctccgcgctttgacaactgtcggtatcccctatttaaacatcgccttcttaggggtggtcttgaatcaattgcagcaacatgcaacttttcggcaagtcattctcctcattggtggctttttgcttgccagatatctgttgcaacttgccagtaattggtttgccaaactggctgaagaccatgagaccggcgtaaatcgacgacttgatcgcgccaccactgaaaagctgctcaccgtgagctatacaacgcttcaagatccgaatatgcgtaatcaatacgccggtgccgtagaaggtaaggcttttagtggcgggatcacatcacttatgaaagatggccttcaagacttcttctcgctagtgattgccatcggttttgcggtcgccactttaatcaacctcacgcaggcaaccaatcatgcagctacttggttcaatgatgcccgttatccgcttttgatcatcgcgttacttcttttcccaatcatcgtggggagttggagcgttcatcacagtaatcagatccagcaacaactcatcagaaaaattctgccaagtaaccgccaattcacctatttttcaaacttcacgcaaaatatggacaatcatcaagtcattaggctttatcaggcatccgcgcttgtcatgaagaatgaacgtgacagcaatcaccgctttatgaatcagcttcagagtggctactggaaaattgctaagttcggtcattggcccaatgttgctattgccttatccgtcatcggtttgtacatccttgtcggagccaaagccttaatgggggttctcgccattggcagcgtcatgattgccgttgggtattttcagcaactcatgacagtcgcttatcaatttctccagcaagttgccatgtatgtcaacatgattgactatttgcaattctacgttgattttctcaacttgccggaccatgatcagtctggcacactgccagttgaaaaacgcaacgacaacgaattcgctatccagtttcatgatgtcagcttcaaatatccaggcagcgatcaatgggccttgcgccacgtgaatctgacactgaacatcggcgaacggcttgccttagtcggtcgcaatggcagtgggaaaacaacgctgatcaaactactcgtgcggctatttaaacccactgaaggcatcatcaccttaaacgatatcgacattcaaaaatacgatgaaaacgaatatcgcagtcttttgggtgtggtttttcaggatttccggctttttgcctatagcattgccgaaaatgttgccgctactgctcaccccgatcgtgaacgggtctggaaagccctgaaagtagccgatgtagccgaccgggttaagcgtatgcctaaaaccatcgatacgccgattacgacggcgctgagtgatgacggcgtgaccgtttccggcggtgaagcccagaagattgccattgcacgggcgtggtacaaggacgccccgatcatgattcttgacgagccaaccgcagcactcgatcccatctcggaatatgaaatttaccagcgctttgatgagctcatcgagggtaaaactgccatctacgtctcccaccgaatgagctcaacccgtttttcgcaacgaattgttgtactcgatcacggcaagattgttcaggacggtactcacaacagcctcatggcagaacccggtatttatcgcgatttattcaatgcgcaggcgcaatactacaccgaagatcgcatcaaagcggctcgtaaaaaagtggcaacgacaacaactgcagtggcggattagacaacttattctgacgtctcccagaaggcacactatgaagaatcttggcatggtgtgccttttattatttttaaaattctaatgtaaagtttgcttgacattttagtcaaaagagattatattacatgatgtaaagtaagctttacaaagcgaggtgtagcttttggaaaatcggatcgaaacattgcgcaatcaacatcacttaacgcaacaagacttagccgatcgcttagaagtttcgcgccaaaccgttagttctctcgaaaacggcagatataacccctcactcggactcgcatttaagctttcacatgtatttaacctacccatcgaacgcatttttatcgatgaaagtgcggattcgaagttgctataacccatcctgaatgatcaatcactgtttgttttaccaaggaggtaaccgtcatgaaaagaattttgcacgttatgcctttaacgagttggttagcgtggtttggcgcttttggctttgccatgttataccggtatagcaaagccattgttccagaaagtatcgaaaaggttcttttggtaacagttgcggtccttgtcagctatgctatttttgcaactcagcagcgaaccgaaactcagcgaatccaaaagctgcaacatggatcgctttctgataagaggcttgctaatgagatgaacgatgagcgcaatcaaatgattatcggcaaagcagccgttctctctattaagtggattgtccttttgaacatcgccgccttgtttgtcatggcagcattggacgtatcaagcgttgccatagttcttcttgcactaagcactattatgatcccaattctcaatatcatccttcaggtacacttgaatcgaacaatgtaaccataaacgcataaaaagggcacttcattttgaagtgcccttttattatagcgttcaattaaccaaccaaactgccattttccaggttttctgagacttccagcaatgtgatcttcttgccgtccaaactttcggctgataacagcatcccctcggacatttcgcctttaagtttgcgtggcttgaggttgaccacagccatgacctttttgcctttcagcttttggtaatccggataaaattcacgaataccggacagaatctggcgcgtaccttcatcaccagcgtcaagggtaaacttcaacagcttgtcagcgcccttaaccggttcaacgtttaagatttctgccactcggatttcgctcttatcgaattgcttgaagtcgatttccggcttgcgggtcttttcatcgacagctgctttagccgtgccaggcgtcatcttgctcttgatatacgctacttcttcttcagcatcaagccgcgggaagatcggtgtgccttgttcgacgactttggccccagcaggcaaggctccccacttcacgactttgtgatcttcgttttcgtgatctaagccaagttgaccgaagatttgaaccggtgcatgggtcatcactggctgaatgagtaaagcgatcaggcgcaaactttcagccaagtgtgccatgaccgaatcaagctggtctttcttggctgggtctttggcgagtttccatggttcggtttcatcaatatacttattggcgcgggaaacgatcttccagacctgatccaacgcgtctgagaaccgtaattcatccataagcttgtgatattgcgccaacgctgcctgcgcaacatcgccaaggtcctgatcaaatggggtaacatccggcttgaaggcaggtaaaattccgccttcatacttgttaatcatggcaattgtccgattcaacaagttgcccagatcgttcgccaaatcataattaatccgatcaatgaagtcttcaggtgtgaaaatgccatcgttaccaaatggaatcgcgcgcatcaggtagtaacgcagcgcatccagtccgtaacgttccacaatcatgtccggataaatggcattgccttttgacttgctcattttgccgtctttcatgaccagccagccatgtgcgtaaatctttttcggtaatggcaaatccaaggccatcaaaataatcggccagtaaatgatgtggaagcgaacaatttccttcccgattaactgaacattagccggccagtatttatcaaataaggcgtgatcgttgctgccatagcccagcgcggtaatatagttcaacagcgcatcgacccagacgtaaaccacgtgtttaggatcagacgggatctgaacgccccaattaaaactggtgcggctcattgccagatcttctagaccaggcttgatgaaattgttaatcatttccgtcttacgcgatgccggctgcacaaaatcaggatgctcatcataatacttcagcaaacgatccgtgtacttgctcatcttaaagaagtagcttggttcatgaaccagttgaacttcgtggccagatggagccttgccgccaatgactttgccatctttatcacgataaacttcagacagctgcgactcggtaaagtattcttcatcctcgactgaataccagccagtgtattcgcccagataaacatcgccttgcttaattagccgttcaacgatttcctgaactgcctcgacatgttccttatccgttgtccgaataaacttatcattcgtgatctcaagcattttccacagttgcttgatctgtgctgccatcccgtcaacataagcttgcggtgtgacccctagcttgtcggctttttgctcaatcttgaggccatgctcatctgtcccggtcaggaagaaaacatcataacccatcaaccgcttatatcgtgccaatacatctgccgcaatggtcgtatacgcattgccgatatgtagtttgccagatggataataaatcggtgtcgtcacataaaaagttggtttgcttgccatgcaagtgcctcccgtacattaattcagaatgagtctagtataacagagtgtgagcaggaacgcttagaaatcgaagtgagcgtgaaccggcgcgcttagaagtcggagtgtaagtggcctcaaacgtgatggcccggttttggccattgcgtttgaggtccttacacgcagacttctgcgccggtgagcgcgttatgggcataagctggaacataagcggccttaagcgtgatggccgggcttggccatcgcgttcgaggtccttacacgcagacttctgcgccggtgagcgcgttatggtgagcgtgaacagggccgctttgaaaccggagtgtaagcggcctcaggcgtgatggtcgggctttgaccattgcgcctgaggtccttacactccggtttctggccctgtgagcgcggttatgggcataagctggagcacaagcgatctcagacacgatggcccgttccacctttatccagctactcttctcaagccaaaatccatacgccccaagcagtcaatcatttgccgccaaccattgatccagaacatgaatgaactcatcatgttgatctagcagcgccaaatgccgactattagcgaacaagtgccactttgcaccgggaatatggtctaccacgcttttggcaatcaaaggcgtgcacagatcatccgttccgctcgtcaccaaaacaggcacatggattttgtgcaactggtcggtcacatcaaaatcactgatggtaccattttccgtaaattcatttggcccttccgcaatcagactagcgcgtttcccattcgttggtcgacgtaatggttcaggcgaattttcatctggatcatcccagcaatatttttccatgtagcgatcatttgcggctagatacttcacgttggtaaaatcaccggtgcgctccgcttcagcaattgccgctcggtcttcgtaactaagatacttgattagccgatgttgctcttgaacccacaacttaattgaagccggtgagccatcaatcatgacacttttaatgccttgcgggtcaaagctagtcagataatacatctccaacatcccgccccatgactgaccgagcatatgtaactcatccaagtgcaggaacttacgcaaagcaacaagctcttcggcccaagtttccttcacataaacccccggatcttccgggagcgatgacttaccacagccaacctgatcatacataatcaactgccgaccggtttcggcatagtcatccatgagctcaaaataattatgcgacgaacccgggccaccatgaatcaacaacggcgctttatcggcactaggttcaccgacaatgcgatagtaggttttatattcatgaaacggcatgtatccttctttaatcttcacaaccatccaaacattcgacctttcaagaaagtgagcgcgagccggcgcggttagaaaccggagtgtaagcggccttaagcgtgatggcccgctcttggccattgcgcttaaggtccttacactccgacttctgtgccggggagcgcgttatggtgagcacgaacaaacggtcttctacgctagcaaacacgttacgttatcgttgccaaaaatcgcacgcacgcaacctaacgtacttactgcgattttactacgcatcggcaatactgtcagacaaaatatgaaaattgtctaaaaaaaccattaaaacgctaaaacaaatccaactgccgcggcgccaacccgggaaaatccagtcctaacatatcaatcaactgctgagcgtttgctgccgcgtcatgtccgccattgttattgaagataaccgtcacatttttgcttttcaaatgcttcacgattaaggcaaacgcctctaactcggcttgactgtaccgataattggttcgttccgttgtcttagcaccgctttgcccccaagcctggttgcgcccatgtaaccgtaaaattgtcagttcagggttcgtggcaattggcaccaatgggactgaaccgctcacggtctgcgcctcatcgaccaccacatgaatgtcgccagcagctttgagcaagtcaatcgttgcggcacgatacgccggtaagtaccaactaggatgacgaaactcaatagccaccggcagatcaggcagccattggttcatattttgtaaatatcggacattttccgccgttacgccaaagtatggtgggaactggcacaaaaccgcttgtaattgatgcgtggcagtcaacggcgccaccatgtcgttgaagcgcgaaaattcggccaccaagtcttgcgttgcggcatgtttcgtcatcaatttgcttgctttaacgataaactgaaagcccgccggcacctgcgcctgccaccgtcgcactagatcagcggttttcaacccataaaacgtggtatccagttcaatgaccggaaaatactgggcgtaatcagcaaacgtactgcgcttaccattggccgccaagctagggtgatcggccacgctggttaatccgaccctaatcatggaactcaccatctgcaattcgaaatgcctgaagcgtgtcgccgttaaagtaggaagcataatcatgtttttcgccattcaacgcatatttcagcaacggctgcagatccggcaccaacccgggattatccgccagcagccacgttttggaaaaagtcgctaaaataccttcccgcgtcgcttgcggtcctaaaaacggctcatcggttttcccgaaaaaggcgtaaagctcaccccgtaattggccatcaacatgccaaaaaacgcgcccaacgcccgttaactcatgagcagggatgataatgtggctttcctcctgtaactcccgtgctgcacaaacagcaggtgtttcatcaggcaggaacttaccacccaacgtattccacatcccgcgatacggtggattcgtccggttgattaacaaccaaccacttggcgtttcaacagtcaccaacgtatattttttaaccatacccgaaaaactccttattaaggcgtaacattcaaattaactctagtaaaaaggcgccgatttgatcagcaccctcaacgttggagtaaaacgttagagaataccggtcacaatttggcgtctttttatgcatgacatcaatgctactggattaatcttacttcatcttttccactgtagctttaatgatgcccgcggaatgaacatacttagcgcgctcttcatcggtaagcttcaacttaggcgtgttaacaacaccgagcttgccaatcgtcgccggatgaccgatggcgataccgaattcaggatcatagttagcgcacggaaaaatccgcttggcatcactgatgatcgcctgcgtcatttcggttgcaatggtggcaatgccgtagctggtataatgtttggcctgataaatcttccagccgccagcccgcgccgcatcagctaattgatcataatctacttgcgcataatccgtgattggctcgttgttaacccgcaccgttgaccacgccgtaaattgtgactcgccatgctcacccatgttataaccgcgaacatcggcgacattcacatttagcgattcagcaaccgcgcgccgcatccgataagtatccagcgaggtgccagtgccaataatctgggactttggtaggtcaagtaaatattgccaatagctggtgacagcatcacaaggattggtgatatccagcaaaacgccatggaatccggacgctttcaactttggtgccacatcgtctaatgcttgttttgacgtttgggtttcaccaattcgatcgccgtttgaaatcgcaccgatattgccaaccgcggaaatgacaacatctgcatctttcaaagcatcgtaatcattgacgataatctcggtataagtcggcaatccaccaagtgcatccttcaaatcataactttcgccttcagctaaatcagccttttggtcaattagcaccagacgatccgcaatccccttgctaacgagattaaatgctgttgtcaccccaacatgtccaataccgataataccaatggttcttgccaagataaaaaccccttttcacaaagtttagtttttcgggccatgtagcaaatgccgttcaacccgctgatccgggatggcccacaagagtaacattaccaagtccagtatgatcgttaacggtggccaaagcaaagccaaaatcatggcaacaaatgcgatgatgatcgaaccgattgctttccagttatgctggcgattgtataaagcagccaattcagagtgtggtccattaactcgccgcaatgtctctaccaacaatagataactaatattggccattaaaaccacaaagccatagatcaattccggtccaaacgcttcaacatgcccttcgccaacccagctggtggcaaaaggaaacattgaaatagctaacataaatagcgagttggcccacattacccgccaatcaatgcgcttaaccagctgaaaaaggtgatgatgattattccagtacaccatcaacgttaaaaacgagaccaggtaaataccaaacacgccgcgaagttcccaaagcgaagccaatgaaccgctgtggggcggatttaattccaacaccaaaatcgtcaaaataatggcaatcacagcatcggtaaatgcttctagccgtcctttgttcacaagccattccccttttcgtgcaccttgtaaatgatcagacgtgcaaatcggcaaaaatatcggtggcatctcccaataccatgtggccaccttgaggcaaggcgatctgctcccgattaacggccacaatcgtcgcgtccggttgcgcataaccgatgagtccagcaaatggataaaccacaaaactggtgccaacgacaatcaataagtcagccgacgcaatcgcgttaatggcggcactgaccgtatccgggttgattggttcgccatataacacaatatccggccgtaaaataccgccatctgctgcgtgcacgtcgcttttcaaataagtctgataatcaaaatgttggtgacactgctgacaataaatgcggtacagattaccgtgaaactcgaccacatgcttggctcctgcttggcggtcaagtccatcaacgttttgcgtgacaatggcgcccttttgattactaatcgccgccattttttcatgaatcacattgggtttggcatcagggtaatacatgttgttcacgacgaattcatgaaaatcttcatgatgtgcctgcagattatcaatggaaagcgcgtactcgggatcaaccttatcagcatacaggccaccctttgagcgataatccggaatccccgaagccgttgacacccctgctccggtcataaacgtcacatacttagcctgagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgccaaaaataattttgtatttcttaacattctacggtcgaaaggtgtaatattattctatataaagattgatagaaaggtgtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttctcggacagcggcaagacgaaggcattttggtcatcacttcgacccatggcaacataagcaggctgcttagtgtcccgatcgcggtagccactgtgcttgattaggtaaacctgatccaaggtgagtcgcaattgccgtttggataaaaccggtgacaacgtagcgaattcctgatcgtttgtgggttgatagcctagttgctcaattaaggcatcaaagcggctaaacaaatgcacgatggcacggcgcaacccaaacggtgaatcgagtttctgctcgttaatcaactgaaaaagttcttgagcgtaaggcaatgcttgcgggtaggcagctgccaaatcagcgggcagcttgccatctaaaaagcctaacagatcaagtaacgataaaattcggtagatgaccaattgatcgtcagcttcagcaggtacattttgcttgaatccggctaacacttgcgccacgactgcatccgtgattaacccgtgttcgcgttgccatgccaccaccaacatatgcatcgccgcattatacaaagcggtactggtggcgtaaagctgatcatcgacttgaggatcaccgcttagcaaatgaaattgcaactgcgaatagcctttcatctgatacaacaagtgaagtaattcgtgactcagtgtgtaatccgcattcgttgtatccgtcaccactacctctagcgtaccatcttttttcaatcgctgatggctctggtcgtgagtcaagaccccacttgcctcgccttgaatgaccacttctaacggatgatcatagtgttgtttaacctcgtcaagtaatacctgaacattttcttgcatgccaataattctccttttgcctgcgtgatcggaatattgagccaattaagcagtcatttttccggtaacgattggctttcatgtttttgatccactatcattaaggtagcgataaaaaggaggaaattcaaatgaaactatccgtaccacttgttaacggccagcttgatgatcgttatggcaaacatgctaccggtgctgatgttaaaaacggttacccgattacgagttttccgtttacgattgaagatgcccctgcaggtaccgtcagttttgccctttggttcctcgactatgatgccgttccggttggcggtctgccgtggattcactggaacgcagccaatattccggcatcggtcactaagattcctgctggtgccagtcatcataacctcgtgccgatgattgaaggtaaaaatgcgacggccggtcatttggtgggtaacacggatccgtttacccgggaaggctatgttggcccgcaaccacctgacaaggatcacgattacacgttgattgttttcgcgttagatactaagttaccactgcaaccgggtttctggttaaatgaagcccgccatgccatgaaaggtcatattttagcccaggcagaagttgacctcccatcacgggtttaagtgcggggttgctaaaaagtaagttactcaaaaagcctgctgatcagtttcagcaggctttttgaatttagctcaactttgcaactttacagtccagtccttcaactgccatcgccggtgttcatccacaatgctccggcaccgaccgcggctaacaggccaatgccgataataccgaccaaggcaaatttaaaaattgcaaaaccgccgagtgcaaacagcgccaagctgataaacgggtgccgcaaaatcgcaccgaggagtttaacaaccaagaacaggataataatgacggcaacaatagcgccaatcgtgatggcacctgttagcgtgtgtccgttttcgctctgtgtacttgccagcatacttggtaacatcatgaaacctcacctctcttaatggccaatcccacgcagctgtccgatttgactaaaacatgctgcgaacccactggacaatgccactaaagaagctaacgatgccgtcccagattttctgtaggaaattacgattttcctgcgtattcaaactactattaagcttgtcgaataagcctttagctgaattttgaattgaatctgccagtttgccagcctgcgctttaaaatcggtattcttcaaggaaccggccttttggacattcactagcaagttaatgattaattgccgctgattgttattaataatcgtggtcagattattctgtttcagctgactgtcaacgatattgccaatttggttctgcgacagggtttgctgcccattgttactttgcgaagccatttgctgtttggctccggcaactgcattgttcagctgtttgtcggtatagccatctttgcctttattagcctgcgtgatcgaactcagcgtattgacttcctgctgagcggcattaatttgttggttattcaggttctcgccattttgggcaaacgctgcataaacccccgccaacgcaccggagccatcgattttgaccgcactggtgatgtataaattagcattgctgaccccagccgtcaatgcggcgttacggtattgatctgccgtaatcgtggtaatgttattcgttccgttatacggcacaatggtgacattaataccgccattatttgtcttttgtactaaggcactggaccacacgccggaactttccgtaaacgagctaccagagggattgagatacttcaccaaggtggcaccattgaccgtcaactgtgtggcattggagacgcccgctgcgttttgtaatgtgctcagcgttccgtttttctggtcggttgtcagcgaagaccctagcgttgcaaccggctgggtccaggcatcatcagcacgcacgatttgtggtaccgctgtaatcaatgccagcccagccgcagctagtcccagccatttaatcagttttttcataactcaaaaccgtcctttaagttgttacgactattatcgctgatttgctgcggctcgtcagcaaatcagcattcggtttaagcaatgattaattaatgttcccgctgattcacggctcgggtgttcaggtgatcgtaaagtgcgccttcacgtaacccaaactgtgaaaaggttaagcgatcagaatcaaggtaccgaatcatcgaaataaccggcatgagtccgccgacaataatgtcagcccgatatttggacaatcccggaatggcttcgcgggctgccaggtcggagctgagaatttctttaaaaatattattggcctgctgtgtcggcatacggtaaccgtgaatggcttcaaaatcggctaatttttccttacgccgttcgatcttcgccaaggtccgattactcccgcccaacgcaataattggcaggttttgcgcgcgccgtaaccaccaaacactattaaaagtttgctgaataaaggtgcttagcgcaaaatattcggcggctgaaattacatcaggattcaaaaaccgctcagataagttaaccgacccgaatggaatcgataccaggtgttgcaacttacgattttgaaccagaatcaattccgtcgaagcaccgccagtatccataatcaaggcgttttgaatcggcaacgtattgataacacccagaaaatcgtattctgcctcacgcgtacccggaatgacgctaatcgttaaaccggcttcgtttttgacccgtttaagaaagtccttttgattcttggcctcacgaacggcagcagttgccacggcttttagatcaatgtcatcgtacttatccagttcggctttaaacccttgcagcgccttgagcgtccgcgccatggcggcaggttgcagaatacgggaggatcccatatcttctgacaagcgcaccatttcttttagccgtttgacgggcttaacgacttcctgctcaattgaccagattgtcattcgtgcagagttgctacctagatcgatgactgcgaagtggtgcgtcatgcatcatcatcctcctttggtgctgtcattgggataaacgtgtgggttgcgtgtaagtcctcaggtgcctgatcaatttcttcacgtcgtaacgcctcacccatggccacagcgtgttcaatgaagtaagcctgagcgttgagttttgtcacaccgcgcaattgtgcccgggtccaggtactgtctggctgtaaaatacgcgttttgacgttatcatgccacataatatcgaaaatcttgatgatccgttcccgaatatcatcttgcaaaatcggaaacagcaattcaacgcgccggcttaaattccgattcatcagatctgccgaggacagatacacattttcctgcccgtctgcataaaagtaatagatgcggctgtgttccagtaactggccgacaatggaatgaacggtaatattatccgaaacaccggggattccgactttcaaattgcaaatgccgcgaatcagtaaatgaatttcgacgccggcatgcgaggcttcgtaaagcttctcgatcatggcggtatcagacagtgagttcattttcatttggatcaaagctttgcgtccggccttagctgccgcgatttcttcgtcaacccgatccattaaataatcacgaatgccaagcggcgcaatgactaacttgtggaaataaggcggttcggaaaatcccgatagcatattgaaaatgtttgacgcatcttcgccaatttcgttattgcaggtgaacaaacccatgtcagtataaaggcgggcggtgacatcgttgtaattaccggttgccatatgcatatagcgcttaatgccatcttcttcacgccgaaccactaacgcgagcttgcaatgggttttcaatccgactaacccgtaaataacgtgacagccggcatgttcaagttcttgcgcccagtggacattattctcttcatcaaatcgtgcttttaattccaccagtacagtcacttgtttgccattttccgccgcttttttaaggtaacggataatgggtgatttgctcgacacccgataaagcgtcatttttacagctaaaacttgcggatcctgagcagcttcccgaataaagtcaacaactggctcaaagctgtcatacggatgctgcatgaaaacatcacgttctttaatcacatcaaaaatcgaagtgtctttaaatgccggatcgatatacggggtaaatggcttaaagagtagttccttatgtccatgcacctgcttaaccaacttactgagaaagttcaaatcaatcgggccgtgaatttcgtaaacatcttcttccttgacgttcatggccttggtcaggcgtttgcgcaggtgtttacccatccctgcttcaatctccagccgcatcactttaccacgttgacgcttcttaagttgtgactgaatctccttcatcaagtcagaggcatcttcttcagccacgtccatatccatatcacgcgtcacccggaaagttgccgtttctttgatatcggcgcctacaaagagttcgcccacaaacatgcgaatgacctcttccagcaaaataaatacgttatcaccgcctggaagccgcaagacccgtgggaacacatcgggaacctgcaccatcgcaaacgaccgtgacttatcgtcatcatcgtccggccgcacaagtcggattgccaaattcaggctgttgttactgagaaacggaaagggccgggttggatccactcccattggcgtcaataccggataaagctcatagtgaaaataatccgacacaaaatcctgttgcttttgggttaagtctttggcatgcagcaactgaatatcgacagcattcaattttggtatcaacgagcgtaccagtgtgttgtattgtttttcgaccatttcgtgagcagtttttgaaatggcatcaagctgttcctgaggcttcatccctgcagcatcaggcttgtcgtaattaaccgtcaccatctttttcaatgatgcaacgcgaatattgaagaattcatccaaattactttgggtgatgcctaaaaatcgaacccgttcgagtaagggattatttttatcccgggcttcttccaacacccgatcgttaaacgccaaccagcttagttcgcggttattaaaataccgcggcttcgaaaaatcaagctttttcataacgtgtttcgtcctttcagctcaagtcctactccaaaaacctcggagaaaaattcacctttacgcgccaaggtccagcgttcaagttcaatatcatcattggccttcgtcgacaacaccactttgtctggcttcagcgaaacgcgcattcgttgaatcttttgctgccgcgatgcatctaaactgtctgctacccgtaaaatggctgatagtttggcgacaactaagcgattctcggtcgacatgatcgggaagttcttcaaatccgactggggggttaccgaactgtgaaagcgcgtgatggtagcgaccatggtgacgtccagtgcatttagacccataatttcagaagccttaatgatgtaattcgaatgcgcatagtgtttgtgcgtttcaatgtaactaccaatatcactaaccgttgccgcaacctctagcagcagccgttcatgcttgcccatcccatgtaatttcttgagtcgatcaaataattgcaaggcaaatgtacgggttgtctgcatgtggtcacaatcaacccgataacgtttggccaaattattagcgctgatgacaatttcttcatctggatcaaaccccagctttttgaagccaccagcatgggccgcgtgcacttccaaaccatcaatcgcttttaaatccgaaatccaaattgattgactgtttaacgtttcaatcaaccgataaaccaacaggactgtcggtaaaaccaatgacgtttgatttgacgttaaatcataagtatcggccagatattggtcagaggcttttgtcacttcatcataaagcaaatcaaagccgggacgatcagtttcaacttgccgcttaccttctggaatcaggttttgaaaaatcgacaagctgctgcccattaaaatcacattggtatattcaaccccttgtggcaataagcgcataaaatccagtaagcgactgtcaatataatcacgcataacctcaacgtaattggttaccgagcgctgaacatcactcataatttcatacacccgcaacggtcccagcgacaggttacgtgaaaacccaaacgttccttgactaaaagtcgtcaactcgactgaaccggaactgatatcaataagcacggttcctttttgggtaatcgtttcaaactggggaaacttgaccataatcgcctgggtacggaaaaatgcctcttctgacaaagaagtggttttaatgagccagccagtacgcgtgtatagctgatcccgaacaaactcggcattatccgcttctgcccagctcgtactggcataaacattaacggttgcaacgccatagtctttaaagatctgatcaatagcgtcaaaggcctgcacaatggtatcaacggtttccggtaaaatttcatgttcagcataaaaatcatcaccaatagcaactgggtatttaccgcgctcgattgccttaagcgtccgtagattcgtgatactaaaaagaatcgactgtgcgccaatcatcacgaacccctgtatattgtttgccatgtccgctccatccgtttcttctgaattttccaaagatcattaatgttctaatgccatgatagcacggctattatccgctgtgagaatttttagacaagccttattcaaagccgttttctcaagcagtttcagtttaccaaagatcccatcatttcttttataaataatgagcgatatttatttcttctcagatagccatcaatccgcaatccgtgttttgcgcgcatccgctggggtcatcacctcaactattggtatttgcgtaaaaagattgtaacgacccaatcttttgcgcaagcgccatcatttttgtgatagtcttaaatcatcatgaaacctttctgaaaggaagtctcacaattgaaaatgatcaatctcgggcgctccggcttaaacgcttatgccatcgctcttggcgtcatgcgcctaccgaatcttgatcgtccgcgcgcaacggaattgctcgatgctgcttacgatgtcggaattaacttctttgataacgccgatatttacagtaatggtaaggccgaacagttattcagtgacgcactgaaaaaagcgagcttcacccgtgatcaagtcttgattcaaaccaaagtcgggattatcaatgatcgcaaaagcatgcaccgctatgacttttccaaaacgcatctggtgacggctgtcgaccaaagtctaaagcgtctgggaacggattatgttgatagtttactgctacaccgtcccgatccgctcatggaacctgaagaagtcgctgaggcgtttcttcagctgcaaaatgaaggcaaggtgcgtcagttcggcgtttccaactttaatcctgctcaaatcgatttgttgcagcaagctgtcccgcaacgccttatcatcaatcagctgcaattttcgcttatgcatactggcatgattgatgccggcatgcataccaacatggctgatacacgttccatcgatcatgatggtggccttttgccgtatagtcaacaacatcatatgaccattcaggcttggagtccgttccaatacggtttctttgaaggggtcttcatcaataatgaccaatttcctaagttaaatgcgctgcttcaaaaactagccgatcaatacaccaccaatcctaatgccatcgcggctgcttggcttttgcgcgttccggcgaatgtgcaggttattgccggcaccaccaaaccggcgcgtctgcgggcgattgccgaggcagcagatatcaccttaagccgtcaagaatggtatgatctttattttgcggccggtaacgacctgccttaagcctaaatgccattctgattggcagctatcagacaccaactcgtaaatgacctaaaaattgacacatttaatctttctataaagggagtttcgcatgaagaatcgactcgatgatattacagatttaatggcacttggtccgactccggatgcccgtgacattcagcgacgtcaaaccgcccaccgaattgcaattgcagacgcttggcaaattcaaccaggcgaaaacatcttggaaatcggctgcggtcaaggtgacttaagtgcggttttggcagatcaagtgggtcccagcgggcatgtcaccgggatcgacattgcttcgcgcgattacggtgcgccgctcacactcggacaagcgtgggatcatctgttaaacgggccgttagcaagtcggctgacggtacactttgataccaatctcgccgccagcctcggtccggttgccaatcaacattttgaccgcattgtgatggcgcatagtttatggtactttgcatcggccaatgcgtttgccttgcttttgaaaaacctgcgcaccattggcgattatgtcgatcttgccgaatggtcacttcaccccaccgcgcttaatcaaattggtcacttacaagccgcgatgattcaagggttactttatgcgattgcacctagtgatgttgccaacattcgcactttaatcacgcctgataccttagcgcagattgcccatgataacacatggtcctacactgctggcaagctaatagaatgtccggatctagatgatgccaaatgggaaatcgccaccactaaggctttattgaccgagctaaaacttagtaccgatttgcgtgatcgcgtaaagccgcagctggaggccatgcagcataatggtaccgctagtttgcccacatttaccggtcgaatcacgttctaatgcataggaggcgtcagcatgatcgaatttgttcccgccaccaccgcagatctgcccaagattgttgccatttataatgagaccatccctacgcaccaggcaacagcagatttgcaacctcaaactgttgaccaaaaagctgattggtttgcagcgcacaatgatcattttccggcatggatgattcaggttgatcatcacaatgtcggctggctaacgctttccgcttacagtgaccgggcagcgtatgatcaaaccgcggaaatcagcttgtatctggacatcactgcccgcggtcaccatatcggcagttcggccttggcgtttgtggatcaagaagcaccggctcgcggattgacaacgatcatcgcaagaattttcggccacaactcggccagtcggcgtttatttaagaaatttaactacgaccactggggccatctaccagctattgccgatctaccagaaggaaaagccgatctggaaatttacggcaaacattttaacagctgattgggacacctactaacgaaaaatttcctactaaggttaatcgccaaaaaaatcagttcttcctgcagcccactgacttaggaagaactgatttttatattctatcatgtcactttttccataatggctacttctacgctttttcccctgttttcgtatcttcttgctgtctaatccgccgcatggtgcggatgtaggagctgaccaatacaagcacgctgccaagccatgccaggggattggccgccgatgccccggcaaagccaaacggtactacaaggaaaatcgccgcaaatgcccgcatacctaattcaaaaaatccggccacagtcggcaccagcgtctgtcccaatccttgaagcaggttccggacggtaaataggatggctagcagccaatacatgctggcattgtagtggaaatacgtttgggccaaagcggtaacggcgggctgattcggtccgagaaacaaattgactaatggtttactaaagacaatgatcaaggcacccaacaccaacgataagccaacattgaccaacaaagtttgatacacgccgcggcgaattcgaccgtaagccttggcaccgagattctgcgcggcaaacgttgccatcgctaccccaaacgaagctgaaggtagtgtcgcgagctgatcaatccgaccggccgcagtataggcagcaaccgcattcgtaccaagcgtgtttagcatcacttgcaagataacagcaccgattgcaatgatcgacatttggaaccccattggcaagccgacttttaagtgtttaacaatatcctgccaatcaaagcgcaagtcgctgcggttaatgaccaacaacggaatccgcatgcgaatatagatccaacacagtaacgccgcaatcacctgcgcactgacagttgcataaccggcacccgccacgccggaatgaaaacccagaataaaccagaaatccagcacgatgttaataatcgtcgcaatgatcaggaaaaacagcggtgttcgtgagtcccccaatgcccgcaacatattactcagcaagttgaaactcatcgaagcaataatgccaaaataaatcacccgcacaaaggcaatcgagtcatccataatatccggcggcgtctgcataacggttaataacggccgcgtcatggtcacggcaccgattgtcaaaataacggaaattcctagcgtgatccagacactcgtcccgaaactacgccgcacccgccgataatcacgtgctccatatgcttgggctgtcaagattgacagtccagctgtcgtgccttgcgcaaagccgataatcaaaaagacgatactcgaagttgcaccaaccgcagccaaagccgctttgccaatcgtacgaccgacaatcagcgcgtccataaaactataaagctgttgaaaaagattccctattaacaatgggatcgtaaataagatgatcagtttcaagggtttgccaattgttaaattgcgcatcaatctatcctccaagattctttcatgcctggttgcgtgatgatgtcagcgcgtatgttgggttggcatcatcgaaacttatggggttatgacgtacgggaacggcttgtattttgggctttttgagcttttttcgcccaaatgtgtttccccggcgcagaagtctgcgtgtaaggacctaaaacgcaatggctaaagaccgggccatcacgctttaggccacgacgaaccactttacgcccataacacgctccccggcgcagggatctgcgtgtaaggaccttaggcgcaatggccaagaccggtcccatcacgcctgaggccacgggattcactttacgtccataacgcgctcacagggccagaaacctgcgtgtaaggaccttaggcgcaatggccaaagaccggccatcacgcctaaggccacttacactccggtttctaagcggccctgttcgcgctcactaaattacaatccccccacgatatcacaaaaagccagacagctgaataactgtctggcaattgaaatatatttgcaatcaaacatcggcaccgccgcctccggagctgccgccgccccagcttgagccaccgccggaaccgccgccaaagccgccgaatccgcctccgccgcctcttcggcctgcagagaacaaagcatctaggatgagccatagccagaagccgccatcaccatcgcggcgccgtccgccacggccaccgccgccgcgaccgccgaagatgactgctacgaccacaacgacaagaaagatcacaacaatctttcctagcaaactgccaccgcgatttcggtccgcattttggtagcgattcatggtttcatccgagaccgtgttttgatccttaggaaatttatactttttatcaataacggtcgcaacggcattgaagaccttgcgcaaagcctgattcagttcggctttattacccgatttaattccttttagattcgtattgaggatttgtcccgccaaagcgtctggcaagtcaccttcaaggccgtaccctacttcgatccgcagattttgcttaccattattgtcagcgtatagaatcaacacgccgttgtcggtaccttttttcccgatcccccatttctgaaaaagatcaggtgcataatccgacaatggatcgccgtgggtagactttagtgcagctaccgcaatttgcggctgttgtttggtgctttgataataacgattcttttgatcaaccagttgttcggtttcctgatcaaggtaacgatcctggtccaggtagtaatggtcagttggtcgtgccggcagatcctcggccgctgctaccggatgagctgcaccggtaaacaacaacaagcccgtcagcgcggctagtaaccacgctaaatgcctgcgcatggcgccacctacttcccagaactggagctattgcttgaaaaatcaacactcgggacggtctgtgctgatggggtagctttgaaggtgtccttcttgcccagtcccatcatgcttgcaaagatattcttcgggaaggtaacgacgctttggttataatcccgaacctgatcaatgtaacgcttgcgttcaaccgagatccggttttcactaccttcaagctgcgtcatcagcgtgttgacctgattactgctttggaggttaggatagttctccttgatcacattaatcaatgtcccaacactcttattcagttgatcatcggctttagccttgctggttgttgagtcggcgttagcataagacttccgggcttcagcaatatcgccgaagactttttgctcctgacccatctggcctttaaccgcattcaccagattcggcaccaaatcggcgcgccgctgcatcacattttcaacctggctccactgggcttcaactgcttggttctgcttggccaacgagttataggtaccaatgccaaaaatcaggcagattgcaacaatgacaccaagcacaatgctcgtgactgcaactggacttaatcgtttcgttttcatcatggattctcctctagtacatgcgccgttaataagactgttaatcgtcgtcttcagttataaacttattaactcgcatcgtaatcaattaccacttcctttatattttaccatgttggttgcattcgacatccggcttaagacgtaattacctacttaaaatagttaaagccgatcgcatcacggacttcttgcagcgtttgattcgcgacaacattagcttttgccgacccttgctgaagcatttcggccactgcacccatatcttcggcatagtgggcccgccgcgtccgaattggctcaagaaccgcctccatcacgtcaattaagtagcgcttgatcttcacatcacctaagccgccatgttgatattgctccttcaacttagccacctggtccttgtccggatcaaaaatatccaaataagtgaagacaacattgccttccaccttacccggatcgctgacatgaatgtgatttggatcggtatacatcgacataatcttcttttgaacagtatcagcatcatcggctaggtaaatgccattgttcaggctcttgctcattttggcgttaccgtcaatccccggcagtcgtcccagaccttttggcgggaagtagccttctggttcgactaagacatctttgtgataggtccgattgaacgtgcgcacgatttcacgtgtttgttcaagcatcggttcctgatcatcgccaaccgggaccgtggtagctttaaaagcggtaatatctgccgcctgactcaccggataaataaagaatcccgcgggaacgctgtcgccaaacgctttttgcttaatctctgccttcactgtcggattgcgttccaagcgattgactgtcactaaatcaagataataagcagtcaactcaaaaagcgccgggatttggctttgtaccaaaatggtcgtcttatccggatcaatcccgactgccagataatccaatgccacttccaacaacgagtgacgaatcttctctggatcattggcattatcggttaatgcctgggtatcggcaatcatcacaaacggctcatattcgcctgagttctggagctcaacccgattcttcaaagaaccaatataatgcccaatatgcaaccgtcccgttggccgatcacccgtcaaaatcactttttttgccatgcgtgtttcctccttaatttaaaaaagcgtcctatgtcatgacaacataggacgcaagcgcgcggtaccacctaacttgtccgaatttcggaccgctcttggcttaaggcgcacccaccgaacgtaacgcaaacgacccaatttcacctaccctggccatcgacttctcagcgctgccgactctctggcgaccatttggatagggtactcatcgtttgtgtgaatatgggtttaggttagctaagtttttactagaagtcaatgacaaccgaatgccaacaagaaaatgaaccatattgtcattgtttctgacgtttcttattggcaaggtatccggcaacgatcgcaatcacaatacaaatgataagcactattttcatggcgttcatcctcctctggttagtgtaccagacggggatttttacgcaaagaaaaccttatagcaatataataaaattggtaattacgtctgaaaaagataagttgcttatgtcgcaaagagaggtttactaacaatagcattagcattattaaagttaatccgcatcaacctttattaaatctgatattacttttttcgaaaaaaccggtattgcggcgatcatcatcacaagtcccaaacacaaaacaatggatggcgttgcggctaggtgtgacaacggtgcactggcaatcgccgcaatcggattggcaactgaaaaaatcgtgagaatagcgccgatcaccatgccaatatgttggttcggtaccgaaagctggacagtggaaaaatataaaatcgagccggtagcattacaaataccatatccgagccaagctaataccacaccaaaaatacccctttgcaacaaactgaaaaagccaatcaataatatcatgaagccttgcagaaacaaaaaatacgggaagctttttgcagtaaaaatttttgtgtctgagtgcttggcgttaaccagaaatgctcccagaatcgagcctacagtaaacgcaagatcaaccgcattatacatatacttaaactcggaaaaaatatcaattgacagcttaggcattagaagccaaactgtccagaaacagaagttggtcactaaagctatcgggacaatgacagcaattaacgtattagaacgaataattttgattccttcaaaaaagttactggtctgaattgaaagtgatgatgatgcctcatgatttgcttccggtgcttgtgtactgttcaaacggccaataagaaaataggagacgctataaaggatcaacgacagaaccaatcctgcacccacattcccgaagaaaataaagatcgcagacagcccagctgatagcaccgatgcgagttgattcgttatggatacccacgaattagccgtgaccaagtcatcccggtcatgcacgatagatggcacaatggactcagtaagtggactgtacacaatgttaagtaccgagttgatcacaaccgtcatcatcaccccaagaattggattattcatcagtaaataaatgacaagcccaaagctagtatttagaattcgaatgagcacaactatcttcagtaatgcaattctgttcattcggtctgaaaaatagcccccaataaaagtaaacaaagtcgcgagcatcgagatgagtcccagaagtgaaatgtagttctggttatgagtcacatcataaatgtaccaataagcaaacaaaactaaggcgccatttgttaaagtgtcaaagaaatcgctaaaaataatctgcttgatgcgcttcatatcattctccttaaatgaatagggatattcctcggataacggaatggttagatcttttcaaaattcttaccacaaaatgcgtcatttagtgaaaaacttcagattgtaaatttagactaaatgctttaatcgggtaactatttttgtatctcattcttgctattatcctgtgggcttctagagagagctaaccagcaacgatcctctccagcaggcaaaataagtgaaactgtgctgataagaatgaagcggttctgtcgccaacagaaaaacagccctatgatcatgtgcggagtcccatctatactcatcatcattgaccttattccagagacccatcttaagattgttcggtctaactgctactgattgctggtgcctattttaattattaagagcattttcgctttttaatctttctataatgattctgcaacaattgccgaacctttacaagtagattatctcaccgttattagtagccaagcgttagaatggatcacagcaagaataaaagttagtttcaagacttatatatagctaagactggatcccgccaaacgcacatcaccttctttcgctacattacttctctcatcacgctccaagcccggtcgctacgctgtttccacggctgagccccatctggcctacgattgctccgctttggcactggaatcgttaaagctcatttatactaaaatgaaggaagccaaaaagcgtactatttcttgaaaaaaagaaatagtacgcttctattttgaaacaatgaatgatgcccccgcctcgagcactcaaaaaaggatagacctagcaaacttgattgctaaatctatcccttttgttttaacgttcgaattcctcaaacctacttctgcagattaaaacaagtactgcaaatcactttgcgcactcggataagcatagatccggttgagatcactaggttcctgcccggcatcaattgcggcggcaaaagtattgatgaggtcttccgccagactcgcgaggacaacggcgcctgcaagtttgccggtgcttttatcgacaatcgtccatacctgcgcatccgggtcttgtatgcgattgtatgtgtaccaatgggttgtctcgttgtgagtgacctgatactgctccggtgcggctagggcatcttcaagcgccacgccgactttagccagctctgtggggccaaagacgatggttggaatcgccgggtaatgaatcggttcctgactgccaagaatttgttgggctacatagcggccttcaaagccagcaaccggtgtcagtttcggttgaggttttaagttgacatccccaattgcataaatgttggcaaccgccgtccgcaagtgatcgtcgacgggaataccgcggaggtcggatttaatcccagcattggccaagcctaaatccgcaacgttggcaattcggcccatcgccgtaactgccatatccacgttgagatcaaacccatctgcatgcaagtgcgtcatcgttcccagtggactgattttcgtcagttcaacattagggtgaaaatgaatcccggttttaagcaacagctgcttcaatgcctctgtggcaactttagggaaagcacgtaaaagtcgatcggaatgaccaatgatatgcacatctgccccagccgctgcgtcaatgttagcaagctcgacactgacataaccggcaccaataaacgcaatgctagtcggtaatgcgtccaagtccagaaaatcacggctggttttcaacaaattggcaccggggatatccggaaaacgcggcgtatgaccggtggcaatgacaatatgttctccggtcacgttttgcgacccgactttaaccatatgttggccgagcaattgggcgcgtccgtataaggttttaatgccagtccgtgtcaggccggttagcgtcccggccggaataccggttgtgtaactgcgcttaaaggccatgagtgacggccaatcaatcttagccgtaccgctgatgccaaaaccgttcatccgcaaagcagcatttttgacttcaactccgcgataaagcatcttcttgggatcacagccgtaattgggacaggtaccgccccacagatcactttcaatcaccagcaccctttgcttggcggcaagtccgtaagcagccgccaacccaccgggaccgccaccaatgacaatcgtgtcataatcatacgccatttcgatcatcctttcgtttctgtgtcctgatcaacaaatgcacttgcaagatacgccaccacactatgcgtatcaatcacgaaaacgccatggtcactcttgacccgcaatgtttcatgggcgtccaacaacggcagcgcctcggccaacgttaaattaccgccaactgcatgatcagctgattgctcaaccgcaaatggtgctaattgactcaatgtcacctgcaacccttgatttgcctgcgctcctttgaaaagatcagcaacaaaatcattggctggctgcgtggcaattgcttccggagtgtccacctgcaagagccgaccgttatgcatgacgccaatccggtcgccgagtttcatcgcttcagccatatcatgcgtgacaaaaacaaccgtggttttcattgcccgatgcaaatgcagcaacatatcctgaagctgggtccgtgaaatcggatcaagcgcggaaaatggttcatccatcaacaccactttcggccgcgatgctaaagcccgcaaaataccaatccgctgttgctggccacctgatagctcgctgggcatgcgatcacgatactcggctggcggcaagtcaaccattgccaataaatcatcggttgccgtgcggattttttgccgtgaccaccctttcatttccggaatgaccgcgatgttttgtgcaactgtcatcgttggaaataatgcaatttgctgtaaaacatagcctaaatcccaacgcaaatcacgtaccttgtatgccatcagtggtttaccggcaaatttgatgactcctgccgttggatcaaccagccgattgatcattttcaacgtggtggttttcccactgccggatgtgccgaccaggacgaacagttccccttgatcgacctgtagactcaaatcgttgacaaccggcttgtcatcataagtcttcgtgacgtgttccagactgatcaatgccatcagcgcacctccttgagcaaaccgtgttgcacgagatagcgatgagcgaccgtggccgctttttgattttgtacactcacggcataattcatcgcctgcatctgtttttcggtgatgtgattggctaaccggtttaacgccgcaaccagtcgtgggtgctgcttggcaaacgcggcccgcatgagtggggccccgcggtaaatcgggaacagacctttgtcatctttcaaggccactaaatgatactgtcgcagttgcgcgtcagttgtgtagccatcagtcaggttaatctgcccgcgatctaatgcttgatatcgcaacgaggcatccatggaatccaccttaaattgcaggccatattgagattgaatgcctttatatccatcttggcggtcaataaattccaagtcaaagccagcgcgaattgatggtgcaatttttgccagatcactgatggtttgcaactgataacgcttggcaaaacttgctttaaccaccagtgcgtatgtgttgttataggccattggtttcagataagtgaagccttgccgggccaacaactttttggctaatggataattatttttgcctgccgctacctgctgctgttgggctgcagagggtttcgtcagactagccaagaccgttccggaaaattctgggtacaagttgatcttatcggttcgcaaagcattgtacaagaagctcgtttgcccaaagtttggtttcaatgtgaccccaacatcaggatcggctttttgaatcagttccttatacatatgaatcaaaatatccggttcgctgcctaatttaccggcaatggtgatcgtttctttcggcgcagtcacccggctgtaaacctgcgtgccgacgagtccgaaaaccgccaacgccacaaccccgacgctcagcttccagttaattttttgcatcaagttcaataaccacgaaaagacaatcgccaataacgccgcagcaagggcacccataagtgtcagtgcggcatcgttacggtcaatgcccaaaagaatgaaggttcccaacccgcctgcaccaatcaacgctgccagagtcgccgtgccaatgatcatcaccatcgccgtccggacgcctgacaagatcaccggcagcgcaatcggcaactcgactttaaatagtttccgcaaccgactcatcccgaatgcatccgccgcttcttcataggaaggatcaatgtcgcgcaggccgatatatgtattctgaaaaatcggcagcagcgcatagaccactaacgcaataatcgccggcaatgttccaatcccgacaaacggaatcaataaccccagcaatgccaatgaaggaatcgtctgcaacacgccggtaatctgaagcaaaactgccgcgactttggcatgtgtctgaacccaaaccgccaacggaatcgcaattaccaccgctaaaataagcgcaatcagtgatatttcaatatgctgtcccagtgcacttagcaattcaccgtggcgctcagcaatcgtccgccataaatcagccatctcgaacctccgtgtgatgtgattatgtttaagtgtaccaccttgttttccgatgcaacaacatgaagcagagtgagcgcgaaccggcgcggttagaagtcggagtgtaagcggccttaagcgtgatggcccggttttggccattgcgcttaaggtccttacacgcagacttctgcgccggtgagcgcgttatgggcgtaaaccagaacgtatgtggccttaagcgtggtggctgggctttggccattgcgttttagatagagcctgttctcaactctattctaattaagtgatctccgatactccgagctggctccgcggtggctgggctggaacgtggtgggcacgacttcgaacccgcaaaaaccgcggtttcgaagctcggccttggtctaaagcggagaagcccactccgcttaagaccaatttcaccactgagcccgccaccgctccgccagctcttgctttctatcttaatttccaaacaaagcgtctcatattactgttgaaatcatctagacaaatttgtctttgcttgcccagaacgtgtacactttacttttccctcaaccgggcgtaagattatcgacactattttaaacacgataatgcatttgctagtgcaggattcgatcgatttgatcctagtcacatcaacgcacgcatactaaatcggagaggagcgccggttatgaagaatgcaacgaaagcagaagaacaggcacgggtcacggcggtcattgcgaaactaaaagcgaggttggctgccatccatgagcaaatcgaagcggcgcaccgtgaaaccagtcgcatcgaacgggcatatggcgaaaacaccaaagtcaacgtgactgaagtcgatgatcaaatggaaaccaacgccgccgttcagcaacaaaaagtcatggttgcacgggcggttgaaaatgaaaccatccttaaacatgaaggcgatcgcttaactttattggcagacaacccgtattttggccgcatcgacattgacgaagacggcgaaccggatacgctttacattggcaccgcgaccttcattgacgaagatggcgattttctggtttatgattggcgcgccccgatcagttccatctattataacggcacgctgggggatgtgacctatgaaaccccagctggcgagcagcacgcgacattgaaaaataagcgccaatttcaaatcgaacacggtcacatcaaaaccatgtttgataccaacgaaacagtaggcgatgagattctgcaatcggtgcttggtgaccaatccgacgaatatatgaaaaacatcgtcgccaccattcagcgcgaacaaaacgacatcattcgcgatacctccagtgacttgctagtcgttcaaggcgtcgcgggctcaggcaaaaccagtgcggtcctccagcgggttgcctacttgctttaccacagccgcagcgatttggatgccgaccaaatggtgctcttttctcctaaccggctttttgccaactacatttcccaggttttaccaagcctaggtgaaaagaatatgcgtcaggccaccttgttcgagttcctcgccaatcgttttaccggcctgcatgtcgaaaccttatttgaacggtacgaacacgatgcagccggtttaccgcaagcagccgaaaccattcgccgctttaaagaagctcctagctacttacaagccattgccgattacgccaacgatccggatcgtgttcctcatttcattgacgttgaattcaatggtgaagtcttcttttctgccaccacgattgccaatatttatcagtcacaaccgaccttgatgaaacccatcgacaaattcacggcgaccaaaaatgcactgattaaacagttaaacgctcgtattcacgacgaagccacgcacgactgggctcaactgcgcgtctctgacttatcccaaaccgaattagagacgttgacagccgatcacgagtttgcaaccggagaagacgagcaacaattcgtttccgaagccattgttgcaaaagccttcgcaccaatttacgacgcactgtacaatgatcatttttatgacgtcttccaggattatcaacaattcatggcacagatagcagccccggtgaatgcgccgatttggcagacgatgatcactgcctttagcgacggcattgaagcccatcacttacgcttagaagacgcggctcctttgctttatctgcgcgacctgagcactggcagcggccaaaatagtttgattcagtatgtgttcgttgatgaaatgcaagatttcagtatggcgcaattgttatatctgaaacatgcttttccaaaggccaaattaacgttgctcggggatgccaagcaagatgtcttcaccagtaattaccagcccagcgacttcatccacgaaatcaaggacgtttttgccggttataagatccgtttgattacgttgaacaagagttaccggtcaacccaaccgattacgaactttgccaaagccttgttgccagaacacgaccacattcaagcctttaatcgcgccggagatatgcctgaggttttgaccgtttcatcagcggaggccactgctgccttatcgcgttcggtcacgcggttactgacagttgacagtaccgtggccattttgaccaaagatgccaaaaccgctgcacaactttacgccacactcaagctcgatacgccggtcacgttactgtctgctaacgaccacagtctgaaaaatgggtgtgtcatcttgccggtttacctggctaaaggacttgagtttgatgcggttgtgggctgggacatttccgcaaccacttaccgcaatgaagccgatcgcgatattctctataccctttgctcgcgtgccttgcatcacttaacacttgtaacgttggatgcaccaagcccattaattactgcattgccgaccgatctatatcggcgaaccggcgatgcttcggaagctcgagtttaaggccacacaaacgcccttgtcgcaaaaagacaagggcgtttgttttattcgtgattattatgatattttattaacatcatcgtttaatttaaaaacttaataaaaactccggaggccatttaattgtttaacttattacgcaccttcatggctgtctatgaaactcgcagtttttcattggcggctgagcatctttttacgagtcagcccaccgtctcccaccacattcagcagcttgaacacgaactcaatgtcacactttttgaacgcaacaagcgcagcgccaccgtaccaactgccgcagctgatattctgtacgattttagcggcaacatgttagccgaatgggacaaaaccaaacaggcactgcaaaacaccacggcgacaaccacggtcaccttacatatcggcatatcccaaagtgtcgcggccgtgctgtttcctagcttagcgcgcgatttgaaggctgcttttccctacctacaattcgatgtagccgtcttaaattccctccaggttgtgaatcagctggaatcgcggcgccttgatctcggctttattgaacagccattgacacttaaaggtgctaccagaacgaccttgtgttccgaccagctcacggtctcgggctggcccaccggtacctggatcacccgcgaagaaggttccggcatgcgctattacacaactgcttacctacaaacaaccggcatcacacccaaacacctgatgaccgtcaataacaacgctatgctgcgggccttggtccaaaatggcgtgggtcaagcgctattatccgatcgcatcgctccgcctgaagccccgcaacaagccatcgggaaaaagtttcaacgacatttttatctgctgcagaaaccgagtgctcactggccgcataagcaagcgatgctggataagattattgatctggctaaggtagccacaaaatgatgcgctggatttatgctgtttaaaggcagaaaaaacgtcacaaaagctgtctcatcgccttttcgactattcaataaccttctgcgcgtcttgagcagcagccttaaccccttttcgaatccgccgcagaaaatgcagataatgaccggttacaaagactagcatcagcgttgccgcgatccactcaccccattgcaggacactcatcagatcatgcactgtgccattctgggcaaaagccgcaatatatttggtcaatgcggtggcggaaatgaccaaggggaacgtgaaggccgcaaaactagggtaaaacgacaaccgcgtatactgccgaatactaaccaacgtaatgaaatataaactctgcgcaaaaatcagcatccctgttgccagccagaagttagggtggtcaaaactggccagataaccggtcagacacaacgaggccggggctgccataatggttaataatggttgagtcgcttcgggcaaaggcacatgccgtaaccggtgaagcacaaacggaaacaaggcaacataaatcaccaacgccatccagaaaagcggctgacctagcgccggtacaaattgactgctggtcaccggaatcacgcccaagccaacaaacgtgacaaaccagctcgggtaaatcattcgccatgctttcggttgtgaaatcaaatgccgcagaacaaagaaaatcatcaacccaaagtgaatcgccaccgccatcagccaaacaatcgtcgcaaccggcaacggcatcccccaagcaacaaagtaagtgcacaagatcatcagcgtcattgaaaaagttggcgaaaccgaagcaataatcggatccttcaaactaccagcagcatgaagcggcgtcaaacaaagcttcagcaaaaccaatccaaacaacaacccagctacgatcccagtcaaatcaccaaccaactgccaaccagctaatttatacaaattccccaacgaagccaaccccaacgtcaaccccgccatgggtaacggtacctgctttaaaaaattacgcataacatcctcctgagcgtgagctggcgcggttagggatcggagtgtaagtggccttgggcgtgatggtcgcactttgaccattgcgaccaaggtccttacacgcagatccctgcgccagcgaacgcgttatgagcgcgaaccggcgcgcttagaagtcggagtgtaagtggcctcaggcgtgatggcccgcacttggccattgcgactgaggtccttacacgcagatttctgcgccggtgagcgcgttatgagcgtgagctggcgcggttagagatcggagtgtaaacgaccttgggcgtgatggccgcaccttgaccattgcacccaaggtccccacacttcgatccctgcgccagcaaacgcataatcaatcacatgctccccagtctaacaagaacagctaacatcaaccaaatgaatcttttgcatcgttaatattcatgaatcgaatatcagccctagaaaaaagcgttggtaaatcaacctttcgctgatgccaacgcctatcgacttgttacttgccatcaggacgaccatcaatttaataaacaagctttttttcgaccaagttgattggaattagcgcaattattaacaatacaacgaacaaccaaaccagattagccaattgaccactcaaattaccatcagctaatccgcgaattaggcccaccgcatgggttaacggcgaaaaccagccaacctgtttcaaccagctggccacatgactcaacgggaaaaacgtgttggaaaacataaacatgggttgaataaccaacatcgtgtaatagttcagataatctctgctaggtgccatcagtgtgaaagccagtcccaagaatccaaacagggtacccgtaataaacaaaaccattggaattaacattgcccaaaaactgctaatggttcccatcagtagcgccactagcataaatagtgtcccgaagatgacgctccggataccggcccaaatagcttgaccgacaatgatatccggcaggctgatcggaccggtgctcatttcataatatgttttgtctaaatgcatctggatataggcattaaccgtgctctcattgttggatgcgttcatcgccgtcccagcaatcaagcctaacgtaataaacttcaagtaaggcatcccgtctacttggccaacaaaactgcctaaacccaaacccatcgctactaaatacaggatcggatcaaacagattaggaaaaatagagattttaaacaacttcttgaagctcatccaatcacgatagatcacatgaccgatgcctttaatcttgagtttgttcaatatcttcccgcccctcatcaaaatttgtcattttcaagtaagcctcttccagcgtggcataaccatactttagcggaagttctttaacaggagcttctgctaaagcaacgccatgatcaacaatcataacgttgtccgccaacgcctcgatttcatcaacataatgcgacgtgagtaaaatggaaacgccgcgtttttttaaatcattgattcggtgccaaaagacatgtcttgattgaatatcaagcccagtggtgggttcatctagaatgatcagtttaggatcattgataagcgcccgcgccaagactaagcggcgacgcatccctcctgacagactggttgttgctttattttggtaatgagacaacccaacaaactttaacaattgctcggctttttcagcagccactttaaccgttaaatcaaataagataccatgagcgatcatattttctttaacggtcagcgttgtgtccagtaagtcatcttgcataaccaccccaatcgtccttttagctaatcgaggttgtttaacaatatcgatcccgttgataaaaattttcccggaagtaatggcggtcgtcgcataaatcatttttaaagttgtcgatttaccagcgccattaggtcccaagacagctaacgttttcccgcgatccaaggacagtgaaatgcctttaactgcctcaaagtttccataacgcttaactactttttcaacctgtaaaattttcacagccggacacctccactagcgaaacaaatatcgcttttcataggcttaactaacgcccttgttctaaattttagggcgcagtcatttccatgcgcatcgaaatgtggaataattaaagcgcggttattattcgccgataaggaggttcgtttcatggcaaaagaattacctaacatcaccaagattgcagtcgctttgtccaatcactcaaaaatgctagttttagacagtctcatggataaacgcggtcacacacttctagaaatagcccgcgaagccaacattcaacctcaaaccgccagttatcacttacagaacttcattaacaacggttgggttaaaatggaaaaatccggccgttttcactatttcttcttagtgagtgatcaggttgccgcactcatcgaacaattcagtccactttcaccatcagcgtcaacccataccttaaccagagcccttaaggttgataaaatgcggactttccgttcttgctacgaccatatggcgggaaaaataggcgttttgattaccgatcaactcttggctgatcacctcattagcgaagaacctcaagcatatcaagtcacgccggatggtctgaacttctttgaaaagggtttgaatattgatcttgaaaccgtccaaaaaaagaaacgtctctttaccgttaaatgtctggactggagcgaacgaaaacatcatctcggcggtgccttgggtaatgccatttttgatgcattttcaaagcaagcttttgttgaacgtgatcccaacaccaaacgagcgctttatctgacggcagaaggaaagtattttctacacactgaattgaactgccaatttgaataaaccgaccggaacgcataaaagccacccatcgcagaacaatgatgggtggcttttgtacattcattaacgcttttagcaattcggaatctgcccatagccaaggaagctcacgcggcaatggctggttgttaggatcacgctgcttaaaccaataaaatcgtcgcattattcagtatgtgcaaaccgattgaatagcgcatgtcccgcgtacgcaggtaggtccaggctaagacagcgccaagtgcggcataaataaaaatattgtagtcaatgcgcgaccccgccacatgggcaaagccaaatgcaaatgcactcaccaacacgctaacccactgccaggaacgtttctgcaatgagccaaagctattcatcaaaagaccacggaataaatattcttcgacaatgggaccaccgacgaccgccagcaacttaattccccatggatacgtgtgaaccagcttaatcaaattactctgatttgctgccaggggtgcatgggttaactgcataatgagtgaattcgtcacctgaatcaaaagcagtaagccgatgccttgcaagacgaccgcaacgggatgggcaacttttaaaggcgattgctggcgatataagcgccggtaacaaaccatcaaggcggcaatcaatgccccaaatgcaatgataaacgccgcgatcgcaccgaccatcccccaagttagttcgctgcgaacaagtgcaagttcggccagagagtagaacaagaaaccgacaataacgccaaaaatttgaatgatggaacggaggatttgcaaaataaacgatcctttcgtaggcagtcacttggactgacggataacgatgtcacaacattgctagcaacttataataaaaaaagcccgaccagataactatctgtcaggcatttcatttgcagccgtctatcgggcttgaaccgacgacctcatccttaccatggatgcgctctaccgactgagctaagacggcaaatgacttggttgtttaaaaacaactgcctaattaatgtacactaaatcgccattccccgcaagccctttttggaaaaatatcgcaccaagccattttccaactgcaaatttcaagctgttagccacgtcaatgggttcaaaccgttacaatctggtcaagctgatctttaatctccggacgaaggttatgggtcaccatgatcagtgtggtcttgggcaacgataccagtaatttttcgatggcgagtcctgacttaggatcaagtgccgccgtgccttcatcactgatgatgacgtggctttggcgaatgaggccgcgcgccaaggcaattcgctgtttttgaccgcctgacaagtctgccccattatgttccaaaaccgtatcaagtccctgttcctgttgcgccataaacgttgtcagccgcgcagcttcaatcgcatgctgcaacacatcatcagccacctgctgtcccagcgtcaagttaaagcgaatggtgtcgttgaagatataaggtgcctgatcaatataggtaatctgatcccgcaaagagcgcggatcaagcttctgatagttttgggcgtcccacgtgatttgcccttgataatcggctagcacatcgctaatcagtcgcaacaaggtggttttcccatggccggatggtccgacaatggcaattttcttacctgccgtcaacgtcatcgtcacatccttaagtaccggctccttgcgatgcggataggtgaaagtgacatcctgcagatgaatgccttcttccaaaccattaactggctctttcggtttttgcggtgatggaatcgccttggcaaacttatcaaaaatcggtgcgactgatttaaccgtggtcagggcaaaactcatcaaggttaagccactaaaagtcgtcccggccactgaatgaattgtgacaaccgccccaaccggaatcacgcggttatatgccagcaatccggcttggatcagcaggaaaagttgactgcctagattcaccaaattaatcaagaattgcgtggccatattgaattgaatatacccaacttgtgcgtgcccggccgcattcgatgcatgaaacacccgatccaccatgacgtgacggcgattcgccataaataaggtattgaagccttcaagaatatccgtaattcgattagtcagtttctcgttttcctgactccattttgccgccgcagcgcttagctttttacgataaatcatcggaaccgtgatcaatagcactgcacaaaccaaggtggtggcaaataacgatgcttgataggtcaatagcacaaagatactaagcacaacttgccagctcgcctgaatgagatagccaacattgcgcagtccctgggtattaatcgtattgacatcgttggtcatccacgaggtatacaccgcatccgaccgcgcatggtactgttcaaacggcatcgcagcaatgctcttcgttatttcggtacgaatgtcattattgagccgccgttgtagtgacacctgataaatattggtcagcgtctgcatcaccagttgaaagatagtcgctaccaccatcacaatcgcagcagtcacaaaggcatttactttaaactgggtcaacgcagtaatcatattcccagtaaaaattgacacagcagtcagcgcagaaatttcaagtccatacatcaggataaacacgccaaaccgccacttaagccggaaaagatattgtcgaaacgtcacggccatgcctccctttaaaagcacccatttaaagttggaaaataatggttttcaccatgctgtccgtattaggcacaccgcttcatcgccagacaatgtttcatccaacaccaagcgttgcagccaattttcacttaattatgagtcttttctgagcaagattagaatacccaaataatagcattacattttcggaaaaacaatcgcaccattagcgttccccctgccactctgctttaaattcgtccaaaaatgacagcatcacttgctgccgatgctcagcaagctgtttggctgccgatgtattgagctgatcctttaacttcaacagcttttcataaaagtgattgataaccgtgctgtcttttccccggtagctgcttgcggtcagggtcgttcttggtgccagtgccggatcgtgcatgcgaccaccatgcgcaccggcgtacataaacgcgcgcccgattccgatcgcaccaatcgcgtccaaccgatccgcatcttgcaccaactgtcctgccactgataacggttgatgcttgcctaaatttgctttgaacgacatgtggtcaataatttctgtcactgcctgaatctgcacctgcgtcaacccggccgcggccatcgcttgctgggcggctgcttttgctgcgccgacatctgccaccaacttatcgtcataagtatcatgcatggttgccgcagccacgacaaccgttgcatcaacgcctgctgttttggctactagttgttttgcattcgccaccacccgttcaatatgatcgaagccatgcccgctatgatcctgcgatgaaacttttttcgcatattccgtcaatatttgccagtcaatcacgtttcaacactccttagctgataatcatcaaaaattaatgtgatgccatgaacaatttaactagttatccgccctaattgttgcgccccttaacctcaagagttcatacttaaagtataaagaggttatgtaaaaaagggggaacatgacgatgaaaaagcaatatttgtcggccagccagtcggtcaaccaatttaatcggcttttttcaccggtgtcaacggctgacattccattgaatcaacaaaatctgctcttttggatggcgaccgattcgacacctcgaacaccaacgaatctggccaaagaaatgcacgtcaccaaggctgccattaccaaagcaagcggtccactgctcgaacgcggcctgctcgacaagcaacccgatcccgaagactgccgtagtttcaaactcgtgctgagtgaagccggcgaaaaggctgtcgaagacttgggaccggaatatttaggcaatctcgagcgtctgtacaatgagttaggtgaaaagaaatacctcaaactcatcaaactgctcagccaagcaaccggcgtcacggtaaaagaatagttcgtcacccatatttgtaaaatcgcatacgccttacgcatcaccgcgtaaggctttttggcatattccgataaatttgatgcttttctcagctgcgttacaataaactcatcagccttttcaaactgactcaccgaaacgttttgtctgccaaaggagcgtgttgcaatggcaattccagatcatatcagtgttcggggcgcgtatgtgaataatttgaaacatctcaacgtcgatattcccttaaataagctcgttgcgatcaccggccgatccggttccggtaaaagctcgctggcaatgggcgtgctgtacgcagaaggcatgcgccgctacatgagtgcgctgtccacttatactcgccgacgcttaggccaaaccagcccggctgcggcagattcggtcaaacatattcccagtgccattgcgctcagacagcggcctgttgttccgggaattcgctcaacagtcggcaccgcaactgaagccctcaacgttattcgcctcatattttcgcgtctgggctcccctgtttgtcccaatggtcaccgcgttccgccgacacttgatattgccaaagcgatggatctgcctaatgatggcgaaagcggcatggggatgatcacctgtcccacatgcggtgtccactttatggcatttgcggctgaagattttgcttttaactcgaccggtgcctgcccaacctgtggcggtacggggcaggcgcggacgctcgcggccaatcgcctcatccctgatccaactttgaccattcgccaaggcgccgtagcatcatggcggcttccgggacgtaacttcatgccttatgtggctcaagcaatcggtattgacattgacacgccttttcaagacttacccgaagaccagcaagaacaggtgtggcacggccagcgtaaaaagtacgcgatcaacattccaagcaaaaccggcaagatttttcacatggatcacgcccaatatgaaaatgcttttaatgccgttgaagattcgctagccaccaccaaaaacgaacgggcaattgaacggttaaatcgcttctatgaattcggcgtttgtccgacctgccacggcagccgattcgcacccaaactgttagcccagcatctggtcgatcaaaatatcgctcaagtcagcgacatgacgctcacgcagctaactgactttattccgaaaatttaccagtggctgccagctaacatgcaagccttggcgcacgatattatcaaagagctgacccaactgctcaagccgatcatggatctaggcttaagttatctcacgttgagtcgggccgctgcttcgctttcaaccggcgaattgcaacgtattcagcttagccgcaccttgcgcaccgaaacaaccggcgttctctatgtccttgatgagccttccatcggtttgcacgctgccaatgtcgccggtttattggaagtcatgcatggtttggtcgatcaaggcaattcgttagtcgtcgtcgatcacaacaccgccatcatcaatgccgccgatcaaatcatcgaaatcggacccggtgccggagctgacggtggccagattcttgatcaaggcagcccggctgaaattagtcacgatgccaattcgctaatcgcaccgtttttaactggcaaaacgcctttaatcgtccgtccgcaagccggcagtgcggccattgccaaggccaagcagttgcagctcacggtcacgaatcggtttaatcttcatcatctgaacgtccaatttccgattaattgtttctcggtggtgtccgggttctccggtgcgggcaagtccaccttgattttcgatgcgctagtgccggcactttccgcaaccaaagatcagcctgctcccacgtttgttcgcaatctaaaaaccggtggcattcgccatgtggtcgccattgatgcaacgccggttggcaaaaatgtccgctcgacggttgccacctacaccgatatcctggatcatttgcggcatcttttcgccagcttacctgctgctaaggacaaacaatataccagcagccatttttcttacaatgtcaaagccggcgcctgcccaacctgtggcggcaccggggttatcaatctggacatccagtatctaccggatatgcaacaaacctgccccacctgccacggccgacgttacaatccagaagtgctgaaaatcaaatggcacgagcggagcattgcggatttgcttgacctcgatgtggacacagcactcaccgttttcaaggacgaaccgaccatcgtccacaccttacaaaccttgcacgatatgggtctgggctatttgcatcttggcgaaagcacgccgacgttatccggtggtgaagcgcaacggctcaaacttgttgcccacatgggacgctcgcaaaaagacacgctttttgtcttcgatgagccttctgtcggcctgcatccgcttgatgttcagaccctagtggcggtgttccagcgactgttgcaaaccggcgccaccgtcattgccattgagcacgacttagatgtcattgccaacgctgattacgtcttggacctcggaccaaaaggcggtgcagaaggcggacacgtcatagcagccggcacgccgcaagccattgccaaacaaggtcatggagaaacggcaaaatatttggcggcgcatcttgctgcttttcatgtggattgagagcaccagtaaagtattgtccctcaaaaataaaacggctccggagtcaaaaaatactccgaagcccttttttaatgcttatgcttagccttttacagccaaacgtcaactaagcatttaaaatatcatcaatttgttgaatctcttcagcagtaaaggtcagatgttccgttgctttaaggttatcctgaaggtgttcaactgaggtcgtcccaatgatcacacttgtgacaaccggatcccgtaacaaccacgccaaggccatttgactcagggtctggtcgcgatcatgtgcaatttcattaagcgcatttagttgcttaaccacagcctctttgcccttagcaaaagtggccttgttggttggatggattttgaaagtatccggaattccctttaggtagcgatctgataacaagccttctgataacggtccgtatgcaatcaacccggcaccatcagcttttaatgcatcgatcaagccggacgtttcagcggtgcgattaaacatgttgtaactgtattgattcagtacaaaaggcgtgtgcagatctttaaacatcgcaattgcttctttggtctgcttcgtatcatagttggaaatgccaatatacaatgccttaccgtcacgcaccgtttgatccagtgcattaaccgtctcttccaaggccacggtatcgtcaaatcggtgggcatagtaaatatcgacataatctaactgcaagcgcttgagtgaatcattcaagccttgaataactgctttacgcgacgtcccgacaccgtacggaccagggtgaatctcataacccaccttggtactaatcaccaattcgtctcgatacggttttaaatccgtggccagaatctgccccagtaacctttcactagagccaaatcccggttcacgatcaccattaccataatgattagcgacatcaaaatgaaaaacgccacgatcaaacgcatccaaaatcaccgagcgtcgcgggccaaatggatccaagttgccataatgctgccacaatcccaacgaaataaccggcaacatcaaccctgtcttaccggcatggcgaaccggcattttctcataacgatcagctgctgcatgatacatcattaacgccctcctcaaacgaccgcaaaataaaaacgtttaccatctctatggtggcaaacgtttcgctaacaatcaaccagaaaccccactttttacggaaaaagctcacttctcaaagaaatccgttaaaaagtttgccacgccgtcatccacattagtatcagtgacataccgagcaacgcgtttcacttcaggcacagcattacccattgcgacactgatcccggcagcttgcaacatccctaagtcgttcaaaccatcgccaaaagcaatcgtgtgcgcagcgtcaatgccggttttcgcctgtaattcacgcacggcattggctttgtcaatgtgcttaggaatcaattccagattcgtgtgttcagacgcagagacatgcaaaacgttgcgtgcctctaatgcggtcttgccagctgccaatgcctgtgagtcactcggtccgaaaataatgccattcgtgatcgttgcggcgtgggttaataatgccgctgctgacggtaaagcaaccacctcgatcgcgactgaactcggtgcaaaccgccgtgctgctgcttcaatcgctggcggcaaggtcccggtgaaataaaccgtgtcatcgctgaaatacaacgcattgagtccaagatcggttgccacttcttcaaccgcagtcaacgccgctgcacccaacgtatgatggacccgctcaccggaaaagtcataaaccgcaccatttgacgcaataatgttggcataaggttgaaattgatgggctaccacttctgccagtgcatgcatgcgcccagtcgcaacgtaaaacgctgctccggctgtcactgcattggcaattgcctgcgttgtcttttcggtcacgtcatgatgattggcagtcaatgtcccgtcaatatcgctgacgattaaatattgcgtcataatgttcctttcttgtctgtaaaccatgctgcttaccgtttagccgttgtagatcaaagtgctgatgataccaaatcagccatagaaactggattcgtctctatggctgatttaagcctgatctgcctgccatctaaaaatcgtccgaaaacaatgcgctacttaatgacacccagcttcatgcgcttgattaaagtccttgcggcaagccttcaatttgatcggcataccatttagcccatggtgtttccggcgccccttgagcgttgaatgtgacattgacctgtttcaaaagatccaacaagttgccagaacgatgtgtcagtaacccactcgttaactcctcacgcgtcaacgtgcgattatcaagaaggtagtggttaatatccgccaaatctccttgctcatctagttgagaaaaaacatcgagcccgtcaccaaagaaccgactcaggtaaaacttagcaaaagtctcaagcgctgtcttttgtgctgcttcatttaattgatcaatcgttgtgttgctagttgccatgactaatttcgtcctttctattttattccattataaccactttttacctgcttttggaaagcaaactggtggaagagcgcgagccggcgcgcttagggatcggaatgtaagcggccttgggcgtgatggcccgggcttggccattgcgaccaaggtccttacattccgatccctgcgccggggagcgcgtttaagagcgtgaacaggagcgcttagaaatcggagtgtaagtggcctcagacgtgatggcccgactttggccattgcggctgaggtccttacacggagatttctgcgactgtgaacgcgtttaagagcgcgagccggcgcgttatggtgtgccttacgcatcaaagtcaagtacctaagttcaaaaaacatataaatatttttaactttttgaaactttccgccttttgtaccttgatattgagcaacagttgttatagtatgccacttatgttgggaattcaggaaaggttggaggcattatggaaaaagaaaaattacatcttggtgacgcggtggtctgtcaggttaaagaagacatggaagctcctttcaccggtaaaatcgaaaaagtctacgaaaattcggcactcttgacgatcactgactacgctgatcaagaccgtcagaacgcgtcagagcttaattttaaaattgttgcaaacttccacgctatgaccaaaaaccttggcggcggaactgtcttggcctttccaccagaaacagaagaagaccgaaaaaaataatgacccagatcacattcaaccagcttcaggccgcatgactcgtgcctaaactggttgttattatttacttagtcattaactcataaaacaaacaaagctttcctggcgagtagattctatgctcgccgggattttttttgtttaaggtcaaaccgttttcagcttagaacaaacttaatttcaaacatcaccttcaaaacggtttaagcttaaaagtcactttcattgtcagctggtcaaacttgcgtagaataaaatcaaatagtaagcaaacgaggcgaccataaacatgcaaaccaccacttaccccattcacgaacgcctgctcatcggcaccttgctcactgctgctgccggcagttttgatgcgtatacctacttgttgcacggtgaagtctttgcgggcttacaaaccggtaacgttattttgctcggcgtccatcttggccaaggacagtggcacacggcaattcgctatctagtacccattctcgcctttatgtttggcaccatggctgcacgcgccttgcagctacacgccagtcatcgcccccaactgcttgccgaacagcgatggatcctccgttacgaaattgtatggcttttggtggtcagcctcctggggaagtggctgccggatttgttggccagcgctatcgtttcagtgattgcggctgcccagctacaagagttccgccgcttaaaaggtggtccgttcacgtcactgatgatgaccggtaatttacgcaccgccgcgcagagcctgtatgacggctttattcgcggacaacaaaaaggccgcgcatccgcagccactgttggtacgatcatcttgagttttgcccttggtgccggggtcacgggtatcctgacccatgctatcggcacctacgccttagctggggctacgctggtgttgattctgattgatctattgctttggcgcgatcagaaaacattgccgcaaagtacggtttaaccaagcgcttcttgcccatgatgcagaaaacttagatcgttgaagtccgtcacccgaaagcggtcattaagccacattaacttggtgacactcgcattatccagcatttcgcggccatcaatgttgtagtggatatagttcaaccacattaacgctgccgttccgtgtgacaccaccaaaacgcgttcccatccctttgcctcggcttccacggcaatggcccgcaacgttcggtccaaccgctcctgcaccattcgattggtttctgccgggtttggatgctgatccatattagccgcaaatgccgcatcggctgtttgcgctaacgtaatttcgcgattggctaaagcatcatggaagttggcaatgcccatcgtcgccagcgaaaagtcatttgccagttgcccttcgaacttgccataattttcttcacgcaagcccatgagtcgcgttaccggcagcggttcacccaaaccacttaaaataaaatgtgcagtatcgacagcccgcgtcaagtcactcgcaaacgccgcatcaaaatgcacccctgccagttgaaagccgcgtcccagcgccttagcatccgcgattccttttggtgttaaggccgagtcagccatcccttgaacccgtttttgcacattgaattctgtttgcccatgacggacaagatatagcgttgtcatgatcgcaatcccctaattttcatttatttccaagtcatcgtcattaagccagttttaaataatccgctaagtaatctgccatcccatcgtgatcgttatcgcttggtgtctgcgcgtctgccgcttcaagaatggctggacgcgcatttttcattgccacgccatgtccggcaaattgcagcatgtccaagtcattcatatcatcgccaaacgcaatgatatgtgcctgatcaatgccataccgctgggcgacatacgccaacgcccgtgacttgctcgtatttcggctagtcacttctaacgccgtatagtcgccactccaagcgccccaggttttggctgccaaatgcggatacaaagccgccacttgttgcgaaaccggctcaaacgtcttagcttccataaacatggtgaccgaaatcggcgcctgacgcaacccatgctcatccaataaagcatcagggtgtaagcgatccggcaagaagggaatattggcataaggccggtcagccaccaatagtcgcttaccttctgccaccatcactttaaaggtaaagcgttggctgagttggcgtaacgataacgcaaccgaaatcggaattgtcacttctttttcatattgccactgctgatgcggcacatgaatcaaggcgccgttgaaattaatcatcggcccctgtaagtgtaacgtatcataaaactgttcggaaatcgcatccggccggccagtcgtgatcacgaccaaatgtcccgctgcctgtgccgcccgcaaaaccgcgatcgtgccagcactcagctgaccttcagtgttgagtgtcgtaccatccaaatccaatgcgataagataacgttccatgcagcagcctcttttcaatctttttttaaataaacaaacatagccattaccaccgcattcccctacaatagatagttagaaagcgagggtatcatggctgaatcaatcgtactatatactgacggcggtaatcgcaacaccggcaatcacgcaggcggctcagttcggcccaccgacaaaagcgcgtgggccgcattactgatctacggtgagcatgaaaaaatgctctctgagggcgattacggtcggaccaataattatatggaaattatggcggtgattcaagggctcaaggcgatcaaacgaaccgatattccgattgacgtttactccgattctgcctatgtgatcaacaccatgcaacaacgctggtgggtcaagtggcagcaaaacggttggcgcaaccacggcaaacctgttaaaaatgctgaattatggcaagcactgctccaccaaatgaaccgtttcgatcaagtaacctttcataaagtcaaaggccacgcaaccaaccgcaataacaaccgcgttgacgaggcactgaaccaaacgatggaccgcctggatgatcgcacctgatcattttacccttgattgccaagaaaagcttccccataagtttccgccaaaaatgtgtgaatcacctgctgcatccgctggacagaaggtgattttttgatggtcggattaatcaccaaacacaaggttcgcgcgaacggttcggaaaaaggatacacattcacatcccccaccagcttctgcaacgcgagcttcggcaaaattcccaagcccagccctgattccaccatggatagaatactttggtcatcaatcgaatagttgatcgtgttggtcgacacatgataacgatccaacgcattcttggtatcacgatcatagtcaatttgttgcaaaataaaattccgcttctcaacatcggcttgcgtcacggttttgccgtttttaggcttgaagcgttttggtgtgatgcagtagatcggatcttttaacaacggctcaaccaccaccccgggtccaaccggcagcgatgaaaagcccatgtcaaccgtacctagtcgaaccgcctccacaatgcggttgaaggtcccttgaataacactgatttcaatgtgtggatagcgcttcttaaaccgttgaataatcgtcggcagccagttagtcgaaaccgacgaaaacgcgccaatccgaattctgccggtattgacgccattgatgttatcggcgacttgcgacagttgctcttcaaggttctgaatactttggataattggcagcacctgggccccatcttccgtcaacgtgacgccggtacgattccgaattaaaagtggaaaccccagctcggtctccagctgactgatactatggctaaccgcactcggcgtcacatttaattccgccgctgcttgggctaacgtgccacgttccaccactttactaaagacttcataagaaaaattacccatgttatcacttttcccttttttatacttggcccaagtgacacgcgttgtcacttgagccgcacaatgcctgtcaaatggacgctgaggcctgttcgttgattttaacatgaacaaaattcaacttaagctgaaatagttgagctttactcaatcatacgagccgttttacactagtgtcaataagaaaacgttggttgaacttttaccaacgcgacaacggtatcgcaattaacgtgtggatcggcatcaggctcggttacacgcccgatatcaaaaggggattcatcatgaaattcgcaaaacgtacccaaaaaaccggcaattccggattagaagatctgttcgccgcgtctggcccgaatgtcatctcgtttgcaggcggctacccggatcggagtttgtttccgacccaacaactgaatcaggcatttaagcacagctttaacagtggcgatactgaactgttgcaatacgctagcactcaaggctacttgcctttacgcgaaaagattgcggctcggctgcgcgcaactggcattccgactcgtgccgataacatcatgatgacccaaggcgctcagcaaggactcgatctagtggcgcgcctcatgcttgattcaggcgatggcctagttgttgaagcgccaacgtatctcggtgccttagccgcctttaatgcttatcagccaacttattatgaaatcccgatgcaagacgatgggatggacattaatgccttacagcgcgttttaatgagtcacaaagtcaagttcatctatacggtacccgattttcaaaatccaaccggcgttgtgatgtctgtggctaagcgtaaggctttgattcgactcgccaaccaatatgacgttatgatcctcgaagacaacccctaccgcgatcttcgctatgatggtaagccgctgccgaccattaagtcatttgacacgcaaggccgcgtcgtctatctcggcagcttcagcaagatcctctcaccaagcttacggatgggctggctcgttgctgcaccggaccttttgcaggaattactggcgttaaaaggcggaagcgacttggaatccagcaacctgaccatgcacggcattgatgcctacatggcggaaaatgacctagatgcccacatcaccgaaatccagaatcgttaccgcgaaaagaaaaatgccatggtcgcagcgatgaatcgttaccttcctgatgaagcgcacttcaccaaccctgatggcggcttcttcctgtggctcaccatgccagccggcttcgacatgggtgccttcatgaagcaacatctgttaccggaaagcaacatttcctatgtgccttccgccaacctatatgcaacttcggctcaggtcaacggcgcacggctaaacttcaccggtccgacacttgagcagatcgacactggtatcaaagcattaggcgatgcacttaaaaccgcgttgcagcatcacctagtagccgaacaagcttagttttcttcgtcttaatctactcaaacttttacaaaatgacaaagtaaccatcacactttcgtcacactttgtcagtagtataggaaacatagaaatgagccacccactcatctctacaccccaacctaattttcatttttctcctccaaagaaaaataagatgattggcccccatccaatcatcacaaaaacgcccgctgccaatacgcaacgggcgtttttgtatcatgagcgcgagccggcgcggttagggatcggagtgtaagtggccttgggcatgacggccggcactttggttattgcgcctggagaggttgtacaaggttctaggctagcaaccgcgttatggggagcaacggcacctgcatccaaatcagcattcacgcttaaaacgatggtattcccgagaaatacttattagcaatcgcctcagccatgccttccatgtcaaacagtaccgtccgctgcgctaaagtgagctgatactgatggtcgcgcatttcgtctctaatgaaatacccgattggcaagacttgtggggcaatattgactccttgtatccgtttatccgccaccttatcaatggcctgtttgatacttgcaacaatagcttgcgatgtcgcatcggattgtttctcgaaaagatgctgcagttctagcatctttgcaatgagttcttgtttcttttccattttggctcaccccttcatttgtgaactgatcgtgtcgaataaacagcttgccctggccgtgccttggtatgcagcatacatgagagcggttgcaatcatcttagattgccgtttttgatttggcaagcaataatgcttgtgctttttgaagattgtttgacgaacatgacacttgaacagtcactttgaaaattaaaacactccaaagacaaaatgctttacgagaacaattttccagcatatgctatagccaatttcagacaactatgcacctgtagattctatagtccatttttctatgcctcgtttactgacttaaaaagactaataaacgttcaattgcaaagagaggggaatgatcatggaaacattgtataaaggccaacctgctgatgtttgggaaatcaccaaaacaggcgctcagccagattgggtaaaagatgcattctcacaaaactatctttattggttggataatcgggttcgtattctcatgtgggcgttaaccccacctaacaagaagaatttaaagttcgttgctagcggttcacttggaggtggcgttgatgcactgggtgtttacgcatacggagattcaggtgacttcttggatgcaaccaatcaacgcgtggtatctcgggaaagattctttaagcaatatcaaattctaaaatccaacgaagcataaccaattaaaggcgcgtgtattaacgtttgttgacatgactgtattattgttctgttggttcacccgaattcaagatccgtgataggtgcaaccgtgatgaaagtttttgtgaacaatcgcttggctcttttcctatcaagcaaaagccgcaaccagactcacatcatgtgtaagtctggttgcggctagtacgtttacgcatattttaaactaaacggtcaaccccgaagctggatggatcatctttcttatcatccggctttttgtcagttgttggtttctcttcaggcttcttgtcagccgttgttttctcgtctttagcagtatccttcttttcgtcctcttcttttggcttcggtgcggactgctcgcggatcttggcttcgatttccttggatacttcaggatgctcatccagataatgagacgcattgaccagaccttggccgaggcgctccttaccatagttgtaccatgagcctgatttggtgataacgtccagatcgttgtctttatcagtcgctaagttgatcatgtcagtattgtgctcgatcccgtgcccaaacgacatagtggtttcaacggtcttaaacggcggtgccaccttattcttggtcaccttgagcttgctggcaaacccaacgacattcttaccatctttaacctgctggcctttgcgtacttcaatgcgcacagaggcgtaaaacttcagcgcccggccgcctggggtgacttccggattgccaaaaacaatgccgactttttcacgtaactggttaatgaagatgaccaacgtattcgtattgttaatcgttccggccatctttcgcagtgcctgcgacatcagccgtgcttgcaagccaacgtgactgtcaccaattgcaccctcgatttcagcctttggcaccagcgcggctacggagtcgatcacgacaacatcaaccgctgccgattcgatcagcatctcggcgatttccaatccttgttcacccgaatttggttgggaaagcaaaaggtcgtcaatgttcacgcctaactcggcagcatactttggatccatcgcattttccgcgtcaatataagctgccttgccaccggttttttgtaattcggcaatcgtctgcagcgcaatcgtggttttcccactactttcaggtccataaatttcaacgatccggccccgtggtaagccaccgacaccaagagcgagatccaatgacagaatcccggttgagaccacatcgatcttcaactccggtcgatcacccatcttcatgaccgcgccttcaccgaacgccttggtaatcttttgcagcgccttttctaattcggtttcacgatctgtggcatcagactttttattatcagcttttgtggtcgtttttttcgccatacttgtctccttaatgtcgtacatacttcgctcaaaatacactagttacattatcgaacacgcgtttgttttttgcaagtcttttccgtgattgaaacgccttttctgcactttaaaacggttatagttctattttacctgaaccagtcaaccaattggtaaaaacctgccgttattgatcgccgtaaaacatgctatgatagttcggttaagagcaaccagcattttgaaaaggtgagggaaaatacatgatgttcatgggttcaatcgttaatggcttaacgattatcggcggcagtttactagggctgatcctgcacaatatcagcgccaatgcaaaggacacgattacgaaaagtttgggtctgggtacctttgcgcttggcattcaaatggcgttgcagaccaaaagctttattgtgatcatcatcagtctctgtctcggtggcttgctgggcgaatggttgcatattgaagacggcatgaatcacctcggtcttaagctgcaggaacgcttcgcccgcaacaacagccattttgcggaagggtttgtcaccgcgactttaattgccgtcatcggtgccatgagcattttgggggccattcaagccggcgtgtccggtgataatgcgaccctgtataccaaggcggttatggatggtttcatggccattatgatgaccgcctcgctaggcatcggcgttttattttcggccatcccggtgattttatatcaaggaaccatcaccttgttagccagctttcttgtccagttcatccccaaaacgttgatggcaacctcacttcgagaaattggtgccattggcgggttgatgatcctcggtatcggcctgaatctcatgggcatcaccaaaatccgcatttccaaccttttgcctgggctagtagtcttaattggcattctaaccggacaatattttctatcataagtcagtcgcaacaaaaagcaggtcaccatggcctgctttttgtctgaactttttgttgccatcttagaagttcggcagcagtcgttgttttcgactctgaaagcgatgatacaccaacttgcagtgcaaatcgcgaacatttgccaaaaaatgcgagttggcatcgtgataccaatagcgtaaatcatctttgatatacaagcgattcaaccacgcgtgatcgtgccgcaaaaacgtaaaactttctagcaaatcctgttcgcgccaaacatcaggcaacaaaaactgactgcgcgtaaagcgttttaactgacggcttgaataatagacgcgctcaatgcgaccaataaagaaagccgtcttccccttgcccacgtacggtgccataggtgcaacaatcaatcccccgcgtaaccgctcaaaccaatctgtttgcggacttactttgattgcatgcgtaatatctttgggtagccgaaagtccaaaaccaaaccatccgggcgccgtacccgagccacaatatgctgtttcttcacattaacaccccatcatcttggccaatttaggccacttgagctgttgggaagagtttaccacgaaatgttcggatttgcatgaagaacgtttgtttcgttaagtaacgttcagccaaactaacttcttaagcaattccaagccgatttggaaaatgtgaacataatcgccataaagacataataaaatgttggatttgccttcacaattcattcacaccctgtctgtagtataagaaacatagaaatgagccacccactcattcctaaaccccaacccaactttttcatttttactcctccaaagtagaaatcgtcgatcgtcccccaacgatcagacagtaaacagaccgcccacccagcggtctgtttttgtgtgagcgcgagcaggagcgcttagcaatcggagcataagtggccttgaacctaaatggctggtctttggccatttaggttcaaggtccttatgtgcagattgctgcgactgcgagcgcgttatagaaagcagaataaagccaccgaattgcccaaaaaagaatacttctgtccctgctgcaattttccatccataaacaccggctttggccatttaggttcaaggtccttatgtgcagattgctgcgactgcgagcgcgttatagaaagcaaaataaaacctccacattgcccccaaaaaaacacttctgtccttgctgcaattttccatccataaacaccggcttactttttgcctcgataccgaagtatcaaggaccctgcacatttaaacgaaactttgttcagttttcaaaggactactttgtcaaaagacaactttgatagattatcatgatcagcatatcatgtcaacaactttttaaattgaatatttattcaatttattgaaaatgatgcacatcctgctgattcatcaactttatctcatcagttcatccgtcaaggaacgacgtctttgttttgacaacaacaagtatcataccagcacttgcgcgaactagtcaacaaaaaattgacataaatcaaaataaattccaattccgaaaaacaacgaacgttagcaattaaaatgcataaaaattcgcatattttgcgaacaattggtgggaggacgtgttaaaagttcactaaaacgtttgatgacacttgcgaacgactgtggggcattccgttttccatttgccacaacgacaattagcgccctgcatcaacccatgattcccttacactaagctctaaggcagcgtgcatctcctcaaaatgctaaagatcgtatcgtgaacccaaaattgccacgttaatgtcaaattctaaaaattcgctgcatcaaccttgcaaactggctgaccacattctcgcaataccctaacttcattaccatgaacagcctaatgccatttaattaagccagagcaatctatgcccgcctcatttgcctgcactgctgatgaagcgtaaagaaaaaaccgctcatttatgagtggtttctccatctaagtgttcaagtgcttcagcgacccacccatctaaatgagcggcaatcggtgcaaagccggtgtgaaatttacgactggtccagtaatgtttgcgacgccgcttcttacctaaccgaggcggcgcttgcaacgcacgcaaggataaactaatttttttggtatattcgtcgatgtccaagatcacaacttcaactcgctggccgacgttaaaaatatcgctggtgtccttgacataaccgtgctggcattctgaaatgtgcactaaaccttgtgtgtgctcatccagcatgacaaacgccccatatggttggacccctgtcactttgccagtcaagatatctcctatgcgatattccattctgacacttcatttcattggatttctctttgagtataccctaaaaatcagcggcaaccaatattagtcttgaattgtcaaccgatcgatcgtcaccggctcaaccggcttatcgttggcaccggttttgacttgaccgattttctccacaaccgatagtcctgataacacttgaccaaaaacggtgtggcgatgatctaaccacggtgtgccgccttgttcataggctttgataatcggttcgggaaatccggcttcgcttaattgtgccttcatgctcggatccagatgcctattcgtgacgatgaaaaattgactgccgttggtgttaggacccgcgttggccattgacaaagcaccttttagattaaatagttgatttgaaaattcatcttcaaagggtttgccccacaggctttcgccgcccattcccgtgcctgtcgggtcgccgccttgaatcataaaatcggcaatgatgcggtgaaaaatcaggccatcgtagtacccttttttagctaagccgatgaagttatcaacggttttaggagcctgttttggaaatagtgcaatctcaaaatgtccttcgctggtttcaaaaattgcttttggtcctttgaattctgcaagttctagttgtggatagtccataatcagtctccttcatttgtctcattcgtatttctaacactaggcgtagtataccagcatcatcaatatgggcaaagtaaatgtcatttgctttgtgcactcccttagtcaatgaaccattcaatggtgatatcttgttaaacaggcttgccagactactgtcaccttggtaaccattagcaaaatatggtagggtatgaacgtcatattatttatcgaaacggagcattgcaaatgtcagtgcagcatgtatatgaaatcactgtgattggcggcggcccggtcggcatgttcgccgctttttatgccgggttacgtcaagcagatgtcttattattagaaagtcttgacgaactcggtggtcaaaccggaaatttatatccggccaagattctttatgatatcggcggcttcccccatgtcagcggtaaggatttagtcgctcaactgaaaactcagctgatgcattttaagccggacgtcaaaacagctactgaagttcagaccattgacgaggctgatgatggtacttttgttttgcatacgagccaaggagatttccacactaaaacggtcattgttgcgactggtggcggtgccttcacgccgcgtaaattagccgttgattatgaccccgctttagaaggtcagcaacttttttattttgttcaagatctggagacttttcgcgatcaggaagttgccatcgctggcggcggcgattctgccattgattgggctttggcgctggagccgattgcccggcatgttactttaattcatcgccgctccaaatttcgcggacttgaggcaagtgtggctgcacttgaaaaaagtagtgtgacgatcgaaaccccgtatttaatcgaagccgtcacgcacgaaaataagcgcctggctgtacgcttaaaagaagttcgtggtgaggaccagcccaccttaacagtcgacaaattgctggttaattatggctttgttactgacaaacggcatcttcaagcatggcagttcaaaaccgatcgtaatggcatcctggttgattcacagatgcaaaccagccgacccggaatttttgcgattggtgatgccgtcagttatgccggaaagttgccattgattgccagcggctttggtgaggcaccgactgccattaacgaagcgctcagtcggctttacccggaacgccgtcaagctttgcacagtacccaactttatcgataaaaccagccagctcaacctaatgacgctaatgtgttcgccagtaccgactgctaagcacactggccaacgcccactttgaatggagaagcgaaaaatgacaaatgaagagaaattgtatgaacgcacgatccagttattacacgagcgcggtgtgcaactcagtgatattggtgaacttgtcatgttcttacaggaacgtttcattcctaaattgacgatcgaagaagccacgcaaaacgttcgcattgttttgcgtaaacgggaggttcaaaatgccgtgatgactggcatcgctttagataaggctgctgaagcaaacagtcttgaggagcctttacagaagatcattgcagaagatgaagggctttatggggtcgatgaggtgttggccttttcaatcgtcaatgtttatggatcaattggttttactaattacggctatattgatcggattaagccaggaattctggccaagctcaatgcccacgagccggggatcatccacacttttcttgatgatatcgtcggggcaatggctgccgctgctgccagtcgccttgcccactcccatccggaaatcgaagacgatatttattgatgtttttctaaaattttcgcatgtttcatgaaactttcatcttatcccgtataatgaaagataattcattaaaggagtttacaaaatgacccagttgtttgatttcatcttacacattgatgaacatttgatcaccatcgtcaatagcttcggcccctggacctacgtcatcctctttgcgatggtcttcatcgaaaccggggtcgttgtcttcccgttcttacccggagattcactgttgtttgccgcaagtgctttagctgccaacgcggcttacaacttgaatgtctggattctcttcgcggttttcttggctgctgcggttttaggcgatactgttaattatgaaatcggtaagcgtgtcggttctgctgcttctaccggtaaaggctggttcgggcgcttgatcaatcgtgacaagttgcgccaagcagaggccttcttcgataagcatggcggcaaaacaattgcaattgcccgtttcatgccgcttattcgcacttttgccccattcgtttccggtggttcccgtatgcactatggtaagttcatccactacaatttacttggcggtttcttatgggtcaccttatgcgtgctcggcggtttctatttcggtaatgtgacttttgtaaaagaacacttttcactcgttgcgcttggcatcgtcttgatctcacttctaccaatggtcattgccgcggttaaaacccgcactgccaaagtcgctgatcgctaatcatcaaatctaacaaaaaggcgcaacgcatgtttataaacaacatgtgctgcgccttttctattgctttgacccgagccgtgcatcttgccgccctcgccaaatgccccatatcatcactgcttcaaacaaaccaaatgctagtaggaaacaaagcatgaagaatccttccggcaaaacattgataatcggatcggttgccggatcaaacagccagtcctgattccggaaaagcatttcatgaaaaacaataaagaaccggtcaaagttcatcgccaatagtgccgttaacccgattggcacgactgccccgatcataaacggtcgcaccaacaagtaacgcttactcgtggctttgagccgatgtagccaacgaatagcaaaaggcagcgttacgagggccacgaggatatcgaaaataaacagacgacgcacgtcagcaaagtgaaccgctccatgcagactagttggaaaatcctgcattcgaagtgtcccaatccaagggaaattcaggtaagccatcaattgtaagtaattgtggtaaagccttcctaatgacatagcggcaatttgcggtaagtcatccatatgtgcataaattggaaacgtcagcaacgtgctcaggatcgtgaccaaaatgacggtactaattattgccagccaaagaaccacccactgcccagcgcgtttcatctaaacctcccagtccgttaactggtcaatttgatgcgttggctgatgaacttgtttagacacataatcacgcgttgacaccccggtataaaccaggatcgtatcaatgcccgcgtttaatcccgccttaatatcggtgttgtaattatcacccaccatggcaaccgagtctttaggcaagcccatctttttaagtgctttctccataattgtcggctccggtttgccaatgtaaaaagcgcgctgctgggtactacgctctactaatgcaatcagtgacccagctcctggaaccaatccccgttcattgggtaggttggtatccgcgttggtgccgataaacttggcgccacgcttaatggccaaagtcgccaattcaaacttatgataggtgacatcataatccaagcccactaccacatagtccggatccacttcatttaaccgtaatccggtatccaaaagtgcttgcttcaagccaagctcaccgatgatatacacggatttccctgaaacatccccgtgattaaggtccgtcaaataagccgccgttgccaatgatggcgtgtaaatctgatcaggcgtgacatgaatatcgtgatttttggctaaattatcaacgacatcttcagggcttttagtcgtattgttcgttaaaaataaaaacggaatccgcgccgcttgcaaccgttcgacaaaatcctttgctgccggaatccgttctttcccccgataaatcgttccatccagatcaatcatataacctttatacttcaagtctgtccctacttcttgttagtctcacgttgacggatcgtaaaatgccgtttgcgtggttggttttggtgtacggttttagcctgttcgccgcgaaattgcggtgatcgaactgacttttccgtgtatggtttgttggctttacgtttgccatgtaatgggtgcttattggcatgtttacgctgcgcattcttagtcgtttgcgaatgctgatcgcgtccttgccggcggggactcgacttaggggcgggcttgtctagacatgcaagcacaaagtaagcacagccaaaattacagtattcatacaggtaatcttctaatgtgctgataagctgatctttgctggcaccacggcgatcgtctttataaaagccccgaagccgtaactggtcatatccccagtcgccgacaatgaaatcatacttatcaagaatatcattatagcgttcatttaatcgctcaagatcgcaggcatcccgataattctcgacaatccgataccggcgcccatcgatcgtgatcaaatcgtgcccgacattgacgattcgtaaatctttttttaaggccggtatcaaggcatcatcgatttgttcggataatggtgatcgttcacccaagtcatgacctcctttttcatctaaaaatcgtttcatgcggcttatcatcgccgcacgtacacagcagtccttgcgtgggtgttccaaaagtataacacgaaactatcttggataaacttttgccatgtagtcaccgataacctgccgcaagattttggggaaaagcaattcattactgcccataatctcgatggttgggaaaaatggaatgaataaaaagttgtcgacggtcgcaaacgtatattgcttctccggaatcagcggctcaccttgccataaaacccgccgcttctcccgatccaccgttatcccgcgatagccgatatcgccaaaaattttcccgcgaaaactcatcccgatcatgtgaaagtgtcgtaaaaacatccgattcttttccatttccatgatcagccgccaaagttccttaccactcaaagtcaccttcagtaaatgcatcggatgcggtaagcaagctaacaaatcggcttgggtgacaaccccggggccaagaggggtcaaaaacaagccggcattcaaaattgcagcatccgtctgagcggttgctgccaccgcggctaaaccaaaatcaagtaacggtgagggccgatcgtagctaatggctagctgtttaggtaaatgtgcgacttgctgttgttttaataaggcgattcctttactttcatagccttgaatctcacgtggatccgccgcggcactttgcaacaaagccgtttgaaaagtttcggctcgccgcgtttgaatgtgatggtcatcatttaaggttaaggttattttcccaacataatgaccatatttttcagcggcggttaacaaagtggtgccatgcaattcgccttcagggagcaagtgatgcgtgtgcccaccgataatgacgtctatttgcggataatgttgcgccaaatgtcggtcggcttcaatgcctaaatgcgacaaaacaaccaaaacatcatacgaaccctccagctgcttaagtattgccgggaaaacatccgccaccgtcttaacctgccagccattcggttcatacgtgagaaaaaacggtgccgtaaagcccacaatcgccactcgggttcctgctggtgtctgcttcataacaaccggttttgcccagcgtggtctggtcccatccggctcaaataaattggcaagtgcaaccggaaaattggcatgatcatataaatgttccagcactgcatgcggattaccgacgccttcattattgccaatggttactgcgtcataaccgatttcgtttaacaattgaatgttaatctggccatcggttgcctcggttagtggcacggatcgatccatggcatccccatcgtcaaacgctaagacactagctccttgcgcttgctcagccgcccgtgttcctaacatgaatcgccgaatttttggccaattttcaaagtgggaatgcaagtcattcgtgtgcaggatcaccaacttctccacaaggcacctccttagactccttgcaaccagcatcttttcaaggtattgctatcaatccattctaatttcatcctatgcccgaaattgcgaccggtcaaaccgcttctgatcgctaccgttccttactcaaaactgcaacctttagtcgataaatctcatgtatttcagctgccgtcagtggcgtcccgaaaggcaaatgcggcaccagtaaatcgcgctccggtgcatccacgccgacgttgatattttccgcgatgttgacactattgtgatgaatgtgaccatgtagattcagtgtctgcttcacaattcccatcatcagcggatagtgtgtcataataaattgcgtgtgatcgtctttgataatcgtaccaaccgaatgaaacgtgaacttaggcaaaccatttacgcccgggtcatgccggtgcagatatttgaataacgattcataatcatgattgcccttgataaaaacaatgcgaccgtgaagctgcaataagattgccaaaacttccggcggctggggaaaatgctccggattcatggcaatgtcgcccaaatgatacaccacatcccgatcgtcaacccgtgcattccaagcttgaatcatcgcatcgtccattgcttctacagatggaaaaagtcgcggtgcaaagtcattatcacctaaaagatccgcgtgaaaaaagtgggtgtccgcaataaagtattgcatgttactccttccgacgatgtgcatgtcttgtcgccacaacccaagtggtcatcggtaccgttaagatcaccgcaataaccgaaatcaagacctgcaataactcgccaacgaaaattttgttattaatcacttgtgaaaaaggatatctaagggaagcaaaccagataaacaaagaggaaaaaccaccaaaaaaaccgaagaacagcgtgtttaaagccgttccaatgatttcatgacccatttgtttaatgcccgcgctgctcgcttgatccttaatttcatccatcccggctgcgaccgcaatcgccgcttcagcgatggcgccaagcgtgcccagtaaagttgttgcaatcagaatgtgtggaaaactaaccccaatatacaccgagaaaccttcaaggctctcggaatcttccggcccgaaaccggctgtttgacttaaggtcatgaccaccaaaatcaaaccgaccagtaacgtcatgatcaataaagcagaaacaaacgcaggcccagcaacattaagctgattggtgctcaaaaagatcgttgccgctaaaatgattaagccaaaaataaccgcgacaataatcggattgaacccgctggccattaatatcacgaccaaaatcataagcagggcattggcagccaaggcaaagaagttcgctaagccttgcttgccgccaacgataaacatcatgaccactaacaccaaggctagcgcaagaatcgcgttcatgctgtcaccttcttaatcttagccattaacgccgctaatccgctggtcaccggtactgccaggacaatgccgaatgcgctaatcagactttgggcaaaaccaagtcccatcacccagataaccgtttgcgcgatcgaattattattgcgaatccacaaaaccgactccataaacgtatcggcgatgaagatcatgaaaagcacggaaattaagggacccatcacattccgtccaatggccatgccagcgcgaaatcgttctttagccgtctcgtgaagctggaaaatagcgaccgaaatatcacttgcttcatcaagcacggctcctaaagaaccgataacaacctgagcaaagaacagcaactgcggcgtttgggtagcatatttgacctcttcaaaatgaaccccattgtagtttgtcatggccataatcccgtaaccaagcgccactgccagtccggtcgccaccaaggatcccaaagaaatagcaacagcaatcgctttaaatccgacaatgaagacagccgttaaaacagtaaaaacaaccgctaacccgacaaataaccaccaggcttgccactgtttactgccaatttcccattcaactgccgcaaagaagatcagcgtattcagcaaaatactgatactcgttaaccaagcacgccgtcccatcacaaggaaaatcaaaccaaacgttagcaccaaaagccccgccagaattgcgtctcgtttgacgttgttcaatgtgtaggtgcctttattgacatccaaaaacacctgctcaccaacccgcagctgattatccaagccgccgctaaacgagtaggtattatgcatggtgacccgccgcccccggttagcagtattcagcagccgaacctgcacctgttgcctcaccagacgatcgtgattctggtcttcatcctgatgactctcggtcttgactactttcacggcttcgactcgcccaatcggtttggtataaaggccgctatcaaactgcatgccgataaaaaccgcaattgccgctataaacggcagtagccatttacctatgtatttcacgcggacccctcgctttcatatgccttacattatataagtggcgtcaatccaacgcaaaatccccgaccggtttaaaccggaagttctaaaatggcgcgcctacacccgtaatgatgctggacttcatttaaaaattgatatttttattaaaatattcggctgccatgtaccttcaccgagacaagtgaatgcagcagctaattaaccgacgtgattttgcttgaggatctcatgataagcgtcacgaattgggccctccggcttgtcccattcttcccaactcgttaaatcggccggtggaaactcgtaatgttcattaatatatttttcataagtcgtcacggccgtcgaatgggcaatattcagttgaacgatccggacccgcttaataaaccctttcatcgcggctttttcggcacgtccgttcatcatgacgttccctagctcgaaataacgactcccgtcaagacgcgttatttcctgaattaaatcgaaaacctgatatttttctgccattttcaattaaggctccttatttgatttcacgaagtatgggaaattgtcccagtcgcgttgcggtgctatctttgtggtatgatgtttttttctggaaaggagcagcctgtatgggcaaacgactcacactgatagtctttttagtgccattatttcttctgctttcggggtttacgctagtcggccaccgtggtgatcctttaaattatccggaagagacctttcaaagtttcgacagcgcttttaacaacggagctgattacgttgagcttgacgtccatgaaagtgcagatggtgtgattgtgattcaacatgacaccacgattcagcgaacgactggtgccaacttggcgatcgcgaaaacaaacttcgcacaacttcagcaatatcataccaaaaatggcgaaccgattcacagcctagaggaactcttcgcccatgagcaacaaacaaagcataaattcctgattgagactaaaattgtaaaaggtgaaccgcatccgcatctagaagacaaagttgcggccctgatcaagcaatatcacatggaaaatcgcgtgatgtttcattcattctcagcagctagcctcaaacgcttgcaggcagttctaccaaatattccgcgaattttgatcgttggctcgcttaagcggatcaactttgacgtcttgacgtacgtggacggtattaatctaagttccgatttagtgacgccgcaacttgtcacccaactgcatgatcttggtaagaaagtttatgtctgggatgaaatgaacgaggatcgggcgaaatggacttggctcgtcaatctcaacattgatggcgtcgtcactaattacaccagcctcggccacgagtttcaaacgcttaaggcagctgctgtcaccaccagcatcaatgatcttggcgcaaactcaagccttgctgcactgccagtttatgaaaatccttatcagccattgttgcgctctgaacggctggcaccgcaaaccccgatcatgatttccagcatggtttccctcgctggcagtacttactatcaaattggcgacaatgcgtttgtccctgccgaaaccattaaccttgcccctgaagccggttgggcaagtctttttctccatcagcgcatcgtcatcaccagccgacactttaaggtacccgtgcacgccgatcccttacatcagcaagccattaccggccatgttggcaatcacaaatgctactgggtattagcagcccgttatcaaagcggccagctgtatttaaaaacaaaaatcggttggttaaacgccaaagatttacaggtgctgccaaccgccgagaatatgcatatctggctcacgctctatcgcagcatccccgaaaaccaaaaaccgctccttcactgggcacttggcgacacggccttcgatacaccgcttctcaatgccagtgtcctgaacatcggttaaaaacttgagttgctctatcaataggcgcggcgtctgtcttcactacgcattatcaatgatcgagtcattcattcgtttctatgccttaaacatgctattcttaaggcaacactagtaagaaagtaggttaaccttatgaccattaattggcagcaagaagctgaaaaattggaaccccaacttctctcagatctaaccacacttttgaagatcaattcggaacgtgatactgaccatcaaaccgatgagtatcctctcggaccgggaccggccaaagcgcttgaagcatttttgacgattgcacagcgggacggtttcaaaacattaaatgtcgaccatgttgccggccgcatcgaattaggcgatggcgacgaaatctttgggctttttggccatgttgatgtcgtgcccgcgggaccaggctggcaaaccgatccatttgaccccgttattcgcgatggcaagatttatgggcgcggaaccagcgatgacaaaggcccaagtatcgctgcttactatgccttaaagctcattcgcgatctcaagttgccgattaataaaaagattcacttcattcttggtaccgatgaagagtctgactgggtcggtattcaccgctatctcgaaactgaacctgctcccgacttcgggttttcaccagacgcggaattccctatcatcaatggcgaaaaggggattgccagttttgaaatcgttcaaaaaccaatcgccgctgcaaccgctgatctaacgttgaatcatttttccgccggtattcggccaaacatggtgccacaagaagcaaaggctgtcatcagcggaccattaccggaagcatttatgacgcaagccgagaagtgggcggcagagcaagaagtcgccctcaccctgacaccaggcaacccgacgacgattgaattgattggaaaaggcgcccatgcccaagaaccaaaagatggcaaaaacgccgcaacctatttagcaacgcttttggccgacttaccatttgatccagccgggaaagcctatctgaccatgattgccaaccaccttcatctagactcacgtggtcaccatttagggattaattataccgataaactaatgggcgacctgaccgcaagtccggatatcttcacctttacgcaagacggtccccaaagcgttctggtcaatgtccgctacccgcaaggaaccgatgcagccaaaatccgtgatcagattgaaacggcgctaggagcagatcagtacaatgtggcagtcagcggtcacgctcaggaaccacactatgtatctggtgatgatccacttgtcaagacattgcttcagacttttagtgatcacacaggcatccccggtcatgaacaagtcattggcggtggcacttatggtcgtatcatcaaacgcggtgttgcctttggtgcccaaatgccaggccaggaaaatgtcatgcatcaggcaaatgaatatatgccgatcaaagacattgtggcagcagtcgccatctatgccgatgcaattagccggttagtgaagtgactttgcccgcttgattgcgctgcgaacactaacgccttgacgctctttaaactaatcatgcaacccaagcgccagaagtcggcaactcacgatgttgcggtgacttctggcgtttgtgcgatgcaaatcagaaaggaagcttatgatgtttacacctcatgctttagatccatggttagacgatcctcatttgcgtgcagccgttgctactcaagcaaccgtgacctctaccaacaccgttttaaaacacgccgttcaaaataacagtacggttccccaaattcttattgccggtgaacaaactgccggagtcggccgccatggcaaacattttgccagtcctgccgatgcggggctttatcttagttacgcattccatccgcaaatcagtcagtccctgatcacaccagctgcaggggttgcgctgcagcaagcaattgaaacccagtttggcattgtgaccgcgatcaaatgggtgaatgatctgcaaaaaggtggtcgcaaggttgcgggcattttagcggaagcactcattgaacacaacgctgtggtcttaggcatcggggttgatctttttccggctcaatcagcagtgctgccaaccgatcagccgatcaccacgttacttgccaatcagccagatagcgatccgcgtccagaactggcaggccgatttttaaccaatctgatgcgtctatttgccaatccggaaaccattatgccgatttatcgcgcaaaagctgcatgggttggccgccgaattacggtgaatggcacacaaaacccgctgaccggaacaatcagcgggtttgatgataatggtgccttactgttacaaacggcccaaggtaccatggtggttacgagcggcaccattcgtttagccgactaatcagttcagacagccgttaattagccaagagtaatttagttagatcactaaattcgttcagttggtaagtcggggtaatttgatcgcgattcggctgaaaatgcgggttaaaccagatcgaatcaatcttaccgttaatcccgccttgaatatccgaggttaacgagtcgcccataatcaacgtctcgttgcgattaaaccgcggaatatgtttagcaacataatcaaagaacgcgacagtcggtttgggactacccacactatcagaaacaaaaatatcctcaaagtaatcaatcaagccactggtagccaatcgctggcgctgaaccggctcaataccgttactaacaatgaagagtcgataatcttttagtgcatccaaggtttccataacatgtggcaataagatcgcttcttggtccaaaaagtggtgataagtgcgttcagccaagtgcggatcagcatcaatgcgatgatgccgaaatagcttggcaaaccgcacatcaaaaagttccggtctagtgatacgacctgcttcgtaatcgcgccacaaattggcatttatctttaaataactcgcttcaatccgcggtgtgtacgttaatttcagcttggcaaacatttttgccaggctttttaattcccctgctttaaaatccaacaaggtatcgtccacatcaaacaaaataattcgatacataacctgctccattctctcattcatgacatatgctattagtcttacacaatgaaagttaagtcgcaagagcgtgaaccggcgcgcttaggagtcggagtgtaagcggcctgggacgtgatggctgggctttggccattgcgccccaggtccttacacgcagactcctgcgccggtgaacgcgtttcagaccagagcgtgaaccggcgcgcttagaaatcggagtgtaagtggcctcagacgtgatggccgggctttggccattgcgtctgaggtccttacacgtagatttctgcgactgtgaacgcgtttcagaccagagcgtgaaccagcccgcttagaaaccggaacataagtggccttgagcgtgatggcccgggcttggccattgcgctcaaggtccttatgtgcaggtttctgggctggtgaacgcgttttagagcagagcgtgaaccagcccgcacgcgtaaacctccccctaaaaaaccaccaccccaagcctaacgctccttagattcaaacctccaaacacctcacttggcactccccatttacagcattagaatccgccctgtttttaaggtatactaaggcgtactagaccaaaatttaaggtgggacaagcacttgaaaaagttcgtcaatcgggtcaagacgcttgggactcgattttgtcgttggttcacgcaattcgtgacccggcatcccgattccaaagcagataccaatcaacaactaacgggtaaagctgccgttgtctattatggcaacgtcacacttcaaagcatcaaaacaactgtttactatttattaggcgttttaggcattgctgtcgtgtttggcctcggcttgtttggcggctattttgtgtcgattattgacgcaacgccaattccaactgaaactgctatgaaagcaacgttgtccaataccagccgcacttccagcatgtattttgcccacaacgtcaagcttagcgatgttaaaagcgacctgtactcaaccaaagtcaacctcaatgagatgtcgccatggctcaccaaggcgattatcgccactgaagatgaagacttctatcgccacaacggcattgttcctaaggcggttatccgtgcgttcttctccgacttaaccggtatgggcagtcagacaggtgggtcaactttaacgcagcaagtggtcaaaatgatgtttttaaattcggagacaacctttaagcgtaaggctgctgaaattatgctggcccggcgcttgaacaatcacttcagtaaaaacaccattctggcaacctatctcaatgttgctacgcttggtcgtaataacaaaggccaaaatattgccggagttgaagcagcggcgcaaggactgtttggggtttcggctaaggaagttaacttgccggaagcggctttcatcgctggcctgccgcaaagtccatttgtctataccccttacacggccgatggtaaattgaaaaccagtctcaaagccggtatcaatcgccaacaaaccgtcctcttccgcatgtaccgggctggcgttatcagccatcgtcaatatgttgctgccaaatcatttgatctaaagggtgcctttctccagccagaaaaagcagaccaggatgatgatgagtatggttatgtctataacatggtactaagtgaagccaaatcattgttagccgagaaattagcaaaaagcgatggccattctgcagcagagctcgcaaaagatagcgctttaaacaatgattatctccgacaggcaggtgatctttttgcgtccaaaaactatcgcattaagagcacgattgacaaagatgtttatgatcgcatgcaatttgtcatgcgcgcaacccgtgatacgttcggtcaaacttataccagtagtcagattaatccgaaaaccggtgaaacggaaaccgttaaatacccggttcaaaacggatcggttgtccttgataatcaaaccggggccgttctcggctttgttggcggcgttaccggcgaactcaaccatatttataccctccgttcccccggttcgacgatcaagccacttttggtttatgcccctgcgattgaccaaaaaattatcggctcgcaaactgccttagctgatttcaaaaccaatctcgggaacaattacagcgtcactgactatggcggccagatccaaaaccgctttatccctgccactgaagcactggcacaatcctataacattcctgctgttaatctatataaacatatcaagccatccgtaaacgtcaaagcctacatggaaaagatggggatcaacaccctgaccgacaacgactatagtcaacttggtctggcacttggaggtactgattacggggtcgacgttaaggagcaagccagcgccttttcaacattcgccaatcaaggtgaacatgttcccgcctacgtcatttccgaaattgtcgatccctcaggccatgccgtttatcgccatcaagtcaaaaagaccaaggttttctctaaaggcaccaactacattatgaaccagatgctcaaaaacgtggttgcatccggaactgcggaaagcctgaactatcagttgcgatttaataccgataatctgattggtaaaaccgggaccagtaacgattttcgcgatatttggttcatcggctcaactccgggcatcacgattgccagctggatggggtacgataatagtaatggcacgaactataccctcacggaaaatagctcgatgaccaatgaagcatattgggcaaaactggccaatgcggtatatcatactattcctaaaaaattcaaagcggataagaaactaagtcgaccgagcaccgtcaaatccgtcaccgttgataaacaaaccggtcagccggctgcaagtctttcgtttaacgggcacacctaccgtactggcggctcaactgtgaccagcctttataatgactgggagccaaccgccaaggccgagtttgcaattggcggcagtaaagataattatcagctgttctacgattatcttgatggcaaaagcaatggttatggccaagtgtcagatgctaacggccgctccaccgaggctaaaaaagaacatcaggaaacgccgattacgacagaaaccccttcatcagcaacagtttctagcagtcgtacacctagcgtaaccgtgccatcgagtcagcaaaaccaacaaggcacttcggaaaatcaaccgagtgagccgcaaactaccggtactggcggcaacaatggcacaaccggtggcggtactggcactgaagcagccaccaccagttctgcaccgacaacaggcggtaccacgactactccgcaaaccccgtcaactaatacaggtaccggccattaactgattaactaccgtctaagcaatgcgcggatggcagcattgatctttatcataccaacaaaccaaaaagcagatgaaccgcgccatatatgcgctgattcatctgctttttatcgtctatgcttgcttggcatgccgccagaatatcgtgttacttctgcctacttggttgaaccacgcttaagaatatcaaaacctagcataacggtcttttcttcgatttcttctttattcatcatcttggtgagcaagcgcatcgccaccgcaccaatgtcatacaaaggttgatcaatggaggtcaactgtggccgtgtcatttccgtcagcttcgtattgttactggaaataatttcgaagtcttccgggaccttaacgcctttgtccagcgcaccatccaaaatgccaaccgccaattcgtcatcgccggcaatgacagctgttgcgccaaccttttgcaacttaccgaataaggccaacccagcctgataacttggttcattttcaaaaatcaggctttcatcgtaagcaacacccgctttttcaagtgcctgcttgtagcctttcaagcgaaattgaccattgatcggatgtgtcaatgaaccggttgccaaggcgacgcgcttattgccgctttcaatcaactgtctggtcgcctcttcaaccgcagccacgtaatcaatattgacgctgcctacctgttcgtcaggatcaattgacccggccaaaacaaccggtgttttgctgcgtgaaaactcggcgcgaatcgcatccgtcaactcgtgccccataaagatcaaaccatcgacttgtttcgccagtaaggtgttgagaaccgagacttccttttggttattctcatccgaattggccagaatgatgttgtatttgtacatggtagcaacatcgtcaatcccccgcgccagacttgaaaagaacatgttggtcacgtcgggaatgataacgccgacagtggtggttttcttactagccaagccgcgggcaactgcatttggtcgatagtcaaggcgctcgatgacttccaaaacctttttacgcgtagccggtttaacatttggattgccgttaacgactcgtgacaccgttgccatggacacatttgcttcgcgggcaacatcataaattgtaattgtttgtttttccactttattttctccttagtcgcgaaaatgaaaattcacgaaacctctatttacattccaaaataacagaaccagaacggcaatgcaagcgttttactgatttttccatgaaattttcacaaataggcttttcagaaagttttagcattttctccgtgttatactgatgggtaaagttgcgtttgtgttgcttgctaagccgctagcagcgagttttaaggagtaacctgaaccaactgttttcaacacaccacaggacatgatgaatcgtcaagaaactgacttacccagtggctgtttaatcaggtatgtcattttgacgtttacttttgcatttgtcctttgaggaggaaaatcatgaacgaacatttagcagcattacagacttggatcggtgaagagggccttgatcttgcttacattagcgacccgatcaacatcaactactacaccggattcttccaagatccagaagaacggattacggctttaattgtcgctccagatcacgatcccttcttatttacaccgcaactgaccatcgaagaagtcaaaaaagccggctgggcctacccggtattcggttatcttgatcacgaggacccgtttgcaaaactggcgagtcatattaaaaccgtcaaccctaatccaacgaaatgggcaatcgaaaaagataatctcgccgttttcaaatttgaagcgatcatgaagcagttcccggacgctaccttcccgattgatgcttctcgttttattgaaaaacagcgcctgatcaaaaccgcttcagagatcaagcagatggaagccgctggtgctcaagccgaccgggcatttcaggcaggattcaatgccattaaagccggagcaaccgaacaagaagtcgccgctgaaatcgattatgccatgatgaaagaaggcgtcatgcacatgagcttcggcaccattgtccaagctggtgtcgatgctgccaacccgcatggcgaaccgatgggaacaaaactcgcacctaacgaattggttttgttcgatctgggcaccgacaatcatgggtatatgtccgatgcgacccgcacagttgcttttggtcaagtcactggtaagccacgggaaatttttgacatctgtcttgaggctaatttaaccgcgatggacgctgttaagccaggacttaaagcatccgaactggataaaattgcgcgtgatatcattactaaagcgggctatggcgagtacttcaatcatcggctcggccacggcatcggtatgtcgacgcacgaattcccgtccatcatggaaggcaatgatatgatcttgcagcccggcatgtgcttctccatcgaacccggtatctatgttccgggagtggcgggggtccgcattgaagactgtgtccacgtcacggaaaccggctgcgaaccatttacgcacacatcaaaggaattcacggtcattaatggttaacttgtgacgttaattgttgcgcttttgaaatcgagggttacatgtcaatctagtaaaaaaggttctaacaatgacaagctcagtcattgctagaaccttttttagattcactcaccaatttctttcagcctaaaagctcagatactaaactatttatccctgatccgctgcttcctccagctgctcatataagatacccgcctgatgaagcgccattttaatcttcgcaatgtcgcttttctgcttgacactaatgctgtgcaaatgaataccgcccgttaattctgataaaagatggccatgataccgcgcgacccgactcaagaacagtttcatgtcggcaacggtacgaatattcaattgcccgcgtaactggccatacaacggatgctcaaccaaaacgtcttcaatccagccaccgttatcaagaatcaattgaagctcctgctcggtttgggcgggggtatgcttacatggaaccaaaaactcaagtgcagctggttgcgataacgtatagcctcttggggtggcgataatgggttcgccttgtgcccgtaatagtgcaatatccccgacgatcgtttggcgactgaccgtaaatcggcgtgcaaaactcgatgcactaagcggttcagctgccgtactcaatgcagccttgatatgcgcctgacgttcactgtttaacatgttactccctcaatttctaaccaaaatagccaattcggctcgccttgaccgttacgatgtgaaaagcgacaagcgaagggtactcacacggagttacctttcgtttgccgccatctttaatcatcaaaaagctgataattacttatctgctgcttgagaatctgccgctgccgaatctgctgatgcctctttaatcgttaccggttttgtcggttcaggcacttcatcggtgcgggtttcactaccttcatcatcgtctttcgcctgcgcaaacgcacttttaccatcaagaacgatgtcatcaaagtcagctgaagtatcggtatcattagccgtgttcagctgatcgcgtaattgttcggttgcagcatcataattagccaaggcttgtgacccgtcagcatcgttaccgcgcgtcttgatctcatctacgaaatccgttgcactttgcttccaatcagcacttgcttctttggcgtaatcgaaataatcaaccgcgcgatcagcaaggttctcagacgcatgcttaacccgccgcttcaactcatcactggtttgcggtgtcaataaataagtcgttgccaaggcgctagcagctccaaatacaaatccaagcaaaaaatgtccttttttagccattatgtttccccctgctattcattttgatgtttctttttggtcaacattgaaaatgctttggcacccattcgtgcagcaaccgttgccttagccccgttttttgcaccattcgtgacccgctgagtgagctgacgcgttgactggttcaagtccgaaacactttcgccaagttcaccaatcgcggtaaagaccggatcaatcgccgccaccttgccatttacatcttcaagaagggtattgctcttggcaagtaggccttcaacttctttcgtcaaaatgccaagctccccgttgatcgtatccaacgtcttattcgtctcagcaacggtttctttaacttctttggttacgccagaaacgcgaacagcaatgatggcaatcgccaaagcaataatcaaaaaagccgttgccgcaataatccaagcaatctctccacctgacatccaacaccctcctatttcaaaccagttggttacattaatcataacatcgtcacaacacgcgtgcaaaagatttaaagagcgtgagccagcccggttagaaaccggagtgtaagtggccttgagactaaatggctgggctatggccatttagtctcaaggtccttacacgcaggtttctgggctggcgaacgcgtttcagagcatgagcgcgagccggcgcggttagaagtcggagtgtaagtggccttaagcgtgatggccgggctttggccattgcgcttaaggtccttacacgcagacttctgcgccggggagcgcgttatgggcgtaaaccagaatataagtggccttgagactaaatggctgggctatggccatttagtctcaaggtccttacacgcaggtttctgggctggcgagcgcgttatgggcgtaaaccagaatataagtggccttgagcgtggtgaccgggttgtggtcaatacatccaaggtccttacatgcagatttccagatttccgatcccgtaaacgcgtttcagatcctaagccgatttcagacgtagctttctgcacctacaaccacatattgaaaccatccgtccccacactcgccactcgcactttctccacaaccctgcctaacattaaaaattgcctcacacgcggcaaatccccagcaagctagccctgattctgataaaatgaggctaatacaaaggaggccatcacgtgattcgcacgatcttcacaaccgcgaccgtgactggacaatccaatgtctggttaaggtactttacgaaaataaattgggaccagattgccggaactttgattgataaagtgctctcgttgctattcttctcaattctgtttcttgcgctctaccgcttaggccaatttgccatcaatcgcacctttaaaagttaccaacatcgcgccaagttatcaggaacacgcgtcaaaactatccacgcgttgtccaaaaatctttttttctactttgttctcttcttttatttttacgcgatcctctcaacattaggggttcctgttggcacgttgctcgccggggctggtgttgccgggttggcgatcggctttggcgctcagggcttcgtcaatgatgtcgtaactggtttcttcattttgttagaagcccagtttgatgttggtgatgtggttaaactaggaacgatttccggaaccgtcactagcctagggttacgcacaactgtagtaaaaagctacgatggtacggttaactttattcctaatcgcaacattacgattgttagcaacctttcgcgcagcaacatgcaggtacttatcaaattgccgttagccccaacgaccgatcttgatttggtccgccgaacgattgaacatgtcaatcacaatctggtaccgaaattctcaaccattacggatggaccggatatccttggcctgactgaagaaaaaaacggaacttttacctatcaggttctgttctacgccgaaaatggtgaacaagtcagcctccaacgaactttcctggctgcctacattgccgcattgaaatctgccggcattcatgtcattacaccgccgctgaatctgcaagcaggttcatgatcgaccttatccgtgtttgtctattaataaatccatctataaggagatgtcatgcttaattttatcaaaggtgccattatcggcattgcacttgtcattcccggactttccggcagtatctttgcggttgtggttgggctttatgatcgcctcttaaatgcacttaatcactttcgcgccaatccgcgcaaaaatttacgctttctgaccccggttggcttaggcgcaatcgtcgggatccttttgtctactaaagcggttctggttatcacgacccactggccattaccgagttacggctttttcatcggcttggtactggggatcggaccgttcatttatcgcaagctggttcttaagccgttttcatggtggtatcttttgttggtgcttggcggatttattgcgatttatggattagccaagcttggcggcacccaaccggagaacctgatcgccattcaacgactatcgagcgtgcaggatgccgcaatcatgggcttttcaggtatctttgccgtatcattaatggcgattcccggaatttccggatcggtcatgctcatggtgatcgatcaatatggcacggtttaccatgctgtcagtcagttaggtgatgctgctcgggctttggttgccggtaattgggccgggtttacgtctgcgatgggatctgtcgccttactggtaccttttatggtaggtgcgttgatcgggctcattgccattgccaaactaatgggttatttactagaacattttgaggttgaggtttattactcggtttgtggcattgtcgccgcggcggtggtcattctgattgaaacagggattgctccttattggccaactacgggtacgctggctgctgtattggctgttcttgtcagtctcgtgattggggttttggcaactgtctttttggataaaccggaaagcgatcgggatgcctgatgacagcaaaaaaaccagcacgcattcatttgctttgctggttttaatcaattaggattctttctccgttaccggtgtgaccggctccaattgaaactgcttgtcgatgttgtggccaatgttgttgatgcctttcatcacttcacgtcgcgtcacaattcccgtaaagtagccatcctgaacgactggaataaacggattatcgaccagcaaatgtaacacagtctccaaatcatatgggtcgttaatcgtggcgacatccgtttgcatcacgtctttaaccgtcatggtgtccaaagattgaaaactgatatggtccagccccagcatcgtgtcggtaatcataggtagtgagatgagtcctttgaacttcgaatcatgatccaacacgggaatctttgcatatctaacctttgtaagcacaagaaaagcgtgactcaagggattattctccgaaaccgttgccaccatatccgcagcgatcataaagtgatgccgattctcaaccagcatgttggcaatgacctgatttaacatatgactagctcctttttgatattgctattctagtttaaaaaagcgaaattatgttgagctaagtaaccttctttacagcatcttaacgctcattaaggtaagtgccatccgccaaaagacggataaacacctcatattattttaccatgagctgtctataacgcgctctccaagggaatttcaatggacggtatttataaaaattgatacactatcttgagcaataattatacttgtataagctccactgaaactttaatgatctttgactaatttggaggaaaaaaatgacatatgatttaggagtgcggttagccgctgaatttattgggaccgccgttatggttctgttagggaacggttccgttgccaacgttgatttgaaaggtaccaaaggaaatggctccgattggctgttgatcgcggttgggtatggtgccggggtgatgatccctgccatgatgtttggcgccatctccggtaaccacatcaaccccgcctttaccttaggattagcagcatcaggcatgtttccttggtccgaggtgctaccatatattgccgttcagatggcaggagcaatggtaggccagctgcttgtcgttgccgcgtataaaccgcattatgatctcaccaccaatacacagcatattcttggaactttcagtacgattagtgccaccaagagtaagctgaatggttttgttaatgaatttatcggttcctacattctttttattggcgctctgggtattactaaggcgcctttcttccagaacaacctgggcactgcacacatgggtttaggatttctcgtggcaacgctggtagcatccttgggtggcccaaccggaccagcattaaacccggcccgtgatctgggaccgcgtatcttgcatgcactgttgccactaaaacacaaaggcagctccgattggggttacgcctgggttccggttgtagcacccatcgccgctgctatcctagctgttttaacgtataagatcttatttctttaacctcaaattaaagatgaccatataaaaaacggttccgtaattgggaccgtttttctatactcgcctattccgctgccacaatgttttcgtaatcagtgtgatgattgcaaaaaatcacggcttaacggtgcaacgatactgccatcacgcttcaagaaatcaacgtgaatctgatcggatgtaaaagtaaccgtggcatatgtgccgccgagattggcgaattgccctcgcggctggctaatagagcctggattcaacacaatcatcccggcatgttcttcaacgcccaactgatgcgtgtgaccaaaaatcacaagccgtgcgtgggctgcttcccccgccgccaccagcttatccagtccaaagttcaccccgaaacgatgtccgtgtgtcataaaaatcgtggtgttatcaatagttgctgtaacggtcatgggaaaatccggatcaaaatccatattacctgcgactgcacgataaattttaaaaagcggatcgtttgcaggtaattccgaatctcccgcataaaaataaccatctagattcggctgttgcttcaaaatagccgccaaaatatcgcggtcgccatgtgtgtcactcactgccaaaatcttcatacattttcctccaaccatgcctgccaaaccttctccaatgcgcgcattgcattaccacgatgactaatttcattcttttcatccgcggtcagttcggctaacgttttatctaacgccggcaccaggaaaaaaggatcgtacccaaacccgtctgttccacgggggatcgccgtgatgcgtccggatagatcgccatgaaccaccaaatcggcttcagggtgattgggcttggctaataccagcgtcgtatgaaacgttgccgttcgcgcttcttcagggacatcggccaaagcagccagcagtttggcgttatttgccgcatcattgtgaccgtcaccggcatagcgcgccgaacggattcccggttgtccatccaaggcatcaaccatcaaccctgagtcatcggcaagcaccggcaaatttaaatcctgtgcatactgatcagctttttggcgggcatttgcttcaaaagtggtcccggtttcatccaccgtgggcacagtaggaaaatcagccaaacttttaacggttacccccgctggctcaaacatcgctttaaattcttttatcttgccggggttcttgctggcaatgacaatggttttatcagtcgcctcagaagtcggctctacaaaatgcgttggttgtgtatcaatgtcaacatgctgtgcgtgcatcggtttttttagttccaaccatgattcccccaattcgtcaaacattgatggtgcgccggtcgtataatacgtatgcgttggcacctcgctaccatcgttggctaagtcaaaatagtcaagtaacatcgaaacatcattaacggtttcagcaccagaatcaattaacgtgacgtcttcacccatcacattttgaataatcggccgcaaaatcggataatgcgtacaacccaacaccagtgtatcaatatcttgatgcaaaagcggctgcaaggtgtccgctaccacacgcttggcaatcggtgagtgcgcttcgttactttccaccagcgacacaaacttgggcgcggccagactcgtgaggcgaatgttaggtgctttggctcgtaaagctttaggatacgccccgcttttgacggtaccttccgtagcaataataccaatatggccggtctgggttgcctttaacgctgctcggctaccaggcttgatcaccccgatgaccgggatcttcaatctggccttgattaacggtaatgctgccgccgttgccgtattgcacgcaattaccagcattttgatatgcttggtgagtaaaaagttgaccatctgccaagtaaatgcctgaacctgctcagctggccgcggtccatatggcaagcgtgcctgatcccctaaataaatggtgttttcggccggtagctgatggagcgcttctttcacaaccgttaagccgccgacacctgaatcaataaatccgattggttgcttgttcatcataattctccttttgaatcacttgatgacggcaagaccgccgattagtggtcgccgtgtccagaaagccgctgtcggccaccctttcacgccaacccatcccgtggtattcccaacatcaaccctatccctcgaaaaggaacgcagccgtcgatcccttatcgtgctggcctccgctataaagctccgagtctttattgtgagtttaatccaaaaaaaatgcaagcactcagaaaagtatgttatcaatccatttttcagctatactagacgaatagaaacaggaggcacaacatggcaaaatctgattataccaccctgctgaaccttcccggctcggtttcattctttgcaatcacggcaatgcgcgatcttatgctgccaaatatgctaggtgaagaacagcaccatattctctattgggctggacgtgacttggcaaccaaattacctgtcgcggaatctgccttaccacagctattcacccaggttggtctgggaactttgtcgccacttaaacagaaacggcaagagcgccaatatctgcttgcaggagatgttgtcgcgactcggattcgtacttatgacgatcccgactttcaactcgaagccggctttttagcgcaagcgctgcagcaggtatttggctttgcagtcgaaggaggcagtgccattcagcgccgcgagcaaaatgttgttctgactgttgtgatggacaataaagatgcgcaacccaccgccaaacatttaattgatcttgccagcgatcaaagctgagtcaacttgcatacagaaaataaacgaagggcaaatggattttcccgacatgggagaaattcgtttgcccttcgttttttatgcttgcctcactttttactacataatgcgatggcacctaaacctgactggcctctaatccaacccattggccgattgctgctgccagtgtttggtataaaactgatcattgagtttgtaatgaacgggagctgctttggttgtcttcaaaaatggccgcaccgtttgatccatcttcagccagccgcgccagccaatatgaatggtatcttccatgaagtaaggctgtgccccatcctgactcaaatccaaaacgtgattaaagccttgtgttttcagctgatacttcattttggtgaccgtgttttgaatcatgcctagatccagcccggtgaaggccgcccattttgcattgatcggcgggataacaaagagcacttccatatgcttcttggcgaacgtattcagcactaattgtaagtctgaatactcaggcgacttaacataactccaagttgcctgcgaaccctttaatttcggcatgttccgcttaacccgctttgtgtagaaatcattcttcaattcaaatgggttattggtcgtctcctgcatccccatccgcgttgccaatccatctagatcatcaacatcgtaagtacttggcaatgtcttggcagccttatcaagttgcggttggttattatttaaaaatagccgtgaaaacaacgcatcctgatgatcagccattggatccttgacctgcttcaaataccaatactggccatctgacagtttctgaccggcagcaatattcttcagtgcttcattgacggttcgatcagaatcggtggacggaaattgaagtaaccgtctggctgcaaagcgatccgcttccgaattcgggttagcatgaagtaagaaggtcgtcatctgtgccggcgaatagaaataatcaaactgggctttgcgaacgccgcctggtacaaaccattgtggggacagcaccatcactgccttcttgccttcaacatgcgtcaaggcattgatggacaagaagtgcgtgagtgattgcgttcccgccattcccatgagaaatgggcgataatcacgatgatacttctgagccaacacggaagggtgaaatgcgtccatccgcgacaattcggatgacccaatgaacgggacatagttttcggccatggcctcgttttttatagtttcgcctttcagcacgttggccgacatggagctggccgcctgcctgatcgttgcttggctgctgcggccaaacttaaatggcacgagcatcaacgcagcgaccaggatgatagcgatcagcaacgggccaagtccgcgccaaaggatcttcccgatcggttttttcattgtgcttgttcgacctttgcaatgattttatttggtgtatcccattctttacgatcaaattctgaaaccggtgcgtcaacgccaaactgactctgtagttccaatagcaactgaaccgttcccattgaatcaagcaatccggtttcaaataagttcagatccaagttctttttcacatcatccgaacctgtcaaatctgccaaaatatccaaaacaccatttttaattgcttcgtctgccatgatgaattacctctttcttttaaaccctagccaatcttcaagcgattgaccgcctacaacaacattcttttagtggaaccacagcttgtctaagaaaccggagaaaatcaaaaacgagaagcatacagcattagcggtcatgaaaatggcgaagtagtgcgttgcgcggttatgcgggaaaaagtccttatgctttttcttgaaccgcagccatgcatccgtcagattaatgagcatcgcatggaacagcccatagacaatgtaataccaggtctcaccatgccaaatccccataatcaggaataaaacgaggtaaccgacaaatgccgtccagacccgcgatttaatccacttgtgtttcatcataaagaacacaaagcgcatatagatataatcacggaaccaaaagctcaaactcatatgccaacgattccagaagtctttgatgttatatgacatccaaggcttattaaagttcatcggtgtttcgatgcccatcaagtaggaaatggcaaccgcgaacaaactgtaaccggcaaaatcaaagaacaaataaccggagtaagcatacatgacgcccacgactggccaactgagtcccaagaaagccccaccgcgactggccatcgccatgtgttcaacagaaggcagccacaaggttccaaagatgtaccccagaataaacttatacagaaaaccaagcatcagatagtgaatcgctttggtcaccaactgggcgtaatgctcgggatcaggaacgcgatcgtaatctttgacaaatcgccgataccgatcaatcgggccacttgagatggttgggaagaatagcagaaattggataaacttccacatgttcaggtctttaatcgacccatcacgaatttccataatcgtgccgaccactcggaaagttaaataactaatgcccaagaagccaagaatagacccatgatgttgaaacagcggcgtaaacttgacaactgccagctgcgcaattcctaacgcgacactaagataaaagactgccgtggagttttttgagccttcgcgcgttcgatatttgaaatacgcgtaaaccagtaataagttgaaaaccacataccccaataacgcttttccttgaggccatttatcggcatcaaaaatcagtaccaggaaaaccaacgaaaagatgctttcataccaatgcatccgaaagcctttgaacatgccgatgatgacgggaagcaaggcaatgattaaatagacaaaatactgtggattctcatacggttgtaaattaagcattaatgatttacctctgcaatcagtgctttgcgatcaaccttgccattagccgttaacggtaactgatcccggtaaataatccgttggggaatcatatattccatcaccattttccctagttcggctttaattgcctgcgttagtttcatttcgctatcaaagtcatttggtttggcaaccgcaaaggcaatcaactgggcaactttatgatccttgtcataccgcggaaccgttgatgcctgcttaatataagaaacctgattcaaattatgatcaacatcttctagctcaatgcgataaccatgcaacttaacctggaaatcagtccgaccgcgataaaagaccatcccatctgcggtcatggtcactaagtcaccagaccgataaccgcgttgattgccagccttgaaaaatgccgcggctgttttgtccggattattgagataccctttcgacacgcttggacccacgatcatcaattcgccttctgtgccagctgaaacctgttcaccttgctcatcaaccacataaacgttggtatcaggcttcgcatagccaatcggtaaccgcggatattgatcaacaatcgcctgggtaatcgccattcccgtaaccgcaacggtggcttcggtcggaccatacgtgttatagacggttgctttcgggaaacgtgtgatcagcgcttgggcggttttattaactagctcctcaccgcaaaacagaaaatgggtcaggttcggataattttcctgcttgaaattcggatcaagtaacgcaatttcgacaaaagaaggggttgatacccattcgttcaagcccaattttggcaacgtcgcaaataattctttaaagttatcagtgacttcttttggtaaagccttcaaggtgccgcctaaaaccaaggtcggataaagatccatcacacttaggtcaaaggaatacggcggctgagacatggcgacaacgccttcttcaagcccaaagtcggaaatattccagttcacatagctcaaaaggttatcgtgactaatctgaacgccttttggtttccccgttgtgccgcttgtaaagatgatgtagtaattatcatcgccagcaaccgcatgctgcagtgaatgaattggcgcgtgtgactgctcagcttgatgtaacgccggtgcccgaataatcttgacatctgggaccgtaatcggaagcggtgccacttcaatcacagcaggcgcatgggcaacatcttgcacctgggtaatccgttcatttggactatgcgtgtcgatcggaatgtaggcatgccctgatttagaaagtccaaggaaaacctcaaccatgtcaaaggtttgaccaccatagacaatgatgggttcaccagccggcaatgattccgcaaagaatccagcaaggcggtcactgccttctttcaactgggcgtaggtatattgggttccttcataatcataagccacgcgcgttggatgctctgcggcgacccgatcaatcgctgtaataacattatcgatcatcgcggtttccccctttaaaactcgttataaatgaatttactgttgttaataccgctgtaaccgtatagataaaccaagaccagcagtatcacgaaatacgtgacggtccaaaagatgaaccgaaatgtgggattttcccacaccgcttttaattttgcgaacatcttgtcaccccacgttcttattgacacatccattatagttttacagaaaaagcctcgccaacgaaaagcgtaacaatcacctaacagtttcgtaatgtgaatcaaacaggccagttagataaccgtccgaagtcccgaaacactaggcatcgccggcattttttcaaactcgaatcagcgcaaattcagccggtactttttgcctgaaaaattcggtgacggaccatcgaaatagcttaaatatatccgcttaaagctaaaaaagatattgttttccctcgttttagatgaaatcagaattttgggatatttttttgctttcttgattctggcgtccccgaaaaaatggtcaaaaaaacacactgaccattcaatcagtgtgtctgaatcgcaaattcaattaagcggtgtacttgtttaaggttgcttctaattgatccttggtttgataaccgaccagcttttcaacgaccttgccatcttttttgatgaccagcgttgggatcgccataatcccgaatgatttaggtgtctccggattagcatcgacatccatcttaacaaacttgacgtcatcgcgactttcggctaatttgtcgatcactggactctgcatccgacaagggccgcaccaagtcgcccaaaaatcagtgagggtgacgccagtgtcggtctccgtcttgtagtttgaatctgtaactgcttgaaccatgaacggattcctcctcttactttttgtaactaaatcatagcacatctgccggcaaaaaactagccaactacttgaaattaacaatcgtcgcgccggagccgccagcattttgcggggcaaatccaaagcttttgacttggcgatgacgtttcagatattgggtaaccccattgcggatcgcaccggtgcctaaaccgtgaataattgtgacggatgggtacccggctaacagtgctgcgtcaatatactggtctaagtcagccatggcctgatcgtagcgttcgccgcgtagatccaaggttgttgaagggccgctcatgccaccgccactgactttgacgaccggccgctgcttggctacctgcttagatggtttgatcttttcaagctcggttgtcgggactttcattttcaaaattcccaactgtacctgccaatgatgctcatcgaattgttgtaacaaggtcccggtttgatcataactggcaaccttaacctcatcaccaacatgcaacgcctgcttttcgcgttctcgccgcaacacgcggttcttctgaagcggttcatcttgatgcaaccgttttagatcggttttggctgcgattaactgattttctttgacggtacccggattggtcaattgcatttgccgcagctgcttaataattttatccgcttttttctgtgctttgtcaactagcgcattcgccttttccttggcctggtgtagctgagcatcgcgctcggtggtaaacgtgtgatatgcgctcgccaattcatcatgaagtgcctgagctgctgctaattgccgctgtgcagaagcgcgagcagtttcggccgccttacgctgtttttccaaatcgctaatcatgtcgttaagttcatgactatcggatccgatcatcgacttggcacggtcaacaattgtgtggggcaaccccaaccgtaacgaaatgtcaaaggcgttcgagcgacccggaacgcctaccaacaggcgataagtcggttgaagggtttgactatcaaactccattgaggcattgatggtcttcggagtgttgtagccatagagctttaattccgggtaatgagtcgttgccaccacatacgcgccgacttcacccaccgcgtccaaaatcgcaatcgccaacgctgccccttcttgcggatccgtgccggcgcctagttcatcaaacaagacgagactgttttgcgaaagctgcttaagaatatggacaatgttatccatgtgggcagaaaacgtcgataagttctgctcaatcgactgctcatcaccaatatcagcaaaaacttcatcaaagatcccgatccgactctcatcgtcagccgggatgaataggccggattgccccattaactgcagcaatcccagcgtttttaacgtgatcgttttcccgccggtgttggggccggtaatcaccatagcttgataatcggcgccaagcggaatgtcattgccaaccacctgatggggatcgatgagcggatgacgggcatggcgcagcaggacatcattttctgctgatacgagtggctcggttgccttttgagcttttgccagcttggctttggcattaataaaatcaaaatgtcccaaaactgccgcattagccttaatttggccggtatacggcgccaattcattcgacagttcagccaaaacgcgattaatttcggctgtttcagccatttgtgcctcacgtaagcgattattcagcgcaacgattgcctgaggctcaacaaaaagcgtctgtccggtggcactctgatcgtgaacgaccccgccaaacttggcacgataagctgcttttacgggaataacgtagcgatcgtcacgaatggtcacaatcggatcgcttaaatatttggactgcgccccgcgagtatattcggacattttgccgcgaatatcgccttcgattcgcttaatctgttcgcgaataccatgcagctccggactagcttcatccgttagcgttccttctggatccacagccgtctttaaccgccgagataattgtggcagcacggtcagctcggcctgcagtgaatacaactggcgaaagtcaatctggtcttgcaaatccgttaagaatttatcaattgcactgactgtttgcaggacccgactgatgctggccaactcctgaccatttagcacggcgccaatatcaacccgttttagcgctgggtcaatattttccaactgtggaaccggaatgccgcccttaagtcgcaatgccgaagctccatctgcggtttcgtctaatgctcgctgaaccttttcgggatctgtttgcggggtcatgttttggaccattttctgtccatttgccgttaccacttggcgcagtatggcctgttgaattttgtcgtactcaagtgttcttaaaatcttcgtgttcatttaaattgctcccataatcaagaagcgcccaaagacgtcagttatccgtccttgagcgtcatcatgttcataaccaaagggcattcacaaactgtgtcagcccaggtgagtatttaatcatcattttggcaacaagcgagtgatcaagcccatgttgaataccggtgatgggaatcaatgccaataatgacaaaatgagaaataaaaaaatataccctatcgctaaattggcccagccgcctattaatgcactctttttgtgcgccattgctttatacgtcaagtcgtggaaccacaaagccgcaatccgcgtcaataaccagccgatcgtcagcaccactaaaaaagcaaatccgcgataaaatgcatcatccaacgtcaagccgattttatcggaataaaaggcaaactggcctgcattcgtcgcagagggataagggatcaacaacgtaaagtgttctcccaaaggtcgggctagtgccgttgcagctaaaaaactcaaggcataaccacctacatgcaaccactgtaaggctgcaccgcggcgggccccgctataatagaaataggccaaaactaaaataatcgtaattgaaatcaaaacgttcccccattatgctttctgatcggaatgatcctgctgggctgccagcaatttaacttgatcagaaacagcattgaaggcaactaaaatcgcctgttcctcggcagtcagatccggcgcaagttttttgacttgatcaagccgttcattcaacagcttcgtgaccgtcaaaaagtgctgttcggatccgggaccgataatcgtatacgctttatcaccgataacggccttaaaacgacgcttctcttcactcatggcgtgaatgcctccactctttcaaagtgtattctaccataactggtaaagtgcgagcagaagtgcttcggtatgcgccaactttccttcgtttctactctattcgttccttcttgggaccacccatactggggcattttggcattgccacaaaaaggccaccaaaatactggtggcctgatgggttcatgacgtcattaatcttgtagattcgaatcgtcatcagccaaaaaagtattcaacacttcttcgaccatgtcccattccttatcatcttcgattgggaaaagatctcccgaactggcatcaccgtttgcatcaggtgtgaacgagaaagcctgaatttcgacttcctgatcatcatcttcactggcaggatacaacagtacgtagctcttaccataatcttcggaatcaaatgtaaacaaaacctgatatagctcttcattacccttttcgtcaatcagggtaatctgctgattgtcgtcaccgggtttgacatgttcattatttgccatcttgttctccttcaattctggcagggacgcatcgccgcagccagagttattgcttggtcaagggaccttttgcatccagataattctgcaaaatcatttgcgctgccagtttgtcgatcacttgtttctgccgcttacggctggcatctgcttcttcaattaacattcgcgaagcttcaaccgttgtcaatcgctcatcgatgaaatcaactggcagcccaaacgtctctttaagtaaatcaccatatgcttgtgatttctctgcgcgcggtccaattgaattgttcatattcttgggtaatcccaagacaaatgctgtcacctcatattgggtcaccaattctttgagccgtttgagtccaaactgctgcttatcctcattgattcggatgatctctaatccttgagcagtccaccccaaaggatcactgaccgcaacccccacagttcgggaaccgacgtccaaccccatcaagcgcattaagcttgctccttgccaagatagtttcgaacaagctcttcaatgatctcgtctcgcttatgtttccggatcaagttacgcgcgtcgttataacgcggaatatacgctggatccccggaaatcagataccccacgatctgattaatcggattatatcctttttcctctagtgctttataaacagtttccaacgtctcgtgaacatttttaggattgttatcgcgaaaatcaaagtgaacggtttgatctaatgtgctcattcttacacctctattctatccgcttcacagaccattttacttgaaatcaatgcaaatgtacaattcctgagcaaaagtaagtgatatttttggacgatgcgctttaacaccaatcgtcctcgtcctcgtcttcatcatcatccaagtcagccaatccgatcacctgcttgattttatcaggtggtaccggaaagtgaattggcggtatcacatgcggattcgtaacttcagcatgtaacgtgcggccttcattgcccactggaacaacaactagatcgccttcctgcaaactggggatatccgttttgtacagatagtctttgaccccgtggcggaaattcaccttgatatagtgcatcaattgcggcccaagctgaatggcatcttgctgatctcggtgttcactgctgcgctgaaatgcctgaattgcttctgtgacggtctgccatagcattttcatggtccgattcaactcggcatccacctgaatacgcgttggctcaccgtggggatattgaatcgtcaaagccagtacagaccgtggttgccacgttgaatcaattgacaggtcagcgacttcgcccaattcagcaactgcagctgccacttttgaagcgagtgccgcgactaatttgggatcatgatagaccacatcatgatcactaagcggttcagcatactgggtgcgcaacacaacccgattctcgttggcttcaatcaaatacgtccgccgatagcgtaactgccggcttaagaatcgtcttgggccttcaaactttggtaactgtaacgtaccaaatcgcacataatccagttgccatgcgatcggcggtaaaaaatggccgcctggaaccgtcacggtatattttaataaactcagtagctcgttaaacctatccggaaatggctgcccgccttcatatcgcaaaacccgttcatcatcttccgttatcgcaaggttccaccgtgtatcagcaagcagtggcggctgcggttcaccaagtactcgccaagacgcaaagtcaaacgttgctaaccggttgaaaaacgcctccgcatctgtgccagtcaattcattttcgattgtcccctcggtacttgatggatcaaccgtatatgtcagtttaacgctatcggcttgacggacaacgcgatacagttcacgcgaccccaaaaaatccgtcattcccaaccgcaacgctttcatctccctcacctcgctgaaatcgttttcttaattctaccatgacttcccgtattcatggcagcaaaaacaaaaacaccagaagtcagtcagcaaaacgccatcctaactcctgatgtccattgtttgatttaagaaaaactgcattcaatgcttatgcatgctggccgatcacgtttttggcttctgccagtgctgccggaatgccagctggcttcttaccgcctgcttgggccatatccggacgaccaccgccaccgccgcctacttttggcgcaatggccttgatcaggtcgcctgctttcaaaccggcttgattggcattggcattagccgctactaacaagtttgccttgccatttgcttcggtacctaacactaatatgtccgaagcctgctttgttttccactcatcggcaagttgtcgtaattcattcattccggctacctgaacctgcttgtcaatcagtttaaatccgcctactgtttcagcgtggtcaaaaatgccggctgctgcttgggctgccaacttagcttgcaatcctgccaccgttttttgttcggttttcagatcagcttggagttgagtgaccttgcttggcacattcttcacttgatctattttcaaatgatcagccgtttccttaagccagtcctgctgttgggtcaggtattcataagcttccttggacgtgactgcttcaacccggcgaacccctgcgccaataccggattcgctggtgatcttgaacagacctagcgcattggtattggttgggtgggtaccgccgtcaaattccttattgtaatcgccgatggaaacaattcgcacgacatcaccgtatttatccccaaacatcgcaatcgcaccaagcttcttggcttcggcaatcggcatctctttccacgtaatcggcaaagcatcccagatcttctgattaacaatcgtttcaacttcgcgcagttgttttggcgttacctgaccgaaattagtgaaatcaaaccgtaaataatcaggctcgactaacgaaccggcttgatgggtatgctcgcctaaaacatcccgcaacgcctgatccagcaaatgagtggccgtatggttaagtgaaactttcttacgccgcaaacgatcaacgctgagccaatatggttggccctttgtcagtttgcctttaacggtaacggtatgcagattttggccattgggtgcatgctggacatccgtcacttcggccaatacggtgccatcctgagctttaataaccccgtgatcagcaacctgaccgcccatttcggcataaaaaggcgtttcgtcaaaaatcagttgggcttgcccggtgctgacttcatcctgaagctgatcatccacaacaatcgcctgtaacgtggcatgtttatgatccaactcggtccacccggtgaacttgcttggcgtggtaatgtccatcaaaacggtatcttgactgcccattgactgccgatcaccccgtgctttgcgagcccgatcgcgctgtgccgccatgttctttttgaagccggccatatcgactttcaagccttcatcttcagcatattcattcgtcatttcaaccgggaagccatacgtatcaaacaaattaaatgcatccgcaccggaaatttctttttttccgttttgcttcagttcagcaacaatttgattcaacagattaaccccagcgtcaagcgtttgccggaagcgggcttcttcggattcaatgactttttgaataaatggctggttggccagaatctgtggataatagctcttcatgatctcgccgacaaccggcacgagttgatacaaaaagtcatgattgataccgagcttcttaccgtttaaaaccgcccgccgaatcaaccgccgtaaaacatagccgcggccttcattgcttggcagtgcaccgtcaccaatcgcaaaggttaccgtccgcgcatgatcggcaataatcttaaaggacacatcatcttgcgcactggccccgtaacgcttgcctgcactcatcttttcggttgccttgataatcggcatgaataaatcagtttcaaaaatagttggcgtgccttgaataaccgcgactaagcgttcaagccccatgccagtatcaatgttcttatgcggctgctcaacaaaccggccatccggcaaatggttaagctcggaaaagacgatgttccagatttcaacataacgtgaattctcgccaccaggatagttttccggatcatcctcagccacattgttaaaggactggccacgatcataaaagatttcggaatccggaccagatggaccttcgccgatatcccagaagttatcctcagcctcaacaatatgatcatctgcaaccccgactttgcgccaaagttccttggtgcccttgtctttaggataaaccgtgacatacaaacgcttaggatcaaaatcaaaccacttagggctcgtcaataactcccacgcccacggaatgacttcttttttgaaataatcgccaaccgagaaattgcccagcatttcaaaaaatgtcagatggcgcgctgtcttcccgacaagttcaatatcattggtccgaatcgacttttgagcattggtaatacgcgggttgtctggaataaccgacccgtcaaaatacttctttaaagttgcaacgcctgagttaatccacaacaaagtgggatcatcaaccggaatcaacgaagcactaggttcaactgcatgacctttactcttgaaaaaatccaaaaacatttggcgaatctcgccgcttgacatttttttcatgacatatcctcctaaaagaaagtgagcgcgagccagcgcgggtagggatcggagtgtaagtggccttgggcgtgatggccgggctttggccattgcgaccaaggtccttatacgcagatccctgcgctggggagcgcgttaacgtgagcgcgagccggcgcggttagaagtcggagtgtaagcggcctcgggcgggatggcctgggcttggccatcgcgttcgaggtccttacacgcagacttctgcgccggggagcgcgttatggaaagtgagcgtgaacagggccgcttagaaaccggagtgtaagcggccttaggcgtgatggcccgctcttggccattgcgaccaaggtccttatacgcagatccctgcgccaacaaacgcgttaacgtgaaccgcacacccttatcaacataaaaagcaccattgctgccaagggcgcttgcacgcggtaccaccttggttgcaatgatgcgagtcattaccacttcattaatattcgttcacctgatattagggagcatatcttagcctggtgcagccgctctcaacgtatgtggctgtttctgtctcactcaggggtcgacacatatcctaacgagtcccaattatagcttttctgaaaaaccaggtcaactcgttattgaaaaaacaaccggctattcgtcatgtttcaagacaccagatgtctaccttcttaattaaccgtaactgtcgcaacccgccgataactggcaacggtcaggtcatcggcaccttctgcctgataaaacggcgacaatgccaacgctgcttttgctgacggctgtgcgggtaacactgtgcttttttgaatatcttccgcaatcagttcactacccgcacgttcaaccggaatcgtcaaaccaaatggattcggcaaataacgcggtaactgcggcggcaaggtattgccaaacgcaaacagactttgccggccgccgctttgtaaatattcatactgatcctgagtcggcaatcgaaagccaaaaaaactcagcgacttgatcaaatccgctttttgccaggacttgacgatgctcacttgataatgatgagcgctggcaagtcgtaatttaatgttgccactggtcaagctcgccgcccaaccgctttgggcaaaaggatcaaggctgccttgccgatccaacaagcgcaacacctgcgcgcgaatcgcagcatagcgcatgtgattacccttgaaaatacgagtcgtcaggctaatccgccctaagatctcctcatttgccggcgtagctttagtcgcaaccagcataggcggcatagcgacttcccgttgcggcgacaaagcctgcgttaagtccgttacagtcaaaccgctctgctgcatgtaagaagccagttgttcttgctgctgcgcatgaaaacctagggtaacttgggccatccccggaatcaaccgcacccattcgccgccgatcatggcttcaaaagtatgcaacgtctgcccataaaaagtagcagtcaccggtcgaatctcatcaactgtcagtaacggactcaaaaagtagcgggtcaactgttggaaaataaatcgttgtcttttttcatccaagctattccatgtcggtaacgtcaactcgtttacggccatgttctcaccctcgtttacggtgcttgcgtttctcggctagcaaggcttgacgccgcgcaactttggcattgcgcttgcgttccaataacactgctgtccggatcttcttacgatagtttggcatatgcttttgtttcgcttttttcaccaagccgcgaatggcaaggctcgtgtcctcttgcttaggcttgcgctgaacccggcgattacgatcgtacgtgtcaaccagttcacctttttgaatggtcttaggcttaaatttgatgcccatatgttccaattcagcaatctgatcttcctggcccggctcatataacgtaatcgctgtccctggcaaaccattgcggccagtacgcccgacccggtgaatgaagaactcctgatcgcgcggaatctcggcattaatcaccatcgatacccccttgatatcgattcctcgcgcagccaaatcagtggcaactacatactgatacttaaggtcagcgacttccttcataattcgccgccgttcccgaggctgaaccccgccatgaatcttggcaaccttgagtccctgatgtttcaaataatcatgaatggcatccacactggttttcgtattagcaaaaatcaacaccaaaaacggatggcccatcgtcactaactgataaatcagctcgtttttgtcgcgcccctttgctgcgattaaaatattctcaacggtatcggcaataaccgattgtggcttgagttcaatcacggtcggatgatccatgtatttgcgcaaaaacggttcgagcttttgcggaatcgtcgcggaaaaaacggccatctgcaaatgttcgggaaaacttgaagcaatggcgtcaacggtttccaaaaagcccatgtctaaagtcatatccgcttcatccacgacaaaatgacgaaccgatgctggcacaagatcatagcgcttgatcatatccaaaattcggccaggtgtgccaattgcaacgtgcggttgatgcgcctgcagcttatcaatctgcttttgcttatccatcccgcccaccaaacggctaatccggattgctggttcggtttgcgtcaattgttgggcaactgcataaatctgattggcaagttcccgcgatggcgccgtaatcacaacttgggtcgcgtcttcatttggatctaccaggctaagcaatgggaccaaaaaagcatgggttttaccgctaccagtctggctttgacctaccaggttctcgccacgcagcaacgcagggatcacctttttttgaatcggcgtcggctgggtaatccccatggcgtcaaggccggcaatcacaaaaggcttgagttggtattgtttgaattgattgtccataatgcctactttcttgttgttgaaaagtctctaactaattgatcaagttgcgtttcgatttgaatgatttcgtcaaaattggccgccttggctccgcttgccagtggatggccgccaccgttatgttccttagctaggccgttaataatcggacccttagaccgtaagtgaacccgataaccgccttctgcctgttcaatgaactcggcccatgcaaccaccgtgtctaaccgcccaggagtgccgacaaccgcgcttacctgatcatcagctaaatgcaggtcattaattgccgtgcgcggtaccgtcacgctagccgcaccagccggactgattttcaaatgatcaataacatagccctgcaaacgcgcctgccccagcgtcacggtattcatccgattgttaatggcagtcggatcgaagtcttttttgatcagttcagcagcaacctgcagtgtatgcggggtggtattgttgaataaaaatctgccggtatcgccaacaattccggcataaagcaaccgcgctgctttgtcggacaacgttaaaactccgtcactggcagcaatgagatcataaatcaattcagaagctgaactcgcctgattgtcgacccagacgagatcgccgtaagcatcatcgttggggtgatggtcgattttaatgagcattttgccttgattaaaccgactgtccgaaatgcgcggcgtatcagcagtgtcggtgacaatcaccaacgcattttgataaacatcatctttaattgtttgctcttcagccaaccaacttaaattgccagtatcgctgccgacttgataaacctgtttatccggaaaactggcacgaatggtttctgccagccccacctgtgaccctagcgcatcaggatcaggattgatgtggcgatgaataataattggattattggctttaatagcgttaataatatcggtctggatcatttttgatcaattcctttctaatagctgacaagtcacaactgccttggcaacctgaacgccatcactgagaacgtccacgtccaaagtcgcatcgtgtctcgttagctcaagcacccgcaataaaacagtcacaatactctccaactgaaccggtcgaaaagtggtcaggttaacgccctcaaccaaaacattccggcgcccggtatcgtgcaagtagcgagtcgtgcaactattaatggcttcagcaaggacgccaaaactcatcgtccccagcgtattggtcatcgccggcactgttttgagctcaaacccaccaccatatggcttttgcggggtaatagccgttaactgtgcactcacctggtcagcaatcgtattggtcagttcacggctatgggcaatcccggttaagctggaaaagacagcattgcgcgtgacgatacctaaaagattccaactgtcatcgacaaccggcattgcgttcatgccattatcctgcatcgtgtggccgacagtcgtcacgcttaaatatggtttgacagtttgcggatctttttgcattagccgttcgattggcacagtcggtttcttgccagctgccagtgccggacgcattaagccgaccaagcgtccgtttcgcgtcacaaccgggagcggataatggggatctgtcattgccaggtaatcgccaacggttgcctccacgccaatcgtttcgatttgtgaaaggggcgtataaatagcggcaacggttaagatgtcttgcttaatcgcctgatcagacaacgcgcggttaatcatggttgcaactgtaaatgtatcataagccgtctgtaaaaccggtaattgctgatcatcagcaagcgcaataatcgcggaacttgtttcaaagcccccggtaatcagaaccgctgctccgtcttcaagtgctaatcgctgagcgtcttcacggttaccaacaattaataacgaattacgcgtaatgtatggacgcatagcagccggtgtcatggccccgatcacaaacttatcgagttttttgtccataccagcctgcccgcctaaaactttagcgtcaatcaaatcaaccaaggttttaaacgtcacggattcaattggatttaacggtttttgctcaattcgaatggtaccaacccgtgcaattgtcgaaacaaaaccagtattttccgcttccttaatcgcacgataagcagtaccttcgctcaccttcaaatgcttggcaatcgaacgcaccgatattttcttaccaaccgccaaatttgcaatataatccaaaatctgctcatgctttgtcgccataccatcacctcattgcaatctatcgttagtataccatagggtgagagtgtactaatacagagcgtgaaccggcgcgcttaggagtcggagtgtaagcggcctcgggcgtgatggccgggctttggccattgcgttcgaggtccttacactccgactcctgcgccggtgaacgcgtttcagcagagcgtgagccagcccggttagaaaccggagcataagcggccttgggcgtgatggccgctctttggccattgcgaccaaggtccttatgtgcaggtttctgggctggcgaacgcgtttcaacagagcgtgaaccggcgtaagtgtcaactttttctcggttctactctaattaagtgatttccgttactccgagctggctccgcggtggcaggctggcgaccgcgtagctagagtggtgggcaccactgagcccgccaccgctccgccagctcttgctttctatcctaatattcgaacaaggtgacctatcgcactgctgctggaatcgtctaaactgatgcctctttgtttgccatacacataactctaactaagctaatacgcttaggaaccatttttagacagcacatccctctctacaacggcaaatcaatattttcatactgcttagggtcaagtccggtgaccgtaatccctaaaagtcgaatggctagcttggtcagtttaacttcctgccaaagttgccacgcagccgtataaatggcttgttcaccctcaaaataatggtcctgagtcaatcgtttcgtctgggtcacaaagtcaacgtctctgactttcaataccaccgttttgccatgcattcccttctgattcaaagcagttaccaccatcgccgccagcttccgcaattgggtctcaactgccgtggcatccgttaatggcgtgccatatgttcgttccttaccaatcgatttagcggtatgcacggcaactggtcgattatcaacaccacgcgcatgttgatataaaataaaccccatttttccaaacatagttaataactgatcctgcgacaatgcccgtaacgttttgccgtttgtgacgccaagatcagtcagttttggtagtgtcttcttgccgacacctcgaaactgcttgataggcaaacgatccaaaaacagcaatgcctgctcgggtaacactagggtccgccccaccggcttattataatcagacgcctgtttagcaataaatttattatatgaaatgccaattgaactcgttagctgggtggcttgtttaatctgatcctgtagccacaatgcgagcgcaatcgtactgggaaaagcatggttagctgaaacatcaagataagcttcatcaaacgcaaccggctcgattaaatcggtcacctgatgaaataaagtatgaatctgtgccgacaccgctttgtacttgggaaagtccggagttttaaaaacgagttccttacgtggcaccaactgtagcgcctcattggctggcatggcggagtggacgccgtaacgtctggcaacataatttgcggtggtgaccactcctttgcctccggttgtccgcggatcacgagcaatcaccaatgctttatggcgtagtcgcggattatcccgcatttcaatcgaagcgtagaacgcatccatgtctagatgaataattttacgtgacgtatcgttttgtaagggtaattcgaataacgccatgtgtttgctcacctccccggaaccttgacacgtttcaacaaatcttgaagtcggacttgcgcttcataacacgctttcctgcgcagaagtcggcttttccgctccataacgcgctcccccagcgcaggagccggagtgtaaggacctcggtcgcaatggccaaagatcggccatcacgcttaaggccacttacactccgacttctaaccgcgctggcttttctgctccataacgcgctccccagcgcagaagtctgcgtgtaaggaccttaagcgcaatggccaaagaccggccatcacgcttaaggccgcttacactccgacttctaaccgcgctggcttttctgctccataacgcgctccccggcgcagaagtctgcgtgtaaggactttaagcgcaatggccaaagcccggccatcacgcttaaggccgcttacactccgacttctaaacgcgccggctcgcgctcacttaaaaaaaagaggctttgaccttttattggtctccgtccctttgttcagtatcatcatcaatcagctagctggacgcgccgtggttgccagaaccattcgcggccatcgcgttcaagtaagtcaaatgccgcctttggtcccattgttgccgctggataagttggcattgttgtttcctgggaccatgccgcctgaatggcatcaataaatcgccatgaagcggataattcagaccaatgcgtgaagtttgtctgatcgccttccagcacattgctgattaaacgttcataggcctccggagctgctgcagccgctgtcgggtcgtggcgatagcgcaactcatccggctcaacgtcaaaacccgttcccaatgctttaccgttaagctgcagggaatagccttcgctcggttcaatgtaaatcgtcaggctatccgggcggcttgcttctgcttgactaaataacggcgcggtcaccggtttgaacgttaacgtgatttgagtcgatttacgggtcagtcgcttgccggttcgaatataaatcggtacgccttgccattgtggcatatccaacaaaatcttgcctgcgacaaaagttggcgtttgcgaatccggtgcgaccccttcctcttggcgataaccaggaaccgttttgccatctatttgcgccgccacatattgtgcctgcacaaagttagcctttgctgctgccagatcataaggccttaacgcagcaaacaccttatctttttccgttaaaatatcggttgccgtaaacgacttaggcttgggcatagtcaagtaagacaatacttgcatcacgtgattttgaaccatgtcgcgcaacgcacccgccttttcataatagccggcacgttcctctactccgacagcttcagataacgtgatctgaatgttgtcaataaagtctttgttccagacaccctcaaaaatggcattatcaaaccggaacgccagtaggttctggatcatttccttgccaagataatggtcaattcgaaaaatctgatcatcatcaaacgtcgcggtcagcgaatcgttcaatgctttggcgctagcataatcatgtccaaacggtttttcaataatcaaacgattgaatccggcatccgtcaacagatgttctgacttaagatgactggcaatggtttcaaaaaagtccggtgccatagccatataaaagacgcgattaccgccgactgcaaactgatcatccagctttgccgcaagatttttcaaggtgatgtaatgatctgcatcggttacatcatgactttgatagaaaaagtgctgggcaaaggcgtgcacctgtttagcatccgcatgtgcacctgcaacagcatttgctacgacttcgtgataatgttcgtcgctccatggtcggcgggcagttccgataactgcaaagtgttcagcaagcactccgcggcgataaagattgaacaatgcaggataaagctttcgtgaagctaaatctcctgacccaccgaaaataatgatcacagcgcgcgattcttctggcatgtatatgaccctgctttcccaagtcttgattacaattcaacaaatatgtgagcagcgcgatcagcatcgactgccaattcttttccagttcgatctagtttgatgacaactgcatccaacgttttggcggttaccgtaaagacgtcatcaaggcgcaaatcaagtttgacagtgtaatcaatcaatgaaacctcatcgatcaaccgttcaatatgacccttttggccgacttccatcgctcccaaagtgacgcgactctgctgaatatagtggccgtcagcatcagggatcacaccgccatgagggcaatattgaggattgcctaacatggccgccaaacgttttgccatttctggcgtcaaggcgtgttccaatttctcagcttcctgatgaactgcgtcggcaggatacttcaagcacttaactaaaaagacttcccagagacgatgattgcgcactaagatggccgccttttttcgcccagccgatgtcaactggatgccttgataaggcgtgtgtgctactagcttctcttcgcccagtttattgatcatctcactgaccgaggcagcagagacatgcatccccgcaacaatttgcttattagagaccagttcggtatcgccgccgatctcaaaaatcaacttaagataatcctctttattcggtgtcattttacatccttacttttaatttgcagtcactgtactacattatgccatgacttgcacaaaaaaacacgtcaatttcttgacgtgtttaatgacgaccgacgcaaacggtttatctgatgaacaattgccgatcatcgtgaaatgattagcatgtgcgtacttagaatgttgaatctgttccttcatattcatcgagaataatgtgcttcaaatcgctgatcaatggttcctgcgggttggtaaccgtgcagttatcttcataagcaagttcagcaaggcgatcaacttgcttgtccagatccgctttctgaaccccctgatccttcaggcttaacttgatcccgacgctatgtgccaatttaatgaaggcttgaacatagctttctactaattcatcggtggtctttcctggcagcccaagatagcgggcaatttctgcatagtcttcgttagcacggaagtaactgtacttggcccagattgcacgtttctttggttgactagcattgaaccggataacgtgtggcatagtgatggcgatgcagcgtccatgtggtaagtggaacgcctgacctaatttatgggcaatactgtggttaatccccagtaaggcattggcaaacgccatccctgcaatggtagaagcatcatgcatctttgacttagccgcaatgtcgccatgataactcttttcgaggttttcaaacactagcttgattgcttcaaggctcagccccttcgtatagtgggttgccatggttgatacatagctttcggttgcatggcacaaaacatcgatcccggaatcagccacaactactggcggtactgattcaataaactgactatccacaatcgcaatatctggcgtcaaagcataatcagctaacggatatttgatccctgctttggaatcagtgataaccgcaaatggtgtcacttcagaaccggtcccggaagtcgtcggaatgcaaaccagtttggtcttattcagcttcgggaaagtgtaggtccgtttccgaatatccaggaatttctgcttggcaccgaagaagtccgcatcgccagcatcgttgaacaagcacatacccttggctgcatccattacagaaccaccgccaatcgcgatcacggtatccggaccaaacgaccgcatgatgtcggttcccttgaagaccgtatcggttgatggatcaggttcaacatccacgaacgtctgaacctgtaccggattctcccgccgagccaaaacgtcttcaatgatcttgacgaaacccagcttttccattgaacgatcagcaacgatgaaggcgcgcttgatgccttccatgtgttccagatagcgaaccgagtttttttcgaaataaatctttggcggcaatttcatccattgcatgttgttgcgccgttttgccatggtcttgatattcaacaagtcaaccgtccccacattgtgcgaaatcgagttgccgccataggagccgcagcccagcgtcaaactaggaatcatttcgttgtagagatccccgataccgccaacagaagaaggtgtattgatcaggatacggcaagcctgcatggtatcagcaaatttcaatgccaattcgtcgtcagctgtgtgaatcaccgcggtgtgtcccaagccgccgatatccaacatggtttcacatttcttgaaggcatcttcatgaccatcggctttaaccatcgccaaaaccgggctcagtttttcccgagaaagcggatatttcttgccaacgtcttttaattcggcaatcaggatggtcgtgtcatcaggaatttgaatccctgcccattcagcaatttgcttaggactttggccaacaattcgaggattgacactttgcttctcaaggttaataaccgtgctctcgaacttcttcatgtccttaggtttgacaaaataggcaccttgggcttcaaattctttcttcacggcatcgtaaatgctggaatcaacgatggccccttgttcggaagcacaaatcataccgttatcaaaactcttggacaagaccaaatcattaacagcctgcttaatattggcacttgcttcgatgtatgccggtgcattccctgcgccaacacccaaggccggtttgccggatgaataagctgacttaaccatgccagggccaccggttgccaagatcgtggcaatgccgggatgatccatcagtgtcttagttgcttccatgcttggaaccggaatatactgcaaggccccttttggcaatccggccttttcagcttcctcccgaatgacctccaacgcacgcgctgaagacttttgtgcacccggatggaaagcaaagataatcggattacgggtcttgatggaaatttcggatttaaagatcgtggttgatgtcgggttggtcaccggcgttaccccggcaataaccccgattggttcggcgatggataccaagccgcgttgtttatcttcattgataacgccaacggtcttgttgttcttaatcgaatgccagatttcttcagtggcaaacatatttttaatggctttatcttcccaaacaccacggccggtttcgtcaacagcgagtttcgctaattccatatgatgatccaacccggcaattgccatacgatgaacaatatgatcaattttttcttgatcaaaagtcttcatgatcttcaaagccgagtgcgcattggcaaccagttcatcaatcatgcctttcacatcaacttcagtagcagccttcgcagtattcttaagcatgagcttacctccaagcatttcgcagaatttttgttaaccatttcacaagaacatcataccttgtccttgtgattttgtaaacaattttagtgaactttttcacgaaaatttcgcttgttcactgttaaagctgatttgtcaggggaatccaacgtttttcactttgtatctttttgaacttatggccgtaaaaaaagaccggtcaagaaccggtctctctgttaacatcattaatctttaaccttaagcctgcttgtcatcgtctgctttggcatcgctgtcagcagcagccggttgatcatcggacttggccgcagtatcagaagcttccttagccacacgctgttcatctgtgttggtggcttcggcttttgctgctggagccggggttggggttgccggacgtgaagcaacgccgcgaaccgcatttaaattgaatgtcagataaataccgtctgagtcaatcacaacggtccctgcttgctgatcaattgaatcgatcacaccatgcaggccgccaattgtaacgatcggatcacctttttttaactgacttagcatttcctgacgcttttgttgctgctttttttgtgggcgaatcatgccaaagtacatgaacgctacaaagatcaccagcagaacgatcattgaaacattaccatttcccaatttaggcacctcttgtttttttagtttgtcattcaacagtgtaacagaatttcggaccatgctccaaacaatctagaaattcttcgccttttccttgttataaccataagcttcaaaaaaatcttcgcggaaggcaagcagatcatcgttggcaatggcttcacgtacttgctgcatgaggtgtaaaaggaaataaagattgtggtaggttgttagccgaataccgaatgcttcgccaacatggatcaagtggcgaatgtaggcgcgactgtaattgcggcaagcatagcaatcacaattaggatcaagcgggccaaagtcgtgggcatacttggcattcttgatgacaagacgcccgcgactggtcatacacgtcccatttcgtgcgattcgggttggcaagacgcaatcaaacatatcaatcccgcgcaatgccccatcaatcaaggcatcagccgaaccaacacccattaaataccgcggtttatcctctggcagcaaaggtgtggtgaagtccaaaacatggttcatttcatctttggactcaccgactgacaagccgccgattgaatatcccggaaaatccatacttaccaagtctttggcactttgttcacgaagatctttgaagccggctccttgaacaataccaaacagcgcttgccaatccggatttttatgcgcttttaacccccgctcagcccagcgactggtacgcgcaacactttttttgacatattcataactttcaaaaaacggcggacactcatccaaactcatcataatatccggccctaacgcgttttcgatcgcaatcgccttttctggtgataggaacattttcgcgccattcagatgattcttgaaggtgaccccgtcttccgtaatatgccgggtatctgccagcgaaaagacctgaaaaccgcctgagtccgtcaaaattcccttgtgccaattcatgaaacggtgcaatccaccggcttcttcaattaaatccggaccgggacgcaaccacaaatgataggtgttggctaaaataaccgttgctcccattgtgtccaattcctctggcgccattgttttgacgctggcttgggttcccaccggcataaacatcggcgttggaaaagttccatgcggtgtgatcaattcacctaaccgggcaccactatgcttatcttgatgaatgagacgatatttaactgctggttccatacagactccttattcacagcaatgccctcgcagcaccgcttatccattttctcgttatgccagtttaacagagttacttgtgatttaaaagtaagtgactcgctcaaaagctgcaggcctgttcacaaatgaaacctgtccagcaaatgataaccaactttcttataaagcactgccccacgatcaccgagctttatccttttttctactggtttttcctgttaaaataaaggtaaggacgggatcaccgttaccgtagttttcgcacttcccgggttttgacctggccattgtgatcgtctatgaatacgttgttccacgcagcgatgcgttaaaagaaaaatcgagacatgtctgttggtatgtgttgatgtgatcccgtccgttataaaaaccggtttgcaaacgcgcaaaccggtttttatataccttcagagacgatcaatggcgtaaactacccgcagacagtagcgggtcacatgatcgatcatcaataaatgaacatcgcgtcgccaaagctaaagaatcggtacttttcttcaatggcgtgtttgtaggcgttcaagatcgtatcccggcctgtgaacgcagccaccagcatcaccaaggttgactttggcaaatgaaagttggtgataaaggcatccacgactttccactgatacccaggcttaatgaaaatatctgtccaaccggaatccgccttgatagcaccatcaaatttagtgccaatcgcctcaagggttcgaattgaggttgttccagtagcaatgatgcgcccaccgttatcgcgtacctcattcaaagttgcagctgcttccggtgtcagacgataaaactcgctgtgcatcttatgcgcttcaatattttcttctaccaccggccgaaatgttccaagaccgacatgcagcgtcagataaaccagcttaacgcccttatcctgcaccttttgcaataactctttcgtccaatgcaatccggcagttggcgctgctgctgatcctagctctttggaataaacggtttgatacatttccggatcttcaagtttttctttgatgtaaggcggcagcggcgtttcaccgagcttatcaagaatttccatgaaaatgccatcgtaatcaaaatggatcatccgtccgccatgttccagctctttggtgaccgtcgcctttaacaacccgtcaccaaaatcaatcactgtcccgactggtgccttgcgcgctggcttcatcaaagtttcccagtcgtcgccggaagtattattaagtaatagcacttccatgtgggcaccggtttccggtttgacaccataaagtcgtgccggcataacccgtgtgtcgttcatgaccaacgcatcgcctggtttaaaataatccagaatgtcataaaaatgcttatcctgcatcgcgccagtatcagcatttaaaaccaacagacggctggcatcgcgttctttcagcggtgtttgggcgatcaattcatgcggtaagtcataatcaaaatccgaaagttgataatctttattttctacgcgccgataacgttttttgtcttgcaacttgttcgcttccattcatttcatttagttgttttttgatggcgactgctcgtctgaggattgcggcatcgtcatccccatgtgtgcaaagccagcaggggtcaccatgcgtccgcgaggagttcgtttcaagaacccgatttgcaacaggtagggttcatacatctcttcaatcgtggccatttcttcaccgatattggcagcaatcgttgataagccaaccggtccgccttggtaatcacgaatcatgaaggttaataacttgcgatcaatctgatcaagcccttgggcatcgacctgcaactgatcaagcgcatgatcgaccattgccaagtcaaccgggctcttgccggcaacttcagcaaaatctcgaatacgcttcaacaagcgattggcaacccgcggcgttccccgcgaccgccgcgcaatctcgtaagcaccttctgcatcaatcgccatattgaagacattcgccgagcgtttaacaatctcacttaagtcatcaggcgaataatacgccatatgttcactaatgccaaatcgatcgcgcaatggtgccgacaacataccagctcgcgttgtggccccaatcaaggtaaatggcggcaagggaaaatgaaccggatgggcagtcggaccctggccaacgacaatatcaatataaaagtcttccatggccgagtacaacatttcttcaacaatttttggtaatcggtgaatttcatcgacaaacaacacatctccggggcgcaactcattcagcaacgcgaccaaatcacctggtttttcaatggccggtccggaagtggtacggatattcacacccatttcgttggcaatcaccagtgccagcgtggttttgcctaatcccggcggtccatataacaaaacgtgatccaaggattcttcacgttgcttggccgcagtaatataaacggtcagctgatgtttaacccgatcctgaccaatatattgagcaagccgccgtggacgtaagcttttctcaatttgtgcttcattcagatcatcaatgtcgcctgaaactaaccgatccttgtttgcgtctggcaaaaactcacgccccttctatattgtctgaaaaagtcttaccgttgtcgatgtcctgctgctccagtataatcaacgttatgctcgtccgctcaacaagcgtaaaccttcacgcagataagcatcggtcgtcgtggcgtcaaaggctttcaaagcatcggtaatgccatcaaccgcgcgttgggtgtatcctaaggcaaccagtgcagccaaggcatctgccagctccggcgctacttgatcggcggtcggcatgatcgttgcggcagccggttgagcatcggtcgtaattttgccttttagatccaggataatctgagcggccgtcttcttaccgatgcccggaaacttggtcaaaaatttaacatcatcttgggcaatggcagttgctaggccaccacttgaaacatttgccaaaattgccaacgctgatttcggaccaatgccggtgacggataacaactggttaaaagttcgtttatccgctgccgtttcaaatccgtaaagtgtttgatcattttcgcggatgatgagttgcacataaatccgggtctgctttcccgcttcaaaatcgtatggattggctaccagcaggcgaaatccgatgccattgacatcaatgacaatgtacgccggcgttacggcctgaattgtgccttcaaagtattcgtacataagctctccattcagtacatatgtttggtacgcttgactcattgtagcatagaacttttcttgatgataaatcgttctgaggcttaacgttatgactccaaaaaatgtccgccatttgatcaatcttgccaccctgatcgttgtgatcgctttagtcatcgtcactatttattggtacgatctagggattctttctgatgtcaaggttttacaaagttacatcgcccgactcggcttaaccggagctttatttttcgttgtcattcaagttatccaggtcgtgattcccatcattccaggcggcatcagtaccgctgcaggtgtgattctttttggcccgtggtttggttttctctacaactacatcggcatcgcgatcggatcttttattaacttttttcttgcccgccgttttggcaagcccctgctgacgtatttaatttcggaaaaaacttatgaaaaatacatcggctacactaagaatcagacccggtttgatcacctgtttacgcttgccattgtgctgccggttgccccagatgatgtgctatgtttgctcgccggtctcaccaaaatgaccttcaccaggttcttctggattattatactcggcaaacccattaccatcttcgcctatagcatgagtttgctatatggtggccggtggttgattgatctattcagttaaacatggtgacatgaaaatggcgctgctaggttcgctattcgaacttgtgcagtgccatttttggttctaatcaatgctcgttagattagacaacctgccgggtaaatggatcgttagaaatgccgcgactcaaaatcaactttgcccactctttagcagaaaacaggctgtgatctttgtagttgccacaactcttgatgtcaacaccgggtacatcatcccaggtaatatcgttagcaatcgcttcaaggctggacttcagcgctttggcgacttccgtggtgctgtgtgttccccaggtaatcaagtgaaagccggtgcggcagccaaacggtgaacaatcaatcacgccatccatgcgatcgcgcaataatgatgccaacaagtgttcaattgtatgcaacccggcagtatcaatcgcagcggtgtttggctgaaccaagcgtaaatcatagttagaaatttcatcgccattcgggcccttttcggtggtaattaaccggacataaggcgccttaactgcagtgtgatctaacgtaaagctttcaacttttgccataaattaaggatctccttctcaatagcttacctactcatcatataacacaatcccaccggtgtgaaaaaaatctgggaatgacatgacatcatgccaaatagggtcaaaaaattttgagtctagccggctttctgttaagcatcttcccaaacccgatgcgcaatacgctgaaccaaggccaacttcgcccattgatcatcttcggtcagcttgttgccttcttcagttgacgcaaaaccacattgggtggacaaagccaggttgctcagtggcacataagcagtcgcagcatggatacgttcaatcactttttcctcgtcttctaactccggaaacttcgacgtaatcaaccctaacacaatccgcttattggtatcgccttgccacagctgcggtaatggctcaaacgaaccggcacgctgactgtcatactcaaggaacaatccgtcataaggcaagtcgccaatttcatcagcaacatactgatagccgcccgagaataagaaagtcgactggaaatttccgcggcaaatgtgcgaagttacggtcaaatcttcaggtaatcgaactaacactgctttaatgacctgatgcgccagcttggcaaagtcgacaaaatgctggtgtcgtttcgggtcgttctctgtatcttttaggttttgaatcagataagcccaattcgtatcatcaatctgcaagtaacggacacccaaagtataaaagtgctcaatagttgccacgtatgcttgcaccacgtcagctaaataatcatcaaaagaagcatagtacttcgaccagttatcgctgcgatgatccctaaacaacagcgctggactaggaatcgtttgcttcggcaagaccccggcaggcacaatgctcttgagatagttaaaggcggcaaagaagggatgatcgggattgaaaccaaccttaccggcaagatgaacattggcagcagcgttgataccacctttaaagtcccgttcatacttccatgcatcatccttttcgaaaccattcaggccccagaaaaagtctaggtgccaataacgccgcgagaattcaccatcagtaacggcattaaacccgagttcgacttgctttttaacaatatgtttgatggcttcatgctgaatcgccagctcctgatcctgctgaatctcaccgatcccaagctgctgatgagcaaccttcaaccgctccggacgcagcaaactaccaactaaatcagcacgaaaaggggctttggtttgaacttcttctgtcatgtgaaaccctcctaaaagaaagtgagcgcgagccggcgcgcttaggagtcggagtgtaagtggcctcgggcggaatggccgggctttggccattgcgttcgaggtccttacacgcagactcctgcgccggggagcgcgttatggaaagtgagcgtgaaccggcgcgcttaggggtcggagtgtaagcggcctcagacgtgatggccgggctttggccattgcggctgaggtccttacacgcagacccctgcgccggtgaacgcgttatagaaagtgagcgtgaacagggccgcttagaaaccggagtgtaggtcagatctctagccctataaacgcgtcatggcaaacgcactacagtcttgaataaccatcacattcaaaaatggatgcctacgcaaaatcaactacaaattaatatttcaccactgacaacacgcagcaatgaaacaaccaactagtcggtacctttatgcaacacactcgactgatgcggtaagtcatagccgtcacgggacgaaaaaagccccttgatcgaatccgatcaaggggcgacggtgcgcgttaccacccttattcgtgttaatttaacattaacacctcaacagtaccaaaactgatacctggcatcataacgggtgcacccgtttcaatggcgtgaaccactgaaaagctatttggagctcatcttcaccgattagccgatcacctgctcacactgtccaggctcgctgtcgatctgcgcttcggttactcttctccgcaaagcaatgtgtttgtcataaattgaattcatcataacaccgcgataagccatgtcaagaacaacttcaccctcgctattattcttgttatgatttgatcagaccatgattcatggaggtgcactatgggaactaccttttttgcttattccgtgctaacccagcagaacagttggcaaagcaccttacgttataccattattttaatcggtgccttgcttattattgcttatcttctgtactttttacgccacaaacgcagtaacaaataccgcgatcttttggtgctagttgctttagttgaactcctgaccatcggcatccaagttcgcgatcttcaggctagtcgaacggccaatgctgattcccaagccgttgccaccctgttacgcagcgtggcaacccaaaagcatgtcgctacccgccagctttatgccaacagcaatactgttcacaccggcatgctgatcaccatcggccgctccacaaaagaaatgtacaccgtcacaattaatgccgataataacagttaccagttatctaaaacgaccttgattgtgccaaaagctcagttcatcactaaataaggagattcatatgcgactttttcaggatccatactttgtgacggcaatgaagctgcttttgggcttcattgtcttcatcgcgcaaatcaagctcaccggtaaaggtaatcttgcaccggcaaccattgtcgatcaaatgcagaattacgttcttggcggcatcatcggcggcgttatttataataccgatatcggtctgttgcagtttgtcaacgtgctgctgatctggacgttaatcgttttcagcactaaatacctgacgaaccacaatcgttggctcaaacgggtgattgatggcgaaccgttattagtcgttcaacatggtcaaatcaaagtggataccgccacacaggtaggcttgtctgctaacgaccttgcttataaactacgagctgccggcgtcaatgatttacgcgatgttcgccaggcttatcttgaacaaaatggccagttaaacgtcattttaaaaggcgatgaaaccatcaaatatccactcattttagatggacaaattgacccggccgcacttgacgccattgaccatgatgagaaatggcttaaagatcgcttggcagagcaaggatacgaacccggtgatgtctatatggccagttttcttggtggacgcgttgttgtgtcaccatacgatcgcacctaaccgtgagtctcaccagagaaaagcatctaccgcttgggcgaccttaggattttcatgtaatgcgctgtgttgggcatcgcgaccgaagtattctctttcccggtaactggttgcgcgtgggctaaccagatatcgtaacgatcgcgatgagttgttgctaacccgcccatccgaatcggaaccatcgcgaagatcaccgtagatattcaacaccttaaccccttttggaaaacgatcgcgcatccgagccaactcagcataattttcgtctaacggggatggatagccgttagcagttaacttgatttgatgtggttgatcgcccataccaatgatgccgtcaaaatgcccggcaatggcaacataggcgtttattttgggtagtttttgctggtcttgattgcgaattgcatagaacatcaccgccatatttcccattgagtgggcgacaaagttaacgttgcgcacaccataacgttggtaaagctgacgattaaccgtcgccagccaatcagcccatttcacagcatccggattgcgattgtcttcaaagaccacttgcacaattggcttacgaacatgatgaggcgtcccaagccaactgactttcccgtttttactcaccgttgcaataaggactttggttgctcccgcctgtttagcgtgacggattaacgtgttggtcgacccggcaccaccggaatagccatgcaaataaagcgttgcggttttgccaatcgacgcctgctcctgatcggatgtgttggcagactggttgtggaaccaataccaacctgcactgacaaccagaaccatgccaagtaagcccaaccaaatccagttgtttcgtttcatggaacctacctttctgctgccgggttcgccgaatcatctgcaagcaaggcaggacgtggtaagaaatggctaattgccgcaatgattaaaccaacgacaatggtccaacctgccactcgctgccatagcggtgagtatgcccgaattaaatcactcgctaattgcgtatttaacggtgcccgcgtactaatcatgcctaacaatggactcgcagttacaagaatcgctatgaaaccaccaaaataacccattgcgtaagtcgaccgcccaacaacggccataaaccgccgccatgagtgtgctgtttttaacataatgagcagaacaatcaccagcaaaatcgcggctacaatcaccgctgtctgggtcataaggaccaacaacggataaataagcccccagccttgctccatgattgactcattgatttcatattcaagtttggcattgagactcgccaacactttttgatcgtcaaaattttgaccttgatttttcgccgctgtctgaagccgactcgtcagactttctttaatggttgccagtgaaatatgcgtttggttagctgcactggcagtgatcattttaacggcaagccgctgagtgtcatcaagggtgaccagtttagtgtcactattcaaagcagcgccattttggttcgccgttgttaccagatcatggtttaaagtatccgtgagttgttgcagaccttggcttttaacaacgatttgctctgttcgtgcgggtgtcccaatggtcaacatcataccggtactaaaggcttcaacaaaaagaagtacccaaaagatcagcgtaaataatgcaaaccaactacgggagacgcctcgccattgttgtgttctcgtgtggatcccctccctcgcatctggccctattatacacgaagcgtcatcatgacttgtacgcttcctgacatttggactacacttaatggtgatgcatgtcggtcatcattaagccatcatcctaaatcgcttttcgccgtatgattgctggtgttggcgccggttggcaacctcactttcacatgtatttattcgatgttgcatcgggtcacaacttcacaaggaggtttctcaaatgcactatacattaaacgacggcaatgttttaccagccattggttttggcacatataaattaaccgggactaacggggttcgagccatggttggggcccttaatctgggttaccgcttgttggattcagcctttaattatgaaaatgaaggtgctgtgggcgaagcagtgcgtcaaagtgggatcccacgtagtcagcttattgttgcgtctaaacttccgggacgccaccatcgttatcaagaggcgattgataccatcgaagaaagcctatatcgagccggtttagattactacgacctttatttgattcactggccgaatccgaaagaggatctttatctagaagcatggcaagcgctgattcaggcccaacgcttcggactgatccggtctattggcgtttcaaactttctgcctgagcatattgaccggctcatcaaggaaaccggggtcacgccagcagtcaaccagattgaattacatccctatttcaatcagcaagaacaacgcgagtacgatgacgcgcacaatattcaaacggtcgcatggagtcctttagggcggggagcggttttgcaagaaccagcgattaaacagatcgccgcaacccatggcaagaatgttggccaggttattttgcgttgggatcttcaacaccacattctcccgattccaaagtctgcccatctttcccgccagcgcacgaatctcgatgtttttgatttcagcctgactaaagaagaaatggctgcgattgacgcattaactaaatcagatggacgcttaaacaatcaggatccagcggtctatcaagagttctaatgttgcaaatcagctcattttggcaacaagcattgattgcatcagatccatttcattaaaaagagtcgcggcgctatcagtgacagcaccgcgacttctttttctaaccagctcaccttaacgatcagccgcatcattgttattttcaaaactctaatgaaagaggcaggccacatgactgaacctattcgcatcttatttatttcaatttcaggtaacacgcgcgcatttgctaaacgtctagccgaatatgcgcaaacccaacatgatcagaatccggaaaatccagcgattgttctaaaagaaatttccgaggcgacgcaaagtgacggcgaaacgaaaccgttctttgtgatggtacccacctatctcgatggtggtaacggcattgataacggcgtcaaggaactgatgaccaatgccatgggtgactatctggcagaaggcgacaatgccaagctttgtctaggcatcatcggttctggcaaccgcaatttcaatgaacaatattgtctgaccgccaaacgctacgccaaggaattcgacgcgccttttttggccgattacgagttgcgcggaacaccaagcgatgccaaaaaaatttacaccgtcttaacccgtgttgctcatactgccacccattaagcagacatacaacggttaccaattagcgttgaaccagccaaccacgcgctttgtatatgccttctgatgatccggaaaactacgggcatgtgctgcgcctttaacgacccacaaagcttttttcgattttgtggccgcacgatagttttgataaaccatcttggtcgggacaaaggtgtctttactgccatgaatgaataaaatcggtcgggtgtttttgtgcaaagcgtcaatggcactggcatcaaaaacattgtagccggctttgaacgtcgcagttagcgcaactgccggtaccaacggccacttcgggatattaaacattgacttggcttgataagcaagttcgtcaatgatgctggtataaccacaatcttcaacgatacttttgacttgcggcggcaacttctcgccactaaggtacatcacggttgcaccgcccatcgagaccccgtacaaggcaatctgactctgtttgccttgtttttttataatctggttaatccatttgagatagtccagtcgatccggccacccgtaaccgatatagtttccttccgactggccttggccgcgatcatcaggagccaagacgttaaatccggcatcgtgaaacatcttgatttgcggggccatgtattccttgttggtcatataaccatgcgcaaccacgatcgttttattggtcggtttggctgcgggtacataatccgcgactagtttgagcttatcgccggctgcctgttcagtccaggtttccttatgtacagatttaagccatactttactatccgtaataatccggctttccttcccactcaagaaagatttcttggatggaacaaaggcatactgataaaaatataagctggcacccaccagcccggccaccatcaccccaatgaccgacagaataccgatcagccaagcttttttatgttttcgcacgttattaacctccataagtggttcaagacctttacataactgaaaagtgtaccgcaacttttcagaatttcaagttacatgtgacccgtgatttgttaaactaatattcggaggaagaaatatgactgataaacccttactagaggcatatgtggatgcctatttttcaacgttcaagaatatcaatgaactgatctcggaaccaatggcggcgtatcacttaagttttgagcaatatcggattttatcggacattgccaatgatccggaaatcagtttaactgcaattgtgaataagcgtggcgtaaccaagcccgcggtagcccgtcaactgcgggttttacgcaacttaaattacgtcacccagtcaaagtttgaagctgaccggcgccgcaatatgctacagttaaccccgcttggcaaacaggtcgaagcggccattacgaaaaatgccaatgagcaattcaacgaatgggtcgcagcactaggcgaacgcaaagcaaaacagttcgtgaagttattgaatgaaattggttccaaggtcattcggccacagcaagccgctaaaaagaatcgctaatgactgaataaaggcgaatgcattctccgcacatatggaaaatgcattcgccttttgtatccccatcgtgatgccatcagggatttaatagcttcaaacttatctaacgcttattatttagccaattttgccaaacctgcaggaattgcttccggtttatcgacaagcaccttagctcccgcatcttctagctctttggctgatccaaagccataagtcacaccgagtaactgaacatgattgtccaagccgccaatcatgtcattcgcgcgatccccgaccatgacacttttagcaggatcttcattggtttcttttaaggcgtaggccaaaacatccgtcttcgtgacgcgcgtctgctcatcgtcacttgccccataagcagcgttaaagtaacgatccaaggcaaagtgtttaacaaggcgatgcagcatcatctcgggtttagccgaagcaatataaagatggtgtccctgttccttcaatgccgtcatcgtatctagaaagccaggataaagtttggcttgatataagccttcctcttgataatagtgatgaaaggcatcaattgcccgcttaacttcaatatcatccaattccggccagacttcaggaagcttttgcaccaacgccgggccaataaattgaacataggctgaattatccaacggacgcaatccgcgatcctgaaccatgtactttaatgctgcaacgattcctgcttctgaatctgctaccgtgccatcaaaatcaaaaaataatgttgccattgagatcctccttatttgacatgaatgaaaggctgtaaaaaagccattaagtgtcgtctattagtaacgccgacaacaggtatgggcgcttagacaatgatttcgatgcgctcctgttcacgctctatccttaaacgcgctcacagtcgcagaaatctccgtgtaaggaccctggatcaaaatggccaaagcccggccatttcggtccagggccacttacactccgatttctatgcgctcctgttcacgctctctattatacaagttcctgttcacggtgtagtgcgtcttttaaaataaccggggcaattaacgttgtgatgacaataaccacaatgacggcggaatagtattctgcgtccataagcttggcctcaaacccaatttgagccacaatgagcgccatttcaccgcgcgaaaccatgccagctcccacaacattgctttgtaaccaactagcgcctgctaaacgatcgccaaggccacagcctacccacttggtcaccaatgccaaaaccgtcaaaatggcaatgaagcccaaatcacggccaaaggtatcaaaacgcatattcaagccaacgctgacgaaaaataccggaataaaaacggcatacccgattgcactcaaattgccatcaacctcatgccgataatgagtttgtccaaccgcaactccggcaaaaaaagcaccgatgactgcagacatgcccacaagatcggccacatatgccattccaaggcaaatcaataacgacataatggtaaccgcagaagccgggaataatttttcagacaaccgcattaaatacggcgctgcccatctgaccacaaaataaattccaacgaagtacaacagttgctcgataatttgcagccaaaacggaacactggttgttttttgttcccctaatactgcgaccgtaaaacttagaattaagaccgtcaagatatcgtctacgactgcagcccctaagatcgttgccccattgcgaccttccaaggcatgcaattcttttaaaacctcaaccgagatggaaaccgaagtagccgcaaatgtaatgccaagaaagagactgctggtcaagttaaatccccaaagatgggcaaagccaaagacaacgacaactggcacaataacgccgataaccgcgactaacataccgggtttaaagtatttcttcaataactccagatcactttccaacccggctaaaaacatcagaataatgacaccgatttctgcaaatagtgaaatcgtatgcgtagacgaaatccatcccagaagtgccggcccaattaaaattcctgctaataattcgccaataactgcgggcattttcagcaaccgactcacgtgtgccaataccaatgttgttactaaaataagtgctaagttaccaatgtcctgcatctttaccctccatgtttacgtctattaaaccgatgttaaccgaacttcataggcattgcgttcaggaaccggttcgtccatataaacgatgccacgaaaatcaaagcccatacctgtaatcgcatgctgcatgatcacattttttgcgtgggtatccactcgcaaatcgtcaaaaccgcgccgataagcttcactcataatgttgctaaaaaatacccgactcaactgtttaccgcgaatactaccgtcaagtgcgaatcggtgaactgctagatacgggacatctgccaaccagcctgccccatcaattctgagataatgcggatccggaccgacaactaaagccgccactccggcaacccggccatccacaatcaaaacccggccgataccggtagcaatgtcctgctcaatcgcggcctgatccggataagtcccctgccactggtcaattccctgcgcgcccaaaaactgccgcgcagacgcgataactttcatcattgcaggaatatcagcaggcatcgcaacccgcataaatatggttgacacaaacatcatctccaaaacataattgtgtccttcattttcccccaactgtacgcgagattcaatctgaaagtaaaaagagcgtgagccggcgcgttcaggagtcggagtgtaagtggccttggacgtgatggtcgggctttgaccattgcgtccaaggtccttacacgcagactcctgcgccggcgaacgcgtttcagcagagcgtgagccggcgcgttcaggagtcggagtgtaagcggccttggacgtgatggtcgggctttgaccattgcatccaaggtccttacacgcagactcctgcgccggcgaacgcgtttcagcagagcgtgagccagcccgcttagaaaccggagtgtaagtggccttgagcgtaatggccgggcgggctttgaccattgcgtccaaggtccttacacgcagactcctgcgccggggaacgcgtttcgagagtatgcaagaaccccccaaccgaaaaacgactcccgcgggtttattggcgggagtcgtttcaaagcaaatcacctaatacaaattaatgcttgtgatgcaaatgatgttttttattaaccggtacttctgcatattccggtgcaaacacttcatgtgcgccacgatgttctggtgccagtcgccatggatgccggccatgatgacgtttgtgcatttccagcttcaggctcaattgcttggttcgttctttttccgcgcgtaatttctggtgaccgcgaatgatcgcaatgccgccgcctaaagtcagtgcaatgggaatcaaatgaatcactgctaacggaataatcaaatcgggttgttgctccagtgcgtgatcaaaggcatgaaccggttcaagtagcccttcttttaattcatcaaaatcagacatgaaagcacctccatgacatgagagacatatacttaccatttatattataacgttaattatctaataaaggtgatccagcatccgttttcacaagccactgacccaaatgactgaaataatctgtcgggttgtccaacatctgaccatgaccggcattaggtgtgacatgcaaagtggcatttggtattgtctgagccattcgcttggcagctgataacggcatggtttcatgtccaccgaatgtcagataagtcggcattgtcagacgatgtatatcagcccgtcgatcccagtccttaagtgcgcctaccatcacaaattcattatcaccttgaaaatgatgatacacgggggtcgccaacgtgctaattaaatggcgcggctggggatctttggcatgatgaagatattgctcccctaactcacgcaccaactgctggtatttagcatccgcaaacgcgtgctgggcttcaatccgttgcatgtatgccacgtcatcactagaaaacatggtctcccgaatcttgttaatgttaactaaatactcatccaagttatcaatcatcgagctcaaaataagtcccttaagatgctgcggatatttcaagccatattcaatcgccaacacaccgccccaggactgacctaataggtaaaaatgatcaaggcccagctgttgccgaacattttccacttcgtcaacataataggcaatattgagaaaacgcttttgattagccggatcggaaaagtccggttgatcagagaaaaatgaacccagttggtcgtaccgcgagacacggacaccaaaagatgccagttcagcagcaaaattttcaaacacttcattcgtgccgcctggtccgccgtgcaacgtcagtaattgaatcgggccactgcctaatgtctgggtccacaagtggtagccattaggtaatgtgataaatcgggttccatttgggtttcgttttaccatgagagcacttctttctataactttcatctcattatgacggtttcatgactccctaaccataacccaaccatgccagcaacttcaaagttttgtaaaaacaagtgtgatattcggcatcttgttgtctggattggtaaaatggatgaaaagtactggagggcatgcgatggcagagcaaaagatttcacctgatcaagggttatcggaagaacaagttcagcaacgaatcgatgcaggccaacacaacctgccactaaagccactgacacgatcaattagccagatcatcaaagtcaataccttcactttattcaacttggtcaatgtcgtgttgggtgcgctcattattacgactggtagctataagaatttactgtttctcggtgttgccattatcaatactgccattggtacgattcaggagattcaagccaagcgccaaattgacaaaatgtcgattcttgctgccacccgtgcgacagtcatccgtaacggtcaggtggaaaaagtcgagcttgagcaactggttatggacgatatggtcatcctcaaacgcggggaccaaattccggtggacggcaccgtggtagctaccaacggccttgaaagcgatgaaagtccactaaccggtgaatcccgccccattgccaaaaaagttggtgacactttgctctccggtgcatttgttgtatcgggacaggctaccatgcaagtaaccgctgtcggtgacgctacctttgccgctaaactagcgctagaagctaaggcagaaaaggccagtcaaagtcagctattagccactatcaatcgtatcattcgggttttaacctatgttttgattccaatcggcgtcattcttttcacggtttccatgattcgacggggtcattataatcgcgcgattttaaccaccagtgcagccatgatcgggatgatccctgaaggactggttttgttaacaaacgttgcactcgctgtttctgcacgcaaccttgctgtcaagcgcgtcttggtgcgggcattaccggccattgaagctttagcaagagtcgacacaatatgtttggataaaaccgggacgattaccagtggcaagctcaaagtcaccgacacattacctgcagacggacgaaccgctaaagatgtcacccgcgccgccgctgcgatcgtctatgcactcaacgatgacaatgaaacggctttggcaatcaaagctgcagccgatgccgatgccaatcaacaagtcacccagaccgttccattttcttcagctcgcaaatggtccggggccgttgtggatggacaagccttgtttatgggggcgccccagtttacatttggtgatcaactgccagctgccataacggctaagattcaaaaagctgcggcaaatggctaccgggtgcttgcggtgggaacggccacccaacttacccagcctttggttaatccgcagttaatcggcttgattctcatcacggatgaattacgcccgactgccatcaacacgtttgatttcttcaagacccaaggcgtggctttaaaagtcatttcgggtgatgatccgaccacagtcgctaacatcgccaagcaagcccatctcgaaggtgctgatcgcagtgtggacatgagcaccatttctgctgatgccaccgccgctgattttcaaacgctggttaaccaatacaatgtcttcggccgggtgaccccggatcaaaaaaagcagctcatcatggcttatcaggctttggggcatacggttgcgatgaccggcgatggtgttaacgatgtcttggcgttgcgccaaagtgactgcagcattgcgatggcttccggtgccgatgccgccagttcgattgccgatttcgttttgttggattctaattttgatgccatgaccggggtactaaacgaagggcggcgggtcatcaacaacatcgaacgtgtggcctcgatgtatctggtcaagaccatgtattccgtcattttagcgactatctttgtctttttgccgctcgattatccgattgtccccatcaatctcaccccggtttcagctattggggtggccattccctctttcttcttgaccctagagcctaacttcgaacgcgtcaccggtcagttcatgcaaaaggtcatgacagtcgcggcaccagcggctattagcgtcgttgtttatacgctcctgttaacctggatggaatcattcttccatctcagtttcgataccacttcgaccatggtagccatgttgatcgggactatttccttgaatgtcctgctagtcgttgcgcgaccgtttaaccggcttaaaaccggcttgcttgcgagtctcagtgtcgcgctatttcttgtcttctttgttttcaacggtattttttcactcgccaacttatggcattggcagttagccttactctatctgccgctcatggcctcaaccgtaccgttttacctcttgattcaagaattcctcggtcgacgggtgctttctaaaatcaactggcggtaagctgcacccagctttaaaaaacgatgatttcttttgatcactgacgcatggtaaaatcatttaaaaaggatgtgttatagatggggattgacaacaaccagctagtagcgcggtattttgatcgtaaagccgatcatggcgctttttttactgcactagaagcttatctggacgatgaactaggcaaactgtatgccactttgaatgatacattcgcggacgatgccattgcacaggcgcatcaagccggtgctaaaattgacgaccctgcagctgaagaaattgccacgataaattatctgtttaaagagctcgcgtcccgcggcttgtggctgcaatcaccggatatgacggaacccaacaccatcattgccaaattaaacttcggcaatcgccgcacctactactaacggcttaaaagcacctgctacattaatccgatgacaccaaaaggcagttgcggtatgatcacagatcgtatcgcaactgcctttttggatgctttcttcaaatacagtttcagatgatgctattaaaatgaactaggccaaagcggctattgattggctttaggggcatattgcttgtctgcaaaccaaattggaatctcacgttgcgcactggcttcgctatctgagctgtgaataacgttgcgaatcgtctgatcggcccattcccgaccaaagtccccgcgaatcgtgcctggcgcagcatctccgggattcgtagcgcctgtcatcgttcgaacggcttcgatcacattaaacccgctgacaatcatcgccaccagcgggccactggtcatgaagcgttcaattttgggaaagaacggcttgtcaacaagtgctgcataatgctgatgtaattgggcggaggttgcctgtgtgacttttagtgcctcaatggtgaatccgcgtcgttctatgcgggtaatgacctcgccgatatgtccttgggcgacaccatcgggcttaaccaagactaaagtttgttcttctgccatgcatgtgcctcgattccttgaatattttcagtaaattcgttcatattcagtatacacgagtggtagctgatgaaaaaaggcagtttagctttagttaagtttatttttcccgcaaaatgaactgctattaccggcagtaagcatagatgtaccaatacctttttggaaaaattctgaacttgctagcgtgcgcatgcgttttagtcgtgatcaatgctatactttagccactatagtgcgtttcctggtgttaaacgcggcgattcgcacataacgcgcttccccaacgcagaagcctgcgttggctcgcgctcacttttttaaggaggctttttacatgagcgagacaacactaccaaaacggcaagcagtcgatcagcagttgacttgggatcttactccgattttcaacgatgattttgcgtacactgaagcagtaaagcaggtgcgggccttgaccaaggattttgtcaggatgtatcaaggcaaattgacgcaaccagctgtcattgcggatgcattagctgactatggaaccattgtagctcttgccagtcgcatcattcattggggctttatgccatactccaccgatacaactgatcctgcattgcgtacgcggcaggctcaggtaacgggcctcgatggcgaaatcagcggtcagctaagtttctttcgagccgaactcacgcaactttccgaaaacgtgcttgatgcagttgtcgagaccgctcctgattatgccggttttattcgccaaatcaaagttgccaaacaaggtgccttaccaccagctgccgagaaggtgctagccgaattgacaccggtttttcaggctccaagtgatattcgcgaccaaagcatctttggcgatatggactttggtacgtttacggcgcacggtaaaacttacccgttatcgtttgtcatgtatgaagaaaattatcaaaaacatcccgataccgaaattcggcgcgccgcttacgctcaattcaaccagaccttgcgtcgttatgaaaacacgatggcggcaggttacttagcccaagtcacgcgtgaaaagattacggctaccatgcgcggttatgattcggtgattgactatctactcgccgatcaagaaatcacccgcgagatgtttaaccgtcagattgatgttatcatgcgcgatttagctccgatcatgcgtcgttatgtgacacatgtgaaatcgctttgggggcttgatcatattggttataccgatttgcaaatcgacattgatccgaattatgcgccaaccatcacactagaacaagccaaagaagatattaaaaatgccaccgcactcatgggtcaagattaccaggcacagatgatgcaggctttctcagagcggtggatcgatttccctgctaatcaaggcaaggattccggagcttacactgctggaccgtatggtgtgcatccttatgtcgaaatgacttggagtaatacgctgcctgccgtttacaccttgattcacgagttaggccataccgctcagatggtccgctcacaggaagcccataatgtgttggatgcggactttaatgcctatttggtcgaaagtccttccaccttcaacgaactgttgctgactcactatctcgaagaaaacgctaaagatccgcgaatgaagcgctttgccttgtcacggttattaaatgatacctatttccacaactttgtcacccatctgctcgaagccgcgtttcaacgggaagtctataacttgatcgataacggcgaaacttttgatgctgctcggttggacgccattacgcgtaaagtcctgaccgatttttggggatcggcagtagaacttgagccaggtgctgagctgacttggatgcggcaaagtcattactacatgggactttattcgtactcctactcagctggcttgacggttgctacccaagcattccaagccatcgaacaacaaggccaaccagccgttgatcggtggttgcgttatctcagcctaggcgactcacttgatccagtcgaagcagctcgagtcgccggcgttgatgtcaccaccgacgccgctttgaagcatgcaatcagtttcttggggacgacagttgatgagattgaggcattaagtaaagaaattgagcaggtataagaacgacaaaaaccgcatttttatcatgcggtttttgtttgacctgtattctccattgcacccgtgtcacgcagcatcacctgcttcaaccggcttttgcatctgcatcaagttgaatgacctgatcgtatcgctgctgccatgactgacttatatgatgcgccacttcgattaacgttgcaggactttgcaataggcgggtatggagttgatcacttagtttttcatccaacgcagaagtgacctcgtcggctaacaaaatcgggcgctgccgcaaaagagcccgggcaatttcaagccgttgaatttggccgcctgacaaatgatggccctcttcgccaacttgataatcccatcctttttgtgcaataagcgccgtcagaccagcatcagccaccgccttgtctaaagctgtctgggaaaaatgaccgcctaacgttaaattaaaccgaatcgtatcgtcaaacataaatggtgtctgtttaatcaagccaaacaaatgacttaattgcgtacgagtcgccgccgttatttggacattaccaagataatattgtccgctggctagcggtaactcgccgatcagcagtcgcagcaaggtggatttaccgtacccggaaggcgccataatcaatactttttggccaggcttaatggtaaggttgcgcgaatcaagaatcttttgtttgccaagtgttaccgatgcatctttaagcacaatgggtccagtggttattggcttttcagctgtcgacgcatctctaggctgtgcttgcttgatctttgcgactagcggtttggtcgtctgccattgattcatcgcttcgataaccataatcagcggattgcgcatatcgtttgacagttgcacaatgcccataaataacgctaaagtcgaagccccgatcatcacgcggtaaatcccgatgccaaaaggtgctaaaacgccgaaccaaagtgccaatagcatgcccagcgtgttcatactgccggtcaaaacggtcatctttttcaactgatcttcaaggccgcgtgccagcctgttgatgcgcgttttaacaaccgcctgcgcctgataaatccgaatggtatcccgcccggccaaatagttcttgattcctgacgtccagtgaccattggcagttgaccaatcttttgacgcgcgatgcaaccccttcctagcaactcgggacaccgttagcggaatgagattgccgaggaaaaaggctaaggcggtcatccaatcaaacgcaaacgctccaatcatggccccaccaaagatgaacagctggttaatgatggccaattcgcttgcaatgccatttgtttcgatcatttttaaatcattcgtcataaacgacagtgctgatgattgggtgctgacgagatctgcgtcatcaatcaaataagctgccattcttgccttaatattcaaattgactcggcgtgtgatcacggccttcaagaacatcacgagccaatttgctacggaggcacctaagaaaattaacaaactgggcaccactgcctgcaccaaccgcgccatagatcgcgcggatgccgcctgaatcagtatcgtcaagcagtaggcaacccctacattcatcatactgtaaaacaaagccgcaatcgcatagactagcaactgccatttacgcccataacgccatgtcaacatcgtcctcgctcccatcatcttgtttagcttcatctgatcagatgccttgttgtttaatatagtcaggtttatgctgatggaaacgaaaaatgtcatatatgaaaggcgaagtccatgaatatcggtacgcttcttagacaaattcgaaaaaataaaggcttgacgctcgcgcaagtagccgatgccaccatcagtagttcttatctgtccaaggtcgagcgcggacaaaacgacataacggtcacgaaactattgcacctgctggaacgcttagaaacaacaccggaagaattcttatatattgccgctgatgattttgacatggactacagtaatcttgatcggatgcttgagacttattttggttcgtccctcacaatgtcagccaacccccaggattttcccgaaactctgcgtaaaatgaaggaaaacgtccggcaagcgcaaacccgctttcaacaaacacccacgctcaaaaataaactggctgtcaacgcgcgcatgcttttgcctgtcttttttcagtcattggtcattgatgaggcgcataagttgccagtgcgacccgatcttacccatgtcgcggaacaatatctccagcaactagacaattggggggaactcgatttatatcttttcatcatcttcagcattgcgatgccggctgaaacacaacatcgcttactgacaattgccatcaagcgtagtcaccactatcgccattttcgcagtgcgccgttacttatccttaacttattggaaaatcaggtgatgttggaattaacccggcaagataatcaggctgccgctaggtatctgagccaattagaaacagcgctcgacaaaaagccaagcgctgagtttgctttatgggcacagttccatcgtgccgaattgtgcgcacgccaaggacagcacaaaaaggcacgtgcattgttagatcaggttgttgaaatagcagcggctttaaagtttaaagacttagccgatatttttgctttcgcccgaacgattattttgactgagccgccaacatcaatttataaatacttccatattttggtgggctcaattgccgagggtgaataatcagttttaaccataacgcgttctccggcgcagaagtcggagtgtaagaagcccagccgcaatgtcaaaacccgcccatcacggccaaagccacttacaacactccgacttctaagcacgctggctcacgctcacaaaacacagaacccaccgaagtcaagacaacggtgggttttcaacgatatcagtagcaaatgagcgattcaatacctgagtcacatccgaaaccagcggacgaatggcgtcttgaaccgctgggcaggatcggcttccgtagcgttttaatgcccacgcagcccgaatccgccaaaagaggttcatttgattcagttttggatgcccttgcagataataaaaacgggtgcattgacactgatgattctgctgatactgcgcaatctgttgacaattcacggactcgcgccggacaaccccgctgccgaacacaataaattgttcaggcaaatcttctttaaattggcgataaaaggattttaatcccaacactttattgcccacaagatgaccgccatatatcaccaatgaccgatttttcagatctgaagcggtcaaaaactgtacatcaatcatttcgcaatgtaacgtttgcgcgatacataaggcaaatcgctgcgtaaaccctgtctcggaactataaactaccaatgtctgctccatttgaccgccccctttgccactttcttgcgcgagttccattcattaggatagcaataaccacggactgctacttgccattaatttaaccttacataaatatttatattcgcgtcaatttatatgctgatcgacatgttgcaattagattgtgcacatttattttagtatgtggtcatgttaaactaaggatgtcaggcgttattattgagcaaagtagttttcggttactgtgtttttccggcgtttcaaaattttccaacacgccgggaaacgcacataacgcgttcgccagctcagaagtctggcttacgctcagcacacaatacaaggagtgaattctgatggaaataactcgtcacggcaccgctatcatgacaaacggtaccccaacagcaattggtgaaaagttacccgtttttacggtcaaggatgcgcaaggtcagtctttaaccacgcaagatcttagccgacgtttgacgttaatcagcgttgttccagacatcaacacgcgagtttgcagtatttcaaccaagcacttcaacgaagatatggatgcgtttgataacgtcgatttttatactatttcgaccaatacccctcaagaacagcaaacatggtgcgccgcagagaacgtcaagaaaatgcagctactgtccgatcaaaatgctgactttgggaaagccatgggactgtttgttgctgacaatcatactgatgcccgcagtgtctggattatcgacgacaccggcaccgttaagtatcgcgagttgatcactgaacaaacccacgagccggactacaccagcgctttagcttatctcgaagcccatcaacattaaaagcaacaaaaaaagagccagctggctctttttttgttgcacctcaaactattcactttatgccaaaccttgaacgagcatcatgagaatcggcacgacgaccacgaacaaaacggttgaagttgtgacaacgttggtggcatattcaacatcggcatgggcttcagtcgccagaatcggcaagaccgcaagtcctggtgccgccgcctgaatgatcagcgtttgggcttcaagtcccggcacattgaagccagcgtgcatgcccaacaagatcaaaccagtaatcaaagctggcgcaatcacaaaacgaccaattaaggccacaatcgtatcgcgatcaaaccggatagcctttaatccggcatcagctaaaataatcccgatataaatcaatgatagtggcgttactaaactaccaacataatccagcgtgttaactgcaaaacctaaccagccaacgtggataaacggaatcttaagcaacagaaagactaacgcaaccaggaaaccaaccaatggcgctggcaataacttcttccagttgaagctggcgccgcttttttctgctttttcctgagtcggatcatcccatgccatgatgaaggcacccactgtccaagttgaaactgtgttaaccacgtaatacatcaggaaatatggcaccgccttgtcaccaaacaaggccaggttcaacggtaagccgatgaaaatggtgttggcgttgacgaacatgttgatgaaagtgccacgccgtcctggccgaactttaagcagccaaaccagcaaaaaggcaatcagatagccaagaataacggcaccgaagccgtaaactaagccggatgacagacttaccagcttgtttaaagtcagtcgttgcaaaacagaaataaagatcgaagcaggcaacgcaattttcatcaataaatcagagatggttttaccaaactgatcatcgaaccgcccttgccgccgtaaaacataacccacggcaatgagcaaaacgatggtcagcacactttgaatggatgtacttaatgcagtcacagttctattcctccaagtctagttcaattgaatccggtaatggctgatattccggcttccaggtcatgtcggccacagcctgtttggcatcgctgatcggttgctggtttaacccattcttgatggcgtcttcagcaacagcaatcgcaacggtttggctaaactgatcgagcttcgaaaccggtggcaacacggcagcacctggctgatccggatcaacaattccacctaaactgtgcgcagcggccgagatcatggagtccgtcaacagtttggccgttgaagcaatggttcccaagcccaggcccggataaaccagcgcattattcgcctgaccgatcgcataactgacacccttatattcaacattagcagccggaaccccggtagcaatcaagccacggccatccgtccacttgatcaagtcatctgctttagcttcggccagcttcgtcggattggacaatgggaagataatcggtcgatcggtgtgagcagccatttccttgacgatactctccgtaaacgtacccggaacggttgacgtgccaaccaagactgttggatgaactgccttaacgacagcttcaagcgttgtcagctcgtctgcattagcaaactcgctgcgagaacgggcaaacggcttttgttctggcgtcaaatccgtcatgtcatcaaagagtaagccttgtttgtccaccaagtagaaatgcttcttggcttcttctgggctcaagccttcttcaacaaaggcctcgtaaactcgcgaagcaataccagcaccggcagttccggcaccaaagctcaaataaacttggtcggtcaatttttgcttggaaatattcatggcgcctaatagcccggccaaaacgatgatcccggtaccttgaatgtcatcattgaaggtagtgatcttgtctttatattgattcaaaatatctgcagcattactgcgtccaaagtcttcaaaatgcaaatacaggttcgggaacagcttttctgctgcggcgacaaatttatcgacaaagttgtgatacttttcaccgtatacgcgcttgtgacgattgcctaaataaaggtcgtcgttcaacaaactttcattgttagtgccgacatctaagaccactggcaagacctgactcggatcaatgccggcagcagccgtataaaccatcaatttgccgactgagatgtcaacaccctgcgtgccccaatcgccaataccaagaataccttcagcatcgcttacaaccagcaaccggatatcgcggccatctgcgctatgcttcagtgcgctttcgatatggtccggatcatcgattgaaagatacgtggcattttgtggattaacaaaaagtgcactgtagttttcaatcgtgtcggcaatagtcggatcgtaaacaattggcatgaattcgttgatatgctcggagaaaagcttatagaataaaacatgattctcgttgaacaaggtcatcaaaaattgacgcttggccaaatcagttggcttggtctgcaactgggcataagcttgcttaacctgctgatcaagtgtttgtacagctggtggcagcaaaccattcaagccatattggttccgttcctcctgcgtaaaagcagtccctttatttaaaaatgggttattcaggatctgttctggtgtatatttcaaagtccacactcctttttgtgccagttaaatcggacacaacttttaatcacaagaggagacgatacgccgccgcaaaaactatagtcaaacctaacagaagtgataaaatatttttatatgacgccattatttttcttttgtcggcgtggcagctcacaccataacgcgctccccggcgcagggatctgcgtgtaaggaccttggtcgcaatggtcaaagagcgaccatcacgtccaaggccgcttacactccggctcctaaccgcgctggcttttctgctccataacgcgctccccagcgcagaagtctgcgtgtaaggaccttaagcgcaatggccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctggcttttctgctccataacgcgctccccagcgcagaagtctgcgtgtaaggaccttaagcgcaatggccaaaacccggccatcacgcttaaggccacttacactccgacttctaaccgcgctggctcgcgctcactttttttaggaggctaaacgtgaatactcgggattttgactattttctttcgctaacgaaaaccggcaatttctcacaaactgctgaaaaattcgcagttagtcaacccactattacaaccgcgattaagcgtctggaggattattttcacgcacagctgattattcgcgaccgccgtcatcatgatatcagtgtgaccccggctggcgaacagctagcggcccatgcggcgattattctgaatcagttgacacttgcccaacaagacattgcatgggataaaaaaaccaaaatccgctttggtcttcctccaatcatcggtggttatctgtttcctaagattgcgcccgatttgattaataccggtttaatgccacagctggaaaccatcgaagctggatcggccgctttgcttgatcaaatcaaagctggcaagttggacttcgccgtgctgggtgccagtggtccattagtcgagtctgacttacatgtcgtacaaatcaatgcggcaccgtttgtgatcatcacccgcaaagacgatcctttggcagccaacaaaagcgttcgtttcgccacgcttgctaaacgccaattcattactttaagtgagggctttgtccatacccgcgcgtttgcctggtttgaacaacggcacacattctcgccgaatatcgtttatcgaaccggcgatgtgcccctactcaagcgattggttcgccaaaatgtcgggatcgggttcttaaccagaatcgcaattaaccccgatgaccgtctggctactttagccattgatgatgcccatcagccggccttcacaatctcgatcgtacatcgcaaagatcgcgttttaacgccagcgatgaaacggttcgaatcgattttaaaatcatataagtgaggcaatgctgcccagaaaaaaatcgattccagcaaatacgttagaatcgatttttatatggaattttttcctatagttgacgccaaacaagccaattttgcgggcgttgaaagtatctgccactttaaaagtaatccttgcgccacaaccaccatgcggcaagaccgcataaaaccgcggtgccgccaatcagccaccaaaatgcccagtacgcattctcaaatggcagccgtacattcataccgtaaattccgccaacgatggtgggaatggtcaaaataattgtcaggctcgtcaagaccttcatgatgaggttcaggttatttgatacaatcgcactcacagcagtcgaatactgctccaataatttgttcgtaatgcggaccatggtttgagcctcaaccacctcgacttccacgtcatgtagccgacgaaggtaaccagccgccgtgaaaaagcgctcgcctgcacgtaatgacttgagtaggtttcccgagtgctctaacgccgcatcaaaaaagaccagactcttttgcatcgccatcaattgataaagctgagtatttttagctgctttgcccagactgccttcaatctgtttggtttcgtcatttaattgatccatgtcaatcacgaattggtgcaacactaaccacaaaacttccaaggcaaattcttccggtttggaggataatggctgcgcggccaagtcgtcaaaagcccgcaatggatgctgcataatcgtgataacgcgatcggccagtaagatcatcgtgagcggtacggtgttaaattggcggaatcctaattcattggttatttcgattggataccgtaaaacaattaggcccggcatcttatcagccggatccagcccttctacccgtgcattttcatgtttatccaaagccgcatcgacataggtttgcggaagtccgtaagtggttgccaaggtttgcagttcttggggtaaaggagattggaccctaatccagttagcctgatcatccgttgccacctgcacattgcggtctttttgaatttgataacacgtaatcatgatgacacctcttttaattagtataccgtatcgcgactagaacattcacgacttgccaagactggtatcataagaaatgaggtgatcgatatgaaagtaacactcgaacggatttatcaaaaaccccaagcccaaggttttcgcgttcttgttgacagaatctggccacgtggcatcagcaaggtcaacgcggcattggatttatgggccaaaaccattgcgccctctccggaattgcgtaaatggttcggtcatgatccggaaaaatatcctgaattcaaagaacgctatttggcagagctagcaaaaaatccggatttgccaaatttcattaaaactttaaaggaacacgaacaggatccggttatcatgttatacggagctaaagatgaaacccataatcaagcggttgtcttaagcgaattcctaaaaaataagtgaggttgtcatgtctacgaaagccgaatttcgctcccgtcagctcaagcgcctacaaacagcggccaaagaaacccagatggctggggaaaatctattggcagcattagtgaaaactccgctgtggcagcaagctgacagcatcggggtcacggttagcggaccttttgaagttcccactgcccctatcattgcagctgctcatgctgccaacaaagctgtgttcctgccgcgcgttatgcctaaacgtcaaatggttttcctgccagaccccggttttgatcagttggtaaccagtcgtttcggtattcccgagccgccttatcatgccgatcaagtcgagccggcccctgatcttttgattgttcccgggatcggtttttcgctggcagacaatttccgtattggctttggcggcggctattatgatcgttttttagccgattacccaggccatacggtgacgctggtgccaccggttatggcgtttaaccaaccagactggccagttgaatcttttgatatgccgattgaaactttgatacttgctaatggcaacatcattgtgcaaaagtcatattagacatgatcctgtcattagtattttagtgggccgccgctatcgactgcgatcacgtacaaaggtttatgtgatcgtagtataccggcagctcatttgtgatacttctggttcatccttatctatcccagttttgaacaaaattcattttatctcaggaggcaatccatgcgacgtgaacgtattcgccggaatcgcagaacgctttacctcacactagccggaatcggcgcgattattctgtttatcggtgtcttcatctggctagtgcttcggggagctaaggttcaaggacctgtcgcttcctcttcaagcagtagcgcatcatccacctcggcagtcacccagtcttttaaaagcgggacttataccgctactggcgatgtcacggacgaaaacggtgttcatcacgatcttactgtttatgtgaaattaacgactgccaagacttatacccgcctgctcattattgacgcgcatagtcagccacaagtcattaatgataccggtagtattaaacagaaaaaaggtaagttgacgcttgtatccgatcacgccaatgtctacacttacacgacgaccacgacatacaagcacaagcaggcatcaactgttgatgaatattcagccaaggacgcatctggcaccgtgctgagctacacaactgccttgaagaaagagctcaacaataccatctcgttgaagggtaaaacgcctcataattatcactatttaacgactagtttgcccctacaacgttctaagaaaaagcttgtcagtctagcgaattttaaaacctcgcagactgcttcaagcgtttcttcaagttcagtcatcagctcggtaccgtcatcaacaaactcccaaactagtcattctgtttcctcaactgtttccactgaaccatcatcttctgccgcgcctagtgtcgaaagtcagcatagccaaagcggcgcgtcaggtagcaatccggctcaaactggcggtcagggtacgcagactggcgacgattccgaaaagcctggtagcgatcaaagtaaccagccgccagccggttcgtctagcagtcagtcaccatctccgactgatcccggatcaaattctgctactgataccagtccccattaatcaatcggtcctccgatgcctatacggcgatgtttgcgatctcaatcgccaaacatcgcttttttgttcgcgctaagtctcactgggtgatgccttacgtttggctattaagctcgactgccgctgtgccctgacaactttgaacaaactagtgagtgcttgagaatgccaaacgagcttgtccttttgacgccattcgttccctgcgctacacttgcagtcgtgacgtacttttgggctacaccagcttctattgcaaggtctcaccatcggatttgttatgtactggaggtctacgatgattaacctatctgccagcgaactttcaccgcatgaacaatacaagcttttgtccggcagcatcatcccacggccaatcgcttggattaccacccagaatacagcaggtctcattaatctagcaccattttcgtttacaaccgggatttccaatcagttgccgttgttatcggttgcgattttgcgcgaacgccaagcgccaaaagatactgcggccaacctccttgctcgccatgaagcggttgtgcacatggttagcactgatcttaccaaggcgatgaatcaaaccgcagcaagactggctcctgatcaaagtgaattaacgctgattgatttaccattgattccgagcacggagattcaggtgccgggtttacaagctgctcgcattcgctttgaaaccagtctttaccaatatgtccccattcgtaatgcggcgggaatcatcatgacggatctctttattctagaaatccgtcaatttcattttgcagaagccgtgcttgatttaccgacactgcatgtgaatccaactgccttggcccccattgcccggcttgccggtcctaactacgccgaattgggacgaacgtttacattgcggcgaccaaaataatttataaggaagtggcggtatttgacagcatttatctcaagcgtttttggcgttttcgaaattcttattctcatcatcatcggctactttctaacggcgcgcggctggtttaacagccactctagcaaggtcatcgccaaggtggtgacccaagtcgcattgcctgcttacatgatcgtcaccatctcgtcgaagttcactgcgggtatgcttttgcgcttgctaccggatttgttcttcccggtgttatccatgatgatccttttcgccttgtcatttctggtttgttacttgttgaaagtaccgaagtcacgaaaaggcacctttaaatccatgttcttcaactccaacacggtttttattggtttaccggtgaatttggcactgtttggtcctcgcagccttccttacgtcctcgtttattacatggccaataccactattttctggacaatcggggtttatcttatccaaggtgatgggcccaaaccggcacgctttgatttaaaaaaggcgctcggcaaggttttctcacctccgttattaggcttcatgttcgggattgtgctcgtcttattgaacatcaagctcccggagtttctaatggcggatctgacatatgttggtgacttaacggtacctggatccatgttttttatcggtattgcgttgcatacggctggctggcggcagttgcggctcagcaaggaagcctggggtatctttagtggccgctttctttttgcgccgctactcatgaccgcattggttgcttttgctccggttccgaccttgatgaaacaaatctttattctccagtcctgcatgccggtcatgaccaatgcaccggttgtggccaaactctatgacgccgatgctgattatgctgccatcatggtcacagaaaccaccttgctatcaatgatcgtgattcctatcgttatgacctgcatccaatttattcactaggagctcggaaatgaaaaagctgatatttcttaccatcttaatcttgctaagcggctgctcttccacaaccccggcaagcaagtctacatccaaacagccagcggccagcaccgtcaccagccacgtcaagcccactaaaaagaccgttcccaaagccactttaagtacacttgtcggccacgcgttcgtccaagtcgataatcgcaaaaaggccatccgggtcacgtcctcaaccagcggctactatcttgaaaccttagccaaccaaggcggcgtttttgaaagtaccgatcagggaatttttgccgctcagcttacattaaaaagtcgagttttcaccttcacgggtaaagcgcaaccacaagcggccagttctactttgcaattccaactcaccaaaaaaggtcaactcaagcaacttccaaatggacctgtttacaaaaaggtaccgcaagacgaccttgatcgcctcgcccaaccttgatatttgcaacgttgacatcagggtacataatcaaaaagacatttaccaccacttcgataaagtagctggtaaatgtctttttgatgtgagggcgattcgtcctactgaattatgagctgattacacaagcgccggccgatataaactaacgacaattccgagaatcgtgacacttgggaagtacatatcatccatatcatcattttccggatgcagacgaacgccatgcttttctttgtaaaagcgtttaaccgttgcctcatcctcttcggtcatcgcaacgacaatctggccattttcggcatcattttgtttcttgacaataatctgatcgccgtctaaaatgccgatcttaatcatcgaactgccttggacccgaagcataaacaattcatcggcggaatacggaagatcgtcagggacaggaaaataatcatcaatattttcaatcgccgtaatgggaacccctgcagcaaccgttccgacaatagggattccttgtgcctgaaccccaataaaatcaagccctgctgtcgtgacttcaatagtccgcggtttagacggatctttggcaatcaagccagccgccagcaacttctccaagtaagccgcgaccgtactggaagagctgagtccgaccgatttaccgatttcgcgaaccgtgggcgggtacccatgatcctcgatcgcttcatagattgtttgtaaaatctgtttccaacgtttctgacttgcttgtgttggcatccgctcaccgcctcgttctcttttgttacactcagcataccaatacgaacggacgtttgcaattgtttttgctgtttcatttgaaaaaactgtcgttaggcgcaacaaaatatctttttgcctcaatattaaggccattaacgctttttatttgcgtatggaccgcgccgctccccaatgcaaggacaaagcatgcttgggtgggcaattcgatggttttatcctgctttctataacgcgctccccggcgcagaagtctgcgtgtaaggaccttaagcgcaatggcccggtcttggccatcacgcttaaggccacttacactccgacttctaaccgcgccggctcgcgctcacaaaaaatccacagtcgtcatggctgtggattgtttcatcaattagttatgcaataatggcatcttatgcatctgacgccgatcacatctgctcttgatgactgcatagaagaagcttaagaaaatatctagagccatcaacaagatgccggccgtcgcatagttactaaacaatagcaaagttgcgaccagggtcagagttattaatgtccatttagcgccccgaagtatgctcatatggggtcactcctctccgtatcggatgaaccgacattgactcaccgttttggttgtgactttatcatacctgatttttttgatttgtaaagcttttgtatatgtaaaatttacattaagcgcctttgtttaggcttttataatatttgtaacgatttcagcgtgtttttgtaaattttatgtaacgactgcaattacacgttcttgacatttcacggaacccatcctcgaaaaatgctactcagtcgagtatcattgttatacaaggtgtacttgatttttgtgcttaaaatcagcgctaaagtgacgacttcagctgtcggttactgacaaggttaacttgccagccctacgtttgttttgtaagggcttttgtgactgtctgaccgctttggcgtgctgtgaccggaatataacctttaccgttattagaggaggatcgcctttgaaacgtaccgactcgtggctctatcgccgctttgttaatagtaagttcatgattctgctagttgatttgcttttggccctgctagtcatttttgtctttaccaaaattgcttgggtctttcaaccagtcgttgattttctagggattattgcgccgccatttatttttgccggcattctcttctatctcaccgttccgattatcaaccgccttgaaaaagccgggttgcatcggggcttggcaatcggattgctgttcattgtattgattagcctgctggtctggggcttattacggtttattcctgctgtcagcaatcaaatcaccagtatcgttgattccgctccgcaaatatttaccgaaatcggcaaatggttagatgatttaaatgacaaacagaacatcctgtcgcaacatgatctcaacgaaattgccaatgaagtccagactttcttcacgggtaaacaaggtgcctttgtgactggcaccatttcacagctgcagaatctgattggcattgtcggcaatgtggtcgtcacaatttccactgcgcccatcatcctcttctttatgctaaaagatggcgataagttcacgccgatgatcttgcagattgtaccaacgaaactgcgccgctcggttaagcaaatgctccatgaaatgaatgaaaaagtcggttcatacgtgcaaggccagatcacggtcgcattatgcgttgcggtgatgttcatgatcggctattcggttatcggattgcgttacggtttgattttcggcttgttggcttgcccgttgaatctgatcccttatttcggctcggcccttgcgatgatcccaccgctaatcatgggcgcgttaacttctccacgcatgattctcgccgtgattgtcgtcttctttattgaatggttgatcgaaacgcaattgatttcgccgctggttatgggcagcaaacttgaacttcatcccattaccattgtggttgtcctgctcacagccggcaatctctttggcttggtcggggtcattctcggcatccctggctttgccgttttgaaaattgtcgtcacgcgattctttagctggtatcagcaggtttctggtttgtacgaatcagatcaccccacagatgaagttgaccaaaaaggagtacctcatgaatagttttaatgtgttattgatcggactggacatcgttttaattggcctagctggctactatcttttttggcaaagtaagatccaatttacttcccgatatgcagtatctcagcttatctgggccgtgctgcttggcttttggtttatgacaacccgagtcaacaacatgccgtatattattttcatctcgatctttttggtgctatccattatggcagggactggcggactggcccctactcgcctgatcgccaacggtttactggcgcgcgtgattccatacacgcacatgtccagtatcaccttgacaccggtaagccttccaaatggccaggaatgggttgttgccgtatttgcccttagcaaacgccggatggtccgcctgacatttcaggccagtcttcaaaacctgttaaccgaactgtcaaaagtactgccaaaaacggttcctgtaaccgtccagcgtatgaactagcacgcatacgtaaaagcaaaaaagctccccgaataaatttttcggagagcttttttgctagtcgtcattaacactattcatcgatctttcgaatagctaagagtgcaaccagtaccacggccaggccagcacccgtcaccagcatctgccacggcgcggtgacatccaggaagtaataatcaatcagcgccagcattaacccggcgaacaaaagatcaatccagaaacgtcgccaccgagtcctggctgcagcatctaacaataagacgataccaatcaaggcggataatacaatgccaaaactaattgtcgcaattgtcccgatcgtatcagccggccgcatcgtgtaccacgcgaaaaatgcaaaccccgccgctgccagtactaagacaatgaccaagcctatcaattcacgttttgagccaaattttttcacgagcagcctccttaaagctatcgtcttcacgtcatgttcatcgttaattttttatgattcgtcaatcggcatcgaatttttcaagctgggttgcgcacacttggcttgtttcgccaatatcctgcacattttaccaaataacctgtgcatttccaactcacttcataaaaaggttacaataacgacagattaaacgaaaggacgattcaaatgtcacaaaatattgcgatcggttttactaaaggcttagcgatcactgccgaaaacagcttccaaagctttgccctccctgtcccgactccccaaccaaatgaagtcgttgtacaagttgacggcgtatcggtcaatccgattgacaccaaacgtcggcaagcggcaacgcgacaagcaacaccacaagtgctgggatatgatgcagttggaaccatcacccaagttggcgcacaggttgctggttatcatgttggcgatcgggtcatttacgccggcaccacccgcaaacccggcagtaatcagcaatatcaggcagttgacgcacgactaattgcccgcgcaccacaacaagcccctactgctgacttggcagcactgccactggtcggattgacggcttgggagttgctatttgaaaaaatgggcttcattcccgagtacaatgcgaataaaggtcaacaattactgattatcaatggcgctggcggtgtcggttccatgctcagtcagttagcccattggagcggcttaactgttttagccacgagtagtcccaaaaatcatccatggctgcgcgaccatcacgttgatgtgccgctcgattaccacgaggatctgatcgcccaaatccatcaagccggcattcaaaccgttgatggtattgcgctcctctatcatcccgaaccctatctagccgctgccagtcagttaattcgggcatttggccatattgggtgcattgtcggtccgcaagccgggcttgatttggcagtcgtcaaagataaagcagccagttttgattacgagtatatgtttgctaaaaccgattttgcgtaccacattgcttctcaaggcgcgatcctcagcaaacttctaactctgtatcaagacggacaaataaaggcttcggtaaccaaagaattcaccggcattaatgtagcaaacttaaaagctgccactcaattagtagaagaagggcatatggtcggtaaagtcgttttgactgggcccttttctctgtaaatgatgcctccagttgctttaagatcaaggttttatttccggaaacctaaagcatgctgcaatgcaatctttgccccttctgaattcagctggccgggatcatagataatcgttccatcacccatataataatgaaattgttgcatcactgctcgatttataactgtgcgtaggcgcaattcatcattaatggcatctaacaacttcccactccatgtcttatccatcatttcagggatatcccgttcggtcacaaaccccttatccatgatcgcatcggcaccttcctgcttctgaatccgagtgaccatatctgtctctttgtctgccataaagttccctcatttcgtgctttttcagaaaaaataaaaattgaccaacgcgatgctggccgcctattcgattctatcacagccatcacctcgacttggcatttaagaccaatcgtgttaaagttatttttatcctaaaagaagggggcattttaaatgcgcgttgatactgggaaatatcctgatggtgttgaccccgcccgaataaagcggctcaaactcctcagtaagctggcaacttttacctgtattttaatgtatgtttcgtacattccggaaatcattgcaaacttttctggaagtccagtcaatccaattcaaccattagtagcaatggttaatgctaccttatggacttgctatggctggttaaaaacttacaaagattggccaatcattatctctaatatgccaggtattctgtttgggctagttacattcgttactgtttttgtacattaatcgactatcagcaaacaccttcatgattgaaggtgtttttttactttacctgatgaagtaatcgtgttagcattacttcatcagatgcagtagtcaacgaacggcacctttgccagttagttcacgaccactgctgcaccaaccaaccctgcacaaaggaggcgcgctcgtgatcagtagtgatgccatgcgtggctataatgacgtccttattctcgccattttacatcaaggcgattcgtacggttacaaaattggcaaagaaattcgcgaacgaacctccggacaatacatcattcgcgagaccaccctttacgccgccttcaaccgtttaagtaaaaatggctatatcgaagcttaccccggtgcagtcacaaatggaaagccgcgaacttactatcgcatcacctcaagcggtcaaacctttctcgcagttaaagccgcagaatggcgccgcgtcaaaactgttgtcgatttattcttgaatcagccgttaaccgatctttagcctttggaggaacctgcccatggatacgattaaaacctacttagatagtctattcgcctcactacccgataatgccaaaacccaacaggcaaaaaccgacatgctcgccaacatgcgcgactattatcgcgatttgctacgggacggtaaaagtgaagaagaagccatcggtgctgtgatcagtgcatttggttccttagatgagttgcgcgctgatctgggcctcccggtgcaatccgatcccaaccgtgctgaagcggcagccgacgatgatgccattaccgaatcagaactgcggcatttttggcaaagcgttgaccattttgccacccaaatcgcgcttggcgtattgctatgctgcatcagcgtcgccttacctgcctatgccggcacctctcgttatgaagtgttcggggtcattggcatgttcctactagacgccatcgcagtcggtctcttcatttgggcaggcaccacgtacagccagcaaaaaaagttactcaatgaccgaccaatcaccaaaagcgccaagcaccttgcccaacaagaaacggcggcctatagtcggcaattcgctgcgggcctgatcgttggcatcatgatttgcatctgctctctcatccctgccatcctctctgaatacattagccattttatcagcgatgacgcaggtggcgcgctgtttctcattatcgcaggattaggtacttatcttattctttatgtttccattaattattcgcaactgaaacgttacacctacgccacaacagtcccaaattcagctccggaaccccatgacgaacacacaagcagttggtccgcagcaaaacaccaccataaccagcgcgcacgtcaagacattgcacttttccggcaagtttattggccactgattcttgtcacctacttcttggcctcaacccttttcgatacctggagctattcttggctcatcttcgttatcggaggtgtgctccaaaacgtcttcattgcccttatcacccggcgagctgaatcaagataagcttgataaaactttgagtcaggcgctgtcattccgaaatcaatcatatggccgccttttctgcaagtgcctcgtatgtgctttccaaaataatcgtgctttccactattattttccttgcttaacggcagacatccttgcccaattacggtcaatcccctttacaccaacgtcgaagttcagtacaattaggtttgtgttttgggtccatagctcagttgggagagcgcctgcttcgcatgtaggaggtcgacggttcaagtccgtttggatccataattgaaagtcgccaagtaattatataaagcagcgcaggcttggtagcaggtatataggtaacaagcgttgggattttttaaataagactctagcattgagaatttttgaagttcttaatcctagagtcttttttgttcaatccgtgcgatcatgataatcgtagttttgccgctggtgtgtacaataaagttgcatatatgcaaaaaatcttttttctgcaccgtcgttctctcataattggcttatatcgtctacatgctccatgacactcaccgatatacgtatcatggatgccacctgaattaaaacatctttggagggggtatatttgaaaacgaataaaagcggttccgtattagaggctttggggagcttctttcgcagtcaacgcatcgcacgtggcttaactctgcaggaagtcagcagtaactggtctgctgccactttatcaagattcgaacgcggtgaaatcgatattagtaccgacaaaatgctgtcacttatgaccaaaattggcatcgatgaattagattttttggagttttatgaatcgattccggccaattttcctttacaattacaagacctcacgcagttaaatgacattgccattttggaggcacgcaagcgtggattctttgctgcacatccacatatcaatagcatgactgagttagcccgccttatgttcgcggcagctgaaaattggcctaatccccagtttcgatttagcagtgaagatgagcagcttttggcagaccgcttggctacccctgaacgttttaccatcttagagttagaactttacaaggcaatcgctggtccggccagccatgaactgctgtctttgctttggcatcgtgctcaacgaattcctgacaactggcgccaacctcgggaaatgatcgaactattgttatggctcggtgccttgatggatcaagatatggaactcgttaacgatatggagtctgaattggcagaatggtacgtcgctgattcagttcgcgaccgcatcattgaattcatgccaaactggcaatacggtcgcagtgttgcaaactggctgcgcacaccaacgaatcaaaataaagccaagatccaagcaatcattagtatcctgaaaaaatacgatgttatgactgatgctcggtggtttgaaatgatgttagtgcgaactcaatctggaagtgtgtatcacaacacgcaattaattgaccatccgcgtaaactaacggaagcacacacagctcaggaagttgttaaacgccaacgtctgtatctcggtctcaaaatcacggacattaatttaaatgtctcccccacaacattaagacgctttgaaaacggtcagacgcaactagccgcatcttgtttatttcaactttgtggtgagttagctttattaccttcgcagattcttagctcacttgatccgacatcagacaatgttctaggaaagatctcactaaaacaaactttcaaacaagtacagcaagctactgctctaaacgaagacaaacatttagtcgccaatctcattcatcaattcacgactcaattttctgatataccagcaaacacactcaacatgcaactatttgtattgaaatcagcatcaggattagtgtcagcaaatgatcccacaatgcttcggcaagcacccatacttctgtcaagattattacagaataatcactggggcgccttagaaacccacactagtcaagaactcgtcaattggctaaatcctgaacaactgacaatgctgttccaaaaagggaatcatgtcgttgttaagcacccactaacggtaggaattaattacgtttttagtggactgaatcaagctattattcgggttattctccactattcatcaaaagagctgagcgcatttttgcaaagctttagatggctattgacatccactgatccaagtcccgagcgctgggaagctttgggttcttggtatcttgggcgttatctcctcgatccaagtaaagctaatgcggatcaagttgaactctacgtccatgaatccttgcgtataggccatcctaatgcaattacaaatttgaaaagtttcaatatcaagcatttaccgaaaggctttattgataagtttgtctcatcctacaaagattaaaattacaaaaactaagatactttaacatgcatatatgcaaatttgctgggagccactcaataaaggcgccataatttatgacaggttgaggtagtagaagtgggtaacctcagtggaggagtattgaaaaaagcggggttggggcctcgcttttttctgtgcaagcgtggtaaaccggcgcggctagaagtcgaagcgtaagtgccataaacgtgatcactcgggctcggcaattgcacttaaggttcgtacacagacttctttgcctgtaaatgtgttaagtaaacgtctgagcagcataatcactagagactaaacgtgactttgcacaatattttcgttagtccccagacttcgcgatttaacccaaattctaagtgtgccaagttttccattttggccagcatcctagttgaaaagcagccgtcaaccttggtataatcgttttcgaaaatagtttaggcacaactttgtttatacgcattgaaatagcgggtctttagctcagctgggagagcgcctgcatggcatgcaggaggtcgacggttcaagtccgttaagatccatagttgttatataaacggctgtcaatcattgtcatattaaggatttaaatgatagtttcagcttaaaaactgtcatttaattgcaaagaaaatcaaaaaaagaatgtccaaaggaatgtccgacattccttgcttggcaggcagtggccgtaactctttcaaaggagttgcggttatttttatactaacaagacgcacttcataaaaagagcaccaaaaatttttagatttcaagcttctagtccgtcattcacacgctttcagtgtttgtttatttgtttatcagtgattacttgttagatcttaaaatagtcattcggtactagttcacgccaataatcctttaaatcagccaagactttatgatgccccgtgttctgacaacgaacaataaattgtttaaccgcgtttttgcttgtttcagtcttctgaattaagtcaagcgctatctctctgctacccattgccatccaccgcgaaccatcagcttcatcgatatcattgatccagcccagaccctgaataaaatttacgacttcatcagacgactttgttttcactgcacagacaaatgcaagggacatggcaccgtatgcatatgagcgaccaaaaaatcccggttgcttgcttaaaatacgctgaacatgttgaaataacaacgataagtcatcgaatgctaataaaggacaaatatagcgtaggattaagtattcaaataatccccaatgatttgactttagcagttgcttcaaaagtttagaggcgactgtccgttgttcactttcatcaaaatggttaaatccaacctccatggccgcacgttgcaagacaaagagctgtccttgccggatctttgctggaacatctttcatgaatttcatggttcgatttatcacatcttgggcacttgcaacgtccttgccgcgcgctttaagtgacaccatgtcataccaggaaaaccacaatgtgatattgcgattttggccttgcaatgtgacattcatacttccaagtaaagtaggtactaaaacagccatttgtccacttagctgaaccaagccgccaaaagaaagttgtgactcagctttttcaaaacggcgaagtgtcgatttgttgcgacccaagacaatgtcgtctagatgaaggcccaaatagcgtctacggccaagtatcacaccgccagccgtcttacggactacaatcggcataggatcgggatttttcagttcatagttgtgatacggatgtccctgccttgtacgagcaaatatcaacgtaaaatatttagcttggctaatatcacccatcaactgtgtgtcggtaatcatatcatcaatttgtttttcatgagcgacgttttgagaaacgacccattgttctaacaatttggtgaaatgccatacttcttgccactccgtgtatgattctaactcgccgtacttatccatttcttcggtcaaatcagatctaaaagtatcaagaaattcaacatcacgatccatcaaggcaccaagccacaattttgcaagaattgttccacgctcttctttgcgcaaattatgtttcattcgatctgttcgataccaaagtaacatcaatagctcatgacttgcgggtcccatgatggcttcctgtatctcccattcgaacggggtcagattttcgggaatagtcaaccgatccgcgataatttgttctgcttcagcatcaaaatgatactttgcttcaggccaatgaataccagcatcaaaaaggactgaggctaacttggtcatactagttgttttcttattctctaaaaagaactctgcgcgtcgttttgtcaaagcattgatgtcgtttatttgaataagcgtttgtaagtgcatgggaaaagctcccggagcttcaggatacagtaagaaatcttggggctgtattccgatccgacgaattaaccccgtagccttctcattgctaatgtcactaacgccattctcaaaacgcgacaaagtggttgcggaccaatcttcgcctgcagcttcctttaaagttaaatctctccctgttcggaaatccttaaaaaatttacccagtcttttaagttcaaaattttcatccacattcaacaccctttctaaccggtaccccatccaactgacaaacttagcataacaggtatcttccgtgttagcgtgtttttatgaatgatcacgagcttacgaatctaaatttccaatcatgtaatttaaaaagaaccgaatcactttatctcattttaaaagcgacttggttcttttgtgtcatcttcaaaacagtattattgcacacgaccctatctttgcccaatttacttggtcgcacccgaaatttaattgtgcttgctcaaaggataacgaaggctatacgaactttttattaaagtaccatgcacaaacaatgttgtacacaactaaaattgcgaatatgcaacaaagcttcactttaaccaaaataattttaatattcctagtgtagatgttgttatcaataacatctaagtaaatggggtttagattttacatttggaggggcttaaaaatgaataagcataattcgttactcaccaccactgtggcaacagccgccgtattgaccgttgctggcggtgtgacgaccgtacacgccgatgaccaaacgccaaccagcagtgcgacaagcaagacagctcagtccgcggctgatacttcggctaaaacaccggtcgaatctgcgcaacaaggcgtaaaagatgcgcaaggcaatgtcgatgcggcccaaaaagctaaggatgatgcatcaaaaaatgtcgccgacactacggaaaaacaaagcgctgcgcaacaaaaggttgacgcggcccaagcagcaaaggaagcggcccaaagtgtagcagccagttctgctgctgccgccgagtctgctgcaactcagacctccgcagcacaatctgcagctgatgcggcaacaccggaagccaagcagtctgctgcgacagctgtgagtgatgctaaggcggaacaagaagcggcccaatctactgttaatttagcaacgagtcagcaggccaaagatcaagctgctcaatccgctgctagttctgccgcccaatccgccgcaaatgctaccgctcaagaacaatccaaggttaacgtcaccaagcaagccaccagtgatgctgccaaggcccttgatacaacggcggccaagactgcagtcgatcaagcaagcactagccttgccgctgccaaaagtgctttaagcaaggcccaagcagaagccgatcaagcacagactgcccaagcggccactgatcaattggtctctgcagccaagtctagtttggaccatcaagccacaacaacgagtagtgccaaagatgcactcgcacaggcaactgctaagagtactgcagctaaagcaaaagtcgcggaggcacaaaaagctgttacggatgcacaagctgctcttgatgcggcccaagccaagacaaatattgatttagcagcagaaggcattactgtcaccgtctccgacaatgccaaagcgactgccaaggaactggtggcaagcaagtcacgagatggtaactatatacattcacatttagccaccattgctaaaggtattagtatctcgtataaacctacggatgctgactggagtgaagaacttccttacacgaacactggcacagattacaaaggcagaacgatcggtatatcgtcaattaactttgccgccccatcaggcgcctatgattcactcacttctgcgcagaaatcacatatagaagacctctatctcgcaatttttaatcgcatccgaacgcaattaggtatgccgcccattattaatagcaatagcgttaatggcactacaaaggttgctgttataggaccatctgacattgctggtggttccttcctttacagtcgtgccttttatcccacaaaaaagagtgatggtacagttgcttggcttgatgacccgcctacaaacccattaactcagtacaatatggctattttaaaagataatgtgtttaacaatagtgtcttatcaagtttcttaagtaaatcaggtgacacctcagacggtactttggctgcctcaaatctacaacccttacttgggttcaatagagtaggcgaatccagcaaaacgttagccgacactgttacaatcgcccgttctggtcaactccttttcctaactgtcaatgttgcaaccgttaacgatgatgcaaccttcaatacatcaacggatacaaaagcactttcaactgccctaaagaatgctcaaactcaacttgctagctcgcaagcggaccttgcaacggcaaacgccacccaagctgccgcacaatcggcttttgatcaggctaatggtgaacaaacaaaggcgcaagctaactataatgatgccgttcaagatcaaaaagcagccagcgtcaaaaagactagtgctgataataaagtggccgttaacaaagttgctgtgacaaacgcggaaacagcattagcaactgctcaaaagatctacgaagcaagtctgcaagatcaaccagcaaagattgcagcgctcaatgctgccaaaaccgcacaagctgaggcggaaaaacagctgtcactcgcaaagtcagcgcaggctactgctgaagcaagtctcgaagcagctcagaaccagcttaaaaaagatcaagacgcaaccgctgatgcaaaagctaaattagcgaaggcggaacaagccgtaacagacgcaaaagccaaactcgatcaactgaatcatgcacaggatcgtttaatcaaagctaaggaagcacaggccaaagctgacgctggggttgcaaaagccaaagctgctgtcgttgcggcagaaaagaatcttagtgaaaaacaagctgttttagcagatgcaaaggctaaagccgcgacagctaagaataaattggctgaggcaaccgcaagcttaaccgctgcgcaacaacaactcaaaacagctaaatcagttctaaaagctgcccaagatgctgaaactttggctgataatgttactcgtcaacaacatcagcttgaatctaaagcagacgcattaaaacatggctatcatattaatggccaacaagtgcttgatcaaaacggtcatcccgtatccggatggtcagttgtgaatggtcaaatggttgatccatacggtaatatcatcaaaatcgctcaaacacaaacaactccaggcactaagactgccgcaccagtgaccaaaccactagccgccaaggcctcggttaactcaaatggccggcacagtttcccacaaacaggtgaaaatcaagtgataaccgtttggatgatgttgcttggttttgctatgacggcattaagtatgcttggctttgaatctcatcgtaaatatcgtcatcaacgttaagctgaaatgattgtttggctttgattaatttactagtcaacgtcaattatccgctagactaaagaagtcggctcttctccaccaagggcagatcgtggttgcaatgccacggcggatctttgataattttgtcagattaagaaatgaaatgtagatacaaaggtctttctcgcctcccccatttttgatttcgtatcaacaagtatctttaaacgttatattcaaaaagcgttgagcaatcatttcaaaattgcccaacgctttttaatttcttaagcaaatgtcgttttaaccttcatctgcttcacatccgccatcgtctggcagccggtcagctgcatggcgatgttgatttccattttcagatggtcggcaacatccttgacgccttgccagccgccaagtgctaacccataactaaatggtcggccaatgccaacgagatcagcgcctagtgccagcgctttgagtacatgggtgccgcgctgaacaccgccgtcaaagatgatgggaacgcgatgatccacagcggcggcgatggcgggtaactgttcaatggcgcctggtgccccgtcgagttggcggccaccatgattggagacgtaaattcccgcagcacctgctgtaatggcagcaacggcatcggcagggtgttggatgcctttgataataatcggcaagcctgaataactggctaatttactgatcaggccaagatccagcttttgcatggattctttaaacaaaccgcctgcaccaaccccggattgccctgtgttatagccttcgaggttggcaagtcggcctttgagatggtaatgattcatcacgtctttttcacgataaccgcctaatgttgaatctgctgtcaaaatgatggccagtgcaccggcctgtttcgcttcgtctagcaagtattgacaatattcccagtctttaggcatatacaactgaaacatgtatggcgcaccatcgctgaccgctgcggtttccgcgatggttttggaagcaaaggtgctttgggacatcatgataccggcttctttggcgccttttgctaaaccgagttcaccgcttgggtgggccaaagtgttgctggcaatgggagcggttagcagcggtgaagcaagttttgcgcccataaacgttgttgactgatccggattttcaacgccttgtaacacacgtggcagcatgtgcacatcttgaaatgccgttgtattgcggtgcatggtgtagccatcgtcagagccctcactgatgtacccgaattcaccgcgaccaaggactttttcagcgcgcgcttctaaacttgctaaatctaacacatcaattgcattaactttgccgaatggatcagctttcactgcatctaccatgatttgtttcctttcttcttcgcagtcaatgtgactcggttaatctaggtaatcaatcagttgcttgacgtcatagcgctctgtttgcaatggctgttcagcggcttttccgatggcaaccgccataaccggtacaaagcgtttaggatccaggcctagtgttgggatgatcgttttaaagtcatacccggaccatggattggcgtcatatccgtatgctcgggctagaagcaacaattgcatggcaaccatagcgccgtcaatggtcgcatctaaagtcagaaattcaggtgaggcatgttcgtacagtggtaggaaggtgttgaagatttggtccagcttctctttactgattttgcctgcctcgtaaaccttcgtccacacatcgcgatagacctcatgtgattgggtatcgccggcaacgaaaataatggcggaactggtatcaatttgcggatagttgaatttcatggccgcttttttcaacttctctttgccttcagaggtgtcaatgatgacaaaatgccacgactgcaaattgcatgcggacggcgcggttgttgcctcccgaatcatatcttgcagctcatcgcggctgatttttaccgttggatcgaacttgcgaaccgaatgccgatcgaacatcacctttgctaaatcgttattagttaatttgtttggcgctactgtttctgtcattttaaattacctcatttcttaattaatatgttaaccgttttcattcagatagtatagggcttcacaaatggaattatcatacatcattacaaaaaatcgattttaaaaataaaaaagttcattctgattggcgtcaatttttaagaccgccgttatttggatcaccgttgacgctccctcagccgcaaatgagcagcagcagttgtaaaattaccactaagtcaaaaaagttgcttttactgcttaatcagcctacattgacgtcgaaaggggttgatctgatgcaaatccattttgacgaaggcgctgtgaacaagatccaaccgcatttgggttcggacaagaagttgcttttgacgtttgaagatggtgttgggccgtattcgcagcacgcgatgattcatatgcaagttcaattttcacttaatgtcgtcaaggctagtgacccagcaaccgactatgacactgagatcagcagtaatcttgggccaattttgatcaagggttattcgcaggaagacttaaatgccaatatgcatgtccatttcaactcgaccttaaatactttggttttaagtggtgatggtggcgacattgataccaacatgggcttcattgatttcacacaagccaatggtgtccgcaataatccggcccgttaaaagctaaaacgggtaacttgactattctgacgatccccaaccaaagcttcacactgctgcttcacccttaatttttccaccatgaaaatagccgcctccaagcctatgagtttggagaacggctatttttcgtatttaatttttaaatgccacgcggtttgtttggcaaggtcaccacaaaagcggcaccatgcggatgaacatcttttacttcgatatggccatgatggatggtcacaatccagcgggcaatggctagtcccagaccgctgccaccggtttttcggctacgggatgcatcttcgcgatagaaacgctcaaagatacgtgatttatccgcgtcagcaatgcttggtccggagttgcctactaccagttgccactcttttgaggtttgggtgaccttcacccagatggaatcgcctgcctgggtatatttaaatgcattgtccagtaagataaccagtaactgtttaatccgtgcagcgtcaaaccaggcatggctttttggcggaatcgtggtggtaaacgatttatcctgactaatcgcaatgtcgtgataagaagccagttgcggggccagtgtttgatcaaaccgcagatcggtcaattcgatttcaatcgtgttgctatcggccttggcaattgtcagtaaatcatccgtgagttgccgcaaacgcttggtctcgcccagtgacgttgcgatggcctcgctttcgtcaataatggtggcttgcggcttggttagcaaggcttcctgtttactttgaatcacagccagtggtgctcgtagttcatgcgctgcgtctgccacaaaatcttgctgccgctgccatgaccgaacaatcgggcgcattgaacgggttgataaccaatatgacaagcccagtgccaacgcccaaaataggataatcgtcaaaatcagaacctgacgaaaagaacgaatggcagcttcttgagcgtccgtattttgcaagatcaacacataatgcccggcatattgaggatctgcggccgtcaccggaaccttcaccagtaaagttctaaaggtgccatttgaagtcggcaaattttgcaacttattaactgcctgacgatctagttttaacgttttgaaataggcataaaaccgttcacctaacatcgcctgattgatgatttttccttttttattaaaaaccaccatgttcatccgaaaaggtactggtcgtgaagtcaccgggcgtccgggaccacctgcaccgctcatggtttgtgccggcttggtaagcattattttttgttgttccagcgaatgatcgatatcttgataaatcgaacgttcataaaggaaaaaaacaatgacccccagcactagaaaaagtccggcaaagctcagtagttgaccgataaataaacgtcgctgttgtcgcttaatgcctttatctgcattcatgcacggtcctccggttcctgaaagatgtaaccgacattgcgaattgttttgatccatacgtcggcttgcatcggttttaactttttgcgcaggttcgacatataaacttcgacgacactgacggccgtatccgaatcaaatccccacaaccgatcaaaaatctgatccttcgtaataatggttttttgattctgtaataagtacactaacaagtcgaattcttttccatttaacgctactggtttgtcgtgaattaagacttcatgccggtttaggtggacttcaaacgggccggctgttaacccatcctcatcaaaaaaatgtcctgtccgctttaacaatgcttttaaccgcataatgagctcttcacggtggaatggcttggtaaggtaatcgtcaccacccaactcaaaaccacgcaccttatctgtcagagcatctttagccgtcaaaataagaaccggggtcttcacttgcttagctcgcagctgcttaagcaaatcaaacccattcagctctggcagcataatatccagcacaatggcatcaaaaatcccctcttctgccaaatacaaaccatcagcacccgtcaaagcagcttcaggctgagaaaagtcccgaacaaaatcaacaatactctcattcagatcaggatcgtcttcaattaccagaattttaggtttaactatcataaattctcctctaaaagtgagcgtgagcgtgagccggcgcggttagaaaccggagtgtaagcggcctcaggcgtgatggcccgctcttggccattgcgactgaggtccttacacgcagacttctgcgccggcgaacgcgttatggtgagctgagcgtgagcaggaacgtttagcaatcggagtgtaagtggccttgggcgtaatggccgggctttgaccattgcgatcaaggtccttacacgtaggcccctgcgactgcgaacgcgttatggtgagcgtgagccggcgcggttagaagccggagtgtaagcggcctcaggcgtgatggcccgctcttggccattgcgactgaggtccttacacgcaggtttctgcgccggggagcgcgttatggtgagctgagcgtgagcaggagcgtttagcaatcggagtgtaagtggccttgggcgtaatggccgggctttggccattgcgaccaaggtccttacacgcagattgctgcgactgcgaacgcgttatggtgagcgtgagccggcgcggttaggggcctaaccaccaaccaccatccccaccaaagccaatgtttcagtcttatcaattacagcgtcagcttaacatgaaaatcataaactcagcttaagaaaaaaattgctggctttaaggttaatttatgctgcatctcgcatactaatcccattcatcaagaagggagcgattcgatgcgccaaaagctgaaacaattcattggcttcggtttagtcggtggtatcaatactattttgacatacttgctttacctgacattataccaattgatcaatccaaccgctgcgatgggtgtcggctatggattaacgtcagttttaggacttttcctcaatgatacctgggtctttaaggttaaagatcaccgcgaccttaaaagtgtggcaccacgatactatttttcgtatggtctcacctttatcatgagcctgatactcacaagcttctggaatgatgcattgaatttaccaaaaccattagcaccgatgtttgcacttatgattaccgtcccaacgaacttccttttaagtaagttctgggtatttcgagaaaagggagttacggcacatgaaaaaaattaaacagtggacccttgattggtggctcattggcattctcgttctggctgcgtttctttacagctggaatatctgggaagcaggaaacgctaatgattattacacggctgctatcaccagtatgatccaaagttggcacaatttctggtacggcgcatttgatcccgctggctttatcaccgttgacaaaccaccggtagcgctttggttcatggccatttccgccaaaattttcggcgttcacggctggtcagttgttttaccctcaattttgtttggcatcggcagcgtggcgctaatctataacatgatcaaaccccgctttaatgtttgggccgcccgcttagctgcattggcactcaccttaacgcccatcgttgtcgcggattcccgaacaaataacatggacgccacactacagttctttctgctgctcgccagctggtgcctgatgaaagcaatcaccaaccgtaagccctggctggttgtcatgagttttgctttgatcggggtctcgttcaacattaaaatgctccaagcgttcatgattttgccagccttattactctttttctggcttgcatcaaagcagcagttatggcgccgattggctacactggggattgcattagctgcgatggctgtcatgacacttgcctggccactacaggtggactcaaccgccgccagccagcggccctatgtcggcagttcccaaacgaattcagaaatggagctggcttttggctataacggtactgaacgattattgggccaaacaaccggtaccggtgcggccttccccggtatgggcaacagcaagaccaaagcgactggtgaaatgaacccgacatctggggcgaccaaaggcaataatagcaaaaccggcacggcaccgactggcactaaaggaaatccaccaaccggcacaaagggcacaaccggtacgccacctggcggaaatggtggtggtcgcccaggtaatggtcaaggtcagggcggcacgccgccagctggaaccaacggcaaacaacctactgtgaaaaccaaatccggcacatctacaaacaacgcacctgcaaactttgcagagggcaactttaaaggcggccgtggtactggtggtggtgcagctggcggtcgcggcggtggtgccttttcaattgggaatgccgggccactgcgcctgctgcaatctgatcttggtccacaaataagctggcttgcaccgatggctatcattggctttatcagtgcctttgcttattatcttgatcgaaagcgcaaatggtaccaaaccacaagtcagcaaaatcacttgcttttctggcttggttggcttgtgccagtcgccggcttcttttcaatcgccagctttttccatccttattacacgattatgcttgcgccaccactcgcggcattattcggtatcggcacagtcaccatgtttaaccagttcaaattaagcttcaagcactggcagagttggctgctcccgcttgcacttgccgcaacgactgcacttcagacttggtatgtcagtctttactatcagtggcaaccgattcttgtggtcattgccggtgtaatcggtttggcactgctcttcatcgcccgaaccaaaacctggcggaaatcggcgctgggcgtggcgattgccgctatcttagccgcaccgggtttctggtcgttgacaccgacacttgccggctcgtcatcgggcattccaaccgctggccctactttgctaacgtcaggcggtaatagcggtggtatcggtagtggcagtgtcaatagcggtttattgaagtacgttgaagctcatcaaggcaatgccaaatacctttttgctaccagtaacgctagcactgctgccccgtatattatcaaatccggtaaagcggttatggcaatcggtggatttaacggcactgacccggcaattactttgaagcaattcaaagcactggtcaaaagtggcgacatgaaatattacctgtcatcgggtcgcgccggcaattcaaagattgaagcgtgggtcgaaaaagtcggcaaaaaagtggccgcaagcaaatacggcagcaagacaaccaccaacgcccaaaataatcatggtggtcgtatggcaatgggcggcatgggcagcggcacgctgtatgaacttgatgccagcatggtgaagtaattttcattaattcagaaaggagcaagcgtgatgcgacaaaaaacaaatcccttcatttccgttgtcttacccgtttacaacgaaagcgcaggcattggcgaaacgttaaccgaacttgccaattatgtccgggcgcgaccagaacggtatgaacttatcttcgtcaatgatggctcaaccgatgacagtgccacccagattaaagccgcgatggctaaaaacccaaccattcgcctcgtagacttctcgcgcaactttgggcaccaacttgccattaccgcgggcattcgttacgcaagcggtgatgccgttgtcgtcatggacgctgatttacaagatccgccaagcgtcatcccagccatgatcgcccgctggcaagaaggctatgatgttgtctatggcaaacgacgcaaacgcagcggcgagacttggttcaagaaggtaactgccgaaactttttatcgcgtgctaaaggcgctcacaagtgttgacatccccgtcgatacaggtgattttcgcttaatggatcgcagcgtcgtgaacgttttgaaacaaatgaatgaacatgatccgtacgtgcgcggcatggtggcctgggttgggtataggcaaattgccgtagaatatgatcggcaaaaacgaaccgccggagaaacccattatccattaaagaaaatgctacaccttgccatgaacggcattaccagcttctccaccgttcctttaacaattgccaactggcttagcggcttctttctactactggccgtggctattgtcggcatcagtttctttttaggtcatctcagcttattaacttgggtgatcgcgacaacgttacttgttggtgccggcatcaccttcagcatcggtctacttggcaactacatcggccgaatgtttgcccaaagccgacaccgaccgctttacattgtggctgacacttatggctttaaaacgcaaacgacccaacaacaaaattaccgctaccacgccttgcaaaattaacggtaactaagatttgatatctgtaccaaaatggactgctaataacacaaagcagtccattttttgtgagcgcgaacaggagcgcctagcaatcggagtataagtggcctctagcctaaatggccggtctttgccatttaggctagaggtccttatacgcagattgctgcgactgtgagcgcgttatagaacgcaatgttattcccctaaatgcctagaatagaaagcttttccgccctcccgtctaccttcttaaaatcaaccactctttaaacgtgataatcgcactttgaccattgcgccaagggtccttacacgcagatttctgcgccggaaaacgcgttatggtgaggtcgaacaactacgcacttcagcacaagattttacagccaccgcatcattatgttacggttattaaaagtaagtacaaagacaactcgaccccagaaaggattgagcatatgccaacaccaacgaccaaagacctgacgcttttgacgccgagcgatttggccgctgattttgacaccgacctcacaaccggtttaacaacaaacgcagctgccaaacgccgccaagaagatggccccaaccaactgactgctgccaaaaagcccagtttatggcggcaaatcgggcaccaccttagcgacattacctcgttaattttactatttgccgttgccctatctgcttatctagccctgacgactgacagtgactggaccaaaacaattgtaatcggcagcattgtgatccttaacgtcgccattgccttataccaagaacacagtgccgaaaaagcattggcagctttaaaagccatgacggttcaaacagtcaccgttgttcgtgaaggtaagacccaaaccattgccgcagcagatttagtccgcggtgatttgatgctcctcaaagcaggtgatgcagtagcggcagatgcgcgactaattcacagtcaggatctcgaaaccgatgaagcagttttgacaggagaaagttccgccgttgccaaatctgccgcgccactgactgaagtgccggatgatcttggtgatgccgtcaatcgccttttttccggtacggcaattaccagtggaaaagccagcgctattgtcaccgccacaggtatgaagaccgagttgggaaaaattgcatcattattgaatcaaacgcaaaaacaagcgacaccattagccaaacgcctaaacgcactgggcaaacgtctatcgttagtggccatcttaggcggtgcgctgacgatgttgttgtccatgctttaccaccaagaaaccttaaccgaaagtctcatgctcggtgtgagtcttgccattgcggcggttccggaaacattgccggtcatcgtcacgctcagcttggcgcacggcgtccagaaaatggccaaacgccacgccattattcgacaagtgaccgcggttgaaaccatcgggaacatcaacgttatagcttccgacaaaaccggcacattgacgcaaaaccaaatgaccgtgacccatttttggccgtttggtgaaacactccaaaaagttaccgatcaacccttatcaacgaatcagcagcaatttttgacttatctgggactggcaaccaacgcccggctcaccaaacaaggcgaaccggatatcggtgatgccaccgagctggcaattgttcggctgctggcccactacgacttaaaccgggatgatcttgaaacctgctatccacgaattgccgagtcaccattttcatccgataaaaagaccatggcgaccttgcacaaaactcccgatggccattttctggctatcatcaagggcgctgctgatcggattgccttttccaatgatcattggcacgaggaagctacagcgattcatgatcagatgactgcgcaggcattgcgagtcttggcagcaggttaccagcaattcgaaaacgaccccggtgccaactgggagacccaattaaccgccgtgcaacctttaggactgattggcttaattgatccaccgcgtccagaagtaccggctgcgattcaagccgcaaaagatgcaggcattattaccgtgatgatcaccggcgaccatcttgacactgccactgccatcgcaaaagacatcggcatcctcgaccacggtcaacgcgccatcaccgggcacgatctgagtcaaatgagtgatgaagcattggccgctgatattcagcaaattcgcgttttcgcccgaaccactccgaccgataaaatcagaatcgtcaaagcatggcagcagcaacaagccgttgtggccatgaccggcgatggcgtaaacgatgcccccgcgctaaaagccgccgatgttggcattgcaatgggcatcaccggaacggacgtggccaaaaacgccgccgatatggtgctcaccgatgacaactttgcgacaattatcgatgcggtggcacaaggacgaactgtttatcaaaatatcctcaaggccgttgaatttctgatttccgtcaatttcgcgcagattttcaccatgctgatcgcggttctgatcggctggggggcaattatgacgccggaacagctattaatcgtcaacgtgctcgctgacggtattcccggcttcttcttgagccgtgaactagccgaacctggcatcatgcggcttaaaccgattcctaaaaaagccagcatttttaccagtggacttggaaaaagagtagcggtgcggacaacgacttacgttggcctaatcctcggcgtttacgcactcggtcgctttggcttgagcgccaatcaaccaattgtcggcatgaccatgctctttttgacgctggcgattggctcaatgttggatattttcccgatcaaaacccgtggacgacttaatcgcgctgccttcacggtcaatccgatattaaccggcagcttacttggtaccattaccttgatcttgttgttagccactgtggccccgcttcaacaggtctttcggctggcaccgttaaatctcggacaatggctcattgttttggcggtcatctggttgccgatgctggttgtggaaggttacaaacgccgccagcatcgcaatgaattagccgcatggcaaccatcggaattgattggcgatgcggaataacggttgttttgtatttattgatgaatctgctatgctttagttaatatttgagcaagctatggtgcgtgccccgtttgtcagattaggagtcgaattgcgctataacgcgttcacctgctcatgctcactaggaggtcataaagtgcaaccgtttcaggcattgctccacgacggccaacaagctaccttacaaactatgacgacagatgacttacctgccggcgaacttttgatcaaggttgcttattcagacgttaattacaaagatgcattggcctatcaaccacaaaaccaagttgtgcggcaatttccgcagatcctaggcatcgacttaagtggaaccgttgtcgctagtcacgacgcgcagtttaaaaaaggcgatcaaattattgtgaccggtcatggcttaggcgtcagtcaaggtggcggttacgctgaatatgcccgcgttccggcacaatgggcgctaccattacctaaaaatctcacactggaaactgcgatggcgtttggaacagccggtttgacggcagcgttgtgtgtcacagcgttgatgcatgccggaatgacacctgaacgacagccgttgattttggttggtggtgcaactggcggggttggcagtattgccttgcgattattggcaaatgccggcttttcaaaccgcgtggcccttgtccgcacgcctgatcagcaacaacaggttcgcgcgctcggagcaaccgccacactagcccttgacgagttaccaaaaggcaaggcattggcacgtcaacaatttgactttgccatcgatccgcttggtggtagtttcaccaccagcctgttaccgagtatgcgttacggtggagcggttgcgctatgtggcaatgctgcaggcgcttccctaccgctcacggtatttccgttcattttgcgcaacatcagcttgatcgggattgattctgtgagtgcgccaacagccttacgtcaagctgcttggaccgcgttagccaagctagccccagtgccttatcaaacggtcaatctctctgacttgccgcacgttttgaacaaacactttacccatcacgcactgcggacggttgtgaaaatcagctagattgcaagtaaatcgattttataggcaaaaagataaccggcatgcgctcatttaatcatgatcgcatgccggttatttaagttttcaaaactagctcagcaagaccgcatcatcggcaaattcctgcccgctgcgttctttaaacagtgttaacaaatcttcaactgtcaaatgtcgcttttcctcgccgcgtacatcaacagcgatctccccgtgatccaacatgattaagcggtcaccgtatttcaacgcgcttgccatgttgtgcgtaatcatcaaagtggtaatctgttgagcgcgcaccatttgatctgtcaaggccataacagtcgcactcgtttgaggatcaagcgccgccgtatgttcatccagcagcaacaacgccggcttcttcaaggttgccattaacaaagtcactgcctggcgttggcctcctgaaagcaagcccatttctgcgccaagacgtttctctagtcctaaacccaatgtcgccagtttctcctgaaaatgctgccgatcacgacgcttgacgccgcctgcccagaagttacgccattcgccacgcttttctgctaaggcaaggttttgttcaatcgtcaataaagaggcagtgccagaacgcgggtcttggaaaacccgcgcaatgagcttggcccgtttcgcaacattttggtaagtgacatctttgccattgatcaggatttggccttgattaaccggcaatgttccggcgatgctgtttaacaaggttgatttacctgcaccattaccaccaataatagcgacaaattcaccacgttccaggctcaaatcaattccttttaacgcgtgattctcattgacggtaccttgctcaaaatattggtgcaacccgcgtacgtccagaactgccatgttaatgaacctccttttgttgctctgccggtgcaatcgtcatatgatccgatgttttggcaaccatgcgttggtcagacttgacctgttgccgattgctgtgtcgtacttttacttggaagagtttctttttcaacaacggcagtgataagaaaattgtcaacatgagtgcgtagaagaagcgcaagtagttcggatccacgcccatatccaagaccaccgcaataatgagccggtaaatcacggcacccacaatgatcattagcaaacgcgcccacaacggcaccccgcgcaccaggatttcggaaatgatgatagcggccaaggcaattacaattgtgccaatacccatggacagatctgcatagccattagtctgtgccatgagactgccagacaatgcaatcaaaccattgctcaacatgtaaataatgatcttcatcgcatcattattaatcccgttagcagccgccatattctgattgttaccaactgcggctgcagccaatcccatttcggtatggaagaagaaaaccagagctccgatgacaattgccaccacaatagcgcccacgatgatgccagtcgttgtcgcatccccgctatctgtcaaattgaacacagtcttgaccgcgccaatcaagctgacattggcttttcccatgatgaaaagattgacggaatataaaccggtcatggtcaaaataccagtgagcagatccggaatgtgcaatttggtcgtcagaaaacccgacaccgcacctgcagcagccccgccggcaaaacccagcaacgttgctgcaatcgggccaactcctgatacaattgcctgagcagttattgccgcgcctagtggaaagctaccttctgccgtcatatcggcaatgtctaaaatacgaaatgtcagatacacgccaatggccatgaccgaccacaataatccttgggcaatacttgatgtcacaatatccataacgaaacccctttttaaaaatgctcgcttattctgcttgtttcaacatcgcttcagtcagcccaaattgctgcatccgtttgggattggtgactaaccgggttttggcaggtgtttcaactgccaaatctttgacctgtttacccttcaaaagcttaactgccaacttaccggtttgtttgccgaggtcctcgtaattgatgccgaccgttgcaactccggctaacttaaccatcgtggcatcggctggcacaaccggaactttttccttggtgctgaccttaccaatggtggccatagatgcggccatcgtgttgtcggttggaatgtagatgacatcactttgcttcatcaaggccgtggcactttgttcaacatcattggtcgttgccgcggtcttctcaactgacgtcaaccctaacttcttaattgctgccttggcaagcttaacttgaacctgggaattttcttcagcggcattgaagagcaaccctattttcttggctttagggaaaactttgtgaataaagctgatttgccctgcaacatcgactttatccgttacccccgttgcatttttgtctggcttagaagggttacttaccagcccggccgccttaggatccgtcaccgctgtaaacagcattggcgttgtagcatcttccttatgcaaagcctgagctgccggagtggcaatcgctaggttaacatcgttcttatcccgcttcaggcgttgactcatcgtctgcagattcgactgatcgccttgggcattcacataatcaagtttgatcttcttacccttgtaaccggctttagcaagctcttcggtaaaaccttttcgtgctgcggttaaggcttgctgatcaatcaattgcaaaaccccaaccttcacctgactcttatcagccgcagcactcgtggatttaccacaaccagccaaagccacaaccgtcaacgccgctgctacaacggcagccatttttttaatcatcattttcttcctcctaaaataaagtgagcgtgaaccagcgcggttagaagtcggagtgtaagcggccttaatcgtgatggcccgctcttggccattgcgaccaaggtgcttacacgcaggtttctggccctgtgaacgcgttatggtgagcgcgagtcaccttctactcacactggcactcgcactacagaactcactcgccaaaaaaggccagccactggattttctcatccatgtgactggccttttacttttttcccgggaaagaaaaagccacatggatgaattcgtccatgtggcggttaattgcaagtgaaatactcacggccatcatggatacaaacctgattggcttgtatccatgagatacaaaccattatccgaaatagccgtaatagtacgcgtgaataagttgtgttgtttttctttgtctcatgatcaacactcctttgctcagaagttaacccttctggcttgtttcaaagcgtatactcataatctcagtttgtcaacacaagttttcgccggtaggttggctaatcggatttcagaatatcgaaaaatgtcaaagaatgttgatatcatggctattttggcaggtgcaccgtttgcttaatatttttcagcattgtttcattttttacggtttcaactttggccggtttttcaacgcttagttttttgactgctgttcccttaagcagtttgatcgccatcttcgcagtttgtttgccaagatcacggtaatcgatgcccttggtgatggtgcctccatctttaaccatggttgatgcggctgggacgaccggaatctggtgagctttggcaactttaccgatcgtcggcattgcagcagccatcacgttatcggccggtagatacaaggcgtcgacatccttggctaaactttcggctgcctgctgcacatcattggtggttgctgcggttcgaatctgatagcgcaaccccaactgtttgagccgtgccttagcatgtttgatttgataaaccgaattgggttcgctggcgttgtacattaacccaatcgttttagcttgcgggaaagtctgatgcagcaaattaatctgatctgccaccgcgactaaatctgtaaccccggtcgcattcttgtcaggcttttctaaattcgtcaccagtcctgcagatttaggatcagtaatcgccgtgaaaagcaacggtgtcttcttatcggctttttgcaaggcttgagcagctggtgtggcaatggccaaattaacatcattcttatcgcgcgccagccggtcactcatggttttgagattagcttgatcgccttgtgcgttcacataatcaagtttgatccgcttgccactgtagccagccttggcaagttctgattcaaaccctttacgcgcttcggtcaaagcagtttggtccattaactgtaaaataccgactttaaccgttcgactgctggcggcacttgatttcttgccgcagccaattaaggttaatccaatcaagacagttgctgccaacgtgagtacgagatgctttttcattaaaattcctcccaatttgcgcgatccagcgccgttagacaattagatcacatattcgtccaagttattttttaattaacaaaagccaaaaccgagtaccttttttggttgctttttaggtgaacgcgtctgattaaccggtattatcagacgggttagcccctccgcacgcttgatcataacgcgctcgctggcgcaaggatctgcgatctgcgtgtaaggaccttggacgcaatggtcaaagcccccggccatcacgtccaaggccacttacactccggctcctaaccgcgccggttcacgcttgatcataacgcgctcgctggcgcaaggatctgcgtgtaaggaccttggacgcaatggccaaagcccggccatcacgtccaaggccgcttacactccgatccttaaccgcgccagctcacgctcacaaaaaatgggccagccgttggattttatccatgcgactggcccgagttttcggtatcgaaaagccgcatggatgattgttcatccacacggctttgttggcacattcaatgtgacagcctcatggatgcaaaccgttgcttgcgcggtttgcatccgagtgcaaaccgctatccaaaaaagctgccaaaaaagttattcagttgtgtttgccgataattcatcacggtgaacactccctcggttttgtatgggattaagcatactggaaagcatttgtccgcgtcaaggaaaaattctaattattttacaatacacttgttatccaaaaatcatcttgagatattgatggttggctgcagcgactaaccgatcaaccatgcttaactttaaaatgccacttgcttgctgggccagtcgaattaatggtgtatctagcacaattgcttgctgaaacttagcttccgggccttctttgtcaagatagtcttttgttcgcattcggaccgtgatccgagttaccgtacggacaatccatgagtgtttttgcatttcacgcggtgtattgagtcgcgtgaattctcccgggacaaactcatgatgcggtggcaccttttgaccggttaactgttcaaaatcatggacagtcggtttgcctgatagtgtggtataccaatcaggaatatttttgaaattggtgacgttggtgccgtttaagtgaacaggcaacgttgccacaatatcagcagcgcttgtgccaattgctaccgacttggcagcggcaggaagcacccaggtctgggtcttttcctgccattctttaaatgcttgcgcgggtaattccaactgaactgcgactgtttcaccagctttaataaagactttcttgaatgcctttagcgctttttccggccgtaatggacgcggctgctgttctttgacgtaagcctgaatcacttctgccccgtccatatcccctgtattggtcacatctaattgaaccgtcaccggctgtgcatcggttacttcgtcattgacaagccgtacatgcttgatcgcaaaagtggtgtaactaagaccaaaaccaaacggaaacgccaccggtacttttgccttatcgaagtaacgatacccgatataggaactttctacataaggaaccgcgcgcgtgtgtttgtcataaatctcagctgacacaacgtcttgatagcgcttaggataggtttcggctaacttgccactggggttgacttgaccagtcagtacccgtgcggttgccgttccaatatgctccccgcctaaatataaattcaagatcgcctgtacctgatctaaccatggcatctcaaccggtgctccggcgaccaataaaacaatgacatgcggattaatcgctgcaatggcctgaagcaagtcgttttgtacttttggcagggccatgttcttccggtcaaacccttctgattcatagttatcgggtaacccggcaacaaaaataaccttgtcgtgcgtccgcgctaattccaacgcttgggcagttttctcttgatcaacttcatcatcaagtcgatacccggctgcgaaatcataagtgagcccggcctgtttgattccggtcaaaatcgacacttgttcagctgcttgaatatgggaagaacctgcaccttgaaagcgggtttccttggccatctcaccaacaaccgctaatgattcactggtcttcaatggcaaaatgtggtcatcattttttagtaacacaatggcattttccgcaattttctgcgctaactgagcattttggtgtaataaggcttcacgcgtaccatggaagctaggccgatgtttacgcgccattttgataatattagctgctgcacgatccaaactggccgactgcaattcaccggactgcaacgccttcaatgcctcatcgtcaaataaatgatcatcacctggcatttctaaatccgttccggcattaagcgcagccactttgtcgttcaacgcgccccaatcggtgatgaccgcaccatcaaacccaaattgatcgcgcaacacgtttgtcattaaatagcgattgtcactcgtataagtaccgtttactttgttataagagcacatgacggattctggatggccttcagtaacggcaatgcggaaagcctccaaataaatttcatgaagtgccaccggatcaatcatcgaatcggacgacaagcgaccattttcctgattatttgcagcaaaatgtttgagacaggcagcgattccttgcttctgcatgccttgaatccaggccgcaccaagcttaccggccaagtatggatcctcgctaaaatattcgaagttccgcccgcataacggattgcgtttcatgtttaccccagggcccaacacgacatcaactcccagactctgagcctcaagcccaatcgctgcccccattgcggcaatcaattccggatcccaagtagccgcactggcactcgcggttggaaaacttgtgcttgggacactgtcattaatccctaaatggtcagcagcagcggcttggtaacgtaagccgtggggtccatcactcattcggatactcggaatcttatgatcaggaagtgcttcggaggcccagaagtccttaccagaagtcagtttcattttctcttcagtggtcagttgatcaacattgatgtttgatgctgagttgtccatcaaattaccccattttcaaatttctattagaaccatttccacccttaatataacgtttttttgtggcgatttcctgttaacggctctaattttgtagaaaagaaatgattaatcctttaatctgacagtgtttatcattttgattgattattattgcaagaaactgacatctcacagcttctttttaataactagtcattcggccgaaaaagtgcgctgatgacgaaaaaaacgtccgttctaaaattttatgccagaacgtcataaaaagttcacatttagcgattattctgttaactgtagcaaggaagtttacccccttcttactactaccccaacccaacttttttcatttccccagtttacaattcaagtgcaacaccctgacgactagaccataaaggccatgaagacctattcttgttagtgctatagcactaacaagaataggtcttcatggcctttatggtctagtcgtcagggtgttgcacttgaattgtaaactggggggataaatacgcgcttcttagcaaggttaatcatgcgttttcttcggcactagcagcttatctacaacgcagaattcatcagacaaacattgcggatacgttagtcttgatcgccaaatatttatccaccaacgccaaacctattagtgacttactacgtgtacacacacccgaaagtgatctaagtgcatcatttcagaagattttccatgcgaaattcgctcgctatatcgactatgagctttccaaaggcgctgtgacggcttttccagttgcttacttgattgaactatatgtggcaatcgcgatggttttcttaagttactctttaaaaaaggggctggacgttgctgttgttcagtcactaaacgattttcaaaagcaaattttcactgaaaaaagtgaaaattaggctaacagcggtggttatctcgatttggttaaccatttattgattggtcagcctacggaattttgggagtttgtacgacattcacgttgagctttccatgataagtgttccaaaaatgccaaaaaacaacgttaatcggcaaaaaccatacgtttattttttaaccgcatgctattgagtctttcaggttatattggagaaaacaaacttggaaggcggtatgtgagtcatgacagaaaaagagcgtttccggaaatttgttcgcaatggatttcgaaaagatgaagaattgggtatcccctatcatctctattgcctagcccatgcagttttgatagcagtcccgcttggattcattgtatccgcggtgttttatgcaatggatttgcgggacttatatggtactgtgtacgcttttaatatgggcgttattgtgtttttgatgtttgagctggacatcgattggcgcattgagaagaatgaatttttgcctgagcgagtctccaagttgcaatgggtcattcgtattttggcgagtgtgctcgtttccggactcttcttttattttcatgaaacaacagttatccagcaatttgtgaagtaagaccgagcaacacattgccttttgcatgttatgagttgacttgttccaaaatagggcaatcggtgcccgcctgttttcagggacgaaaaaaacacctgtcgcattgatgaaacgacaggtgtttttattgctgctggcgataaggaccatcagttttatttgcaaatgttatagctgacaaaatgcactggttcacgcgcgagaatgcattcctgagcgattgggcttagctgcttgtttaggcgtggttggggcaggtgtttttggtgaaggatcagcatgcggtccgggaccctcaggatgattgttttgcttcatttgtctgtcagtcatactgatcacactggacataaccagcgggagtaggaagacgagcaggatgagaccaatgatgacagccagcgcaacctgaatcaaagtggtaatgccagatggaatcatcgctgcgaacgtaccgcttaggatgatcgctgccgagatgacgactgcgccaatgacactggcggctttggtgatgcgttgtgtcatcgtgccaccttccaaggcattgtcacggtagcgaaccatgaggaagatactgtaatctacccctaacgcgacaagcatgatgaaggtgaagaatggtgtgttccaggttagcatatcccggccaagcacataggttgagaatagcttagtcagacccagtgaggtgacatacgccatgagtaacgttgaaatgatgctgataggttgaattaacgaacgcgtcacgacgatcagcgcaatgccgatgccgatgatcatgatggcggcggttcgttcaaagtcaccatttgccaggtcttgaagatccgctgtttgtgaagtttgaccaccaatggcaatggtggcgtcatcaagcggtgtatgcttcagtttggccgtcagatcggttttgatcgctctgatttgttgggcggcagcatcggtacttggatcgccttttaacacaaccgttaatttggtgattttattgccgtctgacatgtaagtcgataaggctggcttaaaggttttacttttcaaagtttcattggggatgtagaacttcttccccaaataggaatgctgcagttcggtcagatattgtttcatactggtactgccgtctgcaatcgtgccgagggcttgatcggcggaagtaaggccactttgcatggcggttacttgttgcgagatggctttgactttcgtattcagcgtttggacgccggtgttgacttgatcagcaccactggcaatttgcgcggcgccattcgtgagggtaccgttttgtgcggcgagcttagcggatccggaactgagctggttgaccccggaaaccaaggatggtacctggctgttcaatgagttaatcccactgtttagttgttgagtgccgttcgtgagggtgccaataccgctgtttagcgcagttgtacccgcgtttagctgtttgagcccgttacccatcgcagcagtgccgtcatttagtttttgaacatcggtagagaattgattgatttcatttaaaatcggctgggttaaccgatcggcgctggttagaccattgattttagcgatgatatctttggcaatccctgctacgccttgaagctgatcattgagagttgccataccagtggttaattcaccggatttgctgctaagttgactcatgccgttagcaagcaccgtgctattgctatttaaggtgttcatgcctttagctagttgcgtcgaaccggtgctcaaggtgttgacacctgagctgagagccggcatttgatcattcaattggccaaggccgctgtttagggatgttacccctgacgtgtactggcttatcccgctgttgagactggaagcaccggaagaaagcgttgtggtaccgtttgccagtgtctgaacctgttgggtacttccggcaacattggcatttttgatttgggtattggcatcgttgagaccagcctggacttgcttcaagcctttaacactttgagttaagccggcagtgatggttttcagctgatcgtttagatacaacgatttaatctgactaccgccgggctgggttactgaagcaacggttttgacgcctttttctttttgtaggtagttggtcaggtcgtcaatggtgcccaaggtggtttgggtgttcagcgcctgcttgctttgaatatagatggttgtcggtgaagccatgccttttgaataatgatcctgaatcaagcggtagccgactttggattggagggtttccggtaattcatcggcgttgttaaagttcagcgtctggttgacgttcaacagaaacggaatggcgataatgccgatgacgcccagcgtgatgagcggccgcgcgatggcaagcttggaaaggccatgccaaagtctgcttgtgctgtggccgttgaggttcttacttggccagaatagcttttcacccatggttgccatgaagaacatgtttaaggttagcaaaacggtcaaaagaatgagcacgccgatcgcaaccccaactgcggaccggtagaacttgaagttggcaaggccgagcacggagaacccgatcagaaccgacagcccggaatatagaatcgttcgaccaccaaaacgacgggcgattcttgctgctttggtcttgggaatgccttgcgacagtgctgctttgaagtcatcgtatagaagaatattgtaatctgtcccaatcccgaacaaaaccacaaccagaaagacttgggtgaaattggagatcgggaagttaaccttgtctgccaaggtcatgatgatgttcagtgatgttaagaaagaaatcgccacggttagtaatgacactaacggaacaattggcgaacggaaaacgataattaacacaatgaaaatgaagatagccgcgataatctcggttttttgaatgcctttttcggtcacgctcgcaaaatcatcattaaggacatcgctgccagtcacgtaggttttcacatggctggttttgatttgtcgttcgagatcgcgcgtctgcggaccaacctgacctttcgctttaacgtcaaccaatgccatttgggtcgtgccatccttggcatcaagctgctttttggtttcggcattatcggatgacttagtgacgttgatgattttaacggctttggagtccttgagtttggctaaagtttgattgatcgcgcgtttttgcgttgtcgaaagcttgtcgtcgccgttactgaagacaagggcaaatgagcgcaccttttgattatggttggcttttttctcaattgtcgcggcaatttggctttcttcgcttttgggtagcgataaggcgcctttatcacgaacaatgccggatacgtcgggcatggttaaaagtgccaccaaaatcacgacaagccagaagataagtgaggggatatggcggtcgtgaagctttttcaattaaacacccttctttcacttgtgaggccattccagacttgatttttcaagtccgcggctaatggtttctgattcgagacatgaccttcaagttgctgttgggcccagacgatgtcgatcatgctgacaatgctgccgtacaaaattgccagctgcgtccgaacgtcggctttgacaatcacgccgcgctcctggccttccagcaacatgttattgatgagtataatcacccggccacgcgcagcacgactctcagcgttaagtgcctcgttgaaaacattttgttgaataaaatgcaattctgtcggatattgctccatggacgcggtcgccgcatcgaataagcgactgaaagtggtctccggatcatccggttggcagtttgccgcggttgccagggagtcgtggaagaagttcataatatcggtaaaggcggtattaaggatatcttctttgcttttaaaatgccgataaatagtgcctaccgcgacttttgctgctttggcaatcgacggcagattcgtttcggcgtatccacgctcagcgaagagcttcaccgcctgcgcgataatcggacttggtaatggaatggctgtcatgatattttctcctttaggaatgaacgttcattcacatatattagtttttgagaatattcatgtcaagtgcatattcaaaaaataattaatactggcatggtgtgttattgataccaaactaaaaactcgtttaatggcgcagaggtcagtttgcgcccatacaaaaaagcgttgaaaaaacaacgctttattcgagactacatttcttacggccacaatttaatacagccgagaataatcgaaaaaatcgcggtaccgtttttcaataagcgcccatcgattttcgggccgatgcgactgcctacgatgacgccaataccgtgtgtcacgatgatcattgccagtagcggtaaggtggtcatgaattggacttggctgaggtagccgactgcggccggtaagctgatgaagaccgagtttagcaaggcgatgccaactgctgcatgcggttcgcagccgagtaaaacgagtagcggcatgaccagtaccgggccgcctgctccggaaagggcacaaatcaatccagtgacaacgcctaggatgacgagcaaaaccggttgattcaagtgatcaacgccgggttttggcgggtggcgttgttggatcaaaatagcaatgccggatagcaggacgaccagataaagtaagaattgtacccagctggttggcagtaatagattaaggcgtacgccaataattgccccgacaaagctgccgccgctgagtagataagcgacccggcgatccatgagcccttcatgttgataatgacgcgagcccaaccagccggaaataatgaaagccaggaaactaaaggccagaccttccgtagtgctatagccaagtcccgcggtgtatagaatggggagtaaaaaaccagccacgccagtcataccgacgaggccgccgattaagatgttgccaattgcgatgatgatgattgccataatgttgggtaacgccgcgcacacgcagctttaatcctttctacgtctaatgttaacacttctcggttccgcatcagccatttgccggcaaccatcgaatccgcgacatcattagcattgacgctttcaagcaacgtgttattccagttgccggttggccaaaggtgggggctatcaatgtttaacccgatgatatcagcctggtaacccggtgcgattcggcccagatgaccggatagattcagggccgccgcgccgccatccaagaccatggacataattgtcggggcaggcatgacagcaggctgatgttgcaaggtgccataatgcagggtcataacggagcggaaaatcttcatttcctgccacagactcagaccgccatgcgcagcgccatcggtacccaaaccaattgaaacacctgcatgtaataattcaggcgtggcagggatgccttttccggcgttactgaacggactgtgactgagcttgacgtgatgggtttcgatgagcattttttctgtgtcgtcaagaaacagactatgtgctcctagaaaatgatcgcttaaggcgccgcgttttgcaaggtagacatatggccgctcaccgcaacgcgctaaaataccggcgacttcttgaggatactcgttcatatgcgcttcaagaaaagtctgacgatcctcggcacgctgggcagctagatcgaccaatgtatcggaacaattatttaaggcgcgtaatgagtaataaacttgcaaatgattgcggccgtggaattgatcatacaaggcatcggtgtgggcgatggcggttttggcgtccatgttaatagttgccggtaacgtcggatcgtccatcgttgagtaggcaagggcgccgcgtagaccacttttcgcgtaaacggtgccggctgcggccatgtgataactgcctgactcaacgaaaccggtggtgccgctggtgatcatttcaagggcggttaactgggcattaagcgtcatggtttccgccgtcatgttggcttcaaatggcagcatgactttttgccagataatgcctttcgtgtccagcacgcggccacgtaagagttgttggccggtatgtaagtgactgtcgatcaagccgggcatgaatagccggtgcgtgccatcaatggtttcatctgcttggacggttatcgtcccatggtcactgacctgcgcgattttatcgtcgcggattaaaatgtcctgatgcggcttgatctcaccaggtgcggtcatggttaaggtatcctgaatcaatgtgctcgtcacttaaatcacccctgtcagtttcaacgtgagcgtatcccacaggagtgaaccgacaaatgttccggtcatgacggcaactccgacaatgatgtacttccagccttgatggacaaatgtgcccagcttatccgaaattgcaatgccggcaaacgagccaacaacggtaaatggcgcggcaaacgcaatgactttggtagaactaatcacaaccgctgcaatcggcgaaaatggtgaggcaacgagtaggcctaaaatggaacagtacgcaataatcggcaacttgaatggcacaattttagctaagaccacagctaccatggtaatggcgatcaaaatgatcacgccggggaggcttttagcgatgctgacgccggatccgatccagttagctagcagcgtcccgaccccacaaacgctgaggagaaataaccattcacgtaaacgcattacttaatccgtcctttcaaagcggttgccgttttagcgcggcgactggcgaacattttatcgaaaagattgtagagcttgtcggttagcgggatggcgagaaacatggtgatataaatcccggtgatgccggcgatggtgttggcggctgaagccatggcggtgatagtgttggcgtcatgcgggaatagttgcgcaaggctggcactggcagaggccatgaaaatgccggctccaacgcctgtcgacatccccaacgccttaggatcaaaccaacccgtcagtcccaaagcagttgccatcatgccgaaataaatcgtgccaagaataccgccaacgatgtaaatcgccatactgccgcttgcttcgtcagaatccgaaccataagccgaattgattaaggcaaggtgatattcgcgattcagtgaacttgttgcgccaattgcctcacggtgcagccccagcaacattgccagtggtaggccgaagaagatcccaagcagattaccgaagccatgcaccagcaatgccggaccagcatgtaagatcatgtccatatttgcgccggcagtaatccctaagttaacgacaaacgggcaaataccaacgataaccaatttggaagcagctttaacatggcgattgtcaaaccatcgcatcacttgcggcccactgagcataccaagaataatggcatagaaaaccgggaataaaatgatcatgccgggaccgaccttgagtttcaccgttccgatatattcagcgatgacggtgaacaatgctgcgacaagataactcttccattcgactttgatccgtgcacgtaaactgggataagtcatgttttgcctcctcttttagcgaatggaaccagtttagcgcagttattcgggtaaataaaggacaattacattaaaaaacgttttaatgttcgtgtttattcgtcagcacctgatggacaaccttttaaaaatgaataagtgacgagcatgacaaatcatataaaaagccaaaagtcagttaccttgaaaaaccgaatcaagatccaataacgaaagatcaagtgctttctgtatttggttttgattcggcaaagtttcctgacgcttggcgatggtgctaagtagctactgtgatcagttgttgatcacgcaattcaataacgttacttgctgtatttagtcgtttttggccgacttgttttgaccttttgttccagattctgctcaggtaggctggctggctcttcgtgaaacagacggggcaggtggcgtggcgcaacagtcgatactgacgtgacaacctgttgaacatgctggtttagctcggtggtgggattgacggttgttgcggccgatccgctgctagtcaacaaccccgcggcaaccgctaaaaatgtaaagaccatatgcaaaactcccttcgactggctgacattctttaataacagcgattaacagtcagtctagtaaggagatgtgattgatttgccgcatttgtgaggtcttttcacaacgaaaatgaaacgaaaacatggtgattcgttaacagaagcgtaaagcatggcgaatatggaccaaaagttgaagaagtatggatgaatcacgcgccgggcagtaaaaaattttgaacatgaaaaaagacgactcgggtaagtcgcctttttactgtttgctcgttttcaattatgaagcagattttccttttggttccaatcggcgttccaaaaagcctaacgccaggtcggagataatcgccattaaagcggttggcaatgccccggcgagaatgatcgcaccgccattggttgcattggtgccgcggacgatgatatcgcccagaccgccggcacccacgaaggcaccgattgccgtaatcccaatggcaacgaccagcgcgttacgaatcccggccatgatgactgacatgctcaacggaatttcaaccatgtacagtgattgccagcgggtcatgcccattcctttggcggcatccatcaggttcttgtcgacattctgcatgccggtgtaagtgttcttgatgatcggcaacaaggagtagagaaagaccgttacgatgacggtgttcacgccaagaccaagcccgagcatgatgatggacaacattgccaaactaggaatcgtttgaatcacgttggcaatgccgatcaccgtgttactcaaggtgcggtggcgggcaattgccaagccaaccggaatcccgatcacagccgcaatcagcacaccataaatggaaatcagaaaatggcgagcaaattgactgagcacgtacgaaccgttattggcaaggtaataccaaaattgctgccaagtatccatgttagccattagtcgtcacttcctttgaaataattgtgtttagccagaaacttctgagcgaccacattcggttcaagtaattgatcgtcgacttgatagttcagttcctgcatggttttcagattgatcttgccgtctaaacgatgtaacagcggttttaattttggatatttcttcaaaagactgttgttaaccactaatgaacactgataaggcgggaagaactttttatcatcctttagaatcttcaaattgtaactgcgaatgcgaccgtccgtagaatacccgagaaccgtctgcatccggttggcttcaaccgcgtcgtaaaccaaaccgatttgcattggataaacgcgtttgaaatcaaaaccatatgctttggtgaagtcgctgtagccatcgcctttacggttcatccagctggaatcaaccccggcgttgtactgtgatgcgactttctttaggtcggaaatgttattgaggttatccttcttggcttcttcttgggtaaccatgaaagcataggtgtcagagaagccataagacggataccaggtttggtcatagcgttttttgaattcacgcttgacgatggtcatcgctttggaaggacttttgacagggttcatgcctaatgtgccggtgatatcggtgccggtgtatcgagtcgcactgatatcagcatcattacgaatcatcgcttggtgaaccaccgtcccggaaccaaggttgttcaccaaagtcgtcttgtagccgagttcgtggttgattaattcggcaatgatattcgccataatctgtgactcggtacttgtttgggaggcgattcggacggtaccgtcattaccggaaccgccaaggccagggaagccgcaaccacctaatagcagcaccggaatcagcaatagggtcaggagtagttttctgaatgtcttcatcttgccacctcctaagcgcgctcgctgacaggtgttaggtggtattccaaccgccccaacagccaatcaacaatcagtgccaaaatggttacaggaatggtcccgccgatgatgagatccggctggaagagattcagaccattaaagatcaagtccccaagcccgccagcaccgatatacgatgctagggttgcccatgcgatgacataaatggcagacaagcgaattcctgccataatgactggcatggctagcggcacttcgacttggcgaatggattgcatggcggtcatgcccattcccttagcagcgtccatcaacacgggatcaacatcttccatgccgatgtaagtgttacgcaaaattggcagcaatgaatagatgaacaatgcgacgatggcaggtactttcccaatcccgaataaaggaatcattaatgccagcaaagccaacgaaggcaccgtctgtaacatgctggcaaggccgatcacgactttagccgtcttaggaaaacgggtcagcagaatgccaagtggaacggcaacaatgactccgagtccaagtgcaattgccgagatgtaaagctgttcccaagttttggtaatcagttcactgccatgtgcgtttagaaatgcaaacatggtcacacctccttaggtgcgtctcgggtatcttcagttgccgaagtggtggtcgtcgacgatgcggctgactgatcgttattcttggccgcagcactgtcttgatcatcttcattgtcgccccaaatggtgtcataaacgacatcaacaagtgaagcacgggtgacaatgccgaccagtttctgatcattgtcgaccacaggcacatacttaaatccgcgcttaagaatgcggtcagccgtgtcgcgcagtagggcatcttttttcacgtagaaaatgctggacttggtgatgtcgctaacgctggtggcgctttggtaacgggtttccagcgattccagatcgatgaagcctttgaggtgatcctcgtcatcggtgaccagcagcgtatcaacgcggcgtttgcgcatgagggaaatcgcttcagccaaagacttgccaggtgtgatggcagccggattcttcaacatgatctgttcaacagtggtgacgtccgcccgcgcttgaaccaggcgatcctgaccgactaagttttcaacaaacttgttggcgggatgggtcagtagttcggttggggtggcgttttggataatgtgaccgtgatccatgacaacaattttggtggcgagtttgagcgcttcgtccatatcgtgggtcacgaaaacaacggtcttaccgagcttttcctgcagatttttaattaattcctgcagtgcttcacgggtaatcgggtccaaggcgccataaggttcgtccattaagatcagatcctgattggcagcaagcgcgcggataaccccgatccgttgttgttgcccaccggaaagctctgatgggtaacgatccagataatcttcgggtaattcgacgagatcaaccagttctttggccttttcccggcgcttttcttcaggccactttaataatttaggaacgatcgtgatgttttcataaatggtcatgtgtggcatgaggccgatattttgaatgacataaccgatttgacgccgcaattttacggcatcgattttgtgaatgtctttaccgttaaacaggatttgaccgccgctgggttccaacatccggttgatcatccgcatggtcgttgtcttcccggaaccggatgtcccgataagacatacaaattcacccttattaatttcaaggttaatatgttcgaccgcgacattcccgcctcgatagactttttcaacgtccttgaacaggaccattggttgttcttctggcatctgacgcgtcctcctttgtttggttgcttctataataacacatgacgttaatcgttttttaataaagcgaaaatgcgttctatctgctcaactttccaattgtatcttatgaaatgattaaaaaaagctcaagaaagttcccctgttttgattgaaaagttgattgcggtcaaggtggcaataatgattcctcagtacactggtctcgaatgggagggatcagcgatgcgttttattcaaacacataaacaagaagcgatggtgatcggcggtgttttgactgcggcgggattgattttcagtcaggcatggttgctggtgttggcgagtctggtggccgggctgccgattgcggtgaatgcctgggaagcgctgcgttataagcagattagtattgag

SEQ ID NO: 49 - DNA, 2944788 bp, Lactobacillus rhamnosus (residues 1,472,395-2,944,788 of 2,944,788)
  modified_base (670520)..(670616): a, c, t, g, unknown or other
  modified_base (1020827)..(1020924): a, c, t, g, unknown or other
  modified_base (1415060)..(1415158): a, c, t, g, unknown or other
  modified_base (2341581)..(2341679): a, c, t, g, unknown or other
  modified_base (2861685)..(2861783): a, c, t, g, unknown or other
  modified_base (2930296)..(2930523): a, c, t, g, unknown or other
ctattggtgacaattgctctagtgggcgcggtgatgattggcgagccgattgaaagtgcggttgttagttttctatttttgttcggcgactggctggaacagcgtagtttagccaaaacgcgctcggcgatccaaggcttggctgccgcagcaccgaaaacggccaggctgctggatgggacgaccattccggtggggaagttagcggttggcgatcaagtgcgggtgttggctggcgaaacggtaccggctgacgggcaggtgattagcggccaggcaaacattgtggaagccgcgatcaccggcgaaccggatgccaaacgcaagcaggttggcgccacagtatactccggtacgcaggtgagcgatggcacggttgacattgaagttgaaaaaaccggctacaacacggtttatcagcagattatcgatttaattgaagatgcgcaggacgcccaatcgcctgtggcaaccttcatccagaaatttgcccgttggtacacgccgctggtattagtcatcgctttgctggtgggattgattagccaaaatgtccggctggcaattacgattttggtactgggttgccccggcgcattggtcattggcgctccggttagcaatgtggtcggcctaggatttggtgccaaacatggcattttaatcaaaggcggcgatgtggcgaccaagttggatcaaatcgacacggtgatgtttgataaaaccggaacgctgacacaaggcaagatccgtgtggcaacagctaagtactggaccgctgatcagcaacgggttgcagccacggtcacagcggttgaaaaagcaacggcgcatccactgggacaggcacttgttgccgatcttcaggcaaagaccatgcaaaagccaaccgatgtcaaagtcactcgcggagttggggtgaacgcccgaatcgccggacacgcgatcagtgtcggcaatcaaaaggttttgcaccagccgctaacagctgaccagcaggccgctgttcagcaaatcgtggccagtggtgcaaccttggtcttggtaaccattgacgacaaactcgtggcagcttatggcttgcgcgatcagttgcggacggaaacgccaaccatgctgagcaccttaaaagcaagtggcaagaagacaatggtgctttcaggcgactcgcaggcagcggttgaacacatgatgtcggcactaccggtgagtcagactcgcggtggtttactgccggcagataaggtgaaagcgatcaaagcagcacaagcccgcggtgaaaaagttatgtttgtcggcgatggcatcaatgacggccccgccttggcacaagcagatgttggcgttgcaatgggttccggcatggatgttgcaattgacacggcagacgttattttgaccaacagccgtctcacgaatctcggcgtgcttttcgacttagccaagcggatgaatcgcaacatcaagcagaaccttgtcattgcaattggcacggtggcgttgttgttaagtggcttattgattggattggtcgacatggctagcgggatgttattccatgaaatttccatcctgctggtcattgcaaacgccttgagattacgacacacaccaagaaaatggcaaaacttgacggccatcaaggtacatcatccgcaaacggttaataatgagaataaataaaaacgaaaggatctttaacatgacaaaattagtttatcaattagatggtttaacctgcccgagctgcctacagaaaatcgaaggggcactaggccaacaagccggcgtcaaaaccgtcaaagccttatttaacagcagcaaggtcaaagcccagattgatccagccgtgaccaatgccgatgcgttgaaaaaaaccattacggacttgggctacaccgttgtgaacgttcgcagtcaagaagcatagagcgtgagcaggagcgcttagcaatcggagtgtaagcggccttgaacgtgatgaccgagctatgaccattgcgcgaaaggtccttatgtgcaggttgctgcgacatcgaacacaattttaagccgagtgtgatcagggcttcatacatccaagacctttacacaggcttctagcgcggcaaacgcattttcaaggaggaaattatgagcatgagcataacaccaggcatgcacactattgacgaagaaacagtaaaagcccgtcaagcagcggcagctaaacaagtcgaccatgatcatcatgtaccgacagctggggcgatgagcggacatgtactagcaaatttagcagtcttgcaacgtaaactggcccaattttcccaaacgttgagtggaccaagcagtgacggggatcgcgaattgttaacgcaattggcaacacaagcgcagcagcatctgacggtgttagtggcagacttagcggcgcaaggagaagattttcccacgacaaccgcggagtttagcgagtacacgatgttgcaagaagatcccgcgtttcgtttttggaccaatgatatgaaactggatgctgtggttaatgatctggatacttgccagctgttcgtcagtcgggcgattccgctagccaataaagagaacaaggcagtgttggcagcggatatgttacaattgcagcgctggcatgagcaaagtatcctgcacttgcaaacgcgtctcggtcgtgaggtgacggcggggcggaccttgcttgaagaggacgatgactgagcaacattaaacgatcgattgacgagagagcctgtctgtaagggggataaaaatggcgcatagttgtacggcggtcgtaccgttatttaaaaatctaactgatgaagcccgcactgcgattgatgcgttgacccacgagcatcaggtgcaaaaaggaacggttctgatcagtcctaacactgctgctcatttgttagtggttgcacagggaaaactcaaaacttatcaattggcgacaaatggtaaagaacaattactgcgcgttgacggcctcggcgattatgaaggggaagccggcttgttgaatattgctaatccgaatgtctataccgaagcgctgacgaccgccactgtttgcaccattagcgctgccgattttcaacagttactcatgcaacaaccacaaatcagcttgcaattactcacagaaaacgcccgtaaaatgcaggcattggaaaagcaagcgggctatctcggcaacgattccatcaatgtacgcttaactcactacctactggatttgcgcactgccgctggaaaagacacagtgacggtaccgatggcatggacgcagctagccgattatctcggcacaaccccagaaacggtttcgcgcacgttaaaacggttagctgatgaaaaattgattcagcgaactgggaagcaagtgacgattttgaatgctgaggatatggaagattttgtttggtaatttaaaagtctttagccgaataatagtgtcaaaacaaaggatcgcaactgtgaaagctgcgatcctttattgttgttatcagtcatgactagtcatgtgttttttcatgccgaaataataggcaccaacggctatcattaaacccaaagtgaaggcggaaaaatatttttggctacttggcaggaaataccaagcaaaaattgctaagagtccacctgtggtcacatagagatacaggaagctgcggactgcttttaaattagaaggcttctttacgagaaaatagaggaaaaaagccgaagttgcaatgccgaaaattatcgaagcgatgtgtaataacatgtttgggcctacctttcgatcgggtgttgctgtaatctcacagaacaatcaaatattgaaaataaccgttaaacggtactagttcgccgataaaaccggatgcgtgcgtcgtttttgccagaagataaggataatccccagtaagaccaccagcaatatatggacaatatttgacgccgcactagcttcaagtccaaaaacgctgccggtcagtgactgcgatgtcgttgtcgggagggactcgaggacgaacttttcaccagatagcccggaaacggttgtgccaaagatgggaccttccgcgaaattccatatggcgtgaaaggcaccgcacagccagatattgcctgtcagcaagcgaaattgtgacattgcaatggcaaagaaaaacaagccggtggcggcggaaaaattatagccgggattggcaagatgcaaaagcgtgaaaaagatggcgttcaacaaaaccgccagcccgacacgattttgcttaagccagtagcccattatatatccccgacaaagcaattcctcgaacattgattgaatcgcatagccgaagaagaaaagcacaagccacagcaaatttggccactgaaaagtcgccagcacatggtaaccaccaagcagtgcgatgatgccccagataaggctgaacatgagcaggccaaaaagtaagcctaaagcatagtctctaacggcattttgacgggaaaaaggcagcaatgtacgatcactgcgataatagatggccatgccgataatgccgatagcttcagcgtataaaaagagcaggttcaaagacatcgggatgttggtttcatctatgtcgatgtcgaacagaccgatcaaaaaaggaatcagctgtgatgacaatgaccaagcaagtgcaatgccataaacgattaggataggtcctaatagctttgaaaatttatgtagttgtttaattggattcacctctgaatagaatttgaatagagaagatagcttaacaacaaaagaatatttttagggtatccttaattttttgcgtagtcaagcgatccaaaccgagttaccggtgaacgcgttataagcacaggcggttcatcttacttgaaataagtatcaccaacattcggaatgctggtactagtacccaaatgtgcgaaaacgcttttattacccttgctattccgttagtcttcatattgaaaataaatagataaggggtccagcaatatggagaagaagattgttgccgtgacggcttgtgcagcggggattgcgcatacgtatatggctgcggaatcactggagcaagcggcgaagaaaatgggctatgagatcaaagtcgaaaccaatggggcaatcggtgctgagaacgtgttgacgaagcaagatattgagcaggcagacatggtcattgtcgcctcggatattaaaattgatccgattcgctttaccggtaagcggcttttcgttaccaaatcaaaccaagcgattgaagattcggaggcattgatcaatcaggcgtttgaagaagccaaaatttttggaaaaaaaggtgcgaaggttggcaagattcaggtaggtaacgataaagataaggtcaactttttcacgcatattatgagcggcatttcatacatggtgcccatggtgattgcagccgggttgcttttgacgattgctaatctgtacgcctttcaaagagacgatttaggccgaattgttaagtggggctttgacaataaaacgcaaatgggattcttgatggccaagttgttctatgtggggcaaatcggctttaagttgatgattccgttgtttgccgggtttgtcgcgaattctattgctgacaaaccagcgattgccccggcgatgattggcgcttatttggtcaatgatcccgagtttctgaatacgaaggcgggcggcggttttattggcgccatcattgttgcctttattgtaggttacatggtgaagggcttgaaaaaagtgaaatggccaaaactgctggtgccgattgtgccaatcatgatcattccgtttatcgccaccgcggtcattatgttgattgttctttatgtcatcgggaacccgatcgcggttggcatggatgcgatgtataaaggtttgacggatctcaataacaactattccggagcgccgattttgattggcgctatctgcggggcaatgatcgggtttgatttaggtggaccgatcaataaaacggctttggtctttggaaccgcgattttcacggatacgttgaccaagtatgggattaacggggccaattttgttcctggaaccgcgacccaagcagcaatttccgttgcgccactgggagtttggctggccaccatcttattcaaaaagaaattcaccaaggatgaaaaaatcgccgccagtgctgcttttgggatgggaattgtcggtgtcactgaaggcgcaatcccgtttgtcgcggccgatccagtcagaatgatcttttctaacgtggttggttcagcggttgccggtggtctagtagctgcgacagggtgtaaattttacggcggtatcggctcgccactaggaacttttattggttatattgaacagccgctaccgtttattacctggattttatgtgtctgtgcaggaatcctgaccgccgcactgttaatcggcttcacccgcaaacaaacagtggcagggctcgctgttgaacccgaaaagtaatgctaaccgttgaaaccgacaaatgaacaggtaggtagaaaagtgaataaagaagtttttaatcgtcaccatattttatttgatgaaacagcaacaacccaggaagaagccttcaaaagcctcgcccaatttgcttataatgcaggctttgtctccgatgaaacagcctattttgaggggttaaaagctcgtgaaaaggaagcaaccaccggctttaaagatcatatcgccattcctcattgcaaaagcagcgtcaataagaaaccggggttattcttaatcaaatttaagcaggcaattccgtggcaagcattagatcaaaagccagtaaaggtggcttttgggttgaccattccggaacaaggggccaccgaacatttgaagttgctcagcctgatagccagaaagttgattgacccagactttagagaaggagtcctgacacaggatgatccagaaaagctgacagcaatcattgatcaaatcgaatttaggggttaatgcagaagtgaaaagaaaagttcatgtcatccatcacacccactgggactttgaatggtatttcactgccaacgagtcactggtgcagctggcttatcatttggatgaagtcatgcaagccttagagcaacagcaaatcagttactatttgctggatgggcagatgagtattcttgatgattatttaaccagttttccagaacaaaaagagcggctaatgaagttagtcaaaagcggcaaactcgctattggcccttggtatacgcaaaccgatgaattaatcgttcgcggtgaatcgattgtcagaaatctgaacctgggcatgacgttagcagaatcattaggcggctgcatgaatgttggctatttgccggattcttttgggcaaagtaaagacatgcccaaaatctacaatggggttggcattcagcaagcagtcttttggcgcggggtgcctgacgatgtaacaacgcagcgtgaattttactggcaggcagaggatggttcccaagtcttaactgcgaatatcaaagacggctattttgtgggcgttggtctgatttattctgatgatgcgcctgccctcgtcaaaacgattgcggccggtgctacgggtgcggatttactgttaccggtcggcggcgatcaacggtacattgatttcaatctgcgcgatcgcatgaacctgtatcgccaagtgcttcctgatacagagctagaagaaagcaattaccccgggttttttgaggcaattaaagaaaacgagctaccaacaatcaccggcgaatttatttctagtgcagtctccaagatccatcgttccatttactcttctcgttacgatcataaatacttaaatgataaagtggaacggcgcatgatttatcaagtggagccgctgatggtgatggcagaaaaatgcggaatcccttataagcaaggtttgctagatcgaatctggaaattgctgaataaaaaccacgcacatgactctgccggcgggtgtaatagcgacaaaacgaatctgatcatcaccgcgcgctatgttgaagcagatcagctttcttactcattagtggattacctgaccagaaaaatttccgaatcgcgagttcaggtatccgaaggcgaattggtgatttttaataccttgccgtggacgactaaaaaggtcataaaatgtgaggtatcgactcactttgccgcgatcgcacttgaaaaagacggcgtgacggttccggtcgaatgtttacaaacacgcaaagaatcgaatcgttccattcgccgaaaagaagtggcggatgcaccagccaacgcttatttcgttcatgaattattgattgaagcagaagtgccgccgcttagttttgtagcgtatcaagtggttgaaaaaactcgcatatccgctaataaactgctagctgaaaccgcggctgtttcaattgaaaatgaggcgtatcaggtgacctttgaggcaggcgaactatccttaatcgaccgcaaacgcaaagccgcttatcagaactttttggcgtttgaagatagcggggatgaaggcgatacctatgattattcgccgccttatgtggatgatcggtatcggctcaatttgaatggtgctacttgtcacacgatccgcaaccaactaatggaaaaactcattatgaccggtgagtggcaagttgccaaagacctaaaggaacgccaagctaaaaagcgaacccaggcaatcccttatgaattgacgattgaactattaaaaggcagtcgccagcttcaatttcatttggagctcgacaatcgtgcgtgtgatcaccggatgcgggtgttgattgagacaccgaatcagaatgccttttcatactcggacacgccgtttggtacggtgaagcgagcggttgaggatcctcatattgacgattggcaacaactgggctggcgggaagaaccaacggcaattttcccaatgctgacgtatgtaaacagtcatgatgcgacaaccagctggacagtttttagcaaagggatcaaagagtatcaattcatcggggaaaagtttcaaacgatagccttgacgctgtttcgctcggtcggttatctcggccggccggatctgctaagacggccaggggtggcttcaggcaatgagtttaaagccattccgacaccagatagtcagttgcaaaagaaaatgcgcttcaaattcgcactgcagttagatcacgattttcagccagcaagcttggcaaaagattatctcgactatgcgatcagcaacccgcattaccagatccaagacctgaatcgctttaccacaacgcttaagtattttgtctcgaatcccttagaccatcaagtgccaacaccaaaaggaatgacgcttgacagtgagacgctggttttcagctcattacgcaaaagtaacgacgaaccgggctttgatattcgggtttataatccggatcttaaccgggaagtggacggcggcagtatcaaaggcttgcgtaatgtgcggtatacgtttgtagatctaaggggtcatgctgtcgctgaaacccaagaagatgatacgattctcctaggcacctttaaaccgggtgaaattaaaacggtccatatcgttgaatgaggagaaaacgaatgccagaagatatttttattttaatcgagtcgtgtcggttgaacttcactgctgtggaacaggtgatcgccgactaccatttgagtaaacaaccggcgatgaccattgataaatcatctgcgcacttagcggtatcaaaagcttctattacgcggttttgcaagaagatcggtttgagtaattacaaagagttggtctttctttacaagctgtctttaaatcaggaaacgactgatttatccgtatcctcaaaaatcacggcagcctatcattcgcttgcaacccgcagtgacagtcattattcacaagcagtcattgatgctttttgtgaacggctgcatcaacatagaatcattcatttttttggtaaaggcttcaattcttacgctggcgccgatttccagttcaagttttcccgagtcggcaagtatgtccgtgtgattactgatgaaaattcgattttgatgtccgccaattttgcgaaccaagatgagttaatcatggtggctagtttacgtggggatgacgaagagttgctgaaagcgatgaaaattgccaagcagcggcaggtaccgattctattgattacgtctaatcgttattcacaacttgttacccatgcagacgtgacgcttattgctgccagtttgaccaaagaagaggctttaggcaatatctcaccacaaattccgattttgattcagttggatatggtttatgagcgctatatccatttatatgccgatgccgtttctcaatggttggcgtcggaacaaattttacacaagtaacggaggaagcatgaagaaatttcccgagaactttttgtggggcgctgcaatgtcggcaccgcaaacagaaggccagagtttaaatttcggaaaatcagccaccacctgggattactggtttcaaaccgcaccggagaagtttcaccagcaacaaggaccagcgatcacatctgatgtttacggccagtatttaaaggattgtcaacgcatgcaggaaatcgggttgaattcagtcagaacatcgatttcctgggcccgtctcttgccagatggaaagacggtcaacccacaagcagtcgcgttttaccggcagtattttaccgccatgcgtgatcatggggtcgaaccgatcatcaacctgtttcattttgacatgccgatgtggttgatggcgcgtggtggctgggaaagtcgggaagccattgccgcctttgccttttacgcccagacatcatttgagttgttcggtgatctggttaaaaaatggacgacctttaacgagccgcttgtccatgtggaatgcggctacctgcatcagtatcactacccagcagtagtcgattttaagcgggctgtccaggtggcttatcataccttgcttgcacataaagcagcagtcgcgaagtttagaaacgcgctgccgtctggtgagatcggaatcattttgaatatttcaccgacatatcccaaaagtgaagcaactgcggacatgttggcagctaggcgctcggatctcctgaacacgcgtagtttcctggatcccgcagttttggggaccattccggatgagctagttgcgttgttaagtgaaaatgaattgctgccagtgacgaaacccgaagatcaggcactgattaaagaccatatcgtggatttcatcggcttaaattattaccaaccgcgccgagttcaggcaccaacagctcccaaaacgcctgcgcaaatgccggccgacttttatcagccgtatgattggcccgccaaaaagatcaatcctcatcgcggctgggaaatctatcccaaagcgctttacgatgtcgccatgatgatgaaaaacgactatcacaacatgccatggtacgtgagcgaaaatggtatgggggtcgcaaacgaagaagcttttatggcggacaatggcgagattcaagacgactatcgcatcgcatttatgaaagaacacttaaactacttgcaccaaggtattcgcgaaggcagcaactgctttgggtatcatgcttggacgttcgtggattgctggtcgtggttaaatggctataagaatcgctatgggttttatcggctggatttagcgacaggccaacgatcaatgaagaaaagtggccgctggatggggcaggtcagtgaaaacaatggattttagaggtgaccaatgagtctaggggtatttgatataggcggaaccacggttaagcacggcatttgggagcatcagcagttaagcccagtcaacgcttttccaacacctgtcacatttgatgaattactaagaaatatggccgaaattatccgcgatgccaagcgcccgctaacaggcattgcaatcagtgcaccaggagcagttgaccaagaaaagcggaaaatactaggcatcagcgccgtgccctacatccatcaacggccgatctttgatgaactcgaacaacatctcggcttgccggtgacaatcgagaatgatgccaactgtgcagggatagccgaagtagaactaggtgtcggcagagaagcacaaaatattgtctttgttgttctgggtaccggagtcggcggcgcactttttgttaatcgacaactgtataaaggaagtcatctgtttggtggagaaatcggcctgctgaaaagtcagagtcagcaaatctttagtcaaaccggaaccttggtcaaagtcgcacaagcttattctgaacaagtcaatcgtacggttgatggaaaaatgctctatgagttaagcgaaaatggggacacacttgcaaaatcggcgttggatgaaatgtatcagaccatagcaaaaaacctctataatcttcaagttctattcgacccggaaatgattgttttaggcggcggcatctctcggcggccaacattagcagctgaactttcagggcgattatttgagcaactaaaaaaagaaggcattgaggaaatcatgcctgttgtcaaatgctgccattttcataatgatgccaatctaattggggcggcgatgaacttccagaagattttccctgatcagcatcggagttaagtaagtttaaatccgattgggtcaagttttatggcaactcttagccatcattattaagtgaagcgtgttgaatgattacctggaaatcctatagactgagattaagctcaaagaggagattgaatgactcttacagtcctcctaggtctttctcctttactttgcattcgagtcgttatattatcagaatgcttttatttaccgattaatgggtccatctcaatttatggcgaggaggatggaacatgacactgcttagaaaagttatttgggtattcgtgtttgttatttatggggtagtgcttttttgggcttcgttttacagcaacagtgcttattttttaccggtgatcgccatccctgctattttttcgggaatattttggctaatcgaaaatgttaagaaaaacaagaagtgaggaatgttcgtcttactgtgccactttggtttagcaagatgctttattgtcgattgatattacgttccgccctcttttgttgctttaactgaatgcttaagaagcggttgcttagaacgtaaatcaataaaaatgaaaaagatcgcagtactcggtttgagagtattgcgatctttttggccagtggctactttacggatcaagtctacttaaatcagacaacatttaagcattcctactaacgacagactcggtttgcttttgcgtatcaaccgctgcccgaatcgcctttgtaaactgctcaatcgcagcgggggcgttttgcgcttccttggcgacaatgtccacgatggcgctgccgataatgacgccatccgcaatcgacgccatggtttgggcttgttgcggggtatggataccgaagccgattgctgttggcacatcagtgtagcgtttgatttccgtaaccaacgtttttagaccggtgaaaaattcgtcccgttcaccggtgatgcccacagaggaaaccacgtagatgaaaccagaagcacttttggcaattttttcgatccggtggccagaagtcggtgtgattaacgggataatatcaatgccatacttttctgcaaacggcacaatttcagcgcgactttcgtatggcagatcggggatcaccagaccgctaacctttagctcggcgcaacgcttcaaaaaggtatcgtagccgtacttaaagacgatgtttaagtaagtcagaaacacgatcggcactgcggttttcttccgcgctgcttcaacgatttcaaaaacggttttggtgcgcacgttggcagcaaatgcgcgcaggtccgcagcctgaatcactggcccatccgcaaccgggtcagaaaaggggatacccaattcgacaatatccgcgccgccatgtgcaagggcaacaatgtttttgacagtggtatccaagtccgggtcgtccgcaacgacaaaagggatgaaagctttatgatttttgaagatggcagctaaattactcatcaacgtcaactcctttgtatttggcaatgctagcaacatctttatcgccgcggccggataaggtgcagatgatgatttggtccttggccatggttggggcaattttttcaacgtaagcaatggcgtggcagctttcgatcgccgcgacaatgccttcttgtctcgcgatgtattcaaatgcctgaactgcttcgtcatcggtgatcccaacatattgggcacggcctgcttcggcgagggcggcgtgttccgggccaacgccggggtagtcaagaccagcagagatggagtaaaccggatcgatttgtccatcttcgttttgcatgaataaggatttcatgccgtggaaaataccgacactgccgcgttcgatcgtagcagcggttcgcgccgtatcaacacctttgccagcggcttcaacgccgaccagttgtacagaaggctcatcaatgtatgcggcaaaactgccaatggcgttactgccgccgccgacacaggctacgatcatgtccggcagctgtcctgctttagcctgcagttgttgcttggattcaatggaaatgacgctttgaaaatgtttgaccatctccggaaatggtgctggacccacggctgaaccaagcacataaaaggtgtcatcgctgcgactggcccattcctgaagggcagcgttgaccgcgtctttaagcaccatcgagccgctggtgacagaatggactttggcgccgagcaaggtcatgcgataaacatttaacttttggcggtcagtgtcttcttttcccatgaaaatttcacattccatgcccatcaaagcggcaatcgttgcggtggcaacaccgtgttggccagcgccggtttcggcaattaaccggattttgcctagatgcttggcgagtaaggcttgtccgataacattgttgattttatgggcaccagtatgattgagatcctcacgtttgagatagatcttggccccgcctaagtcttcggtcatgtttttggcgtaatacagtagcgatggtcggttagcataattgactaacaaatcgttgagttcggctttgaattgcgggtcgtcttttaaagtgttgaaagccgcggtgattttttcgagttcggtcattaaggtttccgggatatactggccgccaaagtcgttgccatagcggccggcgcggtttgtaggttgagcagtttcatttagtgttttcataaatgatttcctcttttgcgttttgagtaaattgatgaattttatgcgcatctttgtgaccggcagtttcaacgccgctggacacgtcaacgatagtagggtggacgacttgaatggcacgggcaacgttttccggcgtcagaccaccggctagaatcagtggtcgcgtgatgtgtggaatagccgctagattgagcagttggccactaccttttccgctgtcgaccatgagataatcagccggcgaagttaagtcaattgcctggcgttcaaagacctggatgacttgcaggccagcgtgttgcagctgcttaatttcggttggtgtacttgttcgatgcagctgcgcaatttcaatggcgccggcttgataaatcgccagaatatcggcgaccgattcatgaacgaaaacgcccactggttgaatatcgggatggagtaacttgcgtaaagccactgcctgctccagggtgacgtgatgccgtccggaagcaaaaacgaacccggcgaaatccgcttgagcagcattgatggctaaaatatcttcgggatgcattaagccgcagattttcacttttaccatttttcaaatccccctgaatgccgtaattaattcccgcttgtgcttggagcgcatgagggtttcaccgattaagacggcgttgaaaccggctgcagctaacttttcgacatcttgttgcgtttggatcccgctttcggcgataacaggaatcgagtcaggaaccatggcgcgtagtttcagactgtttgtaaaatcaacctgaaaatttttcaaattccggttgttagtgccgatgatttttgcgcctgattgcaaagcacgggtcacttcttcggcggtgtaggcttcaacaatggcttgcatgccgagattctccgcgagttggcggaaggtgcgtaattgttgatcagttaagatggcaacaatgagtaaaataatggacgcaccatttgccttggcttcgtaaatcatatagggatcaatcgtaaaatctttacgcagtgtgggcactgagacttgttggctgatcgtctttaaatagcgaagatggccgttgaagtaatcaggttcagtgaggacggaaatagcatcgacgccggcttgttcgtaagcttgagcaatcgccatataaggaaaatccgccacgatcgttccttttgatggcgaagcttttttgacctcggcgataacgtgtaaaccaggctgctttaagatggtgaggaagtctgattttgtggtgggtggttgatgggcaacgatgcgtttgagttcagttaaggattggcgttgttggtggcgagcaaggcggattttggttgctgccacgagatcatctaagatcatgccaccacatccttacgtttggcagaaaaggcgcgcaggtgatttaattcttcacgtgccttcccagcgtcaatcgtttccgcagcgagagcgatgccgtcttgaatgctcagttccggatgagccagatgcagggcagcaccggcgtttagtaagacaatgtcacgttgcggtccgtgcttgccggcgagaatattttgcgtgatttgcgcattttcttcaggcgtgccaccgaccagatcggcgcgctgactgcgattgaagccgaattgttccggcgtcaccgtgtattgggtgagttggccagcgcttagttcaaccacggctgtttccgcggcagttgtcatttcatcaaggccgtcacgaccatgaacaaccagcgcattggtgacgccgagctttttcaggacgttggctaacggctcaagcaaagtttcatcgtagacaccaagcagttggcgcgttgggtgagccggatttgccagcggaccgagaatgttgaaaatagttcggaaaccaagctgctttctaacgggagcgacatacttcatcaacttgtgatattcctgcgcgaacagaaaagctaaattgttttcctgcaggctttgataactgacagccggcgtttcgttgatatccaagcccaaagcctcaagtacatcggcggcaccgctcttggatgaagccgcgcgattaccgtgtttggcaacaggcgttccagtcgccgcaacaacaatggcgctggtggtagaaatattaaaggtgttggcatgatcgccaccggttccgacaatttccaaaacatccttggtttccggaaaagcgagtgcgtgccgccgcatagaagctgctgcaccggcaatttcatcaatcgtcggtcgcttagccgttagcgcggttagtagactggcagtttgcacttcagacgcctcgccgttcataatttcatccaaaacagcttggctttcttcaaacgttaaatcttcatggttgacgactttttcaatagcttgtttgatcatggcgatccctccaaatttggttgttatagcgacttggttgttgagaaaaaaggctaagtgaaaatggccatcgtttgatttccttggtttgtttcatttttgggggacctcctttgattgttgagatgagtggttgttgctgacgcggtgaggtgcttcttcataacatgcttgcagtagcaaaaaaatccgtccataactaagaactctagttaaggacggattttccgcggtgccaccttagtttgatcgctcgagtcttcgacaaatagtctaacttaattgtctaaaaagagtccgattgatcacgcttagcgagggaccaacatccctccgacaactgacgtatgcctgacgtttccccgtactcgcgaactttcgggagaaccctccgtggtccatttaatcatctgcgttcgattgcactctcagcaacggcaactctctgtgcgcgcacaatgatcttgatctccacatcaacggtttttcatggacgaaatattaatgattgatttgaatattagagccttaccggaaaaatgtcaaggattttaattttcgcttgggtgttaatggaaaccgttttgttttagatgttcgtggtactcggttgccgccgatccgtccagagcgatacaggagcgaggcataagacaattagagcacccacaagataagtgtgactaaacgcgcgtgacaactgggtatttttacggcccgttattgcttgaaaagtcttttgcagcgtttgcttctgtgcaatttgtttgatgccgtttaaaaagatggtctggttcgtgttgatggtcatggcaccggtggccagcttggtgacactcactgacaggggtgagtggctttgttgcatcattttcgttaaagcggttaacccagttgtgaccttgatattagcgtggcgtaacgcggaactggtatcatatagtcgccttagatcagttcctgccgcggatttgggtagattggttttcacttttgctgcttgagcaacggcttgtttcattttttgttgctgatgagttgtcggcgtggatgagccggcgaaaactttcgctaattgctggtgggccacgcttttgacgtaaggtgagagcactttttccgttacgatttgatcgctggcatggtgaatctgggtcttagctgtgtcgatattggtatccagcaccgttaccaggacggcgatgcctaggcaggtgccgatttggcgggcagcgttgacgattccggagccgatgccgcttttgtttttgggcaggtagcgaaccgaggcgaccaacgagaccgaagcgaagccaaaacccatcccattgatgatgagcagtacgacgatgagtgcggtggctgtgtcggttttaatgagcgaaagcaggaagagactggctgccatcaccagcataccggtgagtgtgaccggaatcgcgccgactttggcaagcagtcgagtcgcaagcggcatggcaatcatgatggtcagtgaaaccgggataatgatcaaagcagcgtgtaagggactatctcctaagacgtcttgcagaaaataattcaggattaagcttggtgcaactaaggcgaaaccggtcatgaagtaaatcacactggatgcactaagcgttttttcccggaaaagattaagctccagtaacggatgccgaaccactttttcagtcatgatgaagacaataagtgctactccaccgccaattaaactggtcaaaatcagtggtgaagtccacccgtattggcgaccttccaacagcccaaacgtgacgcctccaagtgcagctgtcagtaacagtaaccccggaagatcaatccggccggcaagtgattcatcatacgattcttttgcgcacacagtaaccagcaaaaatgcgagaatggctagcggaatattaatcccaaaaatccaccgccaagaagctatttgtaaaatgatgccaccaatgggcggtccgccggcagctgccagcgcagtgacagcaccgaccaacgcagcgacctgattgattttttcttttccgtagacttcgatgcccatcggtaacacgattggcgtgatgatggctccgccaagaccttgaaaaaagcggaatgtaatgagtacgggtagcgagggagcggtcatgcaggcggcagagaagcctccaaacagagccagacccagtaacatgatttttttacgaccataacgatccgctattttggaagccgtaatcataaaaaccgacatggcaagtgtgtaaatcgtcatgacccaactggtgttcgcaagtgaaccgtgaagctcggtcataattttgggaatcgcaatattcacaatagtcgtgtccaacgtccccataaacatggcaatcgtcaggccaataaaacaaagtactttagtcaagcgcgtcattgcatcagatcctttcatctgctacatttgtgtacacgtgacacatgtgtgactttcgaaagcactttgagtatactggggctaaagataagcaacaagggtttggtgacaagtgctacaaattggtggtgtttgtgtcagttaggagacggtggacatgaatggaaaacaacgcatggcgcgccaatcaaaacaatggttagtggatgcattagtgacgttgatgaaggatgaggcgattgaagatatttcgattacggaaattgtccaaacggcggatttatcaagaagaactttttatcgtgcgtttaaaactaaggatgatttaattgattatctgtgccgccaactagcagatgattatttcaaaagtttaaaagcggccacccgcgatcaaaccccgattagttttgccaccacgatgcaaaactttttcacattttggtggcaacaaaaagaccttgtccggttgttgattcgacaaggtctgttcgatcggttgaatggcgtctggcaacaaaatgcagtcgcacattatcgtgactttccggcgccgtggcatccgcaaggtacggatcaagaggtcaactacatcatggcctttgcacttggaggcctcaccaatattttgcggctttggctagtccaagcacatccggaatccccagaagaaatccagcggtttgcacaggccagctttgcacaattagcgcggagtttgggtggtggtgaaaataacgagcctcatgaagcgcaagggtgatcgtgcggttaaaagaagaaattgataggtaaagttaaatcggcattactaaatacgagcacgccgtcagcagcttttcccttaggtacatcgagtatgagattgatcgtcttttcctcgctcgtgttgataacaggtaggtttgatggtgtttcaatggcaactttctgattattcgcggaggcggtgaagtaactcggtgaaaacctaagcggaatggcgtaatggttattatggaaagttagcgagatcccggttttattttcgggcatgtttggcaagtaggtggacttaatcgtgaataatagttgtttgttatgcccgtagtaagcaactttgcgaccgatcgcgacgggcttgctagtcatggcactgtgcgcaataggatatgtggatggaacagcgatgacttttttacttgtgcgctggcgggatgttgtttttaaaactaattttgtcgatgtagcgtgaagctttttcagcgtcacagttttcttttttgctttaccgctggctaattgctggttattcaggtcttttagcgagtatttagtgttgggtttgacttgaaaagttaacttaagagcgtcatgaacagtggttacttgcactttggttgcttgtggcgattgcgtttgtgcgtgcgctgcttgctgaggggcgaaaagactgatgcccaaaagaatggcgaatatagtgactgcttttttcacagtgatccctccaagtggcgtggatttatggtatgtggctaattatagttgaactttgactatgaaggccatctttttctaatcatatcataaatatttagagggattttctgtggctgatatttgtcttcaaaataactcaaaagtggccatcgcatttttaacaggtctgcaatggctgcttatgtgagttcttttaccaatgggaggcagacgcgatccacgacttcaaaacagtggaaatttgcatcacaagtagatagctattaaagaacaatatttcctttgacatcgcttttgacagtgaaccgtcaataagatcgttcgttttcaggagcatcggccttactagatgccttaaagctagagtgatggctgaaattcagcgagccaattgccgctgctgctagcagaccgagtagccaaaccatgataacccgtatgcctgacgcaagttgcatttcaggtaacgccgtagattgagcaatggtgccacttgcaatcttccaaacattgaagaaacttaatggcaaccacggaattggcggcattatcaatgcactggctgtgaccaacaagacgatagtagtcgttatccatgcatttttagcgattagcgctgtcacaatattgaacgctgtcactaacgcaattaaaagcaatagtagtgcaattgagtggaagatgagttggccgctggtagtaaagtcctcggcaaaactattcaaggtattctgataggtgacatttattactgggaattgtaaactgccaaaaccatttaggcaacctgtcactagtgttgtgagcagaagcggcaggaggacaatctccactgtcgtcaaaccgattgtcaaaaattggacagcgatctgtgtgccccagccttcaccttgtagccttaaccaattggcgtgtgcgcgttggtgtgctaattctttggcgaaaaggccacctgagacgataatgccgatgagtagtaaataaaacggaatattttgttggaataaatattgcaggtaatcaaacccacgaacataaaaggtcggaaaccactcgcggacaagttttgcggtttcagctggcattgtttgcagttcttgatcagtaaatagcaggccctgaggatagtagctactaagtttgtgctgagcaagaagttcattttggtgttccgttcggttaactgcatccaaataatctggtttggctgaaccattcaaaaccgcgattcgataattggcgccagcattattgttcgttgctgggcgttggccgcttaaaacgggtaattccgcagcaaaccaatgattataagctgctggtgaacggttgagttgttgcagttcaatcttcagagcggttggtccgttagcttggcttgcaccttgatgaatgagttcctgacgatatttctggataaattcattttgtgctgctttttgttggaaattaccggtaacgccaattccggtcaggatggcaacgagtagccaaacccaccagcgttgattgcgtttggtcaattcaaatttcaaataatgaaaaaacatcgaatcacctccgaactcgggcagcaagcatactaagaagttgccaagtaaaataaagaatggcaaagtgtacaatagacatcatgatattttcttggagcagggtttttagaggttgcgcatgatcagtggccgtattttgccaactgtgagtgccactgataagagggcgtccccagagtttactgatgagtagaccaagaccaagcattatgaatagcatcaccagccaagtcatcagaataaccagaaaattcatggctagccagttccgatgattaggctgatttaaagtgacccatttgtgttggttacccacccatgacaaagtccaagttgttgacagaatcattaccatcagtaagagaacggcccaatgtttgatcaagtgactaaagtcggttaggaaaatagcaggaagcgttgcactgccattgatctcatatccttgatgagtagctactaatttccggaaaaatattgcctgctgccgattgaaaataagatcggcgctaaagtcatctgggctaagcttctttaacaacgcttcctggtgaaagactgctaagctggttttcaaatagttgcgattgtcatgacggctcagaaattgttcctgttgggtgtataaacgcgctaagtgacgagcatggcgcacttttagttttgcctgtgcgacttgatccgggctggtttcatcgggatgggtagcaatatagcgccaattgccatcaacccgacttaatgcggcttgtttcgtttctatttgtacgtttaatgtttgatacgtttgatgttgccggacacgactcattaagaagaaagcaacggcaatgatgacggcgagaccaagcgccaagctcaggacaaaacttgcttttaagcgtcgccattcaagaacgaacagtgcctgtttcatcgagatgttgcaaagagcgcattatagcgtgcttctgcagagtcatttggccccagtacttcttcatgaatttgttgtcctgtaatgaagaaataatgctgcgtcactttcatcaattcatccaagttatgtgacgaaatcaagacagcgacatcttggtgcgcaagggtaagaatgacttcacggaccagttgtaggctagtaggatccaacccatttagcggttcatcgagtaagagaatggtaggcttaaccaccaaagccatcaccaggagtagtctttgtttcatccctaaagaatatttgcccacacgttggtttaagaaatcggtcgtttgcagctgatcagcaatggcagcaacagaccggggattcagccgatgaactgctgttaagaaatctaaatgttgttgcccggtcaaatagggataaagaaccgagttgtcttggagataggcaactttttgaaaaatcaactggcttgttatcggtttgtccagcaactggattaagcctgattgcggttgtaataagccggtgagtaagttcagtaaggttgttttaccgtagccatttggggcgactaagctgtaaacgccgggttgtttcagatgcatcgttgcgtgttgaaagattgtttttccgcggaatcgaaatgtcagatcgtggatagccaaaagcatataagtcccctccaaacaaaatgcgttacatagcgaggctcaaagtaatggtatacataccttgcaacgttgataagccgtgacgataagtttggtgaaaggttgctaccatttgcaaaagtgactgataacacatgtttaattgatgtatgactatgctaatattaacagcatacatctcaccaaaaacccatcagcaaagaatatgacaagaatcatatttatttagttaacaacagttctaattttaggaggagtcgtgatgactgatgcagaatgataacgttggggcttattttcgagagattcgtaaacgacgagaattaggaatcgaacaagtgcgaggaaatttgcatcaatcaactatttcgcacttcgaacgcgatcatgatgacattactgtccgcaatttacttcagatccttcagccgacttttacaacacctgaagagttttgtttacttatcaatggtcaggatgaatcaatttccagtattctcaagaatatatctgaatattacgatcaacttgacatcgccggtttaagggcattttcagccgcatttgaacaagcgcaccctatgactgcacctgttcgcttgatcttgttgattcttgaaagttgtgtgaaggaattggcaggtgaagatccccttttgtcagccgaagattgtgattatgtacaagattatttgttgcagccagggaaatggtttagttttgagtatgttgtttttggtaatcttgcctcatcactacccggtgaagttaacttgcgactttggaagaagatgttgacttcttttcgtgagtttcacttggccacgtacgatgaactgctcgtcaacattttgtacaatgttgctgcttcttttttgagtcaagacgatttgtcatcagctgcgtatctcctgcagtcgctggatttatccaaggtagatcattacgttctttatgttcgtcatcatgttgcttttttgaagctagttttgagttatcggctagatccccaaaataagcaaaataatgagaatctcaaagtattcttattaggcactcgaatagttgatgaagcacttttcaaaaagaatgttgatgctttgaaggaactgaatgttgatgttcatacaatcctgccatcggaaacgtgaacaataggtactcctgatgactaggagataggttgcgcaagtggtaccaaaaaagcgctgaccagcctctctaggccaagtcagcgcgttctttttgtttacaggaaatttttccaaacccacaaccaaatgatccgctgcctgaacgtgcaatatagtcacaactgatcaagccagtcaaaatggtgtaaccacttatcttgcgaatagataactcgattctaaaagggggttttgattctcgttattcatcccagacgttccactaaaatgccattatcgtcgatgctttcttccatcattgctttacgtaaatcgtagtcggaattactctcgaagatactatgcttaacggacaacagactgatgacaccattttcggcaatgatgggctaatattcaacatttctaccaatattaaatgacgcggaaactgtaatcatagttgaatttccgtgacggcgctttttaacagtcatgtttatcgttctttcccatgccatgaccatctgtgcagtttttttgtatcaaggtgttagccgaattaaaacatatagttgctcttgtaagtaagagcggtttgcgctattaatacattaaaaagggagtggattgcttatgacattagaagttgttcctttttcatccgcatcatccgaaattgatgggttgaagattattcatgtgaagatggtgacggatgagcgcggaacggttcgagagctgtttcgccagagccagcattcgcaagtgttagtaaaccctaatatggcttggaaacaggtcaatttgacccggactaagcgcggggctgttagagggttgcatggtgaagcgatgtcgaagctcgtcacggttgcccatggagaagcatttggtgcctatgtggatacaagacgggacagtcctactttgggttccgttgtcacggttcgtttaacgcccggtgtgcaggtttttgttcctcaaggcgtttgtaatgggtttcaggcggttgccgatgatacggaatatctttacttcttcgacaacgaatgggaaaaggggatgagcggtgtggcactaacacctctggatcctgatttggggattgagtggccgatcgccattaagcctgataatttagcgcaaatttcaaaaaaagattccgaggcgcctactttgaaggaagtgctgaaacaactggcagagacgcggccaaaggaataactagcagggatagcgactgccaacccgggtacatagtttatcaagtgacaggtacaaaatgtgatcctgagacgtcttttgataaaacaaaacgcgctgacccagcttttttaaaggtatgtcagcgcgttctttttgtctacaggaaattttccaaccccacaaccaaatgatccgctgcctgaaccttgcgaatggcaacggcgactccttgcatgaagctttggcgatcgaaggagtcttggcggatggtgagggcttcaccgggaccgccgaagaggacttgttcgtgggcgatgtaacctggtaagcggatggcgtggaccgggacgtcatcaatgcgttggccacgggcgtcgttgtcgatggtggacaagggcttttgggtgcgtccggcggcgattttgtgcgcagtggcgatggcggtgcctgatggagcgtcggccttatcctgatggtgcatttcgatgatttcggcatcagggaagtaggcggcggcttcctgtgcgaacttcattaagagaaccgcggaaaggccgaagtttggggcgattagaccgccgagctgacgggcttgggcgagttcgattaagcggttttgatcggcttgcgtcatgccgcttgtgccaacgactgggtgaatgccagctttgatcgcagcttcaatgttggcagcgacggcagtggggttggtaaaatcaacccacacatcggcaatgtcgggattgagctgatcatagctcgtgagcacttttgtatcagctggtagtccatatttttgggcatcagcggcagttgctttgggatcaaaaacggcacttaatgcgaaatctttttgtgactggaccattttgactgttttttgacccatggcaccgcgaaaaccggcgacaagaacgtgaatcatgcaagcacctccgcttcaattgctgatagttccgaaacccctaatagatgggctaattcttgttgttgtgccgctgttaatggcagtagcggtaaacgcgggctgccgactttgaatcccaaagcattaagtgcggctttggtaggcgctggggatggaaaatggaataacgcggccattttcggtaacagttgccgttgtaatgcggctacagtggtgacgtcaccgcgatcaagcgcacgatacatttcccggatgctgtgggcatataggtgggaggcaactgaaataacgcccatcccgcccagtgttttgatcgtcagcgcttgagcatcttcgccggtccagacgttgaaggcatcatgtttggttcggtcgatgatatcgctgagtgctgccaaactgccgcactgcttgatcccttgaatcatggggttttgtgccagcgttgccacagtttccggtaacatgtccacgccggtccgtcctggaatgttgtaaataatgatcggtttttgcgcacttgccgcaaccgtggtatagtgcgcgatcatgccattttgatccggtttgttgtaatacggaaccacaaccaaagtagcatcaattccggcaattccaccgacttcatgcgtaaaatcagtggtttcgcgggtgttgttagaccccgaattggcaatcacgagtgcgcgcccgtgaaccatggccacaaaacgggtgtaaagggtgatcttttcatcatgactcaacgtaggcccttcacccgtcgtagccccaaccacaaacccgtcagtaccttgatcaatgagatgatcgactaaccgttgcatactatcatagtcaatttcatcgcggtcgttaaacggtgtcacaatcgcggtgattaattctgctctttgcatttaaaaacccccctgagcgcgagccggcgcggttagaagtcggagtgtaagcggccttaagcgtgatggcccggtcttggccattgcgcttaaggtccttatacgcagacttctgcgccggggagcgcgttaaagtgagcgcgagccggcacgattagaagtcggagtgtaagcggccttagccgtgatggtcgggttttgaccattgcgacccaggtccttacacgcagacttctgcgccagcgaacgcattatgctgaatccaactggcaagccatcaccaaaaaatccgtgactgcccttgcacactatcaatcaagaccctcaagccgcttccgccatccgatgcgtcagaaaatgaatgatagccgtcacacctggcgctagagctgcttcatctggtaaaaagtcagcggcgtgcaactgcgaatccggatcattcacgcctagccaaaacatggtgccaggaattttgtttaatagataaccaaagtcctcaccggtcatgactggatcggttggcacaaaggtcacggctgggtcggcttgcatgaaatcaatgaaatcttttgtcaggtgcggattattttcgacgggataataaccgccttgattcaaatcaactttgacttcgcagttgaaactagccgcgatgccttgaccgatatcccgaattcgctgttgcaagaaattaatttgcttttgcgtgaagccacgcaaggtgccttctagatgggcgctgccggcaatcacgttgcggatggttccggcgcgcatgaggccgaatgtgatcacggcgctgtctgtggggccgacattgcgagcgacaaccgtttggatttggctgatgaaactggccgctgcgacgatcatatcgttagcattttgcggtaacgctgcatggccgcttttaccgattaaatcaacgttaatctcagtggtgccggcaaaaagcgttccgagccgcgtgctaatcgtaccagcaggcaggtcaggccgatcatgcaggccataaaattcatcaatctgccactcaccggtgaaagcgcccatgtcataagccagtttaccgccattcttgctttcttcagccggctggaagaagaaaatcagatgatcctttggctgatgaacggcaaaataactgagaatgccaagtgccacggtcatatgcatatcgtgaccacatgcatgcgcaatccccaggtgatgcgaggcaaacggcaaaccggttgcttcggtgaccggtaacgcatccatatcggcgcgataaccgatcgtgcgttgcggatcggagccagtgactttgactagaatggcggttggcaacttcggtaaggtgcggatggtgagaaaagtctgcggaaaactttggatggttttgagcaggaaagcgtgggtttctttttcctgcagcgctaattccgggatttggtggagctggcggcgaatagcaatgagttcggcttccttcattaaatgtcacaactttctgagttcatcaagcagcaccgtcttagcttccgtttgatcgttgacttttttaatcaccttggctgggacaccggcgacgactgtatgggcaggaacgtcattaatgacaacagcgcccgcagcaatgacagccccttcgcccacggtcacgccttcaagcacaacggcattggcaccggtcatcacgtgatcaccgattgtcactggcttagctgacggtggttccaccacgccagcaagcactgtgcccgcgccgatatggcaatgtttgccgacaatggcgcggccgccaagcacggcccccatgtcaatcatggttccggcaccgatttccgcgccgatgttaataatcgcgcccatcatgatcaccgcattgtcaccaatcagcacctgatcgcgaatgatcgcaccaggctcgatacgggcattggttgttttgatgtccaataatggcaccccggtgttacgaccggcagcctcgacatagtaatcatccagtttagcggtttttaaaacgggctgaatctctgcccagtcaccgatgacagtgcccgtgtgtttgccaataaatgcatgaacacttttagggaaatgcaagtcggctaatttccctttgagatacactttgactggcgtggttttcttgctgtttgcgatggttgaaatgattttttcggtatcgagttgtgccatgatggcctcctatttttttgcgacagtagtggcggttgatgtcggcgctgattgacttggggcggtgtagtgctgatcgtgttgaattaaatcggcgtaagtttcacgcgtgaccactagctgtgcttggccattttcgacaaaaacaacggctggacgcgggttgcgattgtagttggacgccatcgagtagccatatgcgccagtgtcgaacacggcaaccacatcgcctgggtgtgtggccggcagcggggcatcatcaatcaaaatgtcgccggattcgcaatactttccgactaaatggacacgttctgtgggctgggcagtcgggtgatccgcaaccacagcagtgtattgagcctgataaagggcagggcggatattgtcgcccatgccgccatcaaccgcaacgtaaggccgcaagcccgggacatctttgcggctgccgaccgtgtacagactgtagccggcaggaccgacaatcgagcggcccggctcaatccaaacggcaggcaatggccagttaaaaccgtggctttgggttttcaaggtggtcacaatcgcctgcacgaaagcttctggtggtagcggatcatcctgcttggtatacgcaatcccaaagccgccgccgacattgaggactttaggaataaagccgaattgctggtgccaatgatcaaggactgccagcagcttttgggtgacggcttcaaacccggcgacttcaaaaatctgggagccaatgtgggcgtgaatacccagcaaattaagatgatcatccgccagaatacgcttggctgcttcatcggcttgcccgctttcaagatcaaagccaaatttactatcggtttggccggtttgatcataagcgtgtgtatgagcactaatccccggtgccacccggatcaagacgttttgcttgcccacggccgcctttagcaactcgtcaagcaggtccaactcgtgaaaattatcaacgatgatcgtgccaaccccggcgtctaaagcttgttccagttcggctttgcttttgttgttaccgtggaaactgactttgtccatagggaagcccgctgcttgagccgtgtataactcgccaccggaaacaacatcgacatgaatggcttcggctttggcgacctcgtacatcgcgatggtagcaaacgccttggaagcgtaactaacggcgtatgcaacccccgcagtttcaaaaacctgcttgaacgcccgaatctgatggcgaatggcgccaacgtcataaacataaagcggcgtttgaaaagtgtggacaagttgactggcaacaaccccgccaatcgttaattgaccttcgtgatttgtggcaaaattcattcagttcatcctcccgagtgatggcagggcaacggcaaacgaaaagggacccttttgtttggccgcgcgtcaaacaaaaagatcccaacttgcaatctacttgaatgatagcgccccgcttagatacctaagcgacagtacaggatttatttaaccctggcccaacaggctcaccgatcccggatcacccatttcggcaaccgcccctttcaccgaatgtcaccacgaaggatctcgctcgattcggttagtcatgttggctgcaacctctatctgtttgacaccacattataataaaaaacggtacgcgtcaaatttttgtgagcgcgagccagcgcggttaggagtcggagtgtaagtggccttgggcgcaatgacccgggcttggtcattgcgcccaaggtccttacacgcagactcctgcgctcgggagcgcgttatgggagtaaaagcgaactagtgcccttagacggtgatggcccgctcttggccattgcgaccaaggtccttacatgcctgctcagcggaacgcgcgttatggtgagcgagagtatctcttactcagagaccaaatataagagcctcaaacatggtggctgacgcttactttctatttcttcagcgcgaacagtgtgactgtattccaaagaaccatcttgaaagcctgattcccaacaacccactttcaatccgccaccccaatacctagcaaaaaattaaaaacatttttaagctcattattactatgcaatggcgtcaaaaaatgctgttttggcgggatggtgggggcttgtgtttctctgggagtctgttaaagtacagaataaaatgacagagttctcatttgcattgccgtctgttgatgccagatgaaaatcacttacgcaatcgctgtcggttggtgattggcaaggttgttggcgtcaaggatacactggaaaatggggttagggaggcagtttatcgtgcgtgtcgtaaaatttggcggttcgtcattagcagatggagcgcagtttgccaaggttgtggcgattatgaaggcgaatccggatcggcaggttatcgtaaccagtgcgcctggtaaacggcatcccggcgatgtcaaggtgacagacctgctaatcaagtacgcccaagcggtgttgcagcagggtgaaacggctgcaatcgttgctgaaattgtggctcggtatcaggccattgccacggcgttcaaccttgacgcgcaagttatggaaaaaatcgaaaatgaactataccagttaccgaataccagctttaaaaatgccgactacctaatggctggcttcaaggcacgaggcgaaaaattaaatgcttttctcatgacggcagttttgaaccacgaaggtatcgaagccacgtatggtgaaccgaaaactttaggaattgttgtaactgatcatcccaatgatgctgaggtttcacgtgaaacttacgatcgtttggcggcatttcggcggccactgggtgtgctggtggtaccgggattttatggctataccagtgatggtgatattgctactttttcacgtggcggctcggatattaccggtgcgattttagcaaacgggtttcatgccgacctgtatgaaaacttcaccgatgtagatggcgttgcggctgctgatccacgggtggtggcaaatccgcagatgattcaagaaatgacgtatcgggaaatgcgggagttgtcatatggcggctttggcgtttttcatgatgaagcgattctaccggccattgcgggacagattccgattaatttaaaaaatacgaatcatccttctgcccctgggacgatgattgtcccggaacaacattttgtgccgaaacatgcgattaccggcattgtcagctcacaacattttggcgcgatctatctgcatcgttatttactcaataaggaagtcggatttacgctcaagctgctgcaggttttggcgcgacatggcatcagttatgagcatatgccaagcgggattgacgatttgaccattattttggatgatcggcagctcacagaggcgaaacgtaaggccatttgtgctgaaattcaggaagttgtacacccggacgttttgaagtggattgacgattatgcgattatcatggtggtaggtgaagggatggcacaacgaaccggattgattcagacgattttgcagccgctagcgagcgccggcgtgcatgtgtcgatgattaatgaaggggcctcccagatttcattgatgcttggcacatcgcgggaatcggcgaatcgagcagtcaaggccatctataacgcctttttcattccgatcaatcagcgtttggaggtgcagtgagtatggtgacattacaaaaagttcatggctctgaaaatagtttctttttattagatgaaacgcaattgaaacagccattgagcacaagccaactggcagcttttaccaagcaggtgacgaatcgccaaactggctggttaggcggagcagatggcgttttggcaataacggatgcgcccgggactgctgggaaaatgacggtggtgaatacggacggcagcctggctaaattgtgtggcaatggtttacggacagttgcccgctatctaagtgaaaaaaccggtcaatcagcattcaaggtgcacacggattttgccgacctggccgttgcaaaacagtcgccattagcttccggtgttccggcatattcagttgaaatttcgccagtcagttttgccgctgctgacttgccatttgccaatcttggcgttgaccgcatcgttgacactgtcttgccggctatccatcctagtttgaagtttaccgcagtggcagtacccaacccgcacttaattgcatttgtgtctaaagaagaactggtcagtcctgatctggagcgaattggcaaaatgttaaatgccaaaaatccgtattttccggaaggggttaacgtaacgtttgccgaaatcttaggtaaggacaccttgtttgcccggacttatgaacgcggcgtcgggttcaccaatgcatgtggcaccgggatgtccgcaacgaccttagcgtttattctgactcatccccaggaggcggcgtttgagtgcgtgaataccgtgtataatccaggcggcatggtgaagacgatggttcatcatgaccatgggcgttactggatcgaactcatcgggaacgcaaccgtgacggcgacaatcaccgtaccggatgaagcgcttgaaagtggtaaactgacacaagcaactttccaacccactggcgagcaggcggcttatgagcagttcattgactcattgccgcatcgagatttggcagacacattaatagaaggagcataaatcaatcatgagtggttatcacgtagcagttgtaggggcaaccggcgcggtcggaacccggatgttgaagatggtcgcagaaagcaagctgccaattgcgtcagtccttgccttggccagcaaacggtcagaaggtaagacggtaccttttcgtgacgggacgttaacagttcatgaaacaactgatgatgcgttcaaggggattgatattgcattattttcagcaggcggctcggtttccaaacgttttgcccctgcagctgttaaagccggcgccgtggtcgttgataacaccagcgcttttcgtatggaacccgatattccgctggttgtccccgaagtcaatccggaagccctgcgcacccaccacggcatcatcgcgaatccgaactgttcgacgattcaaatggtgaccgcacttgagccgatccgcaaagcattcggcttgaaacaagtcgttgtttcaacctatcaggcagtttccggcgccggacagtcagccatgaatgaactgtttgatgaaacccaggctgctttggacgataaacccttagagcctaaaattctgccaactgctagcgacaaaaagcactatccgattgctttcaacgccttgcctcaaatcgatgtcttcgaaccagacggctatagtcatgaagagtggaaaatgattcacgaaaccaaaaagattatggcgggcgacatgaacagtgatgcgatcaaagtcaccgccacttgtgttcggattccagtaccaattgcccattccgaagaagtttattttgaaattgaagacgctaacgccaccgccgacgacattcgcgctgcattaaacgatgcgcctggcgttgtggtgcaagatgatccaagtcaacagctctatccgcaagctatgaatgcagtcggcagcaaagaggtcttcgttggccgtattcgcccggatgctgaaaattctcggttcttccacatgtgggatgtttccgacaaccttcttaaaggagcggcatggaactccatgcaaattgccgaaacgatggatgccatggggttaattcaaccgaaataacgaataagtttaataaagccatttgcgtagtgcacgtcaaaacactaggcaaacggctttttgttttgcagcggggggacaacagacgtaacatgccagcgtcctctgtaaataacgcctctaattcttgctagaagcttaagatgctgccaaattgattgacggatttcttaaaataactatactgatgaaaaacgagtataggagcatgttacatgaaaaagcatcgtttcgtcatcgcattgatcggcttatcacttttcgcagtcagcagcactgttgccgtcgatatgacgcaagccaatatcgatcagcaggttgtccaatacacgttgaatggcaaggggctagtcatcttcaaccaggcgcgcacctatcgaacgaaaagcaccgccgcagtttataaaggctccttcgcggcagacgcaccgacagcaagcttcaaaaaggtcggcaacctgaccaatcataaagattatcgagtaacgcgtaagataacagccaaggctaagttgaaaggatcggccacgcagactttttactatgtgtccgggcacggttgggtgaaaggcagcgacttgacgcgatcgtgaactgtgtcttcaaaatcagggaaatccgtgtagcaacgcagctaagattgcgtgaatctgtacggatttttctttttgactagaattggtatataaaaattgttgacctgcctgactgtgaacgatacaatcaaactccgactttaaaaaatgaagaggtgatttgatatggtaaacgtttactttggcccaatcccgcagagaccagactcggtgctggtgttgcagttttatcatggcagactcatttgggtacataatgtgaaacggaaatgggagctgaccggtggtaaattggagccaggcgagacggttattcaggcggcggttcgtgagtcttacgaagaatccggcgcaatcgtcgaacccagtgcgatttcgtcgttgggctactatgttttgccaaccggccatgtaacggcagttgtacaagcagaggttttacgtttagaggcgatcccgatgacttctgaaaccgatgatcgccgtttactctttgcaccattaccggatgcggaacaatcttttcatgatcatatttatcggcaaatttttcagcacattgggtggccccatgagtaagcggcgcgtgggcttgttacttaatcttttgtcagtggctgtgatggcagtgacaccggtgatgaacaaatggtcgatgaacaccctgtcgccgctagctgcaagtttttataacgcgcttgtttcactcggtttgacttttatcacgattggtgcaacccatacaaaattgatatgggtgaaaagtcccgttatttgggtattgggactgaccaactgtttaggcattgttttgcagtatttgagtcttttctttcttgatccggtgagtgtcggattgatcggccgcttctatattgtttttgcgattttattgtctgtattcttgttgcatgagcggtttgatcgccgagaaatagtgccgattgggttatgtattgccggaacagcgttggtatccgatttctccgggcgtatgactgacatgctcggactggtttgtgcgtttggctacacgtttagttttgcgttaaccaacacgctggcgaaaaaagcattggcgcgtgtcaatgaaaaaattttgcttttgtacaaccaagcaaccgcagtgatcatactcggcattgttgcagccggcagtggcaagttagctttttcgcccaacgtgggtattggtgccgttgcggtttcggcgttttgctccgggtttctgggactgctgctgttttaccgcggacttaagttcatctcatttcgcgatgccaatttaattcgcgcactaaacccagtatttgttctcgtatactcattaccttttttccggattcaaatgacgccggcgtttatactaggcggcgggttgattgtcctgtcaattgtctggatgtctttgccggtgaaaaaacgcccagcgattgggaaggaaaattgacagtgagaccgctatttttgctaggcttttctgaaaatcaacgttaaattggaaaaacccgacgtttatttggacgatgccacaacttcatggaattattttacactagggatagttagggaaaaagggtacctaaaaagcagtttaacagagccagcggttgttgaactggctagtcatcttggaagaaaagacaggctcgatcttgaagaagtttaagttggaaacaacaaaaatatatctttattattatgcttgtcagcaggtaactcgatcggtccgtctcacagtatggttgggttaggtgtcacgttttttggagatgaatacttatcgttgatttaagggaagacatcatcgctacttgcgtttttacggtatttctattttgcgttgatataatcctaaaggctccgctgcagattattagaaatctgttcacggggctgcttttcttcgtgattatgttactagttcaatatttatgccgtaaaaaacatgatgttcatgaggagtcttgagggatgactgaacgatggtttcaaaaatcacttgtctcacaacgaagcgttaacgtgaaatcttacgttgtcggatactaaccgttgataatatcttttgttagatttaatatcaccccaaagtttagcgttgctttcattgcttagatcaatgattgaataaggctgttttgaaaaggggattgatttaaagaaaaccaaataatgtttatacgtgaaggccatgctgtacgcagcggccttcttttttcgagggtaggaatgaacgtaactgatttttgcgtttgggtatttctttttaagtttcctcaattgcctttttgttggtctatgggtaagaactaaatgacgttgcggttttaaaaaggggactcttagacggagaatttgagggaaatctagtttaattactttttcgatattgtattgtgcccgtaactttgcaagctttttaattttgggagaggacaaaaaaagaatttgtctagacgaataaccaggacatccatataaaaatattccaagaatggttaatactgaggctggtgaaaagacaaatataagaaagaatataaaactcagaatagttgacagtctatcaaacatgtttccagcaaacacttcacccagtaacattaaacttgcgtaaacgcctagggtgattctgataattaatatcatccttttttcgaaaggaattgtcattaacaaaaccatagattggtgaatgataccaatgtaatctttgaaagagatatttgagacaaacaatactagctccccttttttaagcagaaatgattccgcttatcgaatatatgacaatttagacttagctcattgattagtggcatcttcggctattcagatgatttatcaggaacacgccgtcaaagaggcaaagggtaaagttaatgcaactcgagttaagtgaattctaacatgaaatcgtcatttcagtacattcaagaatgtacagagtaagacctaaagagtgaaagttgaatatccgcagaaagtcccgagaaatcgggactttttgacaccaaaaaagacgcaaagcactccgcgtcgtataattaagttgaccaaaaccaacatacaacggagtctttacatccatgtttactatacaacaatcaacccataatatttagctcaaaacaaaacatttcttcaaattggtccatctttctgaggcgcttcggcaagcaaacgcgcaaaaacacaaaggtatcaagattgccagcttgtttcagtggattatcctgtccatctttcaacgttactcactgcatcgagctgaagccaatccaaacttttcaaaacggacagcccgtaattgcttgaatgatgctcgaatcaattggcagcggctggttctactggtagcggttcgtctgattcaatatttccatcaatttgccgcagccggtcgtgatcaagccttcgtcattgacgactcactatttaagcgcgagttctccaagaagaccgaattactctccaaagtattcgatcatgaccatgaacggtactataccggccttcgggctttgacactaggttggagtgatggcaatacctttctgccgctcaactttgcgctgatggcctcaagcaagacaaagaaccaagttggcctgcaaaagccttatgatggtcgatcacttgcggcaaagcatgccagcaagcccatcgcaaaatgaacctagtggcacttgaactggttgattaggcgattaaagcaggtgccaaggcacattatgctttatttgatagctggtttgcttatcccaagatattccatgaactgcttaaacgcgggatcaatggcatcggcatgatcaagcagacggagaaagtgtattttcgttatcgtggacgagaaatggatgttaagcgactctacgccacgttaaagcagagtaaacggccaacgcatcagcattatctgtacagtcccattgtgcaatacgatatggacggtacaaagatggtcatgaagctggttttcgtgactaaaaaaggtgccaagggtcgcttcttggttttagcaaccacaaagactaatttgcgccccgaacgcatcattcagatgtacggcagacgctggcaaatcgaaggctacttcaaggttgctaaacaatatctgcgctttgatgcgacacaagtacgtggctatgacggcctttgcgcacatatggcaatggtcatgatgagctatgatctacctgccttatgtcaacgtgaagaaactgacgaacgcacgctgggtgacttgttcttctactatggaaaagctctacctgatatcggcatttcgcaagccttggattggctcatgacacaattaattggtatagcgtcaacttatcatgaagcccaagtggtcattaatcagatcatgagtgaattcatgcaaaaactgccgaagagtcttgcagatctcttcggcagcgcggcatagatagaatttgaatatgattttgtggatacactctgacgcagcggcagtcagagccatttttgtgctttcactctttagttcaatatttacaccgaaagagaacatgatgttcatggggcatttcgattgattgactgaacgatggtttaaaaaaagattgtatcacaacgggagaattagcttaaaattctgccattaacgggcactcaaaaagcggtgaataatttcggtgttcagtcaaggaatgcaagaattattcgccgctttcgtctgatatatgattgatagcgtgtgaactgtgatccgtcttccctcgctgaaaaaagcgcgacggcctattttccccatccagtcaggattgcatgaatgcccatcaaaaactgctcgtcgtcggtaaacttctgattttctatcggttgcatgaatgtttgcagtgtttttgaagggtgacgtggtgtcacttgtccttgcgattcggaattatctacagtctgaggattaacggcttcggtccaaacaaagccaacagtataggcggtgagcgaattaatcaggaacacggtagttgactgaatcttgaagcctttttttgtccaggctgttaaaattttatcgactaatgcgaactcagacctagttgctaacggacggcttgaaattaatggcaggacatgcggatgcgctagcaaggtttggcgtaaacgggtcattaagtgaatgatttgttgctgccaaggttcatcggcagttgcggggtcaatggttaatacgcttcgccaaagcatctctaccacgccatcaaaaagggcttcctgattaggaaaataccgataaacggccattggcgaaacggccatttcctgtcctaattttcgcatgctgaacttttgcaggtcctcgcgatctagcaaccccagtgcgacttgcagaatataggcatgacttaatgtcggtttggttggtttgacaggtttcacggttgatgttccttctttcaatttaagacccgatcagtgaaaatatacccaatataaccctgacaatcaagcaagactcgcgttcacgtagatggtcgtgaagccagagcgtacgatgagtgtcagggttatttgatgtagcaggtatatgtaaccaaaccactttcctttattggtgctggcgaggtcagccgcagaatcgatgtgatcggagatggtatgggttgaccgtgcgcctagacaatactgcgctttttttgggcgatcaaggccgtgaatacacagatgatagtaaagatagggagcatgatgagcgctgaaccaagtgtgcgagcgccatccagatattttcccaaagttgcaatgtaatgctgagggaaaaggtattgaaggcgggcctgtagcgtggcttttttaattgagaacaaggcgcctgataacatgaatgaaaggacgactagaattgttccaatgcccatagctccttgtttggtacgtgtcagcgtcgcgatcataatgccaaatgtggatgcgaagatacaaacaaggggtatcgttgcgaacagtgtaccggagagtttaataccaaatagtggcaatataagcgccgtgatgggtatgctcaagcagatgagaatggctgcattaaaaataatgtgctgaagtaaatagctttgatgagaaagcccgcttaaatagatgcgctggtcaataccggcacagtcgtcaaaatagaacttatacagaattagcgacaacatcatgacagtgattcccaacatactcaggaagatcttgaaatgatgagtgcctgaaccagcaactttggaataggtgccgttattcaaataggcagttagttgtcgcttcaaagctgagctgcgaacggaggttactgtgtaatgtcccgcttttttggaaacataggcatcatattttcccataattagattctcggtgatgtcgctggaatcagtgactttcgtgaacactagctgccgtttttcaattggggccgcttgcagcagttccgaggcactggtagatacgccgacatcaactttgggtgctttcatggtcactgcaaatgccgttgcggctgtcatcacaatgagaacgagagcagctatgaacaaatatgcaggtcctttcaggaaacgcatggtattatttttgaaaattaaaagtttcatctttatccctcaaatttttctggccgatacagcatatgaatgatgatcaaaaagacacacgagccggccactagaattgcaaatgtcgtaatcgactcctgaaagttatggtcgtaaatgattgcaaagaagacgtcagaaacttttgcaatcggtgacatgtcggcaattgctgcaatttttttgccgaatattttcattggaaagaagagtccggagacgatagcaaatacgttaatgacaaggtttaacagattcgttgagagatcctcgtttcgcaagatgacgcagaatgcgccgccgaacgtaattgcgaaaataacaaacgcgagatccagcaatagcaacggaagaatctgactgccgccaaaattaacgaatctgatagcgttgaacagtaacatgtaagctgccaatatgccataagaaaagccggtagcaactagtaatttagaaagataaacttttgttcgcgcaatgggagtataaatgatacgattgttggcgttttttacacgactaccgaatagcatgtctggcaaaatgacaaccgttgccatggataggtaaatcatcatggtgacaccataataatcatatgaggtcagcacatcatcgccaaagatgctgttaaaaacaaaacctgttacccagattagcaaaggcgggtaaagtaagagataggtcataatcggtttgtttttcagaagatgcaagcaatccaaacgcataattgtgaacatggcgaacctcctcttagtcgcgtaattgttttccagtgagatttaagaacacattttcaagattctgttcttgtttagaaatatcggttagcgccagtccatgctcggctagaaaagtgagggcttgattaagggaaccggtatttgccatgcttaatagcaggctgttttggccaaccgatacggctttattaatgccggccatttgctctagtatcaccgcatcttctgcagttgggtgtccggttagtgtgagttgatagctgtcatcaccgaatttttttaaaatagcggtgagttggtcattaagtagaatcgtgccaccatccatgatgatgacccgatcacagatttgctggacttcttccatgtaatgcgtgacgtaaatcacagtggcaccatggtttcgtaatgttttgatggactcaagaatgtggttacgtgattgtggatcaataccgactgttggttcatcgaagataatgagttgaggttcatgtgcaatagcacaagcaatatttaagcgtcgtttcattccaccggagaaagtggccggcttgtcagcttgtctttccaaaagaccgactttagctaatgcattttcgacctttttacgcatctcttggcggtggacgccgtaaagtgcagcaaagaatttgacgttttcgtaggcagagatatcctcataaagcgcaatgtcttgggggacgatgcccagtttttgcttaacctctttacgcggcatttgtggattgttgaaatatacaatcgtgcctgagtccgctttgagtagcgttgaaataatgttaatggttgtacttttaccagcgccgtttggtccaagaaaaccaagaatttcaccgtcttgaacagcgaaattcaagtcgaccagtgcttgtttaccggttttataggtttttgacaaatgctcaacttttaaaatagtcattgatcaagtctccttaattttggggggagttagcgatacatcattgtttacgtcgtattccgtgtttacagtgtaatcttatgtttgaaaattagctagctaaagttggtaataaattggtaaaaattgcctgtcacgaacggataagttctcctaaaccctttgaaaacgcgaaaagccagctattaaagcgtcaaggcccaaatgaatcagttcctgcgtgctcttttacttccttgctgccagaatccgcttgcacagtatggtagaatagctaaagaaatccttaagtatctgcgcgaagtgaaagcgagtttttctatatgaagaaattgtttgaacggatccgtatgcctgagtttctggaagacatgcggatgcggtatgcagcgattgcgatggttgttttggcagtcatcggtattttaattggcgcgttgattcggccttggttggctttgttgatgctgctgattttgatcagtctggtggcaacgattttttatgcccttgagacgattgccaagaatacgaatcagtatatttcagatctcagttatcggattaagcgcggggaacaagaagcgctgattaaaatgccgattgggatcatgatttatgatgaagacttgaatatcgagtggacaaatccgtttctgcagaagtattttggcgatacggatgtgcttgggcagccgctggaaaaagtcgatgctgaattggcggaacttattcgcagccatgaagacaccaacgaaaccaagatggtgacatggggccagcatcaattcgaaatcattgtccaaaagagcattggcgttgtttatctgatggatatcacgcgttatgccgagattgaggaacgggccgaagacgagaagatcgcgattggccagattttcattgataactatgatgaaatcacccagacgatggatgatcaggttgtcaccaacttgaatagttacgtgacgaatcaactgacagattgggccaatcagtttgggatgttcttaaagcggattgacaatgatcgctttttcttactggcttatgccaaatcgttacgtgatgttgaacgcgataagtttaagatcttggacgtgattcgggaagaaacctcgaagcagaattatccattgacgctatctgtcgggattgcgtatggtgatgaagatttggcacaattggccgtcacatcgcaaagcaacctagacttggcgctgggccgcggtggtgatcaggtcgttgtgcgggcaaaaggacacgaggcgcgcttctatggtggcaagaccaacccgatggagaagcggacgcgggtacgtgcccggatggtggcgcaggccttgcaagagctgtttaagcaaacggataaagtcttcgtggttggtcacaaacggccggatatggatgcggttggagccgccatggggattcgtcggattgcccagatgaacggcaaggagtgttacattgtcattgacccggatcacctgcattccgatgtcgaacgcttaatgggtcaggttggtcaggatccggaagttgctaacgccattgtgacgccggaagcagcattgtcacaggctaccgatcagagtttgttgattctggttgatcatagcaagccatcgatttcagccgcgcctgatttgtacaaacgtctggctgcccgcaccgtgattatcgatcatcatcgacgcggtgaggaatttccggacaatccaatgttggtttacatcgaaccgtatgcaagttcgacttgtgagctgattgcggaaatgtttgaatatcagccaaccaatgtgccgagtctggataagcttgaagcgacagcgatgttggccgggattacggtggacaccaagtcgtttagcttacgcaccggaacccgtacatttgatgctgccagttatctgcgctccatgggggcagacgggatgctggctcagaacctgctgaaagaaaatatcgacagcttcatccagcgcaaccatttgattgatacaattgaaatgattgccccaaatatggcactatgtactggggaagaggacaagcgttacgatccggttattgcggcacaagcggctgatacgatgctgtcactaaacggtgtcgatgccagttttgtcatcaccaaacggccaagcggcgatgtcggcatctccgcccgctccactggggatgtcaatgtgcaggttattatggaagccatgggcggcggcggtcatttaagcaacgccgcaacacagatcaaaggcaaaaccatcgccgaaacgcggaccgaattgcttgcccagattaagaaagcagacgaagacgcatagaaagcagggattagtgatgaaagtcatctttacacaagacgttcgtggcaaaggtaatcgcggtcaggtgaaagaagtgcctgacgggtatgccgagaactttttgattcgcaagggtttagccaaggcagcgactccgcaagccatgagcgccttgcgtggccagcaacggcttgaagaaaagaaagaagccgagaagaaggccgaagctgaagcaattaaagccaagatcgaagacgacaagacagttgttcagatccaaagcaaggccggtgaggattcccgattgttcggttccattcctagtaagcaaatcgcaaccgctttggacaagcagtatcagatcaaggtcgataagcgcaaaatcgacttgaaacagccaattcgttcgctaggattcaccaatgtgatggtcaacctatttcccggcatcgatgcgcgaattcgcgtgcatgtgattgaacagaaataatttgtagcaagaaagggactgcttcggcggttctttttttgtgagcgcgagctggcgcggttagaagtcggagtgtaagtggcctcaggcgtgatggccgggctttggccattgcgactgaggttcttacacgcagacttctgcgccagggagcgcgttatggtgagcgcgagccagcccggttagaagtcggagtgtaagtggcctcaggcgtgatggccgggctttggccattgcgactgaggttcttacacgcagacttctgcgccagggagcgcgttatggtgagcgcgagccagcccggttagaagtcggagtgtaagtggcctgaggcgtgatggtcgggttttgaccattgcgactgaggttcttacacgcagacttctgggctggcgaacgcgttatggagaagcgtgagccggcgcggttagggaccggagaacgcgttagatgaccgctaccaatgtatcaacatatgatgagcgatacagatgtgcaaacgcttgtttcggtcagcattttaacgtagactgttagggataagcggttaaaaatgagccgattaaattgaaggaggacgcgcatggataaccagttaattgaacagcagccgccgcatagtgatgaagcggaacgtgccgtccttggcggtatttttctgaatgccgacacattgccggatgcccaggaatacgtgacggcagatgacttctacaaaaagtcgcatcggctgttgtttcaggcgatgacggatttgcaggataatggtaccgcgattgatacggtcacggtgacggattatctggacaatcacaatcagttggatgacattggcggagctggctacattaccgacttggtggcatcgacgccgattgccagcaacgttgtgtattatgctaaaatcgtgcagcaaaaaagcaccttgcgtaagctcatcagcaccgcgcaaagcattgccagccgcagttatacggaacaagacgacgttgaagggttagttgaagacgccgagcgccagatcatggacgtctctgagaatcgcaatcaggcagggttcaagcagattaaagatgttttgaatcaggcgatggcgcagatcgatcagctctatcaaaacgaccaaaccatcacaggcttgccaaccggttttcgcgacttggacaagattacaaccggcctgcatgaagatgaaatgattattctggcggcacgtccagctgtcgggaaaactgcctttgcgttaaatattgcccaaaatgtcgggacgaaaacggacaagagtgtggccattttcagtttggaaatgggggctgaacaactggtcaaccggatgttgtgttcggaaggcagcattgacgccaatcatttgcgaaccggccaattgaatgaagaagaatggcagaacctgattattgcaatggggagcctgagcaaggctaagatttatatggacgataccccggggatccggatggccgagattcgtgctaagtgtcggcgactagcccgggaacaaggcgacttgggactcatcatcattgactatttgcagctgattgaaggctccggccaagaaaatcgtcaacaggaagtcagcgcggtgtcacgacagcttaagaaactggccaaagaattacatgtgcccgttatcgctctatcgcagttgagtcgtggcgtggaacagcggcaagacaagcgcccggttctgagcgatattcgtgaatccggctccatcgaacaggatgccgatattgtcgcgttcctataccgtgacgattattatcgtgatgctgaaggcgatgacgatgaagatcaagacagcggcgatgagggtgatgacaatgttggtgaagttgaagtcatcattgagaagaaccgttctggtccgcgggggacggttaaactgctatttgtgaaatcgtacaataaattcacaaatatcgcctataatggcccggatcagtaaattgtatttaaaagattggataaataacgaccattgacgaacaagaaagtgagggatgccgcatggatgccattttaatgagtttaatgacagcactcaatgaacacctgctgatcaacgtttaccagcgtgataccgatgatttttacactggatatgtgcaggtactgggtcacgatgcggttgttctgggaacttataacgattcagggattgcggatggctgcgctttgattgccttttcagcgattgatcaggtggaatttgccggggatgatctcgacaacatgaattttcggattgacttagcacagtcggagcattttttgacgcttcaagggaaagaaacgccgtacaagtttgacgccaccaagagtttgatctggcaattggcgcagcaggcaaaagcaagcgggcagatgatcatggtggttgttgctgacgatgacgcttatctcgagggccgggtcaccgcggtggcagatgatcgctttagtatggcgattttcaacaagtttaactatacggatgtccgtgccttgcaagtcgacttttccgatattttagtgatggaatttcacggcttggatttgaagctggaaaccgagctagtccgcaagcgcgatcaactacaccacgtcccgaccaagctgtatcaaaacgacggtcaacttgaaggggtatttcagaatgctttggcggagaatcgattgatttcggtggtgccaaaagggcctgaggatcaattcttcgtcgggcgcgtcaaagcggttaatgagcatgtggttgtcctcagcctcaaggatatggcgggccagtttggcggctacattctgatgaccctaccaagtattcaaaatgtggccaccgcatcggattatttgcagacgatcggcttttacgagcagtgggaccaaacccatcatttcagccagcagccagtgttaaatgctgatcgggaattcgaccctaacgataatctggttaaggcgatcatctccgaggcagccgggtttgaacgggtggtacgcatcaaggttgcggatagtgatgagcattttctaggctatccggaacatgttgacgaaaccgacttcgacttgaatctggttggcccagacagcggtgaaacggttcgcattcgttatggacagattcgtgagattgcattcggacatatttttgcttatctgcaagaggcacagttgaaaaatgctgaccgttaatggcagtttgttaacggcgcggatgttggtggtttgaatatcagcgtagggcaattaaaaaagcatggttttcacggttaaagtgaaaatcatgctttttatttttctaccgattacaccactatttgctagtaacggcaagaacatcatcgcccgctgtgatgttgcgcggggcgaagtcggttagtgatgcgacgtgatccatgttggtaatgatggtcatcaccgttgtctttttgcccgcggcttgaacggcggctaagtccatggtggcgattggctgaccggctgtgaccgtgtcttgatccttaacgctgaaggtgaacggtgcgccgttgagttcaacggtgtctaggcccatgtgaaccagaatttccaagccggttgcggttgtcatggtccacgcgtgcttggatggcagcacactaacgatggtgccggatactggggcgacaatcgtcccggatgtcggttcaactgcgaagccatcaccgaccattttttgagaaaaaacgtcatcttcaacggcggaaagggcttctaattgcccagtggccggtgcgacaaattcagtggtgccaggttgagtggtaacaggagttgcggctggttggttgaccggttcaggttgcggggtagctgtttcgatgaccgtgccgtcagctgtggttgcgaccatcgcactcttaggaaccccgaagaagtaggtggcgatgaatccgcccacgtatgaagctaaaaggccaaagacataacccagccactggtggttagcgatcaacgggataagcgctgctccggatggcccgatggtgatcgcaccgacattgccaaacagtccgatgaccgcaccgccaatgccgccgcccacacaagcggtgataaatggccgtccaagtggcagactgaccccgtaaataagcggttcgccaacgccaagaattccgactggcaaggcacctttaatcaatcgggtgagttgcttatttttgcggcatttgacccacaaggctaacgcagcaccgacttggccgccgcctgccattgccagaatcggtagcaaggcggtaaacccgagatttttgatcatttccagatggattggcgtgagaatctggtgtaatcccagcatgaccattggcaagaaggcaaggcccaaaacaaatcctgagaacggaccgccgacttgaagaatccagttgatcgagccgaccagtgacgttgaaagccagccggcaaatggcataatcaggaaaatcgtcagcaccccgatggacagcagactcagcatcggcgtgaaaataatatcgatggcatcaggaatgaagcgatgcagttgcttttcaaccagtgaaagcagccaaactgcgaagataacgccgatgatgccgccttggccagctgctaacggttggtgagtgaagatgttggtgatggtcacgggcgcaacaacccctggcaggtaaatcagtccgccgacaatcccgcctagtccggctgtggcaccaaattccgttgcggcattaatcccaacataaatgtttaggaaagtgaaaagaccgccgttgataacctttaataccgtgatgaattcggtccagcttttcggcagatcaccagcggccatcatgttgaccaaaataccggcaaccccggaaattaagccggcgccgacaaatgccggaattaacgggatgaaaatggcggagatatgcttcaaagcggcccgccaccacgtttgtttcagtgcggctttgtgagcggcatgaacttcggcggccttggcttcaaccgcagacttgttatcttgatggtcattgccaaccgaagcacttcccgggaaaggatcacctaagccaacgccgacttttgcgaccatggcctgcgcgactttgttaacggttcccgggccgacaatgacttgtaaggtttcttcctgaacgacaccaaggacgcccggaacttttttcaagcctgcgacattgaccttggcttcgtctttaatggtcatccgaactcgggtcatgcagtggattaattttgcgacgttttgtgggccacccacctgtgcgtagatgccgtcacccattgcttgatacttatcttgccccatcttctgtttcctcctgacttaacgcaacggctttactaatgaagccatttgcttgattgagtaatgtttgagcggtggtgctaggttgattcgttaagatcatgacgatggctaatttgacatggcgattcgccgcttcaaaggctgtttgtgcggttttggcatcgcatccggttgcctgctgaataatgcgctgactgcggacaaccagtttttcgttggtgggctgaacatcgaccataagattcttatagactttgccgatgcccaccatcgcaccggttgacagcatgttcaaaaccagtttctgcgcggtgccagctttcaagcgggtggaaccggttaagacttccggacccgctggcacctcgatggcaatctgagcatgctggctgatcgcggcgttatggttgcaggctaggctgacagtagcggcgccgatggattgtgcatagtctagcccgccaatgacatacggcgtccggccactggcggcaataccaacgaccgtatcattttgggtcaaatgccgctcctttaagtcggactggccaagcgcaaccgaatcctccgcgccttcaaccgcaacagtcatcgccttcataccgccagcaatcaatccttgaaccatttctggagcggtgccaaaagtcgggacacattcagccgcgtccaatactccaagacgtccgctagttccggcaccgatgtaaaaaaggcggccaccgcgtttgaaagaagtcgtgatcgtttcaattgcggcttcaatcgcaggtaaagcatggctaacactctgcgcaacggtttgatcttcggcattcatgaccgtgacaaaatcatgaacactcatggtatcgagttgcatcgtcttttcattacgggtttcagtggtcatttggtctaagttaatagtcgccatgttaaggtcctctttctttgtgagcgcgttatagtgtgagcgcgagccagcgcacatcatgatattttgaatcgaatcgcctgatgcggtccgatttggtcaagtaacggtaaattagatggttcaattttgccaatcacattcacccgcgggtcggctggcaagtcgcagcgtgtcaactgaagctcgccggcatagcgaccatacgcactattatcaagtgtgatgctgccgcggggacggggatcggtttgtgctggttgtggcgtggcgaaaatgtgttccagccgtgcctcggccaaacgcacgactttttgcgcgatgtccgggcggctgtgccatgttaggtggagaaggcgttcatcgtcagtctgcacctggattaaaagtacctgatcgtgaacatatgactgaaacgcggcaatactgcgcgggctgagttgcggatcaccgacgtaaacatgatcgatcgccagttgcctgagttccagataggcagcaagcggaagtaagccacggtgagcttcaagtgttggtaaaccagcgaataaaggtccgcgttgttgcgcatcgccggaaataaatgccatggttttaaacccaagtgcgtgcagccatttatttttttgcgcaaaccatgccggatccagtccggtttccggtcgtggataaaagttgtgccaagcttcgatatggcaaagattggccttagcgttggcaagctgatcaatcatgcaagcggaaagtgtgctggcattgagcgcaattgccatggtgtgtgacaacgcggctactgtggtcatgtcgatgccgtcatcaatgcgcaaaccgtctaatcccaacgcttgaattgcttttccgtcgtgcagtgcgattcccaaacgttgcaaacttgcagcagagacatccgccataattgtcagtccaagctgatggcaattggcaaccaattgatccaaacgctggcggatgatttccggtttggcttcggataattgcaatgaggtaaagaccccagtgaatccggcttgctgcatctgtttcagataagccgcttgctgttcggttgccgaatcatttaaatagcaggaaaacccgatcatcccaattcctccatcaagaaacgcccgcagaagctgttagtggtttgcgggcaagtgtcgatcaatagcgaaaatctgaaagccctttcgtgaacttagcgtacatgatctttgatgatatttcaacatatttctaaattatttgaaataaagtttcaaaagggagcaaaaaataacgcaccgttggccggtacgtaaaggcaggatcatttgaaaccgtgccgcatgaattctttatacgctgtgactgccgccttggaatcatcggtttgcttcttagcggcatcgtagtaacggctaacgtaagcgtaatataaaatatcaattaacataaactgggcatgtagggattgcgtcgcggcaaaacgattgggcgcctccatcggttgtgacgtttgaatcacgatattggcataatgggtgagggcgttactgccaagtttggtcgtggcgactaccggtaaaccggctttcttagctaatttggcccctaagacagcctcgggtgattcgccggaattggagatgaaccacgtgagcgtatgcttcggatcggcagtggccgcgactggcaggaaaaggtttaagtcatcgctaaagtggcaagcataacccagccggctccatttttgagcgatgttttgtacggatagataagaggcaccaacgccgaatagcaggatttggcgactacggtgaatcaaatcaatgatagtttgaaccgtgttttcgttaatctgatcaactgtttcggctaaagagcgggttgcattggttttcaacttggttttgatcgttgtcaggctttcatttttttggatttcctgatgattgatttcgccgacttcgccattcaaatcggcggctaattgcatttttaattcgttatagccgttaaattgcaaacgctgggctgcccgactgacagtggccgggcttgttccggcggctttggccaattcataaacactcatggtcaacacgtcttgcgtatggtttaaaacatagtcgacaattttcttttccgcttccgaaagttctccgcgggtactttggtagttaccttcaacactcatgctagcctccttggatcatcgtagtaatgttgccgatcaacttaggccggcaaaccattatggcatgaataaacggtgctgccaatggacgcggcgttaatgaacggttatttttccagcgccaataattggtacggcgatagaaagcgggttttcatcaaaatatcgacaatctctgcttccgagcgcgggttcgtttcatttaaccacaattggatgatatcgatgatgccatacacgatgatctgactgacgtatgggtcggggatgtcgtggataaaatgcgcttcacctttcaattcagcgaggtgaccgagaattttatcccgtaaaagtttggcgattcggcctaaaaagcttggatcacctgctggactaagcagaaattggcacagatcgcgctgttggttaattaaatgcaccatgttgaccatcaatggagatcgctggccggtagcaagggtgctgggatccatcgaagtgtccatcccgaagtccaggcaatcggttaattccttaagcaacgcggcttcggttttagccaccagatcgtctttatcgagatagtgcaaatagaaagtcccacgactgattccgcttgctctagtgagatcggcaactgaaacctttgctaacgtttttttacgccctacagcaatcaaagaacgaacgagggcctgtttggtttgcgcagtttgttcggctttcttcatgatctcgctcctttatacaaccgtttaacattcaagttggttttaaagatgattaacacgatgttcatcataaaccattttggtagggaatacaaagattattgagcgacttcattttaaaattgcctatatgctggtttatacgtgaatgagtcggtatgtcaacggcctgcgtagaaatatcactgaacacatctgaaaaaattgcctatagtttcctgagcctgacgggtttaagctatttttgtaagatgattaacacgatgttcataattattttttggaggtcatcggcatggcaaaatttatcacggtaaaagatgaaaccagacaatatggctcaggtgaaagtactgtttatgccaatcataatgtttcgtttgaaatcaattcaggtgagatcaccgtcattttaggggcttcaggtgcaggcaaatcaactttgctgaatattctgggcgggatggataaagccaccagtggtcaggtcacagtggcaggtgagaacatttctcaatatgatgcgcggcagttgacaacatttcggcgcgagcaggttgggtttgtcttccaattctacaacctggtaccgaacttaaccgcactggaaaatgttgaactagccagcgaaattgcgccggacgcattagatccgcaaaagacgttggtggacgtcgggttgggcaaaagaatgaataacttcccagctcagctttctggtggggaacaacagcgggtggcgattgcgcgggcgattgccaagaacccgtcactgttattggcagatgagccaaccggggcgctggattataagaccgggaaaagcattttgaaactttttgaagacttttcccaccaaactgataagaatgtcattattgtgacgcataactcgttgattaagcccatggccgatcacgtcattgagattcatgatggcgaggtcaaagatgactatcacaatgatcagcccacaccggtcgaacaattgaaatggtaggtgacacagtttgagcaaaaaaatgctttggaaggatatacgcaaatcctttacaacgtcatggggccgatttttctcgatcttgcttttgatgatgcttgggtcatttgccttggtcgggttatgggttgccggtccggatatgcgagcaacaggcgcaacctattttaaacaatataatttggccgatttaaccgtcattggtgaagatggtttggatagccacgatcaaaagacgattcgggcgacaactggtgcaaagcaggttgaattcggttatcttaaagatgtcacgctcaaaggcacgcattctagttttcggattatgtcaaaaccggataagatctcaaaatataagcttgcttccggacgcatgccgactaagacgaatgaaattgcaatcgatgctaactacaaaggcaaatataagttaggtgacacgattaagtttgtgcaacgagcggatcaaaccggcagcaaggtgcttaagcggacgcaattcaggattgtcgggtttgtctattcgcctgaagtcctgtccgccattaacaaaggcgacagtacttcgggtagcggtgatctcaaaggatacggggtcgtcacagcgaataacttcgatagcgacttttatatgatggcgcggatcacgtatcaaaatacccagaagctggatccgtattccgatcaatataccgatcggattcaaagtcataaaacggctttgaacaaacgattgaaagatgcgccgacagatcgcttggcggctatcaaaaagcaataccaaaagaagattgacgcgggtcaaaaaaagcttgatgaagctaaggcacagttagactcggctaaggaacagctgacaaccggccagcagcaattagccagtgccaagcagcaaattacggcaaagcaacaggaacttgatacggccgttaaaaatggccaagcacaaattgccagcggggaagcacagttacaacaagcagcgactcaactttcacaaagcgagtcgcaactagccagtgccaaacaacaacttgaagccagtcagcagcaactggatgccaaacagcaagatcttgccagtgccaagcaacaattggatactgccaatcagcagcttgctaacagtcaggcgcagttggctgccgctaaacaagaaattgaagcagcgctggcgaataacccgcaaatcgctcagctgccagcattccagcagaaacaggcgcaatatcaaaatggtatcgcgcagtataaccaaggccttgaacaatatcaaaataatttacaggcctataacaatcaagttgcagcctggaatacggccaataaccagcttcaacaaaagtaccaagaatataattctggcgcgagtcaattccaacaaggccagcaatcctatgcggctaagcaacaagaattagaacaagctaagcagtcattggcgactcagcagcagtcgggacagcaacaaattgaggcagctaagcaagaaatggcctcaaacgaagcaacgctcaaaaccaagcaggctgaatatgatcagcaagcaccaaacgcagaaaaagaaatccaaagtaacagtcttaaacttgaggatgctaaagaagcgctgaaaaatcttaaagcacctacgtacacggttgacactcggcgtgaaactccaagtgggcaaggctacatggtttatgacaacacttcaaatatcattgattcgctagccaatattttcccattcttcatgtactttgtcgcagcgttggttacttttaccactatgacgcggttcgttgatgaagaacgtatcaattccggtacattggttgcactagggtatagtcggcatgatgtcatcaaaaagtttacagtgtatggtttcctgtccagcttaattggttcgatattagggatcatcaatggacatatcttactgccattgattgtgtacaatgcctaccatggcggggttaatgttccgccaatcgaattgcatttctatccaggcattagcatcgcggcgttgttacttgcgatgatcagtgcggttctgcctgcatggtgggttgcccggcgtgaactgaaagaacggccggctcagctgcttttaccaaaaccgcctgcaaacggctcaaagattctgcttgaacgggtcggctttatctggaagcgcatgagctttacgcataaagtgacggcgcggaacattttccggtataagaagcgcatgtttatgacgatcttcggggttgccggatcagtgaccttgctgttttccggtttagcggttcagcacagcatcggcggggttaatgatcggcagttcaacgatattatcaaatacgatatgatcgtggcacaaaaagacaatatcaccaagaatcaacaaacaagtctggataagctttttaacgaaaacgcggttaagaagacgaaatcagttcactacgaaaccgtcaccaaaaatgccggcgccaatcatgatcggcaagatatcaccatgattgtgccgcagtcaacgaagaattttgacagctacattcatttagcaacgcgcaaacgtcaaaataaactgacccttcaagataatggcggcattatttccgagcggctggcgaaactgttaaatgttgacgttggggatacgatcaccgttaaagaggcagatggtacccgtcgcaaagtcaagataaccggcattaccgaaatgtatatgggtcacttcttattcatgaacaaaacagcttaccaaaaggcctttaataccaattacaaggtcaatgggcatttggttaccttaaatgatcggtctatcagtaatacccgggcccatgccgcgcaattcatgaaagaagatggcgttaaaggcgtggttcagaattcttctttgaggaatcaaattacgacagttgtgaaatcgttgaacaagattatgggcgttttgattgtgttggcagctgttctcggcgtcgtgatcttgtataacctgacgaacattaacgttgctgagcggatgagggaactttcaactatcaaggtcctagggttttatgataaggaagtcacgctttatatttaccgtgaaacgatcctgctttcgattattggcatcttcgtcggctggggctttggtgaactcttgcatgagtatattatcaccgtcgttccgccaaataacgtcatgttcaatcccgccctttcagcgccaactttcattattccaaccatcgtgatcaccattatcaccgttgcacttgggttcttcgtcaattactcgttgaagaaagtgaatatgttagaagcgctgcaatcagttgattgatgtggcttgaggtctttccccaagtgttctaaaaagaaacaggtggcttaagttggaaaaagaccattgatttcgctatcgcatcggaaacggtgtcgagcagtctcctcgcagtgcctgcgttgaggttgctcgattttcgtgatcgtcaatggaaaaagaacagataaactaaaggagatacgaacaacatggatggcacaattgattttcacacacactttttaccgaaaaaatacgcacaggcacttaaaaagcacattcccggtgatccggacggctggccgacgccgggatgggatgaacacctgacacttgggttcatgcgcaagaaccacattagttattcaattctgtcgttgtcttccccgcatttcaattttggggataaggacgaaaccgttgagattgccagggatgctaacgagaccggttcgcaagtcactcaacggcaccgcgataaattaggttactttgcctctttgccattgccatatctcaatgaaacgcttgaggagattgactttgccttagaccatgatgcgctgggcttcaccgtgccaaccaatacgcggggtctttatttcggcacgccgatttttgacccaatttatgcacgccttaatcaaaagaaagcaattgtcctcatgcacccgaaccggccatcgcaaggaccgttgaacgtcaacattgacatgcccacaccgctgatgggtttcttcatggataccaccatgacatttatgaaccttatccggtatcacttctttgatcgctatccggatattaaactgattgtaccgcatgcaggggcttttctcagtattttggctgatcgtgatgctgcctttgtgaagcagcaatacaacgccgatatgtatgcaattttgcgccatgtttatttcgacactgctggcgcggttttcccacgtcagttaccgatgttgctgacactggcggatgagtcccatgtgctatatggcagtgatattccgtacacagctccgatgatcgccgcacaaatgttgaaactgtttgagcctgagacataccgcgccaaaatggcaaaccggattaccaaattaaaacactttgatccggttatgacgcattttaaaaagttccgtgcactaccaaccgtgctgaacatgtcgagtaaaatgctgaccggtgcggaaattttgtcaccggaaatggcgcaggatattttggtcaataacgggcaacggctgctcggtaaaatttgaccgggttaaagcgtaatatgccttatgcggtggcgggatcattcgtttcgagccgctgaatttaaaaatataaataatttcgttcggatttttcgcgaatagtggttttatccattattaaagttcgtattttgcttgtcatcaccttgcgatcctgttagactaccaattggcgggcaaaatcccgcactaattcgtgaggagcgattaattaatgggaactgtagttattgtcggcacacaatggggcgacgaaggtaaaggaaagattactgatttcttgagccaaggcgccaaggtggttagccgttatcaaggcggtgacaatgcaggccataccattcatgccaatggtcaagtctataaattacgcttgattccgtctggtgttctttatccgcatcagttatccgtcatcggtaatggcgttgtggtcaaccctaagagcttagtcggcgaactggctcgacttgccgaacaaggggtaactggtgaaaatctacgaatctcagatcgcgcccacgttattttgccttaccacattaaactcgataaattacaagaagaagcaaaaggtgccgataagatcgggacgacgaatcgcggcatcggtccggcctatatggacaaagctgcccgggtcggcattcgaatggcggaccttttggataaggatatcttcgcagaacggctgaaggcaaacctgaaagctaagaacgaagaattcgtcaaggtctataacagcacgccaatgacgtttgatgaaatttttgaagaatattacaactacggccaacagttgaaacaatatgtctgcgatacctcgattgtgttaaatgacgcgattgatcaaggtgagcatgtgttgtttgaaggcgctcaagggatcatgctggacattgatcaaggaacgtatccgtttgtcacctcatcgaacccagctggcggtgtcacggtcggtgctggcgttggggcctccaagattgatcgcgtggtcggcgttgccaaggcatacacgtcgcgtgttggcgatggcccattcccgacagaattgcttgataaaaccggcgacttcatccggaatgctgggcatgaatttgggaccgttaccggccggccgcggcgaatcggttggtttgacgcggtggttgtgcgccattcacgccgcgttgccgggattaccgacttgtgcctcaactcaattgacgtgctaaccggtttggacactgttaagatctgcgtcgcttatgagcgtgacggtgaacggattgaaaattatccggcatcgctgaagttcctgagtgaatgcaagccggtttacgaagaattgccgggctggaaggaagacatcacccatgccaagacactagccgatttgccagaaaacgcacggcattatgttgagcgcatcaccgagctgctcggagtggatcttttgaccttctctgttggtccggatcgtgatcaaaccaacgtaattgcgaacgtgtgggataaagtgaagtaaccgatttaattaactaaaattttaaagaagctgtcaggtgagttttctcgcgctgatggctttttttgctgagcgcgagccgccgcggttagaagtcggagtgtaagcggcctcaggcgtgatggccgggctttggccattgtgcctgaggtccttacacgcagtcttctgcgacggggagcgcgttatgatgtgagcgtgacctggtgcggttagggaccggagtgtaagtggccttgggcgtgatggccggactttggccattgcgaccaaggtccttacatgcaggtccctgcgccaaggagcgcgttatcgaaagtgagcgcaaatgctttgccacatttaaaaaagcatttttaattgacttccgaacccaaacccggtatattcaagttgttatatgaacacatgctcatatgaacattaaatataagggcgggattattgatgataacaaacaaaccaattggcttttatttgttaggtgtggctgcttttatcggcggcttattcatcacccaaccgttggcacgcgcagggctcttgattgctgctgcagtcgctgccggctatcacgtgattgcagaaggcgtgattgaaacgattcaggactccaaaaagcaacatcgatttgcgccgaacattcatattctaatggcattggcagcagtcggcgcgattgcgattggcagttatgaagaagcggccatgttgattctgatttttgctggcgcggactttcttgaagactatgtcgagaataagagtcgcaaagagattaccgcacttttggcaatggcaccacttgaggcccgacgctatgggcatgatggcgagtttgaagttgtgccagttgccgcattgaagatcggcgaccgcctgcagattctcaatggtgctcaggtgccgacagatggcgtgattattgccgggactgccagccttgacgagtcggcgatcagcggggagagtatcccacgggaaaagcaggtcggcgatgaagtcttcggtgggacgcttaacggccagtcaacctttgatatgcgggtgaccaaggccagtgacgaaacggtttttgccaagatcattcaaatggttcaaacagcacaagcgacaccgactaaaatggccagcgtgattcagcgctttgaaccactttacgtcaaagtcgtcttggcagcattacccctggtgtttctggcgggaccgttattactccattggccatggatgacgagtgtgtatcgcaccattgtttttctggtggcggtttcgccttgtgccttggcagccagtgccgtgcctgcaaccttggcggggatttcgaatctggcgcggcatggcgtgcttttcaaaggcggccggtacttggcaaacctgacgcaattaaaggcgattgcgtttgataaaaccggcaccctgacaaaagggacgccaactgtgactgatagtgaatttgctgccgatgttgatcaagcagcggtgatggcagttgtcacggcgatggaaaagcaaagtaaccatccgttagccaatgcgatcgtgactcattatccggcgactgatgtggtgatcgacaccgttcacaacgaaatcggcaaagggttaactgccgattatcaaggccatacctatacagtgggtaaaccgcaacgttttacgcatgcgcctgcgcttttccggcagcgcgccatggcgttggggcagcaagggaaaaccgtgatttttgtggcagtcgatcaaacggtggtgggcctaatcgcgttgatggatgaagccaaaagcagtgctaaagcggccattgcttacttgaaacatcatgatattcaaccggttatgattaccggcgatgcgaaacaaaccggtgaggctgttgccgccgatttaggcatcaaacaggttgtgaccaacgtgctgccagatcaaaaagtagcggtggttaagcaattgcaggaaacaatgcggccaatagcgatggtgggtgatggcgtgaatgatgcgccggctttggcaaacgcagaagtcggcattgcaatgggttcaggaaccgatgtcgccattgacgttgccgatgtggtgttgatcaaaaacgatctctcccgacttgcatttgcccatcaggtttcaaccaaaatgaaccgtattgtcgttgaaaatcttgtcttttcaatggccgtggtgttgctcttagtcacgctaaatgtgctgcagttaaccaacattgcctggggcgtctttcttcacgaaggcagcacgctcatggtgattctcaacggtttgcggcttttgctaacggaagaaggaacacattcacaaacaccgcatgtgcaaccacagctagggtaacgggttcggctcggtgaatcgttgcataacaaactgcgcttttaataccaaagtctgctaaaatgaggcttaagtatcataaggagcgcattgcgatgacaacgaatgatgttcatgcggtagctgccaataacagtgaaattccggatgacgccgatttacgagatgttcttgatgtattcaaaaccatgagcgatcccacgcgaatgcgaattattctcgctattgcacaaggacccattaccgttaacgatcttgcagccatgctggatcttggccagtcgacagtgtcgcatcagttacggttattaaagcaggctcgattagtcgccggtgagcgatccggcaagcagatttattatcatttagtcgatgaccatgtgttggagatttatgcgttgaccaaggcgcatattgaagaaaagcagcatgggcagtgatgaggtgcgataacaggcggcgccaacgtgcagcctggcattatcttttgtaaaggcaagtgtctttccggctatcaggaaggcacctgtctttttgcgtttattgccgtttatcttagcagaagaaggggctgcgtctaaaagctgatatttacattattagaagcaaatgataccatcattaaatccctgcgctcgggcagtttgctaaatggtagcactcatgacagctaatacgtccgacttaagcattggcgagccagcgtctcttttcatttgtagactagggatttgaccgaacgaaatttaaaatgaaagcgttcgaaacttaaaggtgttatggaggtgttatatgtttgggcggcccataagtaatagatataagtactattggtatacagtcttcacgcaacttagatttaccagaatcatcaatatcatctttgttgtccaatttctaaaattcaatttagtacaattcggacttttgcagtcggtatttttgttatcgcagtttgcatcggaattgccgagtggtgttttaggcgatctttttcgaaaaaaagcggttattatttggggcttggttttactgacaatttcgcctatggtcatgatatcggccagtttggtaggtcacaattttatgtttacgaccttgttaggtgcttttttattggaaggcgtgggtaacgctttgcttagtggggcggatgaggcgcttttctttgaagccattcgcagagacggtctggccaaacagtacgcaaagattcgtggtgaggcacagtttatcggggccattgttgtaggcgcggcaacttttttaggcggcgttttatatgcaattaatcgcgtgttaccgtatttttttcagtcgttaatggtggcagttgcgggtctggttatcttttctgtgcgggaagataaacgtgtcactgcaacaattgaaaaagttaaggaacctagtcaagttaagaatatcctcaccgtttttgcggaaattaaagcatcgaccaatgttctgtccttatttatctttacggctttgatatctgcaatggtaaatgccatttttgcgatgttgccggcgtatttttccaaactcggcttttcttcctctgcaaatggactgatatttatgctctttagttttgtgggcggattggtggcagctcaggcttatcggcttaccaaggtcagttctaaaacattggcgcttatcgtagccggtattttagggctgggggtgatccttcagatgcaagcaagtatttatttcttctctgcaggtgtttgcttgttgtacataacagtggatattctagatccgattgttctggaaatgttgaatctgtgggtgaaagactctgcgcgggcaactttaatctcaggcctttcatttgctactagtttggtgacgatgctgctcaatccgttaatcggtatgttgattcaagtatatggaaccattccgatgctagtgatggtttcaatgttcgcgattgtcatgatcctttttttcgttcattttagtctaaaatcaaaaccgcaagaaagcgaataaaatgttgtggacagttcaccctttgtcgcgccaggaaatgagtaaatgactttgtatatatgcgttacattaacgcttatatacaaagtcatttttgcgcataaacaagatattgagaatcattgtatcgcagcagttgattttgatacccgtaagtttacccaagctcgatatacataacccaatgcgaccattacaattattatagaaacagaaaagaggaagccgaatggaaattaatgtcggtgctgtcatcagtgcctttcggaagcaaaagggcgtgacacaagaggcgttggctgattttgtcggggtctccaaagcctcggtatcaaagtgggagactggccaaagttaccctgacattacgctgctgccaattcttgctgcttattttgatgttagcatcgatcaattgatggcatatgatgctcaattgcagccaagtgaaatcaggcgtatttatacgtcactgaagcaggcatttgaaactcagccgcctgctcgggtgttgacgtccattcgtaatttaattcgtcgttattattcgtgttatccgttccttttgcaaatggggctgctgctgttgaataactatgacttgttacctggtgaatcacaaacagccaaaatgaaaacttatgtgactgaagcacagcaattattcgtccgtgtgcaccaaaacagtggcgatctgcggttgactgctaaagccgttgagttggaaggttatagcctgctattactcaaacggcctgatgaggtattggcgttgttgggcgaatatgtccctgaacaattaccggcagatagtttaattgccggagcgtttcaacaaaaaggcgatttgaaacgggccattgcgacgagtcagagtgggttgatgcaggacttgagtatcatgatgagtcagctgacgaattatatgacgttgcttggtgacgatccccagaggttgaagaaaacgtatcagcgcggccaagccattgccgcggcgtttgatttggtgcacctgaatacggcggtttgggcgaactttcagctggctgcgttaacgagctttgcccagcaagtgcaagcagacaatgccgaagcagtattacgccgctttgtgcgggctctgatgacaggcgagttaacctggacactgcatggcgatgcgtattttgatgctattgacccctggctgaatcagttggacttaggcccgcaaatgccgcgagctacgagtcatgctaagcaacaagtgattacttttatcttggaaagtccaacactggcagctttacgacagcggcctgggattcgacctttgctacgggaattagaacaacttaagacacaaaaataacgcgtttatcgaagccattttcggtggacacatcatggaggatttagaatgcaaacaaattgggcgttttttggtacgtattggccgtttttagtcccgttaatcattttggagtttggcttaatgattacggccgtggttcatgtgttgagacatccgcattatcggatcggcaaccgtacactatggctggtgattgtgatcttcattcagatcattgggcccattgcttattttgtctttggacgggaggatcagtcgtgaccattttgacattgcagcatgttagcaagcgtttcggaagcaaacaggtgcttaaggatcttaatctaaccttaccgactgggtctatttacggctttgtcggtgaaaatggtgcaggcaaaacgaccacgatgaagctcattttaggcttggtgcgcgcggatcaggggaagattgaagtcgcaggcaaaccagttcgttttggtgacacgacaaccaatagcgtcactggttatttaccggatgtgcccgcattttatccttatatgacggcgccggagtatttacgcttatgcggtgaactgaccgggttgcgcggggcggtgttaactaagcgtgtgtcttcgatgttggatcgggtaagtttggcgggtgttaagcagcgggttggcggtttttcacgggggatgcggcagcggctgggtattgcgcaggcgctgctcaatacaccacagttgctgatttgtgatgagccgactagcgcccttgatccgcaagggcgcacggaatttctagcgctactggcaagtttgcgcggacagacaacgatcttattttccacgcatattttaagcgatgtggaacgtatttgtgatcacgtcggcattttgcatcaagggcggctacaagtgagtgcctcgctggccgacttaaaaaaacaatacgccaaacctcaattgcagttaacgtttgaaacgccatcgcgagcacaacaagcagcggctttgttagcatcgcagcaacatgacggttacgtaaaacaggtgaggacaagtggatctgaggtaacagttgcttactcggaaagttacgctgcaacggctgatcgggttttgacggcgttgttgaccgcgcaactagtacccagcagctttagacggcgggaagcgaatcttgagcaggttttcatggaggtgatcaaatgactgccgcgatggtttttaccaagaaggaactgatcgaaagttggcgcacgcaccgctttttgattttgacggttgtctttctgattttcggcattctaagcccgttgatggcaaaattgttgccggagttattaaaaagtggactaggtggcgtgaaggtgaccgtaccgacgccgacttccttagattcctggacccagtattataagaacctcacgcagatgggcatttatgtctttgcactgatgctgggcggctgtgtcagtcaggagattcaacaagggacgcttatcaatctggtgacaaaaggattgccccgctggtcggtgattgttgccaaatccgtggttggcctattgcagtggctttggtgtatcggccttgcatttgcggtgacctgggcttataccgcttattatttccccgatacacacagcccccatgtgttattagcagtactgccactggtaatcttcgggtttttctttttgagtctcattgtgttcggttcgacgctggcaactaatcagtacggtggcctgttgttcacggtgatcatcgtggcgttgctgtacgtggcccagatgattaaaaaaggacacaatctgaatccgatcagtttgatcagcgacaacatgaaaattctggtagatgcagctgattttgctaaactctggcctgcaatggtggtggccttggtgatcggcggtggcttatttttcgccgcaatcaaggtcttgaatctaaagcgactttaaaaaaggacaagctgcttagtgaagaagtgttttctcggtaagcagctatttttatggctaaggaatgaatggctaacatgcgcggaggttataactcgctgctaaaatggtgttattttaaaaacaaatcgcaaacaatcaaatgatgtaaaaccactatatagtgtatgcttattttaacaaaccacaaaatttggtagatattccgttacttttgcttctgaatcttgtatactaaatacattgttacaagttttgcaagtaagggtacaggaggactagccatgatcgaattttatacacaaatcaagaaacgggatgggcggatcgttgattttgatgcgaccaagatcagcaccgcgataaccaaagcggcagaaagtgtggcgaaactgtcaccgcgcgatgtgttaaccattgaccacttgacggatacggttacggctaagattcgcgatcggtatcatgatgatgttgagattgccgaaattcaaacggttgtcgagcagacactcattgccgccgaaaagtacgactgggcagaagcctacacgcaatatcggctgaagcgtgatttagcgcgcaaacagaagcaagacgttaattacaatgttgcgcgactggtcaatcgcgataagagcgtcgtcaacgagaatgctaacaaggatagtcgggtgttctcgacccaacgtgatttgacagccggtgcggtggctaaagcgattggcttgaaaatgttgccgccagccgttgccaatgcgcatttgcgtggcgacattcattggcatgatcttgactataccccgttcatggcggaaaccaactgttgcctgattgattttgactatatgttgaatcacggcttctccattgggaacgccgaggttgagccggcccactcgattcaggtggcggtgacccagatgacacaaatcattgccaacgtggcctccagtcaatatggtggctgttccagtgaccggacagatcaggtgctagcgccgtttgccgagaaaaattaccagaagcatttgcgtgaattcggcgatgtgattgatgatcccaccaccctcaaagcgttggcagtgaagcagactaagaaggatatttatgatgccttgcaaacgctggaatatcaggttaacaccctttattcaacgcaaggacagaccccgtttgtgaccgtgggctttggtcttggcactagctggattgaacgtgaaattcaaaaggatattttgaaaatccgaattctgggtctgggcaaggaacgccggacagcgattttcccgaaacttgtcttcacgttaaaacgcggcttgaaccttaattcggaagacccgaactacgacatcaaacagttggcgattgagtgcgccaccaagcggatgtatcctgatgtggtttcctatgacacaatcaagcggctgactggctctttcaaagcgccgatgggttgtcgcagtttcctgcaaggctggactgatccgaaaacaggtaaggaagtcaatgccgggcgcatgaatctcggcgttattacggttaacctaccgcggattgctatggagtccaaaggcgataaagataagttttggaagatttttgaagaacggatgcgcatctgcaaggaaggtttgctttacaagattgaacgaaccaaacaagccacgccggaaagtgccccgattctttacaagtatggtgcatttggccaccgcttagccgataccgatagcattgacgatcttttcaaaaatggtcgcgccaccgtatcacttggctacatcggtctgtatgaggtcggaacggttttctatggctccgcatgggagaagaatcctgatgccaaggccttttccgtttcgattgtgaaggcgctggatgatcattgcaaggcctgggagaaacaatacggctatcacttctcggtttacggcactccaagcgaatcactgactgacaccttctgccgcgaagacactaagaagttcggcatcgtcaaggacatcaccgacaaggaatactacaccaacagtttccactatgacgtccgcaagtcacccacaccatttgaaaagctcgactttgaaaaggactatccgcaatacagtgccggtggcttcatccactattgcgaatacccgaacctgaagcaaaatcctaaggcactggaagcggtgtgggactatgcatacgataaaatcggttatcttggcaccaacaccccgattgatcaatgcttcaaatgcggttttaaaggcgagttcacagcgacagccaagggatatgaatgcccggaatgcggcaaccacgacccggctacctgcgatgtcgtcaagcggctctgcggttaccttggaaatcccaacaagcggccaatggtccacggacggcaggaagaaatcatccaccgcaagaaacatattacgttcagcctgaatcaggtggccaatcgccgcgataagtagggttgatcaaagtggcatggaaaaagataataggagcgatcgtctggagatcagacggtcgtttttgttttctagagactgaatataaatagtaatcggagacttttcattccgcccattcgcgtgtagaatccaaggcaagttcttgctgacggttaggctagcgtgattggaggtgtgccatgatagctggtgtatttactgttaaacaatggcaaacagcggagcaatggaataacgggtggctgattgttgcgattattgtcattttattcattatcttctgcctcctactcgtttctttttatgtacccaatccctggaagcggcggattatcgtacctgctatccttatttgcatgagtttgacggtttacagctggttgcgaaagggacaatgcggctaattaccaatttaatcaatgggccgcaaaaatcacaccgcagatccgcactaagaaagcggctctatttacttatgtctccgtcccggaaagtgaagttaaagggtatcgggcattaaatgattacccggcgcttacaagcttacccatgtatacgcgtcaccgagttatagcatcagtggtctatcttgggcgtgatgacaatgcgcgctactttaagttagacggcttagtttatcgttattccggaccaatacagatcggcgaacaggcggctttaagcggttatcgttttcggttaaaggatcgcggctatactcaaatgggattcataaatccatccaagaattttacagccgctctagtgatcccgcgaaatcggattgagcagcattaccatccgtctaaggaggtcgtcgtgacactcgagaagatggatggtgaatggacgacggaaaaggtctaccgaaagtgaaaagtttgcgcagtcattttgcaggctggcgttttggccagatgggctttgttaggataagcaagcctgcgccggcgatgatgatcaagattaattgaaggtctatgccgttaaaccagacgaggacgagtcctgttagtaaattgagcaatcctagtgcagagaaaccgacacccatgaaacggcgacttctaacagaccagtcggcaaaaatatccaccgattttggcgttatcgcatagctgaaactaaattggacagcaacgaatacccaccatatgagctctgcaagccatcgcgggaaaaagccaaacatagtcgttgccgccataccagccatcatggcatcagcagttgtcaaaacagccataacgagctgatgtcggctcactttactatccttaataagtttttcgtttaactcagaatcgtcgaggatcagggtatcaagcgacaccgaaaagatccgggcaatttgagtcactgtttctaagtccggtaagttgcgttcattttcccagttagataccgtgtgccgcgaaacgtgtaattgttgtgccaagtcagcttgcgtcatgctgtgtgcgatgcgaatctgctgaagctgttttgaaaagttcaagataaccacctcgcttggtttgattgtggcagaggaggtcagaaacagcaaggcaaggagaagatccgcagcgcgcgttattcgagacaggactattacccggggaattttgcattcggtggctggtgaaaaccgatgaccaaagcaaaaaattaaaataaatggcgatttgttagcagtttctgttcttgcactaatcaccataatgtttgacaagtaaatcatcatgcttgtgatcaccgcacatttcatgctatactccattcggtgccaaaccacggtgagttcgtaacgatcggcgcgtatgcgttcagaaggtcgaagcggctcgccatttttttatgagcgcgagccggcgcggttagaagtcggagtgtaaggacctcaggcgtgatggccgggctttggcaattgcgcctgaggtccttacacgcagacttctgcgccggggagcgcgttatagaacgcaaaggcaaacaaagctcccaaatagaacgcattccagtctccacccacaatgtcacaacaccaaaaaaccgcagccatctcaaaaacggctgcggttaaacatatcactaagtttcacccaccgacgctgataaagtaaacttcaagcggccggctctgtatcaagcttctttgattttgaacgcattgtcaacgcttcccagtcaaccaatggcaattgcgccaccgcacccagaatcaagatcattgaccaggtgagaatcagactcatggtcacatcaccggtgaaatgcgcgagaatccggacccgcgtataagccatcaaagcaccgtaagcgaaagtgagccagaagactaaccgttgacgcttcggctggtcacgatcaacgaaccaagtcaacgtgaggatggtcgccgcggtttgggtatggccggacggaaaactcatgtgaccgttagcaccatttggctggaaccagctggtgaagtgagccgggttaccatttaattcgtaagggcggaaacgaccccagaaggttttcatggcgttcacaatttggtcggacatgatgcaaaccaaagtggcaactaccgccacttttaataagtaatgaagctgttcgtcgcttttacgtgaaagccagtattgactgccagcaaacacagcaacgtagagcactaggaacaagatgacgcttagcccacccggaagagccagcttgctgccatcagaattggccattcccattggcttgccggcgttgatgtcgttgattgaagtgatcaccatcgtcatcgcgtatttcagataaccagcccacagttcccagccggcatagatgacactaccgatcaccatcaagccgcgaatgtaccatgcgagttgcgatgatcgcagcgcatagtgacaaacaacattacaactcaacataataatcagtggcgcagtccagaggccaacgtcttgaaaaagggtggcaaacggatcgttcatgttaccgatcgtttgagaaatctgccaatcaaagccagcagctgcagccaacaataaaagtaagataccagcaacaatcagaaaaatatgtttgcggatcggagcgtttaatttttgcgtttggtccatatcttttccctcccatgtactttgaaaatagcacatagtttacagaaaatggccggatttacggtacctgtacgtaacatttaagctgccgatacgaaatttacagagggttgctaaagtaaggctcgtcaacggttagctggcggtgatcaaagtcgatggttgcctgcaaaccatatggcaaaagggtgcggggataagcgtggccgaagtttaagttgtagagaatgggcgtttgataaggttgcgtgacatccaagagcacctgctgataatccgcaaaataggtttcgttttgaggcttacccactaagatggccttcacttgttgcaagacaccgtgatcagccagatgccctaggtactcacgataggtggcaggtgaaattttatcttctgaagtctcgatgaagagaatcttgtcagtccaatcttgcgggaagaggtgatactttttggcaacttgcggctcatcgtcgtaacgcaccgggtagagcaagtcgtgaaggctatccaaacagccgcctagcaatgttccggtaacctgaccatgcccacgcagcgctaaatagccatgctgctccggatgcgctttccgcggcacccctaattgatccgcggaaaagtcgatccgctcttcgtaccaagttggactggaagtgatggcagtcgttgccggattctcgaaatagtgccggaagctggcagcagtatatggcaataagtgcgtatccagctcagccaagtcgttcaagaagttcggtccgtaaaaagtggtcatgcctagctgataaaacatgagatggtcaatggtggtgtcggaaaagccggtaaaaattttaggctgggtttgaacagacttgataaatgtcggatcgtcaagtaggtaaggaacaatgcggtaagtatcatcgccaccgatggcacaaatgatgcccttaatgtcgggatcggtcatcgctgtttttaaatctgcggctctggcttccgggtgtgcgtttaaataatcgcgtccgcgtaaagcatttggcataaaccgaggtgtcagccccatatcctccaaacgcttaatgccaagttttcgttgatgggcagcaaacgcctcgccaagtgtgccggcactgagactgacaatagcgacttgatcatgcggttttaaagtctgtggttttttcaagggtatccctactttctagtgtgaaaaattgattttcgtggatagctttctttttagtgtatcgtttaaactaacctttgtcttgtatcattttttgaaagcttgccgtgcttctgaccgatgccgatattcaaactgtgaaccagttgcttgttttccaagccggtaagctggtacgatcgaatagaggattgaatgaactgattttaaaaaagtaaattgaccatttttgccaggatttaatggaggattgagccatgtacaccattcaaactgctgcaaccattgccggccgcggtactgtaattacgattgctccgccgattgagcgcattcgagccggtgatcccgttcggctgaatggcgcaacagtcggcaaggtgtgtgcgcttgaaaaggcccgccatccgcatcatagtaacaatcagccgtgcctgagcctactgattacggaaccggtggaggtcggcgataccattgagttccctaagtcacaatgttggcattaggcatcatatttcttttatgtgggtaacggatcttcgtgccataaccgccctgaccacacacctacatagaaaaagcgttgcaattgtcagatgaaagctgacagtcgcaacgcttttcgtttacttgttctagtgattggctgtggtcataatgccggcttccgtcatgccttctgcgtaaagtttcagtttaccgttgataatgtccataacgagatcgccatattctacgccatctgcttcggcttcctgtggtaagagcgaaagtggtgtcatgccaggcaggttgttggcttcgatcacccagacgcccttatcgttggcaaagaagtcaatccgcccatagttttgcaatcccaaaacgtccatggtttgtaacgagacatccttcattgcttgatgaactgattcatccagattcttaggcggcgtgatgaagtcggtgtagcccgcttggaatttgtgcttgaagtcgtaccaaccggaatgcactttaatctcaatggcagaaaacgcccggccattgacaacgcctaaagaaaattcgcggccaggggtgaattcttcgacaatcgcgctgttatcgaaccggaaaacatctgcaatgccattttccagttcctcttgattgtgcgcaatgtgcgtgccaacactagagccgcctgatgtaggcttaacgacaaccggaaagtcaaacggtaccgtatgtttaccattttgattgcgtttgaattctttgaacgccgcagtctggatgccgtggtataacataacttctttgctgaagaccttgttcatggtaatgccggaagccagcggaccggaaccggtatatttgacgttgttcagatccaacgttgcctgaaccttaccattttcgccatcaccaccatgcagtgccaagaacacaatatctgcagccttgcagatcgccaaaacgttaggaccaaacagttgcgtgctgccgtctgtccgtaacttgttgatgtcggcgtcagtcagaatggcatctgaaattttcagatccttactggtgttggcatcgtcaaacacttggtcaaccgtttttccctcaaggtcgtagccaagaaacaggtcaatgaaggtggcctgttgccctttttgtcgcaaggcgttcgtgatccggtagccgctggaaatcgacacattgcgttccgtgctccggccgcctgctaaaacgacaattttcatgtgatagtacctccgcgtattatccgagtttgatagaaactaaagtgtagcacaatcaaggcgcaaccgctatcaggacgcgttgaattgtagcaaaaattaacatccgtggctaatacggttaggcgctgatatttaccaaatttgagcgagtcggaccagctgccatccaaagtttcaaattaacatcatagcaacatttcattagcaacttataaacaatggcttggcatatttagtgataaccaatgagaaatggaggtgaacgactatcgccactggattgaatatgatgatcgggattgtaggggggattgttgtcgcaatagtcgctaatcgcattaacaggccagcgacgaaaacccgcggcatcgtcacgaacacgcttggcatcacttttggcgctttaggtgctcaggctgctgatcagttgctgtatgaaggtccgcagttgtttggtagccaaattgtaccggcaattgttgggggtattgtgcttgcgtttgttgtgatttatgcaggcaagaaatggtttcgtctaggttccaccaattaagggagacattcagaatgaagcaaagaagacgcgtggtcacgatgctgttgacgggactttttaccataatagccgccgtgatcttcgaagctggcatgtgggtttcaatgtattggtgtatgaagttgttctaaatacttaataatcccggcagatcgttgggtagttgtcgccgtttgagatagaaagaggtttttgttgtgaaaaaaagagcgaatagtcttcagtctaaacacattgttggtgggctagttgcgttaggtagtctgcttgtagcaatcctatttcctgctttcaagagataaactgcaaccctgaaccaaacaaataaccaaactaaaacaggtattggcgatgcattgcgcaaccgtcaatacctgtttatttgtatgctttacggttaagtgatacccagcatgattgtgataatcaatcatgcgtttgatcagtgaatctggtactgatcaatgctcccaaaccgatcaaaaccagtaagctgccaacgcccattccgaaaatgccggttacctgattcgccatttcctgttgagctgacaacaacgcatattgcgtcaagacaatggccatggcgccatctgccagattaaatgtttttaggaaaaataacgcgccatggtgaagccgccggactcgtaagaagccgatgattgccatggtaagcttgtaaaagccaatggttgcaactgtaatggcggttattttaccaaaccgtgcctgatagccatcgtgatacatgatgaatgcacagatcgtaaaggccagtcctaaaacaacataagcgaggccagcggtttgaacaaataccttggtttcaggtagctcatcatattgacgagatcgcgaatagtggtgtagaaaacttgagcgagcaagcgataagatgaggtaatagccgccaaacaataatagccataaagaaccggtgaccagacccaatcccaacttgacgagtgcaagaataaaattaatacccgcagccaaagttcccatgagtgcggttcgatccgccggggtactggcatgacgatgaaacaaccggcgtaatcgctgcatggtaaccctccaattaactaatgtttttggtcttcagcgacaaccacttctggcgttttagaagatttaacactttttagaatgatgatcagcatcaagacgacgatgatcgacatactaataaaagtagcattcacgccaccaaccgatgccaccacagtttgctgtgctgcaccgcgattggcgataaacgacattaacgctacgctaaccgatgtcccgactgctccagcaacggttcgtaaggtggtcaaaacggcagatgccgaggcaatagctttgccggttagctgggtgacactccaggtgaccagtggcatcattaagcaggataagccgatacttcgcatggcccatacaacggtcagatagatgattgaagttgaagtcgtcaaaaagctggtgccgagactgctaattaggactagcagaacgccgataattgcaagcgggcggatgccgtaacgatcgtataatcggccggtgatcgggctcataattgccatggcaagcgaaccgggcatcatgatcaggccagacatggtggcggagaggtgatggacggtttgtgcgtagatgggaaaaactgtggaaaccgccatgagaacggcatacattaacgcgcttagaatcactgcagtccggaagaccggatctttaaagacgtgtaaatcaagtaatggttgatcaacatgcaaggcacggtagataaatgccatcccggccacaactgctatcgctagcggcgcggcaattgccaaactcagaaacggtgcggtaccaagattaccgaagccaacggtaataccggtaaaggcgatactgatgagcaagaaagactgccagtcaaattgcagcttttcggtcggcaagacatctttgataacgattaaagcaaaaataatatccgctacggcaacgatgacgccgacccagaatatgacccgccagctcatgtaatcgattaagaggccggtaatcgtcggcgcaataatcggggcggcactggcagccaagccgtaaatgcccataatgccaccttgtttcgaaacggggaaaatagttaaaatgacgacttgcgttaacgacagcaggataccggttccgagtgattgaataattcggcctgccaataaaatggcaaaagttggtgcaagtgcagccagcagtgaaccgccagcaaacaagagcatgctggcgatgaacaaggccttggtcggaattcttttgatcagaaatgccgttgcaggaatcataatccccatggccaaggaaaagccgctggtgagccactggccggcgttagcagttacgccgaaagtcttgatgatatcgggtaatgcggttgtcagcgcagtttgcagtaaagacgaaatcagggtacctgtcaataatacagcaaaaatcaaatttcggttcttgggtgcagattgtttcattctttttagcctctaatctgaatattagtgtgacgatcaaaaaggaatctggagggcgcattattagttcagcagtaaaaaagcggccttgcttgtctcggcaatggcatcaaattgttgatcaatcagaggatcaattcttgccgaacggcgggcctgccaccagcggtaagcaaaataggcacttccccaggcaagaaaaccgggaatagctaacataaccgatagcaaaatcaatgcggcctcccaggcaaaaaccgagccagccatgaatactgtgccaacgatgccgatcaacaggctcagtgaggttgcacttgattgtttcgatttttccaagcgcacaacatgagccatttgttgttcaaattgcttctgtagccgattaagttcgcttttgtgggtaatggagcgatcgcgcttgaatgctaaagtgacaccgtgcagtccttcttttgactcctgtaattgccagccgaagtttgcataaccgtctacataggtggcttgcatactgggagaaaccgtctgggtcaaatattcataggcgataaaactgtttttttgcataaagagaaaccctccatatcttgttataggcgtttgccaagccgatttcgggtggctaacgactgctcatggtttaagcatacggagggcgtgtttttgaattattcatgaaatgttgctgaattgttaattttcactttgcggaagagatacggtgaaggtagtaccttggtgagggttactttggacactgatttttgcattaagcaagcgaataacctgcgccacaatggcgagcccaaggccatttcctgcacttgcatgtgatgtatcgccttggtaaaacttgtcgaaaatatgtgcctgcgtattttcgtcaattccctgaccatcgtcgtgaatatggacacgtagcgtggtatcgtcagcttttgcgagaatcgacaggtgaccacgtggcggtgcgaatttaattgcattgccgatgagattgtgccaaacgatctcgaggagttggggattactgataattggcagtgagtcgggtaaatcaattgttagatgtaactgtttagcatcaatcgcattggcatcatccagtaagcagcgcgtcagttgcgcactgagatcgaatttttggtaatcaggtgccgtgacttgggtttgtagtttgttaagctttagaatattcgtgacaagcgttgctaaatgggcgaccgagtcactaatggtggtcaaataaagttgctgtgttttccggtcaagccctgactgttgtaatgcttgggcataaccttgaatatttgccaacggtcgtttgaactcatgtgacacattggcaacaaagtcactacgcagggtttcggtggagcccagttcggcgaccataatattgaagttagcaaacatcgcgtctaggtagtcgtaattctggggtgcatgaaccggttgtaaataaacatcaaagttaccatttgctacttgttcagcggcatcgctcaaagctttaagtggcttgtcaaaagcgcggtatttctgccaggcggtgaatgcggagaagccggcagcgaccaacgcccagtaaagcagataccagcctaataacggggtcaacactagatgccaattattaccataaagtattcccggtaaggctgctagaatgctcaaggtaaagaaggagccaaagaattgaaaccatgaaaagtgttgctttacttgtggttgaacggcttgctcatttactgatttcataaggttaacaccgccttgtaacctaatccatgaatggtcttgatcgtaaagccatctgctgctttgaatttctcgcgtagttttgtaatgtatacatctaccgcgcgcatgctggtatcactggcaaggtcccagaactcgttgataagttcggctcgggaaaaagcgtgatcaggatatgaaagcaatttataaaggatctggaattcccgaactgtgacatcaaccgtttgatgattgacttgtgcagtaatcgcctcgttgttgagagtgagattgccaacgatcaacaagttgtcggccgtaatttttgcgcggcgtaacaaagctttgattcgtaatagcaattcattgaagttaatcggcttaaccatataatcatcaatgccgctattaaaacccttttctttggacgcaatatcatctcgcgccgttatgaagaggatggggatgcttggatcggttcggcgcagttcttgtgcaaattgataaccgtctacctgaggcatcatgatgtctgataagacgagatcgaattgttcggattgcagtaaatcataggctgccggtggattttcggcaccttgaacagtgtaaccattctgccgtaagatggttgcaatcaggtcgttaaagttgcggtcatcttcaaccactaggattttgaccaaagtaagtctctcctttttggtacgtgtaagtcgggttttacgctgcgggtcgatgggtcgttgtttgctgaacagtatactgatcccagacatatttgtcatggcttagcgattaggtggataggctggcatcactgatagcaacgagattcgcgataatattttttctgagtgggcgattttttagtggaaaggatttttctatgcaatatacatggctaaacatgcctgagcacaattacttgattgtggtcgatcaaggtaagcttgcttttgtcggatcgccggatgccaaactaagcgaagcaacgcgttatatcaaagggccactggtatttgatcgcgaggagatgttgccttttcgcaatgcaatttatgattatttaagcggtgacagtcgagagatcgcggtgccgttagtctttcatggcacaaaactgcaagtggcggtatggcgttatttgatgacaattccatatggtgaaacccgaacttacaaacaagttgccgtagcagttgatcggccacgtgcttttcaggcaatcggcaatgcggtcgggcggaatccattaatgatggcgattccctgtcaccgcgtattacgcacagatggcggactaggcgggtttcgcggtggcttaacgttgaaacgcaaattgttagctttggaacaagggcagcatccaaccttttaatcagcagtaagtttttcaaaaggtagcggttaaacgttctattttacgagcataatcttgtatactgatgaatggacaaatcgaaatcaaggagatattgagaatatgaagattattgcatatggtgcacgcgtggatgagatccaatatttcaaacagtgggctaaggaaaccggcaacacgctggaatatcatacggaatttcttgatgagcataccgttgaatgggcaaagggatttgacggcattaactcactacaaacgacgccatacgcagctggtgtgtttgaaaaaatgcacgaatatggcatcaagtttctcaccatccgcaatgtcggaaccgacaatatcgatatgacggcgatgaaaaaatacggcattcgcttaagtaatgttccggcgtattcaccggctgccattgctgaatttgcgctaaccgatacgttatatctacttcgcaacatgggaaaggttcaagcacagctacatgcaggcgactacgaaaaagccagcaccttcatcggcaaagaacttggtcagcaaacagtcggcgtgatggggaccggacacattggccgcgttgccatcaagctcttcaaaggttttggtgccaaagtgattgcttacgatccatatccgatgaaaggcgatcatccggactttgaatatgtcagcttggaagaactattcaaacaaagtgacatcattgatcttcacgttccgggcattaaacaaaatacccacattatcaacgaggccgcgtttgatcttatgaagccaggcgcgatcgtaattaacaccgcgcggccgaacctgattgatacccaggcgatgctcagcaacctgaagtccggtaaactggccggcgtcggaatcgatacgtacgaatacgaaaccgaagatctgttgaacctcgccaaacacggtagcttcaaggatccgttatgggatgaactgctcgcgatgccaaatgttgttctcagcccgcatattgcgtactacacagaaaccgccgtgcacaacatggtttacttctcactgcagaatttagtcgactttttgacaaagggagagacgaatactgaagtgacagcaccggcgaaataatttaatctgcaaaaataagtagcaggcgctctgtttttcggggcgctttttttatgtgcaaaaattcattctatgactaacttgtcctaaatttacgtaggatcttagcgtggcgctaagaggggaaaatcaatttacaaagaaaccgtttacaacatctggataatctgctaatataaagtcgttcgaatgaatagtcgttcgaatgaatatttaatctgacgcgcgtctacagttggaatgtaaccctttattcgaaatgcaaagtgaggtaattttttatggctaagaagacaatcatgcttgtttgtgctgctggtatgtcaaccagtatgttagttaaaaagatggaggatgcggctgccaaagaaggtgttgacgcaaaaattttcgcaacgtcaacagctgatgcccacgacaaattagattccgaaaatccggatgtgttaatgctcggtccacaagtgcggtatttagagggcgagttcaagaaggacctgagtattccggtcgaagttattaacatgcaggattacgggttgatgaagggtgataaagtccttaaagcggcgctcgatttaatcgacaaaaagtaggaggctctcatggacgaaaaacaacagttgatggtgatgcaactgatcatggctggcggtaatgtaaagggatcggcatttgaggcaattaaagccgcaaaagttggtgactttaagacagcggacaccaaactaaaagaagcagacaaattcttggccgatgcgcacaatgcacaaaccgggatgttgacagatgaggcacaaggccatcatcaacccgtttcgttactaatggtacacgggcaagaccatgtgatgaatgccatcacttttcgcgatttggcaggcgaagtcgttgatctttaccggaagatttcacaggagtcgaattaattaagggagtgtgaaagtcgtgccaaaaccgagcgagtcgaagtatgacaaaggccgccaagagctgagtctaaccagtatgttttttaatcgctatctattgattcgatatacgaccgcggctttcttttttgctaatttatactggttctttttgagctttagtgctgtaggacttgcaaagtggtggcctttcactttgatcctcacgaccgcagcggttgcagttgaacaagttagtaaatactggcgccgggataataagctaccggtaactaaagtcggatatgcaggacaacttctgagtaactttttggcactggttgtcattgtgaccggtcatggggcaagcattttcccgtttttcgggcaaaaaggaatttcgctgatcaccacagttttattaattggtctgggtatttgtttttatattttggctcgggttcatttaatcgaaacaaatcgtgatcgctatttaaagcgaatacgtcaatttgcccaaagtcttcaataagttgaaacgaggagattaaattatggattcgagtaataacaaactatttaagtttatgaacgctcacctgatggggccaatggggaagctggcctcgtttagaattgtgcgtggcgtgatggcagcagggatggcatccattccgtttacgattgtcggttctatgttcttgattattaatgtgttaccacagagttttccaatattgacagggctgtggaagaactcatttgacaagatttcaaacctctacatgttagcaaacggcgcaacgatgggaatcttgtccctttacttttgtttagtatttggctatgagtatacgcggattcaagcacaggaagagaagattgatgtgaatccgcttaatggcgctctgctttcgatgatggcattcttcatgtgcgttccggaattggtcttcaagggtgggacggcaactttaatcaccgagataactaaggacagcaagattgttgacggatatgccattgccggtggcgtcacacgtctaggaactactggtatctttacagccatcattatgtccattattgcggtaaaactatacgcatggtttgttaaaaagaatattgttgtcaagatgccagacaccgtaccagcaggagtttctcgatcatttacggcattgattccaactgcagcaattgcactaactgtcattgtaatcaacggtatcttgatgatcttcaataccgacatttacaaaattgtggcgatcccatttggctttgtgactaatctgacgagcacgtggctaggattacttgttgtgtactttatcatgcatgctttatggattgtcggcattcacggggcaacgattgtgacctccttcttaacgccgattgtactttccaacatgcaactgaatcaaaagggcgccaatattccatttgctggtgaattcaataactgttttgtcacaattggtggttccggtgccacattaggcatggttatcttcattgcattctttgcaaaatctgctcagcttggtgctctgggtaaagcttctatcgtacctgctttctttaatattaatgaaccgattttattcgggatgccgattgtttacaacccatacactgccatcccattcttcttagcaccaatggcttcgatgaccattgcatattttgccattgacttacacatggtgaaaccgatgattgcacagcccgcgtggccaacaccacttggtttgtctggttttattggcacggcgggagactggcgggcaatcgttctagcctttgtttgcgcattcgttgccttcttgatctggttcccatttattaagttttacgatggcaagctgtatcaagatgagcaaaccaaaggcgcacaagaagcggctgcctaaggttttgttaacggtgatttagatgatttaaaaggaggaaaaaagttgtcagcatttcctaaagattttttatggggcggcgctgttgctgctcatcaatttgagggcggatggtcagctgatggaaaaggaatcagtattgccgatgttatgaccgctggagataatcaaaccaaacgtcgaattacagatggcgttcaaccgggtgaaaactatccgaaccacgatgccattgatttttatcaccactataaagatgatgtcgagcttttctcggaactggggcttaagtgtttccggacgagtattgcctggagccggatttttcctaaaggcgatgaagaacaaccaaatgagaaaggcttgcagttttatgatgacttatttgatgatttgcttgcccatcatattgagcctgtgattacgttgtcgcattttgaaatgccttatcatttggttcaggcttatggtggctggcgcaatcgtaaacttatcggcttttttgttaaattcgctaaggttgtctttgatcgctataaagataaagttaaatattggatgacctttaatgaaatcaataatcaagttgggatgcttaatgaatggtcgttatttacaaattcaggattgatcattcagccagacgaaaacaaagagcaagctatgtttcaagcggctcattatgaggcagtagccagcgcactagctgtccaaatcgggcacatgattaaccccgactttaagattggctgcatggttgcaatggggccggtttatcccgcgactcctaatcccaacgatgtttttaaagctgaacgaatgatgcagacaaattattatcttgcggatgttcaggtgaaaggacactatccggcctttttagaacactattttgcccgacgccaatttaatttggatattacattggaggatcgcgatgtcctactggctggtaaggttgattacattggtttttcgtattatgcatctcatgttgttaaagctgctgatgatgaaccaactgatttcataacattgggatccaatcaggagattaaaaatacgacattacaccgctcagattggggctgggaaattgatccggttggccttcgttatgcgcttaactggttcagtgatcgctatgatgtaccgttattcatcgtggaaaatggcctgggcgcgtttgataaagttgaagaaaacggcagtatccatgatgactatcgcattgactatttacgccagcatattgaacagatgaagttggctgttgaagttgatggggtcaagcttatggggtatacaccttgggggattattgaccttgtatcagccggaaccggccagatggagaaacgatatggcgtcatttacgttgataaagacgatcagggaaaaggaacacttgccagaagtaagaaggattcttttgactggttccataaggtcatccaaagcaatggtgaggatctcacctgaacttgtctagataaacagtgatactgatccacgtttaagctaaaaagaagcccaagagaattttttactcttgcggcttttttattgctactttgaggtgattgtcttttaatatgacatgctactaaatggattgactagttcatctattgaaatggggttataattcaggctaagactttacgaacgagtgtgagtgacgaatatagaggagtggaaaagttgtcacaacgggaaagcagttacagcacaaaggaacttgtgaatcagctgctgaaagatattcaacaaggcatgatccaaggcgcagatggacaacttccaactgagccggagttgatgaaacagtatcaggttacgcggtatacgttacggcaagcattgaagaatcttgccaacctgggttatatctatcaagctcatggcagtggtacttttgcgcgcccgcatcatgtggaaggcgcaatttcacttcaaaacaatgttggactgacggcagaaatggcaaggcaaggcaaaattgttaagacaaccggcattagtcaacaaattgtgccattatcaaaggcagcttttgtacctgagagccagaagttggcgcaagatactgaactcatttcagttattcgccagcgaacattggacgatgaaccttttttagtggaacattcttattacttgaaatcaatggtaggcgaaattccagatagcgcactaaaaggttcgttatttgcttttattgatcaaaaacctggactaaaagtaggtttcattgattctgtcattgaatgtgaaatgataaccggcacaccggcgcagttttttaacctagcagatggcagcccgagtttagtggttcgtgatgattcgtatcttagttctggaaaattatttgcgttttcaaaaatattttatgatttccgaaaaactaaattctttatgcttaagaagatgcactagttttttatctaaccctgaaaattaaaaacgagacgcgctcaaattgacgaggcgtctcgttttgatgtttactttaaaaaatcgaattacccagcagcgccatgacataaatgaataatgccgcagcgttgaccagcatggatactacgatgatcgtgaagcggaccgtgtatggccgcgttccggttgacgcatcaaaaaagcgggagtgtcgttgaccacgataagcgaaagtgaaaccgattaaaagaacaacgatgacactctccacaatcgaaagcagtaagaagatcggtgggtttgggttggcggtcacgagaaaataaccaccaaatgcaatcaaatcaaggagcaaagaaatcagaaccatcagcatacctccgttgtcaatggtgagtggcgtcggtaagtatcattattcgggaaagaagagcgtcaagcaagtaaaagcgccgggaatagcctgaacaaagtaaattttcttactcatcgttgcaccgccgtataagccgacaatggccacaaagccggttagtaaacgaagcgtgatcagttgattcgggccatttaacagcaaaagacttagtggcatgataacagccagcgcaccattgtaaatgccctgattcttcaacagcatttgtgcatgcggttgtttaacaaagtcaagcggtaatgccagattttgcgcctgactcgttggtttgccgaacatttctaaagccatgatggtgagatgcagcagactgagcaagccaacaagcaggaaactgatacgtgacatcgggaaaatcctttcttgggatctattagctcagagcgacattaaataaacggtcgaaattgtgctagtgcaaagccgacaaccgtgacgagcacgaacgctgcaatggcactccagatgatgattttactcagatgctgctgctttttgtcggcaaacgccatttcgagcaaaccgatcaagccaatggcaatcagaatcttgatgaccgttaacatgggattgcggttgaaagaaaaccgcattaagaccacgccgctgatgatggagacgaggtaacaaactcgcgcaatcatcgtccacatgacaaattgacgagtacgactaaaaagcgcaatgccggcagcaactgccaagacggcccatgaaatcagatgtaaccacagccacataaaaataccccctttttctgaaatcaaaagtactagtcccactataccgctttccgaaaagacgtgcgatagccagtgaaaattagcaaaacacgaacattaaacacgactgtttgaaaaataaacgtattttctattgcaagttgcgacattcttcggtaaacttttcatattcaagttaggggagcgtgtcatggaaaacttttttcatttaaagcagaataagaccacgccgatgacagaagtcatggcggggcttacaactttttttgcaatgtcatatattttattcgttaacccgcaagttttgtcacaaaccggcatgccggctcaggcggtgttcttagcaacgatcattgccagtgcggtcggtactttggttatggggttgtttgctaacgtgccgtatgctttggcaccgggcatgggcctcaatgctttcttcacttacacagttgtcttcgcgcttggttttagctggcaagaagcgttggcactggtgttcatctgtggtgtcattaacattttgattacggtcaccaagattcggaaattgattatcgttgcgattccggaagccattcaacacgcgattggcggcgggatcggtgttttcgttgcttatatcgggatcaagaacgctggctttttacagttcacatccgaagcatctagcattaataccatcaacggccagccgcttaaggaaggtgcattgaccctcaagcacgggattgaatccgtggtttcaaacggcggcattgttccggcgctggttaacttcacccaagccggtgccgtgttagccttgattggtttggtcatcatggtgatcttgaacgttaaaaaggtgcctggtgctattttgatcgggatcctattaaccacgattatcgggattccgatgggcgtgacagatttacatctcagtgccgccaactcgtttggaagcacatttgcctcactacagacaacttttggcgctgctttttctgctaaagggatggggtcattgttcgccaatccggataaaatcgtgctttcaattatgacgatttttgcctttagtttctcggatatttttgacacgttgggtacctttatcggaaccggccggcgcacgggtattttctcggacgctgacgaacaggcgctggaacaaggatcaggtttctcatccaaaatggatcgggcgttgtttgctgattccatcgcgactggggttggttctatcttcggtaccagtaacgtcaccacttatgttgaaagtgccgctgggatcggtgctggtggccgaaccggtttgacttccgttgtcgttgccggcatgttcctgctcagttctgtctttgcgccattcatcgctattgtgccgacccaagcactggcaccagctttgatcttagtcggtatcatgatgatgagtacctttaaggaaattgaatgggatgacttgtcacaagcgatcccggccttcatggcatcaattgtgatgggctttgtttacaacatctcatatgggatcgccgcgggcttcatcttctactgcctgatcaagctgatcactggcaaggtgaaggaaatccatccggtgttggccattgtgacaattggcttcatcttgaactttgtcatcttggcatcactttaattcgaagcttagatagacttttaaaagaagctgaaacagccaccgttacttactaagtgaataagtagggcgggctgcttcagcttcttttttagttgggtgacttgtagtatcctcatgctgaggtgatagacaatggcattaaaaacaatttttcatttggacacaacccaacgctgggcgcatttggcttcaaatctcaacaattatctaggcgctgaacccgacgctgacatcgaagtactggtgaatggcgatgggatcaccgtttatttcgatccgcaagtgactgaattcatcgccgcccatccacaggttaaattcttcgcctgccacaactcattacagcagcgccacttagatgaaaagcagttgccagcaacggtcaaagtggttccagtcggggtcgttaagattgctcaggctgaagcagatgggtatgggtatatcaaaccgtaaaaaaacagacccgttcgattgaacaggtctggtcaatgaaatggcagcagcagcaccaacaacagcagtttcacgttattttgccttttctgctgtctgcggttctgtattaaacggaaccaattgccgctcgattgcttcacgctggtcttccaagaatggtggcagttccaaatgcacgccggcttcttcgtaagtctcgtcaagcaggaagccaggaccatccgtggcgatttcaaaaaggatgtcgggaattggccggaagtactctgaagcaaagtagaagcgatccacaaagccagaagaattcaaaccagcattcccgattttctcaatccagtattgcaggctatcacggtcgtcagtgcggaaggcaaggtggtggacgccaccaaagccttgataagctgcgggtatcaaccgctgataatcgatgatgacttgcgcaccgtggccgccgttgttcagttcaagcaaggtgtattgaccgtccttggcgatttgtttaaagccgagcagatcggtcatgacgctgattaactcatcatagtgatcagtcgtgatgtactcaggaccaagaccgccgattgcaaattgtgggtcaaccgtcgaatgtcgccaaggggttcccgctggcacgccttcattgtgttcgtcactgatcagctgatattgctggccatcaaaatcatgaaaacggagaatcttggcgccaaatagttcgtcaatcgcatcatggcgcacgcggtgatcatcaaatcgtttgatccaatacgttaatgcagcatcagaaggaacccgaaaactagtgcgggcgatttcgttgttgccgtgttgtgctttttgaatgccgggaaaatcaaagaaagtaatatccgttcccgcagttcccatgtcatcggtgaaataaaggtgataggtacgaacatcgtcttgattgacggtttttttaatcaggtgcaagcctaaaataccactcatgaaccgaaaaatccgtggtgagcttgatgtaattgcggttagatgatgaagaccggtgagttgattagccatttcgtatccctcttttgcttacatttagtaagtaaaagataacatggctcaccttgaaaaacaagctttgcgttttggttaaaatcattaaggtcttatcaaaatgcccgttttcggccaagttgctgggcgatcgcgtgatatgctcatttcaatcatacaagtggatggcaaaaaggagcgcatgacgatgttcaattttcaggataatccggatgagtataaacggttaatgcaacttgaagttttgattgcggttgtggccatcgcggcgagcatcgtgatgttcaattttggggtcatgaccggcgctttgtttgcggcaattgccggggcctttttccttatggatgcaattgttgagggccttcgtttgctaggagcatcgcgcggttttagccggttcattggcacggcaatcgcgattcctgctttggctggttatctgatcatgatgttcaatcgattcccggtgcaagtggcttaatcaaagttacttggctaccacgctgtcagttagcgggtccggtaacaccgaaaccatgacgtattttaatcgcatttaaaaataggctcctgagataacacggttaagctgtgttttctcagggcctattttgtttgggtatgagtaggggtcacctataagtcggccggtctaaaaatggaagtcttccttatccgcaacatcttcggcggtcaattcatagcgaaccagtggaactttgctgccgtctggtaaggtccggtcatgatgataatcgccgactttggtaaagaagttggtggtcaataacttggcgccgcgttcattggtcgcaggcaagatgacataaacccgcttcaacccaagctcaaaaaaggcaaagcccagcatccgtttgatcacttcactcataatgccttcgccttgatggctggcaagggtctcaaagcgtacttgcgccacggttttcttttggctgaaattccagatacagaaactgccgaggaattcgtggctggcgcgatccatgatgccataaagtaaggcgttgttgctcattaccagccgcatcgaacggttaatgtagcgggcagtgtctgtaattttttgatcaaattcgcgtccggattcggcagcaacttggcgatcggcgcgcaactggaaaatgtctttgatcttaaaggttgtcagccaatccatggtgtaatggacggacataatcggatggtatttttcaaagctttgcatgataggagcctccgtaaacatgatgttaagtatgcgtcagcccaatttaaagcaggcgtgtgagttgcaacttccagtatcgtgacgcatctaggtcatggtactcatcgtttcctgcttaggcgtttgggactgagaacacttgctggagttagcttaacataaaaaccgccaatacactgatttgaaaaccattcgcaatttggtacggaccaaaaggctaaagtcaagtcccgatcttaattaaaaaacacttgagcagacgtatgttatcaagatgtggtagcgaaaacttggagattttcaaataatagcgggctttcttggcctgtatggacgcggtttgtttaccgtcttaaaaaggatttttttatttttttagcaggcaaataaaaactgaaaatgacaacatatagttttagcttatataatcaataacatcgcaaagggggtgagtaatttgaaacagcttttttttggctcatgtcggggttaatgctgttacaaccggttgggttaaacgtggggcaacaagttgaatcggcgctggcgagtcaaccgacaacatctggtcagccgtcagttgcaaccagctcgtcatcggtagctagtcacgaaagtttacaaacaccgagcgcggcatcggctgcaagtgaatcagcggcaacgcaggcatcggtgccagcagtggtcggcgagaaaccgcaacaaaccagtaccacaacgccggcagaatcaaccacgctgaaacgatccaaacgggccgcttcatcgaattcaagcagccaaccgcaaccgtgcttggtccaaaccgccaaagcattggccgaagcggtacggcgaggtgaaacctatatccgcttgactgctgacattaacatcggtcgcgcggcgattccggtcaagcattcactcgtgattgatggtgatcacaaatacacttatatgtacaacggtggcgaaaactggcatgtcggtttgtactttgccgccagtaatatcagtatcacgttcaagaatctgaaaatcggtgatccgcgcgtcaagaactctgccaacaattattacggcattgcaccagcggagaacctcattaagaacagcaagattattgttgaaaatgttgattactattctgatcgcggggcccagccgttccacattcgtaacgcaagcaaccaaatcgtcttcagagggaaaaattcatttcataccactaaaattgctggatcggttttagttcaggaatttgctgaagcgactaactttctttttgaagaagattcggataccacgattaatatggaaaacacagagctgatcggtactttctggccatcaaccggcccgctgaacctaaccctgaaaaatcgggcgcgactcaaagtggttagcgccaatgcactggtttattcagatggcggggcgttgcacaagaatcgcataacagttggggaaggcgcggtcttagacgttaagctcacagacaaaaaagatggcgtgctaatgtaccatgaccacgatttaaccattgatgtccaaaaaaatggccgttttctagccgaaacagttggagcaaacaactttaacaagaattccagcctgaatttagggccgggtgccaaagccgaattgaaaaacactcacggcgatttctataaaaatggcagtgggacgattcgactcgacaacgctgacgaattgctgatgacctcgggaagtcatgggaaaaccagtccaaccgggttgtcggcgtcgaaaccgacgttaacatttgcatcttttaccagtgagacaaaaggatatggcatttatgccgatgatcaatgggtcacggatcaagctgatacatcatcgtgggcatttacgccaacccggatcaaacgcagcccgaccgctttgacgagagggcaggaacaccagattcaggcggcctcacgctttaaggtggttcgtaatgcaactaaaggcaccaccgaaagccctaagaatccgccagtcgtcacaccagctaaaaaacccggtcagctgtttttgaaacaagtaccggattttgattttggaccccgtctgatcaagccggagacccagatcctaaggcccaaagttgatggtgaattcattattgaagacactcgaacggcggcagctaagtcagtcaaagtctatgtcaaagttataaagccgtttaaaaatggcaatctcgatgtgaccagttgtctaagctacatcaaccgctcaggcacggaacaacaactctccgatcaagctgttttggcagaggaggtagacatgacgtcaccgcagtcgttaagcagtcagtggaatcaggccactgacgagcaggctcgtgggctcaagttagtgttgccagtcgagaagcaaaagttgggaacttttacaggtgagtttgaatggtcagttcaagatgtgccgaccaattaagagggtggttccaagtgatgaaaaagtggctactgctggtagttttgctaatcggttttacttgtccaccatcgcaagcgctagcagtcgagacacaaacatccggtgaaattagcttctttgaagttgaacagccggttaatcaaccgtcaccagaacagatcaagccaaagcaacaggtgaacgtaccaccaccgaccaaagaagaccagctaccggcattgggaatgatgaccccactgcttgtgagtttaatcgggctactactggtgttgctgatgctactgattttgttgacaaaacaatctaacacaaacaagaaagaggaagaataaacatgaaaaagttttacgtgatggcatcgatgcttggattaggtatgttgggtttggctggagtaacaccgacactggtttctgctagtgatgtgacttcaaatggccaggttaagtttaagttggatcaaagccaaactgacccgaaaaacccattagatcccgctgataagaacccaggcaagccgaccgatcctactcagcctggtggcaaagttccgggtggcaccgggggcccgttgtcgatcgactttgcttcaagtctcatttttggagaagctgaaatcagtcatgaagatgcaacgtattacgcaaaaccgcaaactttcacacaagacgatggcacaaccgttgaccgcccgaactttatccaggtgaccgacaagcgcggcacatttgaaggttggacattaaaagtgaagcaggaaaatcaattcgcggttaaagacgatccgaccaaggaattgaccggcgcccaactgagcttcacaaatggtaacttggtttcaagcaccgatgcacaatatgcaccgaagttccagaagtcatttgatctcattccgggccaggcacaaattgctccggttgaagcggctgctgatcaagggatgggcacctggatctaccggttcggcgatgataaggagatggccaagtcaattgcgttgtcagtgccaggcaagaccccgaaaatggctaaagcctacacgactgctttaacctggtcattggaatcaacaccagcgaataccacaagtaccccaagcactacaagcacgccaagtacaacgggtaccaccaaaccttaaaaagctggaacgacactgatgatttttggctagcatcaacggtttgctaacggacttgaaacattcaaactcattggagaaggatacgatgacggcactaggccgcatcgttgggggaacttaatcaaaaggagatactttgtgaagaaaaaacttttctgcttcataacgcttattgtgatgttgatcatgcctgccactcaagtttttgcttcggaattaaactttgctgctaaagccgagttaccggacaatcaagtgaatcctgatgttagctattttgacatcaaaatgaatcctggcgctcagcaaacgttacatgttcagttgcgtaatgaaaccgaaaagccagtgacactcgatgtcgagcttgccagtgccaccacgaatctcaatggcgtggtggaatatacacccaacacgattaagccggcaaagagtttgcaattcaacatgaaggattatgttaaagcgcccaagcaaaccgttattccagctaagggcagtaccgttttggatttagctgttaagatgccggataaaagttttaatggcgtcatggctgggggaatcacccttaaagaacatggcttgagtgatcaaggtagccaaacatcagggaaaaaggttgcgatcaaaaatcgcttttcctatgtcatcgggctcctgatgcgccaaaacttagccgctgttccagctcacgttaaattgaatgcggttaagccaagtcaggttaatgcacgcaatgtcattttaacttcgatggaaaatgatacggcaaccttcattcagcaagtagccgtggatgcaaagatctttgctaaaggttctaaccaggcactttaccaagttgccaaagagggtctgcagattgcgccagatacgaactttgattttccaattgcgttggcggggaaagcgttaaagccgggaacgtatgtggctaaactcgaagtctatggtaatcggcagccaaacggaaagatcttacgcacaacggcagaaggtaagcaacattaccgggatcactggaccatgaccaaacaatttactattaccgaaaaagcggcttcaacgttaaatcagcgggatgtgacgatcaagccaagccatccgcagtggacgtacattctaattggtgccgtgatcgtcctcatggcactgatcatcctgctactgattttgctactgcggcgtcaggctaagaaacaagcttcttaatcaaaattgtctgagcaaggtgtttgcaagtttagaaaactggcggcatcatggacacaaataaaggactctgagaattcgtgaacgatattgatccagaagaaacgatgatatctgaaaattcgcgcctttggttatcagcgatgtttgatgctgatggcaaaagtgggcggatttttgccgtgagttcccaaagccgggtgagttatcgttggcggcgtttgaacttagccaatttagcgtatcggcttgccggaaaaacattgttggctcaatcgaggatagaacgtgctaaaaagtaaggtggatcttgtgaaattagttgaactgatggaaaaaaacgaccaaaagaagcttcagttactcaattatcttgatcaatatccgaatcgtcaggtaagaaacagcgagttacaggataagctacaaatttcctactatatgtttaagcgatggacaaaagaaatcgtggacgatattgctacttttcaactggatgatcgttttagtcttgaagtaacggatgcatcaacgatcttgcatgagcaccataataccaatacttcggtctttttggcgcactatctgaaactgtcaccaaaagtcaatatcctgctgacgctgatgacccaacaagccacgtttaacttagcggactttgccgaggcgaactatgtgagttacacgtttatgtataaacgctatattgcgctgcgggagacattgaaaaagtggcagattactttgacgagccaaggcgagctgacgggcaatgaactcgcgatccggctgctattggccaaaatcatggtggtcacacatgtcactgaagataagtttaatcatgaggttcggcaggccttagccgaattgctgggcctcatgaaaacaaccgatgccaagccgtcaatgagccaactgattgaaaccaaggcttatgtgctaattagtttgctccgctgtcaacagggctatacaattgcgagttcccaagaagtggctgatttggtggccaatattcgtcaaggtactttggcaaccagaaacaaagcgattgcgatctatcaggctcattttgacgccagcgatcaggcgattaacagcgaatgtgactatttagggacatttttggcgattcttggcattattaattccgaggaaatcgtttttcctgagacaattaagcagcgcgggcaagcttttatccacggatttgaagccaagtttaaagtgacgttatctgcagttgctaagctgaagattgcgtatgccgtcaataaatgttttgtagatgtcttagtgttaccgtttcgcagcgagtttttcgatgatcatatcgacattagctacttctttaaaacttacccgggattttttgagtattgtcagcattttgttttaaaccaggccttgcacttggaaagctcacaggcacagtttttgttttaccactgtttgttggcactcgccgctaatgttccgttgagcaaggtattagcaccattgtcgatttgcgttgactttacatccggtcacgactataacgcgattattacgcgggatattcaatcattttcaactttgaacattcagatgacccagcaagttgaaccggaaacacaactgattattaccgacttggtgaatgcttatcatgattacgatattccaaaagtgatatggctttctccgccgcggcctgaggattgggaaaatttaattaatgaattactgcgattacgcgagcaggcacaagaagaattccaaaaacgctagaaatttttcgttgtttttttgcaacgaagaattagttgtgaaaatagtgtaaatggactagccacactggattaagcccctttggataacaacggttattcaaaggcgcttctttttatttaactcaaaacattttgatattaataaatgtaatggtatactcgccctattcaaaaacggaggcgagacaccatggaaaaggaaacaggtttttggccggcaattaaagactttttctttcgtgccggtgattttaaaggcgttagttcacgctcacagtattggtgggtatttctggcacagttcttactaggtatcgtcattggctttgtatcagcacttacaggctctatcttgacgacaaccacgcattcttttggcgaaagcatcatcaaatcagtggtcacattattatttatggtgccgatgtatctaagctatccacaactgagtttaacgcttcggcggtttcgtgatgctaaggtcaacccgtggtggtaccttgtgctggtgttagttgcattggtcgggccactgttgaccgtcagcggtatgggcttgttgccaatgatcattttgccgcttgttgtggccctcgtagacctcatcattctgctgttccctagtcgtgagcagactgtgaagccttttccagttcacccgcatatgggcagcacaattggcgtaacttttggggcggcggtcaaggatctgtttcttcgtggtggtgacttcaccggaaaatcgagccgcagtcagtactggtggagcgtcctgttttcagcattgattattgtaccggcgttctttttcctcatcttttcgatcactgccgcccttcttggtagcgccgcattaggtaagctgcaaccgcaaaatatcatcaatacctttaattcattgggtattggggccgtgattttggtggcaattatcctggcaatcgtctatggctggtcaatgcttgctttgcctgttttaacggttatttggcggcgttttagggatgcaggcgtcagtccttggtggtttgttgcttttaccattgcctcgaatatcgtttcggcagttcaaacaagtgccccaaatgtcccattaaacctggtaacactcattcttcttattgcgcaaatcgtcatccttgctttaccacctaaagttcaaaatgacgaagcataaagtaatctgtaccacgcaaaaagtgcaaccttccgcagcggaggattgcactttttaatttgcgcttttaattgcagggtgaatcaataaatacccttttcgtcttcatcaaccagtggatcattaaagtttttgtggaagtacgtgctgtcgataactttaaacttgccattcgaaaagcgcgcaatgatttcgccgtattgaacgatgagtggttcggtattgggaatttcgatttttaggcggccaataggcgttttggtaaggtattgaaaattgtcgccgaagaagccttttaggtcttttgtagtggtgccctgtgaatacggtaagaaatgggtcatttttgccgttgaaaatgccgcaaattcgccttttggaaatccttccaaagatgaaggttgagccatggtattctcctcctaagctaagcgtgagccggtgggcgcgttcatgtgtggggatccgaagcgcatggatcgacttgggcattacatctcaagtctttccacacaggtttatgcgccaatgaacacgtgatgtttgagcgcgttataatgcccggagaggttgtttggacaacatcgcgagtttatgaatttacttatcattatgttaacacaataatagaacaatggaatgattgcgtcgcggcctgaaaacgcttaaaattgaggctggacgttgatcggaggtgagcatatggatcaaagtctgtttcaaaatggtaactttcagccgttagcaagtcgcatgcggccgcaaacgcttgatgagtttgtcggccaaacgcacttgttaggaaaaaacaaggtgttgagtaacctcatcgaacatgatgagattagttccatgattttctggggtccgcctggggttggtaaaaccacattggcgcgaattattgcccggcgaacgcaggcacagtttgtcacattttctgccgtcaccagcgggattaaagaaatcaagcaggtgatgaaagaagctgaacaaaatcgtgaattgggtcaaaagacgattgtgtttgtggatgagattcaccggtttaataaagctcagcaggatgcgtttttgccgtatgttgagcggggcagcattattttaatcggtgccactaccgagaatccatcgtttgaggtgaatgccgcgctactttcacgtactcgggtttttgtgctacacggcttgacgagtgccgagctggttgatttattgcagcgggcgcttaaggatcctcgtggttatgggctgcagcaagtcaaaattagcaagaagttattagcacagattgctgattttgccaatggcgatgcccgcattgcgttgaatacgctggaaatggcggtcaccaatgctgagacgaagcatgacgtggtttcagtaacgcaagctgatgttgctcagttgttgactaagaaagccttattgtatgacaagaatggcgaagagcactataatctgatatcagcattacacaaatcaatgcgcaactcggatgtggatgcagctatttattggctggcgcgaatgttagaagctggtgaagatcccttatacatcgcgcggcggctcgttcggtttgccagtgaggatgtcggaatggcggattcgcgggcgttagagattgcggtcacggtttatcaagcgtgccagtttatcggcatgcccgagtgcaccgtccatctgacgcatgcggttacttacctctcacttgcaccaaagtcgaatgcgctttacacggcatatggtgctgctaaaaaggacgcaactgaaaccttggctgaaccggttccgcttcaaatacgtaatggggtaacggatttgatgcaggatttaggttatggaaaagattaccaatatgctcacaacacaaaagataaactgacaactatgcaaaccatgccggataatctcatcggcaaaacgtactatcatcccaccgaccaaggcagtgaagctaaggttaaagagcggcttgaacaaattaaagcgtggcatgcacaacacccagcccctgaatcgccacagcctaagaaaaagtcgtgagtgggacgctgctagtgggcgttaacactatcgtcagcttgtaacagttcaatgtgctgatgcagagttgaatcatcatgcgttattcggcggcgagggtttctaagcgcgccggctcacgctcatcataacgcgttcgccggcgcagggatctgcgtgtaaggaccttggtcgcaatggccaaagagcggccatcacgcccaaggccgcttacactccgatccctaagcgcgccggctcacgctcacttgtttaaaattaggaggaataaaataatggcaaagattctcgcagtcaatgcaggtagttcgaccctgaagtggaagctttttgatatgccggctgaagtgcagttggctgaggggttggttgatcgattgggccagccgcaatcgaaggttaaaattaaatatggcgacggtcagaagtacgagagcgataccccaattgccaactatcaagaagcagttgccagcttgatgggtaatattaaggcgctagggttagtggagcatttgcacgagattatcggggtcggccatcgagtggttgctggcggcgaaatttttgccgaatcggttgttgttgatgatgagacgttgctgcagattcagaacctgcgcgactatgcaccgttgcataatcccgttgaagcggactatatttcggtttttcggaaaatgatgccttgggcgaatgaagtggcagtttttgacacggctttccaccaaacaatgcaaccggagaactttttatatagcattccatacgaatattatgagcaatatggtgcgcggaagtatggtgcgcatggaacaagtgtccgttatgtgagcgctcgtgctgctgaaatgttgggcaagccgctagaagatctacgcatgattgtcatgcacttagggtctggctctagcatcaccgcggttcaaggcggacagtcaattgatacgtccatgggctttacgccattagcaggtgtcaccatgggcacgcgatcaggtgacattgatccgtcattggtaggctatctcatgaagaagttggcgataccggatgttggccaaatgattcatattctcaacaacgattccggtctgctaggtatctccggactcagcaatgatatgcgtgacttggaagccgccgaggacaccaatacacgcgctaagctggcactggatatttttgtgaaccgcgttgtgaaatacgttggctcttacgctgctttaatggatggcgtcgacgtgctggtcttcaccgctggcattggcgaaaacggtgacgagatccgtgataagattatgcggtcgcttgattacctcagcgccaaaatcgacaatgatctgaattacaagtcacatggcgttgaagcagatctaagcacggcagattcaaccgtgaaaacgctgctggtaccgacaaatgaagaacttatgattgtgcgtgatgtgatggcactgagctaaacctgaatcacaagcggttgccagtataaaaattgaacattaccaagacgctcctccaaaaaagcgctagagatgagttttatgacttgtctctagcgcttttttgcatacttgttgcagatacgctacccatttaattaatgcgctcaatcgaaaattcggatgtggttagcgcgagctgcattaacaattgcttcgggcatcactttgtcagtagcaatatagtcaagcgtattcatcggggcactcatatacagttggtgtttaccgactttggtgtgatcgactaacaacatcacttgatcagcgtgagcagcgaaagctcgtttgatgttggcttcctgatcattagcatcggtggcgcctgtagcaatgagaccgcggcaagaaaaaactgccagatcggcttgataattctcaatatcacgagttgctttgtctccgctgatattctccagcattttattgacagttccgcctaccaagctaacataccaaccattgcgcttggaggcttcaagcgcaaccaagatgccatttgtgacaatgtaaagttcatcaatatccttaagctcgcgaataaggactaaagaggtggtgctggaatcaataaagagactcataccacttttgattaatcggtttgcgcgtgtggctaccacccgtttagcatccagattcaaggtgaccgaataatcatatggaacatctttaggttcttcacttaacgttacgccatttaaaacccgtctgattaaaccacggttctccatatccaaggtgtcacgcctaaccgtagcaggactgacgaaaagttgttttgctagatcgctgtatctagcgaattgctgcgtattaaggatctttaaaatttggttttggcgttgaaatgagaccactaagaaccccttctttctcaaggtgcatcattttatgcaaaattatagcaccgattcgaaaaaaagtgaaaaattttcgatatggtcgtcaactattgtcaaatattttcaatcccctatactacgagatgaaagcggtttacaaacacaaaggaggtacatcaacgtggcacttatgggattggatctcgggacgaccggtgttaagagtacgattaccgataatgaaggaaatatcctttctgctgcttaccgagaatacgagacatcggttcccagagaaggcgaatatgaactagatccgagtgtggtctggtcagcgactaaagaagttattcaagagtcaaagaagttcgtgaaagaagatgtgctggcagtcagcgtttcatcttttggcgaggcatttgtagcagttgatgctcaaggccaaccgttgatgaatacgatgttgcagacagatagccgtggaaaagacgagttgaatgacttgttaacgcggatttcagccgaagaaattcgcaataaaaccgggttgaatcccgcggtcactttcgcggtacctaagattatgtggatcaagaagcatcgaccggagatctatcaaaaaattcatcgtatcctgctttatggggcttatattctttacaaacttggcaatgttgatgccattgactacacgttagctgatcgttcacttgcatttaatgtttctaccaacgactgggattcagatatattggctgctgccggcattgaccgtcaactattacctaagtgttaccggcttggtactgtcgttggaacgatcaaaccagaattagcttctgagttgggtgttaatcccgacatgaagttggtgaccggcgcgcatgaccaaatctgcgtttcaatcggtgccggaaccattgatgttggggatgccacggatggtatgggatcggttgacaatatctcgccaatctttaccgacactagtcatctcaaagaaaatgccaagaaaaattatccgaccgttccttatctggataacaaatataccacgatagcttatatgtacgatggtggaacatccctcaagtggtatcgcgatacttttggctttgaagaagttcaagcagcacagttatccggcgtgagtgtctatgacatctttgataagtacgttccgcaaaagccgacaaatttgctgatactgccgcacttttccggcgctgcagttccttatttcgatgaggatgcacgcggtatgattctcggactctcaggagctacccgcaagcctgatatttatcgggcattgatggaaggggtggcctttgaaatgcgaatgaatctggacaatatggaagctggtggcatgcatgtcaacaagttgcgggcgaccggtgggggttcacgatctgatacctggctccagattaaagctgatgtcttcaatcgagaagttgatcgcgttcatatgaaagaatccggaacgatgggcgtcatcatcatggccggtgttgcggttggcttattcgattcttttgagtctgccatgaagaagctggtcacgattgataaggttttcaagccaattccggaaaacgtggcgttctataatcgtcaatataagaaatatcgtgagttatatgcatttggtaaaaagttacggagcttataggagggtaaatcatggttttagttaatacaaaagaaatgattaaaaaggctaaggaaggccattatgcagttggttcatttaacgtgacggacattgaaatgattcgcggaatcgttggtgcagcggagaaggaaaactcaccggtgattatccagtttgctgaattacatgataagtatgtaccactggatgtgattgctccggttatgctaaatgttgcgcgcaaggcttcagttcccgttgcagttcattttgatcacggggaaacctttgataacatcatgcgagccattcgattaggcttcacttcggttatggttgacgcgtcacaggaaaattttgctgataatctggcccaaactaaagaaattgtcaaaatttgcaagcctctgaacatttcggttgaagccgagcttggaccaatgaatcgtgaaggcagtggcgataagaaagttgattatgccgatctaaataagacgtatacgaaccctcaagaagccaagcaattcattgaagagtccggcattgatatgttggcggttgcatatggaacggttcatggggtttatacccagaagccgcacttaagtttcagtcggttaaaggaaatttctgatttggttgacttcccactcgtcgttcacggcgcttctggattgacagatgaagaatatcgtaagtcggttgaaaatggtatttgcaagatcaattactattcggaaatggttcatcgagttgcgttgggtgttcaaaagaaattagaacaagatgatagtgataaacaactatttatttcggacgctagcatttgggaaaccgaaatggtcgaagaagaaattcgcgggcgactacgggtcttcggttcggcaggtaaggcttaagcaattcggaaaacaggcggataggggactgtccgtctgttttcaaggaagaaatgagagcgcttcagtttagagaatagacggcgctcaacatataaggaggctttttttatgaaatttctggttgatatgctcagccagccttccatcattgccggaattgttgtcttggtgggcttgatagcattacgtaaaccgtttaccgaagtcattggcggaaccgttcgagcatttatcggttttgtcgtcatgcttgcaggtaccaatattattgtcggtgcgctgaataactttgctaagttatttaccaaggccttcaacatgcatggcatgattcccagtaacgaagcggcaatcggagtgacagttgctaaatacggaacagttgcaacttttatctttgtctttggacttgtattgaacattgtgttggcgcgtattacgaagtttaagtatattttcttatcaagtgaccatgcgttttacatggcatgttgtttaacgccgattatgatcttaggcggcttaaatacggttgaagctatcgtctttggttccatgactttaggtgtcattctctgcgtcttcccagccatcgcccatccaacgatgaaaattattactggacgtgacgacatgagctttgcccatttcggcacattggaatactggctatcggcaaagatcggatcacttgtcaataagaataagaaatcgaaatcgattgaagatattaatttcccgaagtcattagcatttttacaagatagcaatgtttccgttacgattgtgatgaccatcttgttcttcgtggtgacggcagtggccgggccggcgtatgttggtaagctaactgacttgaatccatacgtttgggcgctcttgcaagctgctcagtttaccgcgggcattatcgtcttagtccaaggcgttaatatgttattagctgagatcacaccggctttcaaagggttcagcgaaaagattgttccaagcgccgtacccggttacccatttgccattctgtttaagggcacatccaacgcattactggctggtttcttggtaagcttactcggtggtttactttctatgggggttcaaatcataatcgggacaaccattgttattccggggattgtgatgcacttcttctgtggcggtatcgcggcaatctttggcaatgctacgggtggtcgcaaaggcgcgctgattggaccgtttatcggtgggattattctaagctttttgcctttggtcgccactggcctttatggggggttgggttacactgcaacttattggtctgatagtgatttcaatacaatcggggtgttacttggacttgttgctaaagttggtaagtggccgattatgctggctgcattgattatctttgccttcccatttgtctttagtgctttacacaagaaaaaactggttgattaatagcaatttttgaattaatagcgctgatatataaaaagtcgatctcatgaagagtggccgcatggcaaacgcgactgcttttcaggatcgactttttatgtactgcgtagcgatctgagttttctaatgcgcagattttcagaagttattcggcgttaatcccttggtcagagtccaccatgacgcccttcgtttcatcaaacacgcaaatgttgccatagttttccttaaatcccatgtgattgcccccatcaatgaaataacgcggcgattcatgggggtactgaatgactttaaccggacatttcggatagtttccagttaagggagtttcgggaactggcggtttcacatcgccggcatagtcaccgtagattaaggcagttggtgtatgtccggtaacaatggttttgttaagcggattgtgcgcaaagatgggatgctgacgcgtttgggtttgctgcatgtcataaatataaggctcccggacccacatgcggttaaacggtgtggtctcttttaaagggttctctaaggatagatctaatccggcgtgaatcagtaaaagcttgtcaaacgtcaccgctgtgggcatttcagcaatgaatgtaatcagaggcgcgatatgttgctgcaccgcttgccgtaaattggacttttgcgcgttggcggggacaaaatccttgatcatttggcgcaacgttactttaccgccattgatgaaccaaggattatctttgtccgccaaataatccagcaacatctgatcgtgattgccccgaactgcaattgcctgactattttggacctgttcgtaaatctgactcaaaacgcggccgccatacggatagccgtcgatgtagtccccgagatagacggtgagtgcatggggatacttggcttgcatcaagcgaacacgatccattgtttttaaattgccatgaatatcggatacaacaatcatggtcatcgcttttgcctcctcacgtctttgtcgtcaccttttttgctgccggctgtggttttatttaacatgctagttcatacacttataaataacggttacgtctagtttactttatttttgcctgattgtgcgatattaataagaggttaggggtgaaaagatggataaacggttaattgtcatgcacaacttgagtcagcactacggcaaacagtattggtggcagcaaaactcactggaagattggttgatgatgatcctgatccagcgcaccagttctaagaatgtcgcgcaggcggtgcataatttgcggccttacatgcaggttgatcgcttgctggcgttatcacaaccggaactggaaacacttgtgcgaccggccggattttaccgccaaaaagctcagcgcattcatgatctattggtgtggtttgtggctcaaggcggcagttttgataagattgccgaaaagccgacagccgaactgcgcaagactttactggcattaaacggtatcggcaatgaaacggccgatgtcatgttgatgtacacctttggcaagaaaacgtttgtcgcggatacttatgcgatgcgcttattcaatcgcttaggtttcggaccctataaaaattacgctaaaatgcaggccgattttaccccattgttggcaggcatcagtttagatgatgcgcgggaatggcacgctcttatcgatgaacatggaaaaacgcaggtacggcatgcctatgatgatcatttcttgcttcagcccaacttgcctgaagcagcttggccaccggaagcaaaacaaattgagcccccgcatgacgatcctggcagcggcaaatggcgccgaatgtcagagcagtctgacaagtaggcaagccgccaattttactgaataatgtcccggttaggatcgcgccagttaatgacaataacgaggagcatgatgatgacgaccatgatgaaaacaccgtggaggccagtgagaatggcggcggcagcatgaggatcgtggacggtggttgctgagttggcgctgatcgctgcattgacggctttaaaggaagtgccatgcagattagcccggatcacaagcgttaacacggccccataaacccccgtcataatcgtttgtcccaacgatcgccctagagtcaagatgctagttgccgagccgacatagcggtcaggaaccaagtgttggctaagcaccgtgttcatactaatgacaatccccatcaccgttccgttaatcatcgcaatgacataaaaagcccaaactgggaatgaggacgaagcaaatgtgagcagtaggtaggctaacgtcagaattgtgaccagggccagtgtcaaagtacgtggcaccatccgcttaatcaaagggccaactaaaaacgacgaggttaaccataatacggaactagaagtcacaaccaagcctgcagcggtggcccctaaatgataaagcgactgtaaccagataggaaaataaacctgataaccgattaagacgccactaagcagcaaagccgttaagatttggacggtaaaggtgaaccgatgaaacatctgcggcgcgatcaaagggtcaacagcgcggtgttcttggcgaattaacaggtaaccgccgacaatggcaagaacgattaaaagtgcggctaaccacggctgctgatcaagtgcctgaatgcctaaaagcaaggcaaccaaggtgacagccaaccaagtgatcccaagccaatcaatcgtaagcgacacatgttcccgccgcggttcccgatagccgatttgaattaagccaaagaccagaattcccagcggcacattcacaaagaacacccaatgccatgacaactgatccaccaggaaaccgccgatcaaagggccaaccaaggcggaaagtccccaagccgtattgttaagtgccagcacattcgcgcggtgggcaaaatcgtaatagtccgcaatgatggtaaaagttaatggcatcaccgcaccagcgccaataccttgcaacgcgcgcgctaaaatgagcagtaaaatatgcggcgctaggccactgagcagcgtgccaagcgtaaacagcaccacaccccactgaaaaacgccacggcgcccaagcgtatcagccaacttgccataaattggggttgtaatggcagttgtgagtaagtaagcactcatgatccagctttgataagccagcccatgcaaatcactaataatcgcgggtaatgccgtcgtaacaatggtgacttcgaccgaggtcatgaaagtcgcaataaaaaccgccgccataacgaggccgcggccttgaggttttgtcgatgtagacatgtggccaaccatctccttaatagctctattgtaacaattaaggtcaagagttttgaatggttataaggccacaaatagctttattaaagatatgcaacgcgatgtttaaagatgaacagtaaagtcacaaataagatgattagcaaaaacagattcgtaccaagattgattaaaacgaacaatggcggctggttaagaccggtcgtgatcaagtacgggcgatttgcagccacagttaaaatcaagaaacttaaataaagtagcaagccccacgtttcattaaacaccgttgtaagacaaaagaagatgatggtaccggtgatgatgctaactagtggatggtgaaaaactataaaagtactttcatgataggctttgacaatagttaagtgtataataagtgtaagcctagcactaacaagaataggtcttcatggcctttatggtctagtcgtcagggtgttgcacttgaattgtaaactggggcttagtaaaattaacaataaaaaattgccggatcaactaattaaaagtttcacggtccgggatacattccgaaaaattatgaaagacgctaatgcactacgctcggagttcaaattggattttttatacaaaacacaaaagaaacaagggaactctgggtttgtcatccattttgcccagacagatttgatcagcaaaggcgagaaattgcatgcctattttgacgagaacttgaggcaagtggttgtcggtgaaaaaatccgtgatgatctgcattttcatcggatgttgccgataatttctgcatttcttcggggtgtaagtggctttattttacagcgggctagggaataccaacagttgaggaacagaaagctatcgccaattgatgaagctatgacgattgaagacgcttgttatactgtctacaacgctttaggtttgtcacaagtgcaagctagagtcttactttcgctcagctacactttttcaaatcaaggtgggattaagctttcatactatccacatagtagtcgccggtttcagcagcgggggcttagcttatttcaatttacaaatgatgctcaacatgaattacggaccgagatcaacgcttcctttttttctgtgactccggaacgttttttgctgaatatactgagtaaggctaatgttttagggctctcagcgacggctactttacccactgttcttgataattatgacttggaataccttcgagatatgcttggcccgcgtttattgaatggtgccgattacctgagcaaaactacgcgtgaagaattcgatttcaaagcgagatatatcaaaggtaacgttcacatcaaaccggaaataagcggcatcaaccggtctttctcagagatcttagaaacagatcgttctagcgttgataaaaccgatattagaacattagatgctattttagaacagaaaataagtatggtttgcgctggtggtcggaaaggcggtaaggattattatcgccaacgatatttaaatctatttaatagctttaaaatctttctgaatgacccactgatgacttcgtttctaggcttgcagtcgttactcccgagtggtggaagcgaaatgaatgaacagtatatcattgatacttttgagaaacttaaacagcggatagggtcatcgacagcaataaatacagaactaaggattgtttcatcacgcaaaagtggcagcattgaagaacagctagaaaatgccttaagtcttcctagcaatcaaaataagcgtgtctatattctaagtgcttatcagacaattggaatcggacaaaatctgcaacatcaaatgaacgaattcgaacgaaaaaacgttataaatatcgcccccaaaaatgccgctaaagatgatccaaggcaaaaaaccgttgatttagcaggtgtttatctagcagatgtcacgcatattcttggcagcaatttgccttttaaaatggatgcgtctggacttcgcactgttatagagcgccagtacctccttgataataatgagataagcgttgatgacttgatgacgtttttgaattatctgcaaaagcaaattccccaaccccaccctaaaaatgcccgcagtctctatgtcagttattcacgaacgatcattcaagcattggggagaatgaaccgatcttttaataaaatgccaaccttacgaataattgtagatcctcaggtgatttcaaacatcaccggtagcggaatcgatctgagtgggacaagtcttgaatatcgcacgttgcttgaattctcaggaaggcaaaatccaaactatgaaagatcgcgcgtagaacatgcgaaggcaaatgcaacattttacacctatcgggacctttttttgatggcattatatttacagaaggatcccgaaacagcgcaattttatcgaaggttacgactattttatgcacagcatccaacttgttcaaataaagaattaatcgagagtaagattattagagaatatcaagatgaacgtgggttgcaatacttgtgtaatgagaggtcatgtaactcttacgaggttaaggcgccaaaacgtgatagtggtcactttgattttggtggcagtggcatggaaatttctgccgaagcgtcggggttgcttgcaatgtgtcattttcccggtctaaaagaagcatttgaagcagaaggtatcgcaacggaatggaagcctaatgagcgaattctgaatccaatccagttttataactattgtggttttatcggcgagtttagcggtaaatttatgatacagaagatttttaacattgaatcagatgtatttcatgacttagaaaataatgagttatttgattttcaatggcaaggagaagtggctattgatttcaaaaactggcatgcgatgccacgtgtgaatgctgataaggaacgagaaaaggttgaagacaagttaaaccgactggaacttaatactaagaaaaaatggcgagcgattattattaatgtcgtagcgattaatcagggaaaactgattatgacagttgatggcaaaattcttgaagtctccgggttgattacccatgacggccagattgctttaaccactgagcagcaattccaaatagggaggtttttcaataacaatgcagacaatggtacagacaactaaacttgattatgggattaacatgttgcagttgcaggctgactttcattttctgctagtcaaagttgctaataatgcttatgctagttataaccgtctaattggctcatgcatgccccaagcgctcacagctataggaaaaggtaaatatctgctcatgttcaaagaattacctatgttgtcacatgacgataatctgaatgttcgcgagattttgctggaaaataaaagtcaattcaggattttccccaaccacttacttcagctgctagttaatgaacagactgccaacagtcctggtttgtcagaagcaagcaaaacacctgagcttctcgttgtaaaagagaattggtgtcagcaatgttcagatatgcggctacaatgttttgcaataaacgtgaaggttaactgggaacaggatctggaactcagagttcaaacatacacggagacagcagaatttaagtgggataaaccaatctataaaattgatgctgaacatgagcggttagtccgttgttatcaaccaacaaatgggccttactttgttcgcgggaaccggaaacggaatcgcaattctgttgagtttttgtctctacaagatgagtcatcgtttttgcaaagtaaggtagggattgcccagacagttttgaacaatcttaatcgaaatgagaaagcgtatttgactcgtccagttacttttcataaaagtttggtagaacaatattcacgtacgaaacttaacgaaacccaagctatttggaagcagattgctggcagtcaacttaccatatatgcgcaacctgacgataaattaagtacaggtttagctgatcgcatggcaatcgagctgatgaaaagttacattgtaaaagaaagcaagattcaaattaaacgtatgtcgaaagcccaatctggactcaatatacaagttattcgtgatgaacgtgaaggaacagcaaaggactattatgaaatcagcgcaaaagatcaaattattcaacatgtaaccgttgaaaagtttggcaattatcgcaatggtgacgaagaggttaggtggaaaccaagcgttaccgggaaagataaggacccgggtcgtgatgtctcgatcattaaacttatccaagaactatgcattaagcgtgacttggcacgaaagcgcttggagttcgtggaagaagcattagcaattaagacgctagcatttagtttttattatttttactttctgcatgagtcacctgatcccgaggtaatggtgattaagctaagttttacatccaagaaggagatggtattttctaaaaaaaaggtatctttaaattggttggaacaggatgatgagtttacccgagtttgtcaactagttttctttagtattttttctgcaaaaaagcaattcgcttgggatagcgttgaatgtgttgttgagtttgaaggtaatcaagtcctgattcaacaactcaatcgtactgtgatgcctgatggggatcgaattaggaaacaactaagcctgaataacccaaaaagaatcctctcacgagaaaagattctgaacgagctgaataaactgcgatctctaatttccgacaatgaacagttggctgcggcgtataaaatattacaacaagttatagtcggtatgcctgtttcctttactctaaaagaattggacactgcagcacgtgcccaagacctaacaccacgtaaaaatggcatgaaacaagttaatcggtttttagaggccaatgcttcatttacactgaagacaacgctgcaacgagaaatgcctaattcgccacttaccggaatgaagtggattggacttacacgaattgaggacagtaatttgggatttaatgcgttttattttgttggcagcagccgatcgctacagacaagaattcctcgggcagtaacattacgccgcctgttacctttaactggcgatgatgaaatgattgataatttatttcctaaacttgcagcaatgatgagtgttgagtttgtgcgcagtggtcagtacaccgttgttccttatccagtgaagtatcttagggagttttggctcagtgagcaaaggaagtatcctgaatatcgcaggtccaagaataggcagtaaagaaaattatgaaggaaaaatctatgtttggctaaattcaatgaccaaccatagattttttacatggttgtgcttgtcgtaatatctgacggtggttatagtggttttaaaagttcacgccgttgtttgaccgtggcaatatttaaaatatagtcatcgtgctaatgcaataacgcactaattgagacctatttgcaaacgaggagtctaaatgaatgaacaagcgaatttcgccaccaaagttctaacccttcatcaacgactggcaagcgtcaaaatgacgttacctggtagctatcagttggtgaatccatatagcggagagcagaagcatgcagttgaccagatcacggcagctttttatcataaatattttaatgataatcacaagcgccgattaattttggggagctcgccagcgcgaaaaggcactgccataacgggggttccctttgaagatgcagccgagttacaagcagagacaggtatcgctgtggcgaagttccagattaagccatcgtcaacaaacttcttatatgatgtaatgcagcaatatggtggcaagagaaaattttatagtgacttctacatgagctttgcttgtcctttggggttaagtaaaataagtgctaaaggaaacgtgataaatagtaattattatgaaactaacgtgattaaggatagactaatgccattcatagttgcttcattgcaggagcaaatcaaattaggcgtagacacctcagtttgttactgtattggtagtggcgagaattttaaggtgctaacaagtatcaatcagacgtatcatttctttggtagcattgtcccattagagcacccacgctatgtcatgcagtatcgctttaaggacagagcccgctatattcaaaaatacgttgctgccttaaattgtaaataaaaggagtttgaaatattttggcaattcaatggttccccggtcatatggccaaggcccgtaagcaagtacaggaaaaaattaaacaagttgatctgattcttgaagtcgttgatgctcgaacgcctgaatcgtcacgtaatccgatgttagatgaattggtgggtgataaaccgcggattatcattttaaacaagcaggacttggctgatcctgtactgacgaatgaatgggttcggtattatcaaacacaaggctttgctgcgattgcgattgatgcacaacatgctaagcggctacagcagatcccccaagcggccgcgaagttaatggcggaaaagattgcgcggaaaaaagcccgcggaattcgcaatcccatgattaaggcaatgtgtattggtattcctaacgttgggaaatcaacggttttgaatcggttggttcgaaaaaatatcgcggtgaccggcaacaagcccggggtaaccaagaatcaacaatggctaaaagcgagcgacaactttcaattacttgatacgcccggaattctttggccaaagtttgcctcccagacaatcgggatgcgcttggcattcacgggagcaattgccgatgctgttttccaggaggatgtggttggtttgtatggactgacctattttatggcgcactatccggaggcgttgaaaaaagcatatcatctgactgacacggatctgcaggctgcaccgcatgaagtactggtaaaactaacgaaaacgcaaggatttggtgaggaatttaatcggatggcggaacggctgattttcgatgcgcgccaagggaagttaggtcgatttacgttagagaaaccgggtgaattagatgccgacgctgagtgaatataaagctcttttacaagctgatcatgttgatcccgcggttttaatggcactggagcaggatagtcggattggggcggggaaactcttggcggcttatcaacgccgacaggaccatcaagcagcagaagcggttgccttacgatatcgtagtagatatgagcgtaagttatggacaatgtattcccatgttgctgggttagacgaagtagggcgcggaccgcttgctggcccagttgtcaccgccgccgttatcttgccgcatcagtttaaatggccggtgaacgattctaagcagctgacagcgcatgaacgagatgtcttgtatccgcatattttgacggaagccattgcggttggcatcggggtggcagataatcacgaaattgatcgggaaaatatttaccatgcgacggagctagcgatggcacaagcagtttcgcatttgcgggttgccccagagtttttactggttgacgccatgcatgtccccgttaatttgccgcaagaacggctcatcaaaggggatgccaatagtatcagcattgcggcggcaagtattgtcgccaaagtcattcgggatcgcttaatggtgatgtacgatcaggtttacccgggctatgattttaaagacaacatgggttatggtacgaaagcacacttagccggattagctgcacatggggtgacgccgattcaccggcgcagttttggccccgtaagacattgtctgaaatcctagatatttcttaaaatattcgcgtaatgttcaagtaggaggaagacagcatgacattacgtgattttttattagcatggcacttggctacccatcagaatccgcgcttggcggtcagtttgcagcaagctattttggaaaaagctgatttgagtacctatcaaaatgacctcaagcagaaattaacgccagcagttgcacgaattttaagtgcagcacgcgagaccccgtatctgacgtttgttgatactgcctatcctccgcggctgcgcgaaatcccgcagccaccgtctgtcctcttttatcaaggcaatctcggcttaatcaatcaattaactttaggtgtcgtcggttcgcggaaggcaaccaactattcagctgaagcactgacgcgactgtttccgcaattaccgcccatgacaattgttagtgggttagccgctggtgctgacagtatggcgcatgaagcggcacttgcagccggactaccgacgattgccgtgattgctaacggcatcgatcaagtgtatccggctaagaatcgcagcttacagcgacaaattagtcgggtgggattggttgtaagcgaatatcctccgggaacagcaccgcaacgctttcaatttgtggcgcgtaatcgcatcattgccggtttagcgcatggcgtcatggtgaccgaagccgaaattaaaagcggcagtctgattacggctaactatgccttgcaacataatcgcgaagtttttgcgctgcccaatcggtttggcgatgtgctaggtgcaggcaccaacgcattaattcaagcaggggccgccattgtcaccggtccggaaaccttagtagaaaatctgcatttttacccgtaaagtgtcaaaatctgcttactttatagtagaaaaattttcgtttgatttgacaagagcaaaatgactagcttatgatagcaactgttttgagccagcaggcaagatggcccagttttgagcatcgggacgcaccgtaaattttttgcctagctgaaactcatgaagcgttgacggtgaatcgtcagcccgcacaaattaaacagggcttgcttattgtagcaatgccaccggaaggagcgcgttcatggccgacaagaagttagtcattgttgaatcgccagccaaagccaagaccattgagaagtatcttggccgcacctataaagttgttgccagtttaggccatatccgtgatttacctaagagtcagatgggcgtcgatgttgaaaataactacgaacccaagtacatctcgattcggggtaaaggcgatgtgattaaatctttaaaaaaggacgcaaaaaaagccagccgcgtttatctcgccgccgatccggatcgtgaaggagaagcaatcgcctggcatgtcagtcatatcttaggactggatccgaatgccaagaatcgggttgtttttaacgaaatcaccaaagatgccgttaaaaatgcatttaaaacccctcgtggtatcgatatggatcttgtcgatgcgcaacaagcacgccgaattctcgatcggctcgtggggtactcgatcagcccgctgttgtggaagaaggtcaaaaagggcctgagtgccggtcgggttcaaagcgttgcgttaaagctcatcattgaccgtgaaaatgaaatcaagaactttattcctgaagaatattggtccttggatgccgaattccaaaaaggccgcagtaagaaattctccgccagtttttatggcatcaaaaacaagaaaatggcgctgaagaacaatgaggcggttcaaaaagtcttaagtcagattgacaaggcaaagccattttccgtcaccaatgtggttaaaaaagaacgcaaacgtttccctgcaccgccatttaccaccagtaccttgcaacaggaagccaaccgtaagctaggattccgcactcgtaagaccatgatgttagcccagcagctctatgaagggattaacttaggcggtaagttgggtacggttgggctcattacgtatatgcgtactgattcaacccgggtttccaacgttgccaaaaccgaaacgagtcattatttgcatgaaaagtatggcgaggcttatgctgctgtcaaaattcgccaaggtaagcttcaagaaggggctcaggatgcccatgaagccatccggccaacgagtacgctacgaacaccggaaagcttggcgtcggttttagataaagatcagatgaaactgtaccgtttgatctggagtcgctttgttgctagcgaaatgacgccggcgattattgacacagtcgccgtcacgctcaatcaaaatgacgtgacgttccgggcaaatggcagccagatgaagtttgaaggttttaccaagctatacgtttcctcgcgagatagcggtgaaaaggataacgttttaccaccgcttgcagtcggagatgctgtgaagatgctgaaaaccgatccggcgcaacatttcacccaaccaccggcacgttattctgaagccaacttggttaaggctctggaagaaaacggggttggccgcccatcgacgtatgcaccgaccatcgaaaccattcagaagcgttattacgtcaaactcaacgcccgccgctttgagcccacggaattaggcgaaatcgtcaatagtctgatcgttgaatttttcccggacatcgtcaatatcaagttcacggcgaatgtcgaatccgaacttgacagtatcgaaaccggcgaggccaattgggtcaaagtcatcgaccagttctataagccatttgaaaaagaggttgcgcacgccgagaccgggattgaaaaaatccaaatcaaggatgaaccggccggctttaactgcgatatctgtggcgcgccaatggtgatcaaaatggggcgttatggcaaattctacgcctgctctcgattccctgactgccgcaacaccaaggcgatcgtcaaagaaatcggcgttatttgtcctaagtgtcacaaagggcaggttgtggaacgcaagagcaagcgtaaccgtgtcttttatggctgctcccgttaccctgactgtgactttgtttcctgggataaaccagtcggccgcgactgcccggtttgcggacatttcttagtcgaaaagaaatccaaagccggcacccaagtcgtctgtcctaacaacgattacaaagaagccttacaaaaagcataaatcacctgacagcaagtacggatcctttgtacctgctgtttttttcgggtacactaaggcaaagtacgagcagaatcgcttaaaaataaccaaacacaaccaagatgaacgtcttaagatcagtgatccattcaatcaaattaataacctcaccaaggaggaattcatgatgcctactgttaacgttattggagccgggcttgccggttcagaagctgcctggcaaattgcccaagccggcgtcgatgttaatctctacgaaatgcgccccgtgaagatgacgccggcacatcacaccggtaattttgccgaactcgtctgtacgaactcactgcgcgctaatcaaattactaatgcggtcggacttttaaaagaagaaatgtggcggctgcattccattatcatgcaaagtgccgatgcaaccgcggttcctgccggtggtgcgctagccgtggatcgcgagcctttttccgagctggtgacccggcagctgacaaaccatccccgtattcatgtcattcatgacgtattaaccgattttccggctggcataaccgttgtggcgaccggaccattgacagcaccggggcttgccgatgcgattgttgcgttgaatggcgaagcaggcttgtccttctttgatgctgcggcgccgattatcgacgccagcacgattgataacgacatcgtttataaaaaatcgcgttatgaccggggtgaggctgcttatttgaattgcccgatgaataaggaagaatttcaggcattttacaaggcgctggtgacagctgaggttgctgaaggtcacgattttgaaaagatgacggtgtttgaaggttgcatgccaattgaggtaatggccaagcgcgggatcaaaaccatgctatttggtccgctgaaaccggttggcctggaagatcccaaaaccggcaagacgccatatgcagtggtgcagttgcgtcaggataatgccgcagccagtctttataacattgttggttttcaaacgcaccttaaatggggtgagcaaaagcgggttttccgcatgattccgggtctggaacatgctcagatcgtccgttatggcgtgatgcatcgcaatacatttatgaaatcgccagtggttcttgagccgacttatgcgtccaaacgccgggctgatctcttctttgccgggcagatgaccggggttgaaggttacgttgaaagcgcggctagtggcctgattgccggtaccaatgcggcgcgtctggctttggggcaaacgcccatcgcttttccgcaaacaactgcgatgggggctatggcacactatattacccacacctcgccgagccactttcagccgatgaatgctaattttggtattatgccgccgttagcaatcaaggttcggaataaaaaagaacggaatcaacaactggcagagcgcgcattgaatgatctggcaacttttcaaactgaattacaaagcgtacatcagtcctaaaattggaaaatgatctcgggtaaccgggattttttcatgatcacgggtcgtcatgttcaccaagcagtcaatgagcgaataatggtggcggattgcaatttttttgcctgtcttcgcctacatttacggcaggtttagtggctgaaaacgtcaacaatcgttctttttatgttaatctattaagcggagggatgtcgtgatgaagccacttgcagcgtttcaggaatacttaaccgttgagcgccagtattcgccggaaacggttacggcctatttaaacgacattcaggaatttcaggcttttcttaaggcgaatggtgggtttaccgactttagcaaagtggacgacttggacgttcaaacctatttaacggacttgaacaagcaggcgttggcgcgaacttccattgcccgtaaaatcagtagtttacggagtttttatcggtatcttgttcggattgatgttgtgaaacgcaacccgtttgaattggttgagttaaaaaagcagcatcatcatttgccgcagtttttctatgaggcggaaatacaggaactctttaaaacggtagaaggggaaaccccgttggatcaacgtaatcgggcattactcgaggttttgtacggtaccggcattcgtgtctccgagtgtgctaacttgacgttgaatcaagtggattttaataccggcttattgctgattcacgggaaaggcaacaaggatcgctatgtgccgtttggccgctatgcccagcgtgcgttgcagacctatctcaaagacggtcgccagacactgatgaacaagcacgatgcccagcaccgatttgtgttcgtcaaccagtatggccgaccgattactgcacgtggtattgaatatattttggatcaattaatcaagcaaacgagtctgaccgcgaatattcatccccacatgctccgccatagctttgccacgcatatgctggatcacggggctgacttgcgcacggttcaggagttactggggcacgcaagtttgtcgacgacgcagatttatactcacgtgacgatggcgcatttgaaaaacgaatatatgaaatattatccgaagcataattaagactaaagcacgatgtaattgcacgacgaattttttaaagtatgaacattggcagatttaacaacactgccagttctgattgattatccgatatcaagaaacaaaaaaggagcataccatgacaacaattgcagcagtgagaaaagatggcgtgaccgctttagccggcgatggccaagttactttgggcgaaaaagtgatcatgaaaggcaatgcccaaaaggtacgccgaatctatcatgatcaggtcgttatcggttttgccggcggggtcgccgatgcgtttacgcttcaagactggtttgaaaagaaactagagcattattccggtaacttacgacgttcggctgtcgccttggctcaagactggcgtaaagatccaaccttgcaaaaacttgaggccatgatgatcgtcatggatgagcatgatttgctgcttgtttcagggtctggagaagtcattgacccagacgaggacgtggttgcgattgggtcgggcggtaattttgcccaagcggccgcaattgcaatgttgcggcattcaccagacatgacgccggctgatattgctaaagaagcggttaatatcgctggtaatattgacatctttacaaatcataatattatcgttgagagtttctagggcgtgtgtgtttgcgttatagggcgttcgttggtgcagaggtctggatgtaaaggcttattgcgtgctggctcacgctccataacgcgttcgccagcgcagaagtctgcgtgtaaggaccttaagcgcaatggccaagaccgggccatcacgcccaaggccgcttacactccgatccctaaccgcgctggctcacgctccataacgcgttcgccagcgcagggatctgcgtgtaaggaccttggtcgcaatggccaaagaccggccatcacgcccaaggccgcttacactccgatccctaaccgcgctggctcacgctcactttcttttaggaggttcccatggtagaagtacaaacaccgaagcaaattgtagaaaagcttgatcagtatgtgattggtcaggatgaggcgaaacgggccgtggcggtggctttgtataatcgctatcggcggatgcagttgtcgccgaagatgcaagaagaaatcacgcctaagaacttgcttatgatcgggccaaccggggtcgggaagactgaaattgcccgccgcttagccaagatcgtggaagcaccgtttgttaaagttgaagcgactaaattcactgaagtcggctatgttggccgcgacgttgaatcgatggtgcgggatcttgccgaaacggcggttgccatggaggaagaaaagcagtttaaaaaagtccgggttcgcgcggaaaaagaagctaacaagcggctggttaaaattttggtaccggctattcgcaaagaaaaaaatagcaatcccatggcggaaatgatgagcatgttgcaaggcatgcaaaatggcaagatgcccgcgggtgacgatgctgatgctggcggtgaagtgacggatgatattcgcaatcgccgtttaagcgtggcggagcaattggaaaaaggcttattagaggatcgtgaaattaccgttgccgtcaatgacgagaaaaaaggcggcggcatgagtgatatgtacggccaaatgggtattgaccttagtgacacgattggcgctttgatgccgaagaaaaaagttgaacgcacgatgaccgtcaaggaagcacgcgaaatcttcatcaaagaagagtctgataaactggtcaatcatgccgatatttatcatgatgcgattcaaagcgcggaaaataacggcatcattttcatcgacgaaattgataaaattgcagccggtgataaacacacgagcggtgaagtttcccgtgaaggcgtgcagcgcgatattttgccgattgttgaaggctcacagattaacaccaaatacggaccgattaatacggatcacattctgtttattggctcgggcgcgtttgcagaagccaagccaagcgatttgattgctgagttgcaaggacgttttccaattcgcgttgagttaaaagatctaacggaacaagatttcgtgcggatcttgaccgagccggacaatgcgttgattaaacaatacattgccttaattggcgcagacggggtcaaaatcacgtttacgaaagaggccgttgaacgtatcgcagaaatcgccactcaggtcaaccatgataccgataatatcggtgcccggcgactggcaacgattctcgagaaactgttggaagatgtgctttatgaaggtccggatatggcgatgggcagcgtcacggttacccagcagtatgttgacgacaagattgggcatatcgccgcggatagcaacatgacgcgctatattttgtaaggtaactttgaagaactgttaggtaaaggatgagaatgtatggtaacgattgcaaatgactttttaacggttaacatcagtcggcatggtgctgaattgaccagtattaaggataatctgactggccgtgagcgactatggcaggctgatcctgaagtttggccacgccatgcaccggttttatttccaattgtcggtgcgttggctgatcagcaatatcaatacgctggcaagacttaccatatggggcaacacggatttgcgcgtgatcgtgactttacggttgtgtccgcaacgccttttaaagccagtctcgtgctcaaagacgatgacaaaacgcgggcgatgtttccgtttgcttttcggctcatcattacctatgcgctagaaaataataacctgcacgtcacctaccacgtcgataaccccgctaaaacggaaccgttatacttcagcatcggtggacacccgggttttaacgttcccatgacgccggataccgagtttgcggactattacatgaacttcaagccgcgtaagtccctggtgcagattccgcttgttgctgggcaaggtattgattacagtcatcgaactttggctgcgaccgatgccaacctggcgctcacacacgaaacgtttaaaaatgatgcgcttatttttgcgccgcttggtaaaaccaccttcaatttactttctgatgaaaccaagcacggtgtcagtgtgaccatggaagacgccccttaccttggtgtttggagtccttaccctaagaccggtgattttgtctgcatcgaaccgtggtggggcattgcggatacgatcggcaccaccggagatttgaccaagaaactcggcatcaaccgtttggaaccgggaacggcttttgagaaaggctacacgattagcattttctaaccgattaacgaagcttgttaacgaagattgttgtgccattacaaaaagacatccgccaagggatgtctttttgattgtcaggtatttgggtgattagtcatgatgatgttggttgcgcaggtataggccgagcccaaacggtaccatattttcgtcaccggccttgatgcgtttgaaattggcgcgatgtttgatgaaaaagacaaccagtaagccgcaagcaactgtcgtcagtagccaatcgtgatacaccaatgaccagcacgtgataatcaccatccccagcgtactggccacactcaccatggacgttaataagatcaggctaaaccagatggcaaaggcgatgaagaaaaatggcgggttatacgctaacaaaataccggcactggttgcgacagcctttccgcctttgaaaccaatgtagatcgaaaaagtatgccccaataccgctgccaacccgacaaccaagattagccagtggtggtcaatcccaaataaaatcggtaaactggcagacagtgttccttttagaatatccaatagcaagactagggtaccgccgaccggtcctaacatccggtaagcattggtggttccgatattatggctgccaccttggcgaatatccgtatgataaaatagtttgccaacgaccaccccaaacggaatggcgccgatgaaataggcaagtataaaacaaagcacaagtaccaaatgtgcccctcctctcagactaaaaactattttagcatttttgacttttgagggatacgccggtaaaataatacgaacacacattcgatctgtgaactatattgcatcttgacagtttcatacaggcgtttttgactgtgatattttgccggtgatcacagaaattgggttttcttaaacgttcctgcgctcgccctccgcttctgcgtggtgtattctataaattagttgtttcaaaaagggagtttattatggacaaagcaacgcaagcatataatgattcatccattcaggtgctacacggattagaagccgttcgtaagcgtcccgggatgtatattggttccaccgatagccgcgggttacatcatttggtttatgaaatcgtggataactcagtcgatgaagcgctcgcggggtttggggatgaaattaatgtcacgattcacgccgataattctgtgaccgtgcaagatcatggtcgggggatgccaacaggaatgcatcctagtggtaagccgaccatcgaagtcatcttaacggtgttgcacgctgggggtaagtttaaccagaatagttataaaacatcaggaggccttcacggtgtcggctcaagtgtcgtcaatgcgctgtctgagtcattgacagttcgggttgtccgggacaaacacgcctttgaagagcattttattaatggcggacatcctgatggcgggttgcagaagttgggcaaggttaacgaacccaatggcactaccattacgttcaagccggatccgactgttttccagaccacggttttcaattacgataccttagccgaacgactgcgcgaatccgcgtttttattaaaggcgatcaccattaatttaaccgatgaacggaccggtaagcatgatcagtatcattatccggatggtttggttagtttcgtgaagtaccttaatgaaggtaaggacgccttatcgcaagtcattaattttgaaggcaagaaagacggcattgtcgttgattttgccggtcaatataatgatggctactctgaaaacattatttcatttgtcaacaatgttcggactggtgatggcggcacgcatgaaatcggattgcgcagtgggatgacgcgtgcttttaatgaattcgcccggaaagtcgggttattgaaagaccgcgataagaaccttgaaggcagcgatgtccgcgaaggttttgcgggtattttgagtgtccgcatcccggaagagatcttacaatttgaaggccagaccaaaggcaagttggggacgcctcaggcacggaccgttgtcgatgggattgtgtacgaccaccttgccaccttcttgatggaaaacggcgaagaatcgcaagaactcgtgcgcaaagccatcaaagcccgcgatgctcgtgaagccgcccgcaaagcccgtgatgacagtcggaccgggcgcaaacgcaaaaaggatcaggggctgctttccggtaaactgaccccggcacagaccaaaaaccctaagcgcaacgaactgtatcttgtcgaaggggattccgccggtggttctgccaagcagggacgcgatcgtaagttccaggcaattttgccattacgcgggaaagttttgaatacgcaaaaagccaagctgcaggatatcgtcaaaaacgaagaaatcaataccatgatttataccattggcgccggtgtcggtgccgattttgacatccagcaggctaactacaataagatcattattatgaccgatgccgatactgatggtgcgcacattcagatcctgctgttgaccttcttttaccgatacatgcggccgttaatcgatgccgggcgtgtgtatatcgcactgccgccgttgtaccgcttgcaaaaaggtgctggcgctaaaacgaagatcagctatgcgtggacggatgaagagctagctaaggaaaccaaggcgatgggcaaaggctataccttgacccgctttaaggggcttggcgaaatgaacgccgatcaactatgggagaccacgatgaatcccgaaacgcggacactgattcgggttcggattgacgatgcgcagctggcagaacgccgggttacgactttgatgggcgatcgcgttgaaccgcggcgtgaatggattgaacatcacgtgaagtttgatctggatgatgaaggcagtattctggaaactccaacggcaaaccatgaaaagttgcaattcggagctaagcaaatcgtcaagcaattagataagaaaaggaagtaaaagccattggccaatcagattcaagagttgaccttagaagaggtcatgggcgaccggtttggccggtactcgaaatatattattcaagaacgcgcactgccagatgttcgtgacgggttaaaaccggtccaacgacgcattttatttgcgatgaaccaagacggcaacacttatgacaaaggatttcgcaagtcagctaagagtgtcggtaatgttatgggtaattatcatcctcatggcgatagctcgatttacgaagcgatggtgcggctcagccaagactggaaactacgcgcaccgttaattcagatgcacggtaacaatgggtcaatggatggggatccgccagcagcgatgcgttatacagaagcgcggctaagcaagatcagtaaggaaatgctggcggatattgataaagaaaccgttgatatggttttaaactttgatgacactgcccaggaaccgactgtactgccagcgggttttcctaatctcctcgtcaacggtgctaccgggatctctgcagggtatgcgaccgaaatcccgccgcataatttgcgggaagtcgtcaatgctatcttgtatttgctaaaacatccgcaagctgacttagccgacttgatgcagtatgttaagggacccgattttccaaccggcggcatcatccaagggcttgacgggatcaagcaggcatacgaaaccggccggggaaagattgtcgttcgctcacgcacccacatcgaaaccattcgcggcggccgcgagaagattgtggtcactgaaattccgtatgatgtcaacaaggcccaaatgattaaaaaaatcgatgaactacgacttaacaaaaaagtcgacggtatcgctgaagttcgcgatgaaagtgatcgattcggcttaagtgttgtcattgagctgaaaaaagaagcggatgcccatggaattttgaattacctcttcaaaaataccgatctgcaaatcacatataactttaatatggttgcgattgccgatatgcaaccgaaattgcttgggctcaaggcgatgttggaagcttatgtggcgcatcgccgtgatgtggtcacacgccggacacgttatgagttaaacaaagcgcaggcacggcagcacattgttgaaggcttgattaaaatgttgtccattttggatcaagtcattgcggcgattcgtgcatcctcagataaaggggatgccaaacgcaatttggtcaaacaatttgatttttccgaagcgcaggctgaagccattgtctccttgcagttatatcggttgacgaataccgacattaccgctttgcaggacgaggcggcacaactggccaaggcgattgccgaatatcaagacattctagcgcagccggcttcgcgtgatcgggtgattgaaaaagaacttaaacggattgctaaagagtacggggatgatcggcgcagcagtattcaagccgagattgaaacgctcgaagtggcaacgacggtcacagtggctgatgaaaccgtgatggtccaggtgtcacgcgacggctatgtcaaacgcagctccttgcgtagttaccaagctgttgatcctgaagataacggtttaaaacccaatgatttggcgatttttaccggagagttaagcaccctgcaacatctttacattgtcacgaatgccggtaatatcatttatcggcccgtttacgaaattagcgatgcgcggtggaaggacactggggaacatttaagccagacagttggcttgggaaccgatgaaaaggttttggcagtctttgcttttgatcagctagatcttgctggtacctttgtccttggctccagtgacggctacattaagcagacggcattgagtgatttgcagccgcagcgcacgtataaacgcaaaccaatgatggcaatgaaattgaaaacaccgggtgccgtggttaccaatgcttacttcacgaccgatcaagcccaggatgtttttgttgtcagccgacatgcgtatggactcgacttcccactggctgaagtttccacggtcggtgctcgggctactggggtcaaaagtatggatctcaaaccggaagatgaggtagttaactttattttagttaagcaaccagaaaaagcagtggtgggcattttgactcagcgtggtgcgtttaaacgtatggcgttaagcgaagtcggtcaaatgagccgtgctcgccgcggattgcttgttttacgcgaattaaagcgtgatccgcaccgcattgtcgccatgatgcaagtcgatgacaacacgcgtctggatgtgttaaccgatgccgataaagtgatcacgttaacgcctgtgaaccacccgacaggtgatcgctactctaatggttcctttgtgattgatactgatgtccaaggaaaaccggttttcgtacgcacacgtgaagaaacaccggttgaaccgtaacgcaaaaaagtcctcatctgtattaatacagatgaggactttttgatttattatatgacagtacggttgtgcacaacttatcaagctaatgattaagctttttttatgaaacaggaaagtacaccgaaaaaacagcaaaacgcctgttatatcagcgataaaacgcttgcatagatttgccttcgtgttatactgagtttgtaagaactgtcacatctgtaattcactttaggaggcaatacctatgaaacagcttgacgaaaccaaagttcctaattattgggaaggctttaacggcggcgactggcaagaagaaattaacgtgcgcgattttatcgagcataacctgaaccaatatgatggggacgagagtttccttgctggccccactgaagcaacgaccgttttaaataatcaggttttgaatctgaaaaagcaagaacgtgccaatggcggcgtgctggatgcagataacaatattccatcgaccattacttctcatggcccaggttatctgaataaggacctcgaaaagattgtcggtgtccaaaccgataagccgtttaagcgggcattcatgccatttggcggtatccggatggctgaggatgctttgaaatcctatggcttcgaaaccgacgctaatgagcacaagatctttaccgaatatcgtaagacgcataaccaaggtgtttttgatgcttatacgccggaaatgcgcaaagcccgccactataagattgtgaccggcttaccggatgcttatggtcgtggtcggatcgtttcggacttccctcgaattgctatttatgggattgaccggctgatggctgagaagttcaacgattacaacctgaccggcgatggcgagatgacagatgatgttatcaaactgcgcgaagaaattaacgaacagtatcgtgccttgaatgacatgaagaagatggccaaagaatacggctatgacatttcccgcccagctgctaatgctcaagaagctgttcagtggatctacttcggttacctggcagccgttaagacccaaaatggtgcggcaatgtctgtcggccgtatcgatacagtgattgatgcctatattcaacgggatatgcgtttgggcaagctgaatgaagagcaggcacaagaactcatcgatcatttggttatgaagttacggatggtacgtttcattcggactgaagaatacaactcactgttctccggcgatccgatctgggcaacactgtccttggcagggatgggtaatgatggccgtcatcatgttaccaagaccgcgttccgcttcctgaagaccttggacaacatgggcgcggcaccggaaccaaacatcaccttgttgtggagcgaacgtcttcctgaagggttcaaacgttatgccactgaagtgtccatccaaagttcaaccattcaatacgaaaacgatgatctgatgcgtaacgaatggggaaccgactattacggcattgcttgctgtgtttccgcgcagccaattgcagatggtgttcagtacttcggggcgcgagcaaacctagccaagaccgtgctgtatgcgatcaacggtggtaaagacgaaattcaggaagcacaggtgggacctgaatacgagccgatcaccagcgactatatcgactatgacgagttcatgaagaagttcgacaagatgatggactggttagcagatgtctatgtcaatgcactgaatgttattcactacatgcatgacaagtactactatgaagctgcgcagttggcattgaaggatacacgtctgaatcggacgtttgctaccgggatttccggtttgtcacatgcggttgattccatcagtgccatcaagtatggccacgtgaaggcaattcgggatgaaaatggcgttgcaatcgactttgttgctgacaatgatgactatccgcgttatggtaacaatgatgaccgggcagacaacattgctaagtggttggttaagaccttctacaacaagatgaatacacatcatctgtatcgcggtgctaagctcagtaccagtgttctgaccattacatctaatgtggtttatggtaagaataccgggacaacaccaaacggccgtcagaagggcgaaccattctcacctggtgccaacccggcgtatggtgctgaaaagaacggtgctttggcttccttgatgtcaaccgccaagatcccatatcactatgcaacagacgggatcagcaatacctttggggtaacaccgaacaccttaggccatgacgatgaaacccgtaaggacaccttggttcacatggttgacggctacatggaaaatagcggcatgcaccttaacatcaacgtcttcaataaagaaacgttgattgatgcccagaagcacccagaagaatatccaaccttgactgttcgagtttccggttactgcgtctactttgcagacctgaccaaagaacagcaagacgatgttatcgctcggaccttcttcgacgaaatgtaatcaagtcaatctattcgcaaaacaggagatcattcctgttttgtcaaaagacggcaacgatgctgttgccgttttttgacaaactgaaatgaaaatcgttgaaaattaggtatttatttgcactggaggcggcatagatgaaactcatcgatcaatcacaaagcccgttaaatattttggaacaagtgggacaggatcatgaaggcccaataaaaggatacgttcattcagtcgaaagctttggttcggttgatggtcccgggattcggtttgtcgtctttatgcaaggatgcaggatgcggtgccagtactgtcacaaccctgacacttggaatatcggtgtgggcgaggaaatgaccgctgatcagatcctggcagatgcacagcgatataaagccttctggggcgaacaaggggggattacttgtagcggtggcgaaagtctcgtccaaattgattttatcctggaactttttaccaaagctaaggaactgggtatctcaacttgtttggatacttcgggtggtccattcacccgtgatcagccgtggtttggtcaatttgagaaactgatggccgtcacggatatttcgttggttgacatcaagcacattgattccgcggaacacaaaaagctaaccggtttcccaaacgaaaacattttggatatggttcagtatatgtcggatcatggcgatgatatgtggattcgccacgtacttgtgccagaacgaaccgactttgatccttatctcaaacgcttgggagattatattgccactttggataaacgcgtggtccagaaagtggaaattcttccgtaccatacgttaggggttaagaagtaccatgaactaggtattacgtatccgctggaaggtatcgagccgccttcagctgatcgggtcaagaatgcagagaacttgctacacgttgaggactatactggatggcaaagttggcgaccacagccagctaacaagcagtgatttagttgaaacttaacgtaacgattaaaaacgcagcaaatccgttgcgttttttttaaatgccacttatgatgatggttgagtaacgttatcaaattataaacgaaagggaagccgccctatgaagacgaaacaagagcgcattttttcctccaaaactctcacgtattttttgcaattagcagaaaccatgaactacacccagtcagcccagttgttggggattacccagccggcactgacgcagcaaatcaagaaattggaacgaacagtgggggcaccattgttttattccgttggtaagaagttgcatttatccgatgccggtcgcacgatgttgaaggcgacacacgagatttatgaaattttgaaccagacgactgacgagattcagcaaagcaccagtgccacagtcggcaagattaatattggcttgttaagttcaattgaagacagtgcgtttaatgcttttatcgcgcattattacgaccttaatcctgaagtcgaaatcacgctacgaatgatgacacgtcatgagatctgggaagcgttggagaacaatcagattgatttggccatcatgaatctgcctgatgagacgattaagaactggaagccgtatgcaagcaagaagattcttgatgaacagttattgttcctgcatcatgataattccttggctaatcgcaaacgcctgcattttaaagatacgctggctgagccgtgggtaacttatccagacgactatttcctgggtcagttgttgcatgaggcgtataagaatcagatggttgattttccgcatgttgtggcgcattttaccacgccatatcagttaactcagtttgtcaaccataccggtgttaacaccgcgttaccaaccagttttgttgccgctcatgctgatcaaatcaaggcgcatgccgttgcctttgaaccagcgattcgctttgagacctcgtttgtgtatcgcaaggaaaaagccgatattccgcggattgccaacttctttaagacgtttgacgcacatttatccgagaaagattatctatcgcgggtcagcgaaaacagtggtaaaattgaacggtaaactattcagctgaggagcgatcagataacatgacgactttgatttttggacatcaaaaccctgatacagacgcgattacaagcgccatgagttgggctgaatttcagaagcaagcaggtaataccgatgttgaagcagtagcactcggtgaaccaaacgatgaaaccaagtttgtattggatcattttaaggttgctgcgccgcgggtcattaagacagccgcaaatgaaaccgggcacgtaatgttggttgatcataacgaattccagcaaagcgttgctgatatcgaagacgtgcaaatcgattcagtggttgatcaccaccgcattgccaacttccatacggcgtcaccactatattaccgggcagaaccagtgggcagtaccaacacggtgattttcgagttgttccaggaacacggctatgaaatttcaccaacactggcaggcttaatggcttctggcttgatttcggataccctgcttctgaagtcaccgactgcaaccgacaaggacaaaaagatcttgccggaaatggctaaaatcgctggcattgacctgcaatcatatggcttggctatgttgaaggcgggcaccaatctagctgccaagtcggatatggatatcattgaaggcgatgcgaagagctttacgatgggcggtaagtctatccgtattggacaagtgaatacagttgatcttgatgatatttatgcgcgtcaggatgaattggtggccgctatgaccaaagaagcacaggcgaagggctatgatgacttcctgttaattgcaaccgatattctgaacagcaattcaacgggctttgctgttggcgcagatcgtgacaaagtggccgcagcattcaacgaaaagtttgatgcaaatgaccggttggcactgcctggcgtggtttcacgtaagaagcaggtcgtaccgccaatgcaaggtgcgtttgaaggttaattttgaacttaataattggttttataaatcgcagccgtttgtggttgcgatttttttgtgctcaaaaacttggatgaacaaaaaggatagttcaaatttaaaacgaggtgcaaaaaacgcagcctcataactacttcgtataatatatattatgtaaactagaatggagattttgagtcgttgactttgacgtgacttatttggtgttcaaatggcaaaacgattgatgcaagtcccctcacctgacagacagctcaaaaacttttgagagaagcaaatcaattgtacggatgtgagcggtgcgctttatttgttttttctggtttgaaaatgaccagtcgttgctaaatatatgtaaattcagcattaatcaaagcagatttgtagaaagtatcattttgagtcataaacagcattcaagtcgcaagtgttgctgtcagctgaattctggatcaaaatacgaaaattgatttgattgcagccaatgaatcgttggttaattggttaaactgttgctaaagcggcgccgtggaatcaggacatcagcacagatggtcctgatcgtgcagtaaattcaaatttgaaatgcaactaagtttagtgtcaaatgacagatcaacaaatttggtgatttagctggcttgatgattagaagcccatttacctttggataatactaaaactttattcagttctacactggtgcttttttcggcgcatatcgttgcgaattaccgatattttcgtcattatccctcgccacgcactggttttttcgcgtatactgaaattatccaaaagaaaacatatgttcgaggtgactttatttgtcgacacagaactatcctaaattaatacaagccatgctaccttccctgccggactatattcaggattactatcacagccaaaaagcaattcccatcgcggattctaccctttaccagtacctgcacttttaccaggaatttctgcattggcttatctccagtcgggtcacggacgccatttcgccacagaatgtgcctttggaaactttagagcggctttccttgcgtgatgcgcaggcgtttgtggcgtatttacttgagcggccgtcaaaaacccatccgaataaacgtatgacgcggcgcagtgtggcgttacgactggtcgggatcaaggccctttatcggttcttaaccgaagaaagcgaaccaaatgcggacggtgagccttatttttaccgcaatgtttggaataaggtgaaacttaagacccatgcagagacgacgacttaccgtaatcataaactgcaggaaatgttgtttgtggatggcgaagatgcgcgctttttacagtggctggatcagcaatatgctcagcagctgccatcgaaaccgcgtgcttattttgaggcgacgaaggaacgaaatttggcgatcattgcgctgctgtttggctccggcgtgcgggttagtgaattggtcaatatgaatttggaagatctcaatatggatcgtcatactgtgcaggtggtgcgtaaaggtaattttcaggatcgcgttaactttgctgactggattgatccttatttaacggcttacttgaagtcccgaaccgcgatgattggtcagcagaagcctacttctccgctatttgtgacgcaaatcggccaaatggtaaaccgcattcgccaaaatacgattgaagcattcttcaaacgctatacaaccgcttatggccgcccatcaacaccccataaagcacgccataccttgggaaccaatatttataccgtcaccaaggatgtgcagcaagttgccgatcaactcggacaaacgacgaccagcgcgacggatctgtacatcaatctcagcgataaaagtggaaaagcggccttacgcgaagtttcggaaactgccgccaaagccttggatcaacatccccagcaaccataatgtcggcggttagttgtctggttaagtcatgttgcggcgctaattaacgtcacagtattcagtgagataacagtggcgacattttttgatgctggttgacatagaaaaaagctgcctgatcgcctttgatggcttgcgatcaggcagcttttttatactatgcgtcagaccgccctcacccacgactggatggctgacggcgggaaacaattcgataataaacgttgccggtcaaacggtacatcagcacgtagatgaccgcaaaaattgcaagcgtgattaacgaaacggttaagaagaattgccaatccggcaggccgaatagcatcataatacgttggacaaagggcaatgcaaagcccacgtggatggcagcgacgatcaaaggcaggtaaaacagtgtgagtagctgactattaatggtagcgcgaacttcccgaaggctcaggccgacgcgttgtaagatggtatagcggcgtgcatccgcgtagccttctgccaactgcttgtagtaaagaatcagcaaggttgccaggatgaaggtcaccccaaagacaaccccaaggaataggaaactgctcatcatgctggcagtatcatcgtaattagcggctcgcgattgaaccgattccggtaatgcaatccctcttttgacgactgcatgataaagcttgacctgattggcgtgactgccgcttaatgttacgtcttgattagtggtcacgtcggctttgagcagtgccattgacctttttggataaagcgcgtgtaaagcggttaatagttggacatcagatgggagcgcaacaaacaagttaggaataaacgttttaggcgcatttggaaaactggtgacttgtttggcgacgtggtaagtctgtttgccaatacgcaacgtggcgggttcgtaatgattggaggcatagattaaaacttcatgattgttaagtgtcacatgcttgccagtatagcggttataattttcgacggtcatcagctgaaccgaacgggcattattgaagctaaacgggccgttaaagttagcttgagaatctaacttgtttttttctaataaagcaagcgtacttgagggtccgttaaaggttcgcatcgagtggattttgacgtgatgtgttttagccagtgtccgtagttggttcgctgcatccggccgcttggggttgattgagtatgctaaatcaaccggggtttgcgagttgacaatctcatgaatgccaaagaataacgttgcggtggttgcaagtgtaatcagcgtcatggtgactaaaatagcaatcgaagccaaccctgcgccgttttgctgcatccggtaaagcagattcgagacgttgataaaatgtttaggcttgtaatagtagttcttgcggtgacgcagccatttcaagacaaataccgagccggacgtgaagagaccgtaagtcccgacaatgacaaggacgaccgcaaagaaaaacaagctcatcgcttgaagcggattcttgacggtgaccgcaatcgtataaccggcagccagactcgcaatgctgacaatcaaagttagccacttggttttaggttcccgttccccagcgttttgttcgcgtacgagttcgatgggatgtttgcgcaatagccagaactcgtcaaccaacattaaaacaatgaacaagccaatcgtgatcaacccggcaatgctgaaggcagtttgactcaagccaaaatcgagattgtgattgacatgcagcattttggccaaagtgagatagctaaggcgtgacagcacggttcccaaaattccgccgcacaataaggttgtcaacaatagcagcagcttttccgtggccatcattttgcttaattcacgtttgccaaagccgatgatgttgtagagccccaactggcggatacgctgtttacgcaaaaagttgttggcgtagatgattaagatgacggaaatgattgcggtcgtcattgagccaaatgaaaacagtgatttgccagctgcctgtccgaactggcggaacaatacatcactgctcgtgtaggcgtttagcatgatcaaattgatggccatcaaaaagctagtggtgataacaaatggcacaaataaacggcgatcggctttaaggttggtggcggctaatttgaaatagaatttcattgcgcctcgccttccttcgtcagcattgcggtcatggtttcgctgattcgggtcaaaaattcgggttgctgtaattcaccgcgatacagctgatggaaaatctgaccatcgcgaataaacaaaacgcgctggctatgactggccgcaaccgcactgtgcgtcaccatgaggattgtctgcttactgtcggcattgacatcggttagcaagtccaacagctcactggaagttctagaatcaagtgcgccggtgggttcgtctgccagtaggatttccggatcggtgatcatcgcccgggcagcggccacacgttgctgttggccaccggaaagctcatatgggtattttttcaataaatcggtgatacctagacgcggcgccagttgggtgagccgatttttcatgatttcaagcggtttcttggctaagactaatggcaggaaaatgttgtcctgaacgttaaaggtgtcaagcaagtcaaaatcctgaaaaataaacccgagatgttcccgccgaaatttagcccgtgcgccttctttgactttgcgcaggtcctgtccgttaaggctgatttcgccgccggtaggatcatcaagcgtggcgattaagttcagtaaggtacttttgcctgaaccggattcccccataatcgcgacaaattctcctgattcaacggaaaaactgatgttcacgagtgcctgtaccggttgggcaccgcgactggtataagtcttttcgacattttttaactttaataatgttgacataagatccgcccctttcatttatcagcttaaaagggaaactgccgaaaaactacttacagtcgacgtgcgttgcttacaagctggtaaggtggcttactcggccagccagcgcgtttgcgggaagtgaatggcaaaggtgctgccgacaccgacttttgatgtaacggtcagggttaaccctagcttttgggcaatttgccggcttaaaaacaggcctaagccacttgccttttgattggcgcgaccgttgtatccagaatagccttgttcaaaaatccgcggtagatcttctggcaggataccgataccggtgtcagccaccagcacggcatcgcccttggcataaatccggatgctcccatgcggggtatatttgatggcattggttagtaattgctcgaaaataaatcgcagccactgactatcactcaccacagtgggcaaagtttctaccgtgacggttaagtctttggcaataaacagtttcgctaaatcccgcacggtttcgttaacaagcggttttagtggtaattcggttaacaccaaatccgtattcagtgtggtcagtttgaggtaattcagcatcacggttagataacggttgattttaccaacttcaagccgcgcatcgctggcattgacaggttcaacctgtaataagagatccagtgcagtcagcggtgttttaatttgatgggtccacagttgcaaggtatcgaccgtttcttgttcctgatcacgatacgtgtcatgattttgacgtaaggtctgttgcagcatttggattttttgaaaataaacctgcccaagcggatcggaaatttgatcagccgcaagcagtgtaacatcgccttggagctgcgaccattcgcggcgaaaccgccaaaaatcgcagccgccgatcacaagtaacggaatcagtgcgaaaaaccagctgtttaacgcgacttcaagcgaagcgttaatcagccagtttgctaacagactggcaaccagtaagatgagcaaactcagccaaaccatccagcgggcgcgcaaaaaagctttaatcatggccgccctccttgtttgctaaacgataaccttttcctttgacggtttcgatcagttggttgagtcctaccggggcgacttttttgcgtagccgattcatgttcactgccaaggcgttgcggtcaatgaactcatcgccttcccataacttctcgatcatcgcttctcgagtaaccacttcaccatcggcaccaaataacaggcttaataacttggtttctgtcggggtgaggtcgatcacttgagtcggcgagcgtagttggttgtcggtcgggaccagtgtaaactcaccgtgacttaaattggtatcggtttgctggtattggtaggttcgccgcaacatcccctgaatcttcgccaataaaaccggtagctcgatcggcttagctaaaaagtcgtccgcaccgagattcatcgccatcaccagattcatatcatccccggaactggtcaggaagataaccgggaccttgctatgtttgcgcaattcgctcagccagtggaagccattaaaatacggtaggctaatatccataatcaccagatccggtgcggcggcacggatttctgcgtccacctgatcgaatttttggaccaattcaaccgtaaatgcccaccgattaaggtagttaccaattgtctttgcaatcacgtcatcgtcttcaacaataaaaatcttttgcggcatgtttgttatgctcccctcgtggtgattcgtgggctttttaagtcaattgctttaaactaaagtcagcttctattttaactgatttcaggtgttaaaagtgagacaagccaaaattgggtggcaggggcaaactgccgcctttctcttaagtcaaaatttatttgtttttggaacgtccaccgtcttttttgcggtgctctgggatattgcgctaaaaacctcttccggcgcgtggatgacctatgtttcgttagcaaccgccctgccagctattttaatttcgctttcagcaggcgtcttggcggatcgctacaatcgtaaatggctgattgtgatttctgcagtcggtgtgactgttttgaccctcgcagtagcttatgtgtttgcgtttgtgacgcaagagctatggttgttgctcgtcatcgcggtgattcgcagttttggtaatggtctggagaatccggcggctaacgcgttattgccgcagttggtaccggaaaagcaattgacgcaggtgaatgggtataatcagatgttgatggccgctatgctcgtgatttccccgctgctggccgggtatactttgagcgatctggggattttttggatctttgtcatcgatgcgctcacagcggtactggcagtgttgtgcttagggattgttcacgtgccaacaccggtcaccaatccggatcaagcaaccaagcagaaaaatggcattgttgccggtttgcgctacgtgggccacacgccggtattgctggcatttatgttcttcaccggactggcgtttattttaattgccccttcttcccaattatcgacattatatgtcaatcgtacattcggttcggaggtctggcatctgacgtttaacgagtggtcatggacaattggtgccgggttaggcggtttgttcattgcgcggcacaaaaagtttcgggatcagcttggtttgattgcgcttggttttgcgggcagcggaattgcatttgccgaaatgggcttgccgcagccatttatgacttacttgctatttatgttggtttccgggatcttttatccgctgattcaggccgggcaaactatctacctgcaggaaaatgtgcccgcggataaacttgggcgcgtcttttcgctgtgggcgattttgtcgaccgggatttatccgttagccatgttgggttacggaccactggcagatcgtgtgccgatcggatggattttcattgtgaccggtttgttgttaatcgttgtcgcttatgggttctggcggcggcttaagcatctgaatgggtcatcaaataagtagcatctattattgaaaaaagaacgctatcacggtgcagtccacaactactgccaccgtgatagcgttcttttctgacggattaaaactgccgttgaactttgaaagccgtcggaacaggtttaaagtcgactttgggataaaactgcatggctgctggggccgatagcaacatgattgaaatgttgggtccctggatggtatgcagtgtttgcaatagtgccttgcccacaccttgatgctggtggcttttgataacagctagctcggaaacaaacgtgcaataggacttgtcagacacaccacgtaaaacgccgattaactggtgatcatcccatgcggtgagcaacacatttgcgttgttaagcattcgctgcatgcgcgcacgatcttcagtcggccggtgaataccggatgcatctaaaacggcaataaactgcgaggccgagatcggctgattattttcaatatgtaacaaggcttatccctcccgaccgatacgaaacatgttgtcagcgtgtggcaaattaatgcgttcatagaaacctactgcgctgtcagccgcgcgcaatgataaagtaacccttgggccgatgtaagcttgtaacgtcgcgatcaattgccgcccaatttggtggccttcataagcgggcagaattaaaatgtcactcagatagcaacagtactcaaagtcggtcagacagcgtgcaaagccaatgagatgctcatcgtcccagacactcaagaccagttgggtttcatcaatcatcacttgtagacgggcagcatcagcgatgggcttgtcaaaatgcgtttgctgataaagatcatgaacttgttgaaccgttaagggtgcgtttactttgatggtgtacgacacaacatcagctcctttataagtttgtcaacggtcaggttaccaaaaagaccgagcagcactcggtcaaggttcattatgaaaatcatatggcaggcacgtttttcaaagtaaataaagtaaatagtgatgtaattgatgatttatttgaaaacagtgactttgcttgccggaatgcgataaagcgagtccggtgcattcttgggtttgccaatcgcaatcagcaaggttggcatgaagtgggccggatccaagtcaagtgccggcagaatcttttcgtgatcaaatcctgtcatcgggccggtttcatagccataagcgcgggcggccaacatcagcgacatcgctgccagactactattttgaatgataaattcccgcagtgcttgcttgtcctgtttgaaatcagccagcaagtgatcaatcatcggcttttggtgttccactgcccggtccgttaacaagccggccgttgccgcgcgtttgaacaaatcgtcttcaaatggtccaaggtctaattcgccgccgacaagcacgaccgccgaagcagataagatttccggagcattggtaccggcgacactggcaattttctctttggcggcattattttgggcgactacgaaccgggttggctgcatattcaaggcactcggcgctttggttgcgtaagtaataatttgcagcagttcccctttactgattgtgatttcaggatcaaattcacgggcagtatgacgcttcatgacaacttcatcaaagttattgttttccaacatcaaattcacctcttagattttttagacatcttcaggatacgctatatggtggcgttttcctagttatttttaaaatggtataggttttgatggttggaatcggctgtcttagttttgcgttgttgccattgtcaggttcaatgcccctaactgtgaaatggcagccgtcacgtgatcacccggttgcaaaaagatttgcgggtcacggcccacgcctgttccactcggtgtaccggtaaagataagatctccgggttgtagcgccacaatcccggcgagatagtgaattaaagcaggcactttaaaaatcaattgatcaagtttggcttgttgcatgatatgtccatttacggtggtcgtgatttgtaattggtcgaggtttgtgatggcatctgttgacgtcacccagggaccaatgggtgaatagttttggaaagacttggctagcgaaaattgcggttcggcattggcaaattgtacggcacgatcgctgaagtcttcgccaaccaaaaatccggcgacatgtttaagtgcatcagcctcggtaatattgcggccacccttcccgattaacacaactaattcggtttcccaatcggttttgggtccacggataggtatcgtacttgtcggaccggccagtgagctactgaatttagtgaagacgctcggaacttctggcaacttaatgtgaatctcttgcgaatgatcaagaaaattcattccgatagcaaaaatctgggaactagcagctaccggcgcctctaattgttccggcttaaagttgatttcagaaccgaatgttaaagtgtcgcggtgggttaaagctgtcaaaacatcggcagcattggtaatgggttgcgccgttgatgcagacgttatcagatagggatggttgtttaatttggcaattttcaaaataaatgcttcctttcagatgagccattagccacaccattattttacgcctgcatggtggcggttccaatcacttcagcgcatttggcccagtgagttctgcctgaaaagtttcaatgatgcgctgtaccgccgtgttttgtgcctcagtgccaaacgtgacgcgcagccagccgggttttaagccatcacgaacaagaaaaccttgttgtagcaggcgcttttttaaagccgatgcctgcattttgggggcctgaaagaattgaaagttggtttggctgcgggtgtgtggcagtccggtttgggttaaaaagcgttcccaactatcgcgcgcttgctgcacccgcttgcgtgtcatcgtgacaaaatcctgatcagctaaggccgcctgtgcgctaacttgggcaatgctgcttaaattgtaaggcaggcgaacggtttgcaagtagttaacaagttgtttagggaaaacaccgaagccgacccggaaattcgccagtccatagatttttgaaaatgttcgcagcacgactaggtttggaaactttgataataagctgatagcgctcgtggctggatagtcatcagtgaactcaatataagcctcatccattaaaaccagcacgtcttttggtatttgtcgcagccattcggtcagtgtcgcaattgacagcagcgtgcccgtgggattattggggttgcacacccaaatcagtttcgttttcgcggttaacgcctgcgccattgcaggtaaatcaaaattgccagcttcactgacggggacatcaatcacggtggccccttcaatttgggcatgcaagcggtactcggaaaatgttggccatggttcaatgacttcatcccccgggctcaaaaaagtgcgggcaattaaggcaatgacttcatccagaccattgccaaaaaccaactgctctgcggcaacgtctaaatgttttgccaccgcggtgcgtagttgactggcatagccatcggggtaatcacgactttgcgtaaaattccagttggtcacggcctgctgaactttgacgctggtaccgaatggattttcgtttgctgacagccgcaccagctgtggcaagccaagttcttcttttaatacggcaagaggcttttctggcgtatagggatgaagttgatgaatggtaggtttaaacataaacaacgcctccttgtgatcttgtttggtttggatgagtttcaaacgtgagcgctggctggcaagcggttgtcaatatttgttgattttatcgcgctcttttaagcgactcatttttccttcacggctcgccagttcagtcgcaatctgatcaagggagatgccgcgttcgaccatgagtaccagcacatgataagtcagatcggcgacttcgagtataaaagccgcatcgtcgggatttttggctgcaacaatgacctcggtgctttcctccccgactttttttaaaatcttgtccaatcctttggtgaaaagataatcggtgtatgagcctgaaactggctggcttttccgtgactggatgagatcatataattcggtaatgctttgtttggcagctgtcattgggtgcccttcctttctgtatactgacgataaaaacaactggtgtggccagtgtggcaagcgggaccagcgggattgacggtgatgagtaaggtatccgcatcacagtcaacggcgatagcttgaaccgtttgggtgttgccgctggtttcgcctttatgccatagcatgttccgactgcgcgaccaaaaccaggtttcaccggtggtcatcgttttttcaaggctttcggcattcatataggcaaccattaatacttgcttggtcgttgcgtcttgaacgacggttgtgattaaaccggacgcctttttaaaatcgagtggtatcatcgaatcgccacctttgcttgttttagcactgtcttgacttgcggtatcgttaattcgccgaagtggaagattgaagcagcgagtcccgcagaaacattcgtatcacggaataaggtaacaaagtcatttgcggatccggcaccgccgcttgcaacgacaggcaccgaaacaatggagctaagttgctggtaaagtcgcaggtcaaatccctgcttggtcccatcggcatccattgaggtgatcaatagttcaccagccccagccgcaactgcttgctgagcccacgtgagcactcctagatcaactggggtacgcccgccgttaatcatcacctgataacgattccgactaggttgccaacgcgcatcaatcgcgacaacaattgcttgacggccaaacttttcggccccggcggtaattaaatcagggtgtttgaccgccgcggaatttaaggcaattttgtcagctccggcacgcaataactgatgcatgtcggtcactgaacggatcccgccgccgaccgttagcggcatgaaaacctgtgtggctaccgcagcgactgtttgcgtcatggtttgccgcgcatcggtggtggcggtgatgtcaagaaagaccaattcatctgctccttgcgcctcgtaagctttggcaattgctaccgggtcgccgacatccttaagctggataaaatgaaccccttttttaacgcgtccttggtcaacatcaaggcatggaataatgcgttttgtcagcatcgttgtcctccaattctttaagtttgttcaagggaaaactgccggtctgccaagctttaccgataacagccgcctggatcccggctgtttgcaaggctgtcagatcagccaaagtgtgcacgccgccactggccacaatattgacgttaggtacggtttgatgaagcattgcgagcaatgccacgttaggacctttcatcatcccgtcgcggccgatatcggttacgataaaggtagtgacgccgcgcctgaccattgcctgtattaaatgcgttggcgattgggtgcttgtggtcagccaaccatcagttgcaaccttcccggcgcgggcgtcaataccaacagcaattttatcggcgccaaatttctgaacagcctgcgttaccagttcgggggtggtgacagctactgatccaagaatcaagcgatcaattccggcatttagatagtgatccatgatagttaaggtacgaataccgccacctagctcgataaaagctggtgtgtgttgccgaattgtgctaatgacggcttgattgactggctgttgggatcgggcaccgtcgagatccactaaatgcaagtgtttaagaccagcggcggttaaatttttcacctgaatcagcgggtcggcagtcagactgacttgccggtagtcgccttgagtgagtctgacactttggccggctaataaatcaattgctggatagagttgcatcagtcgtcatctccttaaaacgctgtaatccggcaagccctactgcaccgcttttttccggatgaaattgcgttcccagaatattctggcgccggacgatgctcgttagcggttgaccgtagtcggtgatagccagcgtgtaagtgggttgggtctggacgtaatacgagtggacaaaataagtcgcttggttggcaaatccggctgcaaaaggatcgggttgagtgatcgtattggtgttccaccccatgtgcggtgtcgggaatcccgctcgtggtggaattgcgacaaccgtgccagggatgaggcccagtcccgctgtttccccgaattcaaagctgcgatcgaataacaattgcattcccaggcaaatgccgagtaaaggtttgccggtagccgcaaattgacggataaccggaaccagatcgcgttgggtcaacgcagacatggcggttttaaaagcccccactcctggcaggattaaaccggccgcagccagaatgacggcaggatcagctgaaagttggttgtcaatagccagataatcaagcgcttttttgacattcaacgtgttgcccgtatcgtagtcaacgatcacaatcatgaaatcactcctttggttgagggaatccccttcactgccggattcagcgccaccgccgcctgcatactacggcccaatgctttaaacaacgcttcaattttatgatgcgtattacgtccgtataaaacagcggcatggagattgaattcacctgcaaaggccatagcctggaaaaaatcttccgtcacttccgtatcaaatcctccgagtcgttgattggttaattcagcatcaaacacaagataagcgcggccggaaagatccaccaccacgcgggcgaggctttcatccatcggcacaaatgcgttgccaaagcgttcgatgccagctttgtcacccagcgcttgtttaaagcaacttcccaagacgatgcctgtatcttcaatcgtatgatgcggatccacgtctaaatcgccttgggctttaacgattaaacccaagcgtccatgtttagcaaaagcatcaagcatatgatcgaagaacccaatgccggtatcaatatcaataccgctttgctggtcaaggttcaaactaatcgttatcgcggtttccttagttgtccgagtgatcgttgctgtacgcatgataaacctcctagaaaagtgagcgcgagccagcgcggttagaagtcggagtgtaagtggccttaagcgtgatggcccggttttggccattgcgcttaaggtccttacacgcagacttctgcgctggggagcgcgttatggtgagagcgcgagccggcgcggttagggatcggagtataagtggccttgggcgtgatggccgggctttgaccattgcgcccaaggtccttatacgcagatccctgcgccggggagcgcgttatggtgagagcgcgagccagcgcggttaaaagtcggagtgtaagtggccttaagcatgatggcccggttttggccattgcgcttaaggtccttacacgcagacttctgcgccggggagcacgtcctaaaacatcatttcaactcataaaaacatgctctaacgcttaatccgtttcaaaatcgcttccgcatgcccatccagtccttcagtttgtgccagcgtcacaattgcatctgcttgagttgccaatgccgcggcactatattgaatgaattgagtgcgcttcacgaagtcataaacgcccagtggtgagaaaaatcgtgccgatccggctgttggcaaaacatgatttggcccggcaacataatcgccaactggttcggcggcattttcacctaagaaaacggaaccggcattgtgaatttcattgagataagtgattggattaggtaattgaatttccaaatgttccggggcgatggtattcattaagcaaaatgcagaagctacgtcagggacaatcgcgataaaaccttggttggtgatcgctgcttgtgcaatcgccttacgcggcaaacttagtagttgtgagtcaaccgccttactgacggcatctgccagcgctggactggtcgtcaccaacattgcgcgcgcgtttggatcgtgctctgcttgtgacaaaaggtcagctgccacccgtaccggatctgctgaatcatcagcaataatgccgatttcggatgggccagcgatcatatcaatcgcaacatcgccaaaaacctgttttttagcttcagcaacgtagcgatttccggggcctaaaattttatcgactttgggaatactttcagtgccataagtcaatgcgccaatcgcttgtgcaccgccaatctgataaatttcgtccacccctgccagttttgcggccgccaatacagctggatttaaaccttttgcttgtggcggcgttaccatgacgattttcttgacccctgcgagtttagccggaattgcggtcattagaatcgtggaaggataagccgcggtgccgcctgggacatacaaacctaccgcggctagtggggttagtttttgaccacggataacaccgggatatgggctatcaataaagccttggctcatttctagctggtgaaaactggtgatgtttttttgggcaagggttaatgctgccagtaattttggcgagagatcagccattgcggcatcgatttgtgcttgtggtacgcggaggtcggagatagtgacatgatcaaaattggcactgtaggcaagtaaagccttatccccatttagtttgacgtctgccagaattttttgaacggtggtttgcactgccggattctgggcaacggtttgctggcgggtggtcacttgttgttgaagctcggttaaggtaccggtaagaattttcatgttaagcctcctgagggcgaacttgttgtagcgactgaataagctggtaaatggccggctttttttgttttaacgctaatcgattaaccaccagatgcgttgaaacgggcgttaaagtagcaaaaatcttgaggttgttttcgcgtaaggtggtgccggtttcggtgatatcgacaatggcatctgccatccccgtgagcggcgccaattctaccgatccttcaatcttgataatctcaacatcttcaccttggctttgaaaatagcgctgagcaagatgggggtatttggtggcaatcaatttgcgtttggttttttgcggatcaaagtcgggtgttgaagctaggatgaatcggcaccggccggttttaagatcaagcatgtcaaactgctgatggccttgttcttcaaggacatctgaacccacaatcccgatatcaacggttccgcgattcaaataagtgagaacgtccgcggctttgacaagaataaagtggtagtcagggttttcggtaaaaatcaaacggcggcttttattcgaaagtgcctggcagtcaatgcctgctgcagtgagtaatggcaaaacctgagtggtcgtgcgcccttttgccaaggcgattgtgagggtcattgcattgcctcctttggggataaatcgattaatttggcgtgatacttttgcgccatcgtcttggcttcagcaagcgaatcgactaggcaaagttgtgcgtgcggggttgtcgcaacgactgccgcggcctcttgccattgagacggacggccataaaccagtgtgagggccggtttgggatcatccggcaaaatatcggttaaggcgtccacatcaaaggccaagccgacagctggcagcaggtcttgctgaaagctggccaacagttgatcatagcgtccgccactaaacagatattgacgactatcactggcgtaggcgtggaaaaatagcccagtgtagtaagattgtggcggttggctggttaaatcaacggttatcgtgacttggggaaattgatgttgaagaaaagcaacagtttgttgtaatggctttaggcgactgtgcagtaacgttggcggcaacagttgggcaagctgagtgaaaatcgtggcagcctcaccgaacaaccatggccattgctgcaagaatgggtataacggttccgcacgtaatggcgcaatgagttgttgataggtactgagattctttttgaaaaatgctgcttgcaatgcggatgctgtcgctggatcaagtggtaatgcctgcatgacttgcgatacgaactgggcatcagacaattccaaggttaggtccgttaatcccaagtcttcacagatccgggttgcttcgctcaagcaggcccattcggcttttatcgaggcgtatccgattaattcgataccggcttgtgtcatttggttataggtaccacttaagctttttcggactcgaaaaacgtctcccacataccaccattgaacaggaggctgaatgctggtggtactcagtaaacgcgctaacggtaatgtgaggtcaggacgcatcacaaccgcctctccggcatcatctaacatttggtaaggttgttcaccgcgaaccgtcaatggctggaaaacatcacggtattccaataatggcgttttaacgcgctcataccctgaagcaatgaatcggtggctcatcatttgaatgagattttctttacgaatcgcccggggaccgaattcatcgcgggtgccgactggtaagtgtcgatttgacatagggttgctccttccgtttgcacgaagcagtggtcattaagtgatcgcgtgtacgttttgttgggaaaaatcgaaacgaattcaacaaaaaaacgccctcgaaaacggtttttaacgttttcgagggcgaatcaacttcgcggtaccacctcaatttgtctggaccttacgacccaaacctcatctaccaatcccatgtcggcttgcgcgaactgttattggcagcggtgataacgcaacgggtgcgtgatagcttactcggttcggctatcaagttcttagatgtgtgttcagtcggtcaatcacgcgttctcagcaatcggcgctctctgtggattggtgccaacctacttggtctaatcacaacttcatggctattgatttaatgtgactctcatcataacgacattttaaaaattgtcaaccatattttttgaatgtgcggcaaaaaactttttcaatgatcgattatttgtttttttattttggcatttttataaacaaatatgcaaaaattagctaatatttgaagtctgtttgattcctaaaaaagtcagtaacagttgttgaacttccgcatcttgctttggcgttccaaagctttgacgaatccagccaggaaccatgctgtctcgcaccagataaccgtgctgtttcaggaaagtgcccagtgcttgcggatcattgacctgatagagcatgaaattggtttgcgtggcataatggcggatttggtgctggtcaaaaaattgatcccattgcttccgggtggcaaaaatctgttgttttaccttgcgtgtgaatgtctgatcttcccaggccgctaaagccgctgcctgactcatgccgctgatgttgtacgggagacgaacattttgcattttggggatgagtgctttaggaacaatactgaagccaacccggaaatttgctaacccgtataatttcgagaaggttcgcatgacgagcagattgggaaactgatgggttaacgatagcgtggatggctcgggctgatcgacaaaatcgatatacgcttcgtccacgacaacgagaatgttgggcggcacctgcttcataaactgcgtgatttgatccgggggcaaataagtacctgtcggattgtttgggttgcacacccagatcactttggtttttgtcgtgatgtgggctaataacgcgtcaagatcaatctccccggtcgccgcaatcacgggggcattaatcgttgtggctccggcaatggcggcttgtaactggtactccgggtaagtcggccaaggttgtaggctctcatcgcctacttctaaaaaggtgcgacaaatcaaagcaatcatttcgtctaacccactggaaaaaagtaattgctccgctggaacgcccaaccgtttggcaaccgcggtccgcaatggcaaagcatccggatcaggataattgcgtgcctgggaaaaggcccatttttcaagcgctgcctggacctttggcgaggtaccgaccggattttcattgaatgacaagcgcgtcattttagccaaaccggccgctttggcgattctttccggggtgctgtctgagacataatccggcagcccggcaatactgttgcgtaacattacgccacctgctttcttaattgtcttagagtttacccgttatatcgaaaaatgtaaatatattatgcataaatatccatatgagtacaatcgtgtctgctcattttttgcgcaatcacgttattaaaaaaccaagccagtacgcaacagaatttgctaatgatgcggattgacttggttaaagttggttattcattcgtcataaaatgacaaaaatgtgcgctttattttttggcgacaaaggctaagtaataagtgaccgctgctaccgtctgagcggaattgattttgccacttttaactccggcgactagttcgctgaatggcacgagccggctggtgacaaattcatcgggatcaaaatcctgagaagttttggccgccaaatcaagttttgccaagacgagatggacggtttcatccgtcatgccttcgcttgaacggacggcggttaaccactgaagatcatgcgtgatatagccggtttcttcgcgcagttcccggctggcggcagtttgccaatcttcaccggcatcgattaagccggcgggcaacgcataaacttcactgttcgtcgccacgcggtattcacgattaattaacacccgattgtcatgagtcaacgccaacattgccaccgcgttagcatgccgaattaagtcacgtttaacggttaggccatcaggcgttttgattttttgcgtcacaatgtcaaaaatcgggccatgataatgcggggtctcactcaaaatagtcccctttgctaaagggtgatcaaaaaacataccgccatctcctcaatgaaaaaagccgcgctgatacgcgacttgaaattaagctttcgtaaaatctttcatccatgccaacgcaatcgccttttcgcccagatgggtaccgacaaccgggccaaagtaagatagctcgaacggtacattcggaaacttttgctccagatcggccatccagcgctgcgcttcttccggatcgtttgcgtggattacgaccgctcgaacaggatagtcaaccttcgccaatgtttcctggaaaagtgtttcaacacgcgcgtaagctttcttgatcgaacgtatcttttcaattgcaacgattttgtgcgattgatcatcaaacgtcagtaacggcttgatcttcagcatgccgccgataaaggccgaagcattgctcaaccgaccgcctcgaaccagattctgcaagtcgttgacaataaagtattcacccatggttgcccgtaaatcatccaggcgcgctaatattgcttgcgggtctttgccggcttctgccatttgtgcggctgccagcaccagccaacccattaaaatgaccgtgatctgggaatcataaacataaactttagcgccatgaacctcgtcaaccgcaccctttaaagtattcacaaacccggagattgtgctggctaagtggatactaataatggtgtcgtaaccttcattagcaagattttcatataacttcagcatttcgcccagcggtggttgcgtggtacttggaaacgttttggcagttttgagtttggcataaaattcttgtgtggtaatatctttaccttcgtcataaacttcgccgtcaagaatgaccggaatcggcaccacagtgatgtgatgttgatcaatttcggtttgcggcagataacaggtactatccgtcacgatagcaattttcatacaggcacccacttcttcaaaaatgattgtctacatcataccataaaaaaacgagttgtaagcagcgcgcaaccaggagcgctcggaaatccaagcacgtttggctgggtttggagcagttaggttcgtggctttttgagtcaaacccaaaagctttagctgattaattggacccctcaccagtttgggcagttccgcttgtttgactgctagttgtaccggtcgtatcactgctgtcattgcccgatgttgcggtgtcactggaagttgcagccgtatcatccccgggttcattagatgtggttggcggcgtggcgggcgttgtattggaagtgcctgttgtgttaccggttgccgcgccagtttgattccagttgccatagccatagccactgtaatagggagaagtatactgagaacttgaggtattggcagtattgttaccgtacgtattcgcagccccagccgtgttggcgttagttgaactcgtcgccgcatcgcttgttgtggtctgattggttgcaggtgtcgaagtagtggcgttatcagcagttgtctgcgtttctgcaggttggctttgcttttccggtgctttttgagcgatttgtttctgatacgcccgcttcaacttgctggccttttgcttaattgtttgtaaaacatcgcgattgtagacaacaaggccttgcttggtgagattagccagcaatttctcaattccatcaagtttcttttgtaagtcggtgactgagatttctttgagcgctttttttgtcaacgtattgtctttgagtaacgcgttattctggtcctgaaaatatttaacatcgcgatcgacatagttttgataacgcgccaggacttcattgctcgcgttagtctgtttggcgtaacgcttttcggctgcttttaactttttaagtgtttgcagacgttgggtgtcgtttttttgtggttgaccatactgttgcttaagattattcaaaatcacctgagttttttcggcttgttgcttttcgccttgaacgtgctggtatttgacaacgcccaataataccgccgcggcaattaaaaccactgtaacaagcaatagaatgcttcgtttgcccttcatttttcccaataccctttcatgaataactttttaactgccctgccccatgctgagcaattttacgaaccagacgctgccgagagcgatcaatcccaaaatattatgcgcgaagattagaaagccgggttagcctagtcgtttcggttacactatcaaatctattttacctgttgtgacgactattgcctaccactaacagacgataattagtcttgatggaaaatggtatgtgagcgtcagtcgggcgttattcacagatatctttttaatccggcatgtcacgtgacgttgacagctttgccttacgcgcctaaaaccggtaaaatgattgggacaattggaaagcgagcggatcgatatgtcttttgacggaatttttacccatgccatggcccaggagcttaataccacgttaagcggcgggcgggttgctaaaattcaacaaccttatgaaaatgaaattatcatcacgattcgagctggacgcaagaaccatcccttgttgctctcagctaatccacagtatgcgcgggtgcaaattacccacattccatttacaaatccagacgttcctgcaaccttcacgatgacgttgcggaagtattttaacgcggctacgttaacagagattcaccaagtgcaaaacgatcgggtactacactttgaattctccacgcgggatgaattgggggatgaactggggctgcgcttgatcattgaaatgatgggtcggcacagtaacatctttttagtcagcaagcgcaccggcaaaattattgatctcattcgccacgtttctgcggatcaaaatcgctatcgtccgttgatgcccggtgccccgtatgtcgagccgcctaagcaagataaagtggatccgtttcatgattcggagcggatttatcacgaacttgaacgtcaggtaacaccttcattgagtcgcgccaccttgcttcagcaacattaccaaggacttgctaaggattctgcatctgaattggccctgcgactcaatcaaggcgatgccggctgggatagcttttttgcggcgctggcaacacctgaaccgactattacaacccaagggaaaaaagccgtttttaccgcgatcccgtatcagtctctgaccggcgaacagcaacatttttcaaccttaagcgcgatgctggatgcctattatgcgcaaaaagcggaacatgaccgggttttgcaacaaggcggcaacctgattcatgtgatcaagaatgtgattgataaagatcgcaaaaagcagcgcaaattaaagcgaacgctggaagaaaccgaaaaagccgatgattatcgaattcgcggcgagattctgacgacttatctgagtcaagtcaaacgcggcatgacgagtattgaactgcctaatttctatgctgataatgagccgattaagatcaccttgtccaatcagctgacgccatcacgcaacgcccagaaatattttgccaagtatacgaaattacgcaatgcagtggcacatgttcaccagcaaatgcaagaaaaccaagaagaactcgactaccttgaaggcattatggcgcagattgatgtagctagtccgaaagatttagtcgatattcgattggaattacagcaacaaggctatctgcgtaaacagaagtccgggaaaaaaggcaataaacgccaaaaagtctccaaaccagatcaattctatgccagtgacggcactaaaatctgggtcggaaaaaacaacctgcaaaatgatcagttgaccttacacaccgcgaagaaaactgacatttggctgcacgtcaaagatatcccgggatcacacgtgattatcgacagcagtgatcccagtgagaaaaccttgctggaagcagccgagctggcagcgtatttttccaaagcgcgcgacagtgccaatgttccggttgactggattgaggttaaaaagattcgtaagcctaatggagccaaacccggctttgtcatttacgaaggccaaaaaacagtgagtgtaacgcctgacgctgatttagtcgccaagctgcgcaacccgccgacaaaataggagatgcatgtttatgtcagaatcatcagcccaaatcagccgcccacttcaggaacatatcatcgccaacaaagtcaaacatggctggaataccaccgacactaactttgaaatgctgctggcttatcatgaaatggcggaattgacgacagcgttgcttaaacacgatcaagctaatatcgctgaagaactggcagatgttaccatttacctgctgggaatcgctgaaataaaaggaattgatttagcccaggccgtgaacgacaaagtgacaatcaatgatcaccgtgtatacgatgctcaaggacacaagcatttggagtaagtatgctggctttagtgcgctaagattgctgctaactttaaaccacaaaaaatcgaccttaagctagcatgttgattgctgctcaagatcgattttttgattcatctgctggtactaccctatcccaaaaacttaaagacaactttactatcaaatagcttgaatgttttttcaaatagtaacttacttaaaagtgcagcggcaattggcaccgcgaaccagcacagtaagaccaagggaattgccagcccggcatctaatgaagctagtgggccgaccataccgaccataccaaaaccggctgattgtggggttccgctgacccctagcagcgcaaccggaatggcagaaacgatggcggtgaatagacacggcagtaggataatcggatgtttaaacagattgggcatcattaacttcattgcgcccagtgcaattgccagcgtcacgccggatttattgacattccaggagaaaacaaccaacgcaatagcagttgccgccacacccatagccgatgcgcctgccgaaataccgttcagttgaatggctagcccaatggcaacggttgaaatcggactgataatcaaagtagcaaacgagcagcaaattaaaatggccatgagaattggctgcaaggtggtaaagctgttgatgagttccccaatggcggttgtgaaagccgcaataaacggtagcagtaagacacctatataagccgtaccacaaccaaccagaatcggcatggccactactgccgttgaaccgaaccgatctttaatccagatcaggagaagtacggcaatcgaggcagtaatcatggtattgatcaaatcgccggtacctgaacccacataggctttcagcgccggattaaacttaacgactccggagccaacaaatgccgctccagctgtcaccatcatctgcatgggattcaattcgaactgtaaggcgatcaagcccccgataatcaatggcgtggcaagttgaaaaatgacggcaatctgtgtcaacgtcaccgcaaatgtattcgtacccagatatttcagaatgccggataagacggcattgggaatgaggccgataatgacacccaaagcggtacctgataagaccttattaagaaaaactgtcaccgttaatttggaagacttttgcttggcgtgccgatcttcaaccagcccgctttctttgccggcttcttcctcagctagtgcatgtgcagcagctgttaactctttatttgccgaatctgccatgggacttcacctcttctataatgttggatctatataaatcaaaataaccatccgcttgtgatgattgttatgagaatattaacagaagatggcatatttagtccatagttaattttggcttaatactactctcacctttttaatatacgcaaaaaaatcggatgcaagatatttttaatcttccatccgatttttaggtatcataagagtcctacttgtgcagtatcgtcacaagcttatggtcgttaaaactggacgccccacttggccggatcttcacgccattgatgcaacgaagccaattgggcactcgtaatcgccccttgcgcttcggcggtttgaatcaaggctgtgtaattcgtcaacgtgaagaacggtagccctgctttggcgaagtttgctgtcaccgcggcgagttggtaactgaaaattgctgcgactccgagaacgttcacgccgtctttttgcgcggcggcaacggctccaagaaccgagccaccggttgacagcaaatcatcaatgacgactaacttggcatctgcagaaaggtggccttcgatctggcgtccctgaccgtgatctttaggcttactgcgaatatacaccagtggcaggttaagtaagttggcaaccaatgcggcatggggaatgccagcagtcgcaacgccaccaatggcagtcacatcaggataatgggccacaatctcttgtgccaatccagctgcgattttgctacgaacgtctgggtagccgattgtgagccgattgtcggtatagatcgggctttttagaccacttgcccaagtaaacggtgcttctggtcgtaaggttaccgctttgattcgtaacaagtcgctggcaatttgattttctaatttagtcatgtgctgtctcccacgctttcttaattgattgataggctgcaaccgggtcatcagcttgcgtaatcgggcgaccgatgacaatagccgaactgcccagacgtttagcacggcctggtgtcacgacgcgtttttgatcgcccacagcggtgccgcgcggacgaatacccggggttaccaccagaaaatcaggtttggtgacactgcgaatgagtggtgtttctaaagcactcgcaaccacgccatctgcgtcactggcctgggcgatcgctgctaatcgttgaaccgcctggctaattggcatatcaatcgataactgattctccaacatagcttgatcagtggaggttagatgggtaatggccaacatttttggtgccggctggtgggctgccttggcaccggctaataacccgcgcttggctgctaacatcatgtctttgccgccagctgcatggactgttgtcaacgcgacccctaaccgccctaactgccacgccgccttttcaacggtattgggaatgtcgtgtagttttaagtctaaaaagatgtcgacagggtgagcggcttgaatcgctttgataacggctggcccttccgcatagaaaagttccatgccgattttgacaaataatcgttcggtttgaggaaaagcctttaaaaaatctagcgtggtagcctgatctttgaagtcgagtgcaatgatgggtgtcataccgcctgtccttcctgaatacgtgcaaattctgcggcaattttggggattgcctgttcttggtaataattagctgaaccgatggcgactgccttggcaccggctgccagcatctcggcgacgtcatgaccggaactgacgccacccatcccgataatcggaatgtgaaccgtgtgcgcgacttgataaaccatatgcaacgccatcgggaacagcgccggtccggaaacgccaccggttacattggtcaaaatcggttcgccagtttggatatctaagcgcatgccgacaaaggtattgatcaaagaaatcccatctgcacctgctgcttcaacagctttggcaatcgtagtaatatccgttacattcggcgtcaatttaacaaagataggaacggaactagcttccttgactgcttttgttaccgcagcggccacggagggatcggttccaaacgccatgccgccttggtcgacattcgggcacgagatgttgacttctagcgcttttacatttggggcggcgcttaactttttggctactgctgtatattcagcaacatcggcgcccgcaatgctagcgataatcggtaagtctgggtaatgggacgcgagccacggcagcttttcgtgtaacacgacctctgctccggggttttttagcccaaccgcattcagcgtactgcttggcccgtcagcataaatcttgccttgattgccgattcggggcattaaagtcgttgatttggtaaccaaagcacctaatagattgagatcatattgtttggcgtaaccttcgccaaacccaaatgtcccgctggcgggcataaaggggttcttcatcgtcaaacccggtaactggatggccatgtgcgcttcctcctccgctaacctgcgtatccttttttggatcagctgatactaactgcgaatcggtgtcattgagaaggcacgcgattccaatactttcaaaatggcatcggccgtgtcaaggctcgtcattaacggcacgccatgctcaatcgcggtttcccgaatgcggaatccatcgcttgacgcctttttatctgccgtcatagtgttaatgaccagttgaatcttgcggtcggcaatgtcttcgagaatcgtttctttaccactgtcaagcttttcaatcgtcgcgaccgtaatcccggcggcttcaaacgcctttgctgtgccgctggtagcaactaactggtagcctacttcacggaagcgcttagccagctcggtagcttcaactttatcggcatccttaaccgtgattaaagcgcggccaaattgtggcaagtgcatacctgctgcttcgaacgccttgtataaagcttttgccagcgttgtatcgctgcccatgacttctccggtggatttcatttccggtccaagcagactgtcaacgtgattgagtttggagaaactgaagaccggcgctttgacgtggataccagcttgattaggcagcagaccagtcgtaaagccttgttccttcaaacttaaaccgaggatggccaaggttgcgacttgagccagtttaacgtttgtgaccttgctcaaaaatggaacagtccgacttgcccgcgggttgacttcaatgacataagccttgccttgatgaatgatgaattgcacgttcatcaagccgatgcagtttaaagcgcgcgacagtttgatggttgcatcggtaatctggtcaataatatcctgactaaatgtttgcggtggataaacggccatcgaatcaccgctatgaatgccggcgcgctcaatgtgctccatgatgccaggcagtaccacggtttcaccgtcggaaatgcaatcgacttcgcattctttgccgactaaatagtggtcaatcaaaactggatggtcgtgcgaaaccgataccgcgcgatcaatgtaactcgctaattcgtcagcatcgtgaacgatttccattgcccggccgcctaaaacataacttgggcgaaccaaaacgggataaccaattttatcggcgactgctaaagcgccatctttgtcagtagccgtaccgccttctggttgcggtaacttaagttctttaatgacttgatcaaacaagtcccgatcctcggcccggttgaggtcggctaccgaggttcccagaatcttaatgccccgttttgcaagcggttcggctaaattaatcgcagtttggccgccaaattgaacgataaccccttttggttgctccaggtcaatgacattcaggacatcttcaagcgtcaacggttcaaaatacagtttatccgcaattgaaaagtcggttgagacggtttcggggttactgttcataatgatcgcttcatacccggctttttggatcgccttaacactatgaaccgtggcataatcgaattccaccccttggccaattcggatggggccggaaccgattaccagaatacttggtttatcactcttggtgctttccgtgctgctttcataggtgctgtagtagtatggggtgtcgctggcaaactcgccggcacaggtatcgaccattttataaaccggtaaaatatgctgttccttacgcatctggcgaatttggtcggcgtgcaatccccagagtttggcaatttcttcgtccgcaaacccataccgttttacttcagctagtaatgataaatcagctttgtgggcggctaattcccgttccaattcaacaatatgcttgatcttgtcgaggaaaaacggattcattttggataattccgcaacttcatcaatcgtgtaatcacgacggaaggcttcggctagataaaagaggcgttcatcgttggcctgaataatgtgtttgcttagctcatcatcacttagcttagaaaattcagggcgccgcgggtgaatcaaaccgacttcaagcgaacgcaccgcttttagtaagctttcttcaagtgtgcggccaattgccatcacttcgccggttgccttcatttgggtgccgagggttcgatcaccattttcaaacttgtcaaatgggaaccggggtaatttggtgaccacatagtccagtgccggctcaaattcggcccaggttttcttggtgactgggttcttaatttcgtcaaggtttaagccaactgcgattttagcggccattttagcgatcggataaccggttgctttagaagccaaagcacttgagcgggatacccgaggattgacttcgatgacgtaatatttgaagctgttgcggtcgagtgcgaattggacattgcagccgccttcgatcttcaaggcccggatgatcttgagtgccgagtcacgtaacatctggacttctttatccgttaaggtttgagttggcgcaaagaccatcgaatcaccggtgtgcaccccgactggatcgaagttttccatgttgcagacaacgattgcggagtcggaagcatcgcgcatcacttcaaattcaatttctttgtaaccggcaatggagcgttcgatcaagacttgggtgaccgggctgaggttcaggccgttttcagcaatttcggctaattctttttcgttgtcagcgataccgccgccagtgccgcccatggtgaacgctggtcgaatgataaccgggaacccgattttgtcggcaaattcctgcgcttcttgaacattgtttgcaatggctgattccggcaccggttcgtgcaatttttgcatcaaatttttgaacagttcacgatcttcggcttggtcaatcgcgcttaatttggtacctagcaattcgatcccaagttcgtctaaaatgccggtattgctgagcttcattgcaagatttaacccgatttggccgccgatggttggtaaaatggcatctggcaactctttgcgcaaaatctgactgacaaattcgacagttaacggttcaatatagacgcgatcagcaatttcggtatcggtcataatcgtggccggattggagtttaccaaaacaacttcatagccttcttcacgtaatgcgagacaggcttgcgtccctgagtaatcaaattctgcggcttgaccgatgataattgggccagagccgatcactaagattttatgaatatcttgacgttttggcatgattatcctttctgcgtacgatctgagaatgcatccatcatttccataaattcatcaaaaagatggtcggcgtcgtgtggacctggcgcagcatccggatggaattggacggtgaaagccggatacaggcgatgccgcaacccttctaccgtgccatcgttaatttccacgtgggtgaccagcaaggtgtccgggtcaatgctgtcaggatcaacggcgtaaccgtggttttgactggtgaaatcaatgcggccggtcgcaatttcacgaaccggatgattgaacccgcggtggccgtatttcattttgaaggtgtcggcgccgtttgccagtgcaaataactggtggccaagacaaatcccgaatagtggaatcttaccttcaatgccgcgaatcatatccaatgcttccggcacatctttcggatccccagggccattggttaacatgacgccatccggtgctaattctagaatggtagccgcagtggttgtggacggcaacacggtcacgttacattgacgtttagccagttcccgtaaaatgctatgtttgaggccaaaatcaatgaccaccacattgcggccagtacccggtgccggataagcctgctgagtcgagacttgttgtacttgattctttggcagtaccaatgctttgagctggtcaaaggcatgttcgtcggcggcatccacaatactggctttcatggcaccgacttcccggatttttttggtcagcgcccgggtgtcaacgccgctgataccgggaatatgtttgcgcttgagaaattcatccagcgtcatctgactacgccaattaccggtgaccctcgcaacgtctctaaccacaatcccctttgcagtcggatcaatgctttcgtaatcatcacggttaataccgacattgccgatgagcggttgcgtgaatgtaatgatttggccattgtaactttgatccgtaatggtttcttggtagccgctcatgccggtgttaaaaacaatttcaccagtcgtgaccgtttccgcaccaaagccgacgccaggaaaaacactgccgtcttccagaattaaatagcgcttcatgcttgtcctcccttttgataggcgatttggccgtgactaatggtatataacgcctggccttgcacctcttcaccgataaatggtgaatttttaccttttgaaaaccaatcggcgggatcgattttataagaagtttccagatccaaaatggttaaatcagcgggcccaccaactgtgatgtgaccacctggcagtccgaatttggctgccggaatcgtgctcattttggcaatcagttgttggagcgtgaacattttggatttaacgaacttggtgtacagcagtggaaaggccgtttccgaaccgacgatcccgaatgcggcggttttaaacgatcccgtcttttcttcagccgtgtggggtgcgtgatccgtggcaatcatgtctagtgtgccgtcttgcaagccttccagtaatgccaaatgatcagcccgtgaacgtaacggtggattcattttaaacatggggttatcgccggggatgttattttcatcaagtaacaaatgatgcggtgagacttcagcggtaacgttgacgccgcgtttcttggcttcgcgaatcaaggccacactttggcgggttgagatatgacaggcgtggtaatgaacgcctgtggcagctgccaggtctaagtcccgagctaattgactgctttcggtttggttaatgatgccaggcaggttcagttttttggcaaccggaccggcgttgatcacgccaccgtgcatgaggcttgcgtcttcaatgtgagccacaatcggcgcgtttaacttggctgcctgtagcatggctcgatacatggtgtcagcatcttgaaccccgacaccgtcattggaaaaaccaagtgcaccggctgcttgtaaggcgggcatgtcaaccacttgatccgagtgcaggtttcgtgtaatgggggcaaactggcgaacggtgattttggcatcgctacgattcttggccagtaacggcttcaaagtggcgactgtatccggcaccgggtttaaattactcatggcgacaacggttgtaaacccaccatgtgctgctgcctgcgcaccggttttaatggtttcttttgcggtaaaaccgggttcgcgaaaatgaacatgaacgtcaatcaatcctggcacaactgtcgcaccggtggcatcaatcaccgtttcatcggctcgagctgtcagttgctggccgattgccgtgatctgctcgccggtgatctggatatcggcagtgtattcggtgtcgctaacgatgtgggcatttttgatgagcatgagttactcctctccgaagtgacgggcattgatgaccgcttccagcatggccattcgcatgaagacgccattttgcatttgcgtaaagatccgtgattgtggtccgtcaactaaatcgctggctaattcaacatcacggttaaccggtgccgggtgcatgaaaatggcattgggtttcatggttttagccaagtcatcggtaatgccatacttagcatgataactttctttagaaaaggcttcgcgattatcctgattgaagcgttctaactgaacccgcagcagcatcaacacatcgacttgtttaaccaactccggcacgctgatgaagtcgccataacggtcaaagctaggatcataccactgttgcggaccagcaaaatgtaacgtagcaccaagtttgtgcagcatctgcatatcactgcgggcaacccgactgtggctaaggtcgccgacaatcccgatgttcaagccttcaaaatgaccgaattcttcgtgaatggtcatcagatccagcatcatttgggaaggatgttgcccggcaccgtcacctgcattcacaatggcggttgttggccatgcacccatgagttctttataatagccgtcttttgcgtgccgcatcaccgcaatattgacgccgattgccccaatggttttaatggtatcttccagcgtttcgccttttgatactgaactgtgggccgggtcgaacgggatgacggttagccctagtttgcgttcggccatttcaaaactggtatgcgtacgggtactattttcaaaaaataagttagcagcataaattggttccggaaaatgaacggtttgaccggctttgaagtcttcggcgcggttgattaacgccatagcacttttttcatcaacctgttcagcggaaacaaaatctttaaacggtgtatctgtcaaattagataaggtcatttttctctgccccttcttcattagcggcatgttctggtaaaacaaagttcaggaagattccgatcacggttgccagtgcaaggccggaaaattgatagccggcaaattgcagactggcattgccgatgccgatcacaagaatggtcgaggcaatcatcaggttgcgcttcttatcgaagtcgactttgttgtcaattaaaacccgtaagccattggaagcaatcaccccgaacagcaggaaactaatgccgccaataaccggactcgggatgctacgaattaatgcgcttagcttaccgatgaaggcgaacaagatggcaaacatccctgcgccgcctaatacataaacgctgtgcaccttcgtcatcgcaagcacaccgatattttcgccataactggtgacaggcgggccaccgacgaatccagcaatgattgacgcggttccgtcaccggctaaggtatggttcaagccgggatccttaaagaaatcacgtttagtcaatttgttgagtaccatgatgtggcccatatgttcggtcatcgtgacaaacgcaatcggtgccatggataaaatggctccccagtaaagttgcggctgatagctgataaaaggcagttcaaactttggcagatcaaaccatgccgcttgttgtaccggcgtcagatcaacaatgccaaacagcaaggccaccacatagccggtgacaattccgagtaagatcggcaaaagactaataaattttttgagatacatgttgtaaatgatgacggatgccaaggtgatcatcgcaacggcaaagtatcgcaggtcataaacgctcttggtggcactgattgtacgcatggtcgcatcggtggcggctgtgcctgccaaggataagccaatgaccatgacaatcggaccgaccacgattggcggtagtgcccgatcaatccaagctgatccgctgcgagcaacaatcaaggcaacgatgagataaacgacaccgactgctacggtgccttgtgcgatggctggataacccgcacctttcatcaaagcttgcatgatcgtgataaacgagaaactcgatcccatgtacgcaggaatcttgccacgcgtaatcaggatataaactaaggtgccgacaccgcttgaaaataaggcaatgcttggatccagtccgactaaaatcggtaccagcacagttgaaccgaacatggcaaaaaggtgctggattgaaagccccacccattgaccgaatttcggcttatcaccgatatccagtactgcttcgtcattatgaaaagccattgattattcccccatcttttcaatgctgatgccgtctttgccatcaagttcggccacctgcacctgaatttgctcgtcaagtgaggttggaatgtttttaccgacaaaatccggtcgaattggcaactcgcgatgtccgcgatcgacaagcacggccaagctgatcttacgtggccggccttcatccatcaacgcatctaaagcggcgcgaatggtgcggccggtgaagatgacatcatcgactaaaatgacatgcttgccggtgatgttaaccggcaactgtgccccttcaacatctggttggtgttcatggtcgattttatggacatcatcgcgataaaaccggatatccaattcgccaaccggaacttttaaaccttctagttgttcgaggcgtttggcgatgcggtgggccaaataaatgccacgggttttgatcccgactagaacaagatcgttcagacccttattttgttcgatgatttcataactgattcgtgtcaatgcgcgtttcatagttacctcgtctacaacctgttttgactgtgccattgatgtgccaccctttcttgtatgtatgctgataaaacttggtgccagtgagtttgcttggggatgaaagctgtgctccgacttctaaccgggctggttcacgctcacaaaaaaacgcctcctacccaatttggatagaaggcgaccgtagcctgaataatccgccgcaacggaaaggaaaccttctaagcctcactggacttagttaaaggtgcttgtttgattgagttaagattaccgaacgttgcgggtcttgtcaatgcctgcacgcagatcggttaaggttttttcaaaaattgggggtaccggcgcggtaaaagttaataattttcccgtgaccggatgcacgaagccgagttttgcagcgtgaagaaactgaccatgaccaggaagggtacgcttagggccatagagaggatcgcctgctaccgggtgatggatgtaagccatgtgtacgcgaatctgatgcgtgcgcccagtatccagaatgcattttaccaaggtgtagtttgtaaagcgctccagtacttgaaaatgggtcacagcatggcggccatctgcgaccactgcttggcgtttgcgatcgcgcgggtcccgacccaacggcgcatcaattgtgccctcgtcttctttaaacgtaccatgaaccagtgccaaatattcccgaatcgacgttttagccttaagctgggcggatagacttagctgggcggcttctgtttttgcaaccattagcaagccgctcgtatctttatcaatacgatgaacgattcccggccgaatgacgccattaataccaggcaacttggtgtgatacagcaacccattcaccagcgtgccgtccggatgacccggtgccggatgaacaaccatgccttgaggtttgttaaccacaatgacttggtcgtcttcgtaaacaatctcgagaggaatcggttcagcaacggcctttagtggtttaacttccggaatggtcaccgttacgacatcaccggccgtcaccttaaaattagctttcacgggattgccattaacggtgaccaagccgtcttggagccatttttgcacctggctgcgggtgtgggtcgtctcgtgggccgtgatgatcttatcaattcggccgctttcggtggtaatggtgaaggtatcgctcatgctaccgccgccttgtcacgatcaaacagaatgtagatcaagacgaaaacaaccccaagcgtgatgcagacatctgcaaaattaaaaatcgcattaaaacgccactgatcaagaaattcgagatggaacatatccgttacatatcgaaaacgcaaacgatcaataaagtttccgatcgcccccgctgtgatcaaggtcaaccccatccgataaaacggcttatgcagactatcgcgccacagcatggcaacaacaacaaacgccagaatcgtagtaacgtaaaaaaaccactgcttaccttcaaacatcgaaaaagcagcaccagtattacggatatgggtgagatcaatcacacctggaattaatgactgactgtcaccaagcggaatatgaaccctaacccaagtcttaatcccgaaatcaagcaaaaccaagacagcagcaaccatgacataaataagcaaagaaaaatcctcctgagcgcgagccggcgcggttagggatcggagtataagtggccttgggcgtgatggcccggttttggccattgcgaccaaggtccttatacgcagatccctgcgccggggagcgcgttatgatgtaagcgcgagccagcgcggttagaagtcggagtataagtggccttgagcgtgatggcccggttttggccattgcgaccaaggtccttatacgcagatccctgcgccggggagcgcgttatgatgtaagcatcagctgactcctacctcagccgcgcgtctaatgtttgtttcctagtgtaccgcgcccaaagaaaaaccgccatcttgaaaatggcggttaacgtttctcgcagcgatgacatgattagaaaagtccggaaatcttaccatcgtcagtaacatccatgtttaaagcagctggtgcttttggcaagcctggcattgtcaaaaccgtgccggtcatgacgaccaggaacccggcgcctagcttagggataatatcgcgcacatgaatggtgaagccttcaggagcgcctagtgttttagcgttgtcggttaacgaatactgggttttagccatgcaaatcggcaagtcctgccaaccgttcttggcaatggttcgaagtgcagcattcgctttaccttcatagacaacatcggcaccgccataaatcttttgaacgatggtcttgattttttctttgacgtcgctgttgcgatcataaagcggtgtgaagtgacttggctgattcaaagcatctaaaactgcatccgcaactgccaaaccgccgcggccgccatctgcccaaaccgttgcggtaactgccttgacattgagtttggcacaggcatcaattaaccactgaatttcggcatcggtgtcacttgtgaaccgattgaccgcaacgacaaccggcacgccgtaaccttgcatactgtggatatggcgtttcagattggcaaaacctttagctaacgcgtccaggttttcctgttgcagatcggctaatgcaaccccgccgttatactttagtgcgcgaacggttgcgacgatgacaacagcatccggggttttacctaacactggggtcttgatatccatgaacttttcaccgcccagatcagcgccgaagccagcttccgtaatcgcgatgttacccagttgcaaagcggtgcgggttgctaaaacggaattacaaccatgtgcgatattggcaaatgggccaccatgaataaatgctggcgtatgttcaagtgtctgtactaagttaggcttcagggcatcgcgcaataacatggcaatggcaccggtgacttttaaatcgccgaccgtgacgggtttgcggtcataggtatacccaatcacaatccggccaattcttgcttttagatcggcaatgttttcggccagacatagaacggccattaattcgctggcgaccgtaatgtcaaacccatcttcgcgcggcacgccactggttggaccgcctaagccaattgttacatggcgcagtgcccggtcgttgatatccaacgcacgcttccacaaaattcggcgagggtcaatattgagtgtgtttccttgctgcagatgattgtcgattaaagcggccagtgtgtcaacggcagtggtcaaagcatgcatgtcaccggtgaagtgtaggttaatatcttccatcggtaccacttgcgcatagccgccaccggttgcgccgcctttcatccccatgaccggacctaatgaaggttcccgcaatgcgataacgggatgctggccgcgttgttgcaatgcatcacctaagccgacagtaatggttgatttgccttcaccggcgggggtcggattgatggatgtgaccaaaacgagcttgccaaacggcttatctttcaacgcattaagcgccgtaaagctgagtttggcttttgatttgccataaagttccaaatcatcagcggttaaaccgatacttgcggcaactttcgtgattggccacattgagctggcttcgttagcctgggcaatttcaatatcagacatacaacacactccttatttagtggatgtttccaaaccttttttgatcaacgccacgattttttgttttcgctttttgccgaacatcagaaacgaaacgcgaccgtattgtttggttttaagcataacggtcaaacggccattcgtaaagtcctcaatgtccgcccaagctaaattaatcgtgttacttttaaaaaagctggttaaacgaaggcctttaggcgttgcgactaggcggagcaataaaatctgaacaatcgcaactaaaattgtgatacctgcaaccgcgaccgccagccatgataaattggtgctttccagctgaagaatgatcgctaaactaagtccaaatacgatcgcactccaaaacatgctaaaatcgatccatgcaggttgataatgtgttcgatatcctgccaatttgccacttccttaggagaaatcatgcttaaactatacacagatggcgccacaaaaggcaacccgggaccggctggcatcggcattctggttagcggattgcctcagcaaattcaacatcatgccgctttgcctgcgatgagtaaccacgaagcagaatttgctgctgccattgccgggtttaaattattgattgaatccagcttgacaacaggcacagtcgcttactacagcgattccaagttagtgattcaagccattgaaaagcgctatgccaaacactatccggctttaacggcagagctgctgagcttaattgacgagtttccgctggtattgcccaactggatcccggatcggcaaaatcgcggtgcccatcacctggctcaacaaggtttgcaccaagctgaaaccgaaagttagtgtcagtcatcttgtcgtttcatggatcgattgacgtaaaaaaaagcctgaaactccagcaatattggaagtttcaggctttttgatcgaaacgtaccagcttgggttatagctgattatttaagcactttgaattgttgctcacgatccatgtaatccttggcattcgcttcgccttcgatggaaccgaatggcatctgagcacgtaactgccagtttgccgggatatcaaaagcttcgcggacaaggtcgtcaatgatcgggttgtaatgctgcaagttagcaccgataccgttgttagccagcgttacccacgtgttaagctgagccgatccttgtgactgttctgcccaagttgcaaagttatcggcatacagcgggaaatttttctctaactgttttacgacgtcggtgtcggtgaagtataaaatggttgcaaaagcggctttgaaaccggcaattttcttcttggttgcctcgtaggcttcctcgcttggcacttcactctttaagcgcttgaccacaatgtcccataacttatcatgttgctcgccaaacaggaaaacggcccgagtagcctgtgagttaaaggctgttggtgtttcttgaataacggattcgattaatgcaaccaactcgtcaggattttgtttgatatccttgccgagtgcatagatggagcggcgttgtttgagcagatttagaagatcttgattcacgagataaccacctttttattattaatcaatacgtgttcgggcacacaccgtcaaacccaccctcacctatcactggctgtgaacgttaaaggcggtgcaacgcatgtgagaacaagcataagtttaccaactgactattagtaagtaaacccccaagcgaaaatttcttgaaaaagcgactggctaaacttgcattagtataccgaatcctgcttagcgcttctatactataacgtgacagtgaccgttggcttgggtacaataaaattattcttcatggaggtgcggtatgtcgctcattacgtggctaattattattattttggttttgaataccattggggcgattttcaccgtcctccgcgaagtccgcgatatttcaacgacctgggcttggttactagtgctgattttcctgccgattattggtttcggtttttatctattcgccggtcgcggcttgtcaaccaagaagttgcggcggattcaacgcgaatatgaatctggcgtgaaagccttcgtgtcacttcaaaaacatgaaaatgcgcgcaataagctattgccgcctacggattacacgccagcagctaaggcgttaacggccttttttcttaatacggcccaagcaccggtactcgcgcacaaccaggttcaactgtacacggatggcgaaaaaaagtttgcggcgttatttcgtgacatcgaagcggccaaacattatatctatgttgagtattacaccatttataatgacgagctaggtaatcagtttcaacaactacttataaagaaagccaagcaaggcgtcactgtaaaggttttatatgatgcctggggttcaatgggtgcctcggctaaatggtggcggcggctcactgatgtcggcggacaggctgagagctattttagctcgaaacatcccatcaccgactttcggcttaactatcgcgatcaccgcaagatcgttgtgattgatgatcacgttggctatattggcggttttaatgtcggtgatcaatatgtttcgcgtaaaccgaaattcggttactggcgcgatacacatttacgcattgtcgggaacaccatttatgcgttgaaaattcgctttacaatggattggaacgcaactgtcgatgagcaaaaagaaattgcctataacgtcgaacaaagcggtgccgaggatctgaccagcgaaagtatgaccgcaggcagcacgccgattcaaattgttgcatccggacctgaccgccccacccaacaaatcaagctggggtacaccaagttaatcactagcgctaccaaatcagtttggattcagagcccctatctggtgccagatgatacggtaatcgatgctttagtctcggcggcgatgtccggcattgatgtccgaattatggtgccggatatgccggatcatccctttattttccgtgccacgcaatattatgccaattatctggcgcgatcaggggttaaaatttatcactaccagcacggtttcatgcacgccaaaaccgtggttgttgatgatgcgattgccagtgttggctcggcaaattttgatatccgcagtttcaaattgaacttcgaaataaatgcgtttatttacgatcgcaaaattgccggaactttggccgaaatcttccaagcggatatggccaaaagctatctactgacaccggaaatcatttcgaaccaaggctggtggttacggtttaagcaagacttttccaggctcctgtcccctattctttaaattgcttcaaaagcctttcattataacgcgctcaccggcgcagaagtctgcatgtaaggaccccttaagcgcaatggccaaaacccggccatcacgcttaaggccacttacactccgacttctaaacgcgccggttcacgctcactttctataaggcgcaaatgataacaacgccggttcaacgatgtgatgtttcgctgaaccggcgttgctttttgaaaaatggctgatgaagataccgcgattaagtaaaattattaccaaaaaggactaaagtcgtctactgaacgataccccgcgcttggagactttcaggaccgcgcgcattaacgctgccaatcatccaataccttggtgtgaccaagaaggtaatgaatcgcagcatgaactaactcgtcgcgtgccgtgagtaattcatcgccgtcaagattatacttatcgcgcaaataaccctctgcaatcgcttgatattctttgcgcgcttcgccaccatcgtttaaataagtatcgatcgcttccagattatctttggcccgattagccagttcttcggccagatcatcaacatgcggctgacgtttgtgagcgtaatccatcagcgtgtcattcatatcaatgacggccgcttcatcagctttcttgtcacgtttcatggttacttcatctcctaatactattagtatgcacctatgacctattttcatcaacgctgagcgcgaaccggcgcggttagaaaccggaacataagtggccttgggcggtgatggcccgggcttggccattgcgtccaaggtccttatgtgcaggtttctgcgccggtgagcgtgttatagaaagtgagcgtgaaccggcgcgtttagaagtcggagtgtaagtggcctcaggcgtgatggccggggctttggccattgcgactgaggtccttacatgcagacttctgcgccggtgagtctgttatagtgtgatttcgtcatataatttccgatggttctgccagcaacaaaataacggccaccgattaacgatgcaaaagctgacgggagcggtggaacaattcttgataaagtgctgaccagctctcgaaccgatcacttgccaaataaaaaacaggcgtgtctggtacaatcggttcctcaccgggagccagcgcctgagcagaaatcacgaggtccgggtgttgggcaacagttaccagtcgaatataggcgggatgcatcagattaagacggactgtttcgtacaaaggttgtggcatcatgggatcaagtgccactttgagtttatctgaaacggcactgtcggtcatgaatggccaaagtaattgatagaatccgtcaacgatttcaggccgggatttttcggtcggcagttcccgggcaaaaaaggccttaatagctgtctccagacgcggataaaacgcgcgcatgggactggcggttttggttaaatcaatgtaagcgccgcctgggaagatgcgttcgctaattaaaatttttagcaagttacctgccaaggcgagatcattggtcacggatggtgaaattccgacgagtcgtgtgctgagttcggtgcgaatcttagcgaccgtttgccatgctggcgtctcgttagcggcatgatagccgaccaaggtggcagcatcaaattgttgttccgtatgaaagcgtggaatccgccattgtccgagataaagatagagcatctcggcttcagcagtggctcgtggcaagtttgctaaaggtgcaggtatttttttaggtaatgatggctgcggtttgagcgcagaaaagttcaaagtaccggcaattgagtggtgggccttaaggcgatgcaaattaatattggctgaaaatagcaactgggcgaccgagaaatcgcgttgtaccatgccggccgcttgcaacgctttgatgagttggcgtgattcgggcaaaatatcggcgaacaacggattcccgatatcgaccagttgccacaataattggcgatagatttggcgaattcgcggttcagaaccgatcagcgataacggggtcaaattaatcgaaacttcagctcggcgcaaatagagtcgtaatgcggaaattcggcgaaaaaaagcagcgcgggaaaacccggtttcagtcaatagatctgaaagcgttgacgtgggcgccatcaaagttttgacaagtagtttccccggcagtgaccgccgatataaaaatatgcgataacgaacgcgactgatggcaggcggtgccgtcatgttgctatcaccgcggtgcaataacggtggtgcagcaggatcaatttcatgcaaatcagcggctaccttctccatgagccggcgaagttgccgataactttcaccacgcgccattgaggtagtcacaatgttaagctggtggttgggtgcgtcgcgtaaagtgccgtaaatcgctaaccggtctcgttcttcgcggtctagaaaaatttcttcaaacgccatggtgccgccttctttttcaaactttgctatagtatagcaaatggcgattgtaaactagctaaataatgcctgcttgaggccacccctattttgaatcatttttgccgctcattcaaagtcttcaaagtagcgaccacgttgacgtgatggtcattgacaatatttaacgcgtccttttgccggttgccactggcgtttactatgcaatcttggtatactaaaagtaagcagaaatcggatcgacaccatatgctcgggggtatcaaaaaaattaaccccaagatatggtgtttttcattgacaggcaccccaatattgagtattctaaaagacataagataacaagaaaggatgatacctatgcgtaacatcacactgtttacgcgcaatggctgtccgcaatgccggatgacaaagcgctacctcgatacccataacatttcatttaccgaacacaatatcaacgaagaacctgaatacatcgactacttgaagaaaaagggattccagcaggttcccgttctcgaagcagatgggcttgattcattctccgggttccgaccggatgccttgaagcaactggctgtttgatcagccagtttttttatcgcatcgaaactagcaaggaagattaaatgcagcgaaagcagggattagcatgtcactaaaaaccattagtccggatgaggttacttattacgcacttaacaacgagattaacattcccgttaacgaccaaattccgcttaacaaagataaagaagcattgcaggcctttttgaccgaaaatgttgcacccaataccatgaaatttgcttcattacaggagcgcttaaagtatctggttgaacatcactattatgaagcagactttttaaagaaatatcaaccggcctttttggagaagttgaatcagtttctcaccgcgcagcatttccaatttaagtcgttcatggctgcgtataaatattatgctcagtacgcgttaaaaaccgatgacgggacgcaatatcttgaagattacaaagatcgcgttttcgctaatgcccttttctttgcggatggtaacgaagatttggccgttgacttagccgatgagatgattcatcagcgctatcaaccggctaccccatccttcctgaatgcaggtcgggcgcggcgtggtgaactggtctcttgtttcctgctgcaaatcaccgatgacatgaattcaattggtcgggcaatcaactcggctttggaactttcccgtatcggcggcggtgtcggcttgacgctgtcgaacctgcgtgaagccggtgcaccgatcaagggcattgacggtgctgccagtggtgtcttgccagtcatgaagttgctggaagattcattctcctacagtaaccagctgggtcagcgccaaggtgccggggtggtttatttgaacgtcttccatccggatatcatcagcttcctaggcgctaagaaggaaaatgccgatgaaaagtatcgggtgaaaacgttgagccttggtgtgattgtgccagacaaatactacgaactcatcaaggctaacgctgacatgtacctcttctccccttattcagtcgaacgcgcgtatggcaagccattttcttacgtggatatcacgaaggaatacgacaagatggtagccaatcctgatattaagaaatacaagatcaaagcgcgcgacttggaaaacgagatctccaagttgcagcaagaatccggctatccgtacatcattaatatcgatacgactaatcgcgccaatccgatcgaaggtaggattatcatgagtaacctgtgctctgaaattatgcaggtgcaggttccgtctaagctcaataatcgtcaggagtacgaggtcttagggacagatgtttcttgcaacttggggagtacgaatattcctaacttgatgcacagccgtgattttggtcatagcgtcgaagccatggtacgcgcgctcacctatgtcacggatcacagcaacattgacgttgtgccatccgtgcagcatggcaatcaccttgcccacagtattggccttggtgcgatgggcctgcacacctattttgccaagaaccacatgtactacggttcaccggaaagccttgatttcactaacatctacttcctgctgcttaattattacacgctcaaagcttccaataagatcgctaaggaacgcggcgaatccttccacaactttgaaaatagcaagtacgcagatggcagttattttgacaagtatctcaatcaaacctgggcgccgaagtatgataaggttcgcgacttgttcaaaaacattcacattccaacgcaggctgactggcaggcactcaaagaagatgtgatgaaaaacggtttgtaccatcaaaatcggatggcagttgcacctaatggctcaattagctatatcaacgacaccagcgcttcattacagccaattgtcaaccggattgaggatcgtcaggaaaagaaaatcggtaccatttattatccggcaccagggctttccaacgacacgatgccttactatcaaagcgcctatgacattgatatgcgcaaagtcattgatgtctacgcagcagcccagcaacatgttgaccaggggatggcgatgacgttgtttatgcgtagtaccatcccagctggcctttatccgtggaaagatggtcgtactgataaaatgaccacccgggacttgaatatcttgcggaattacgcccactataaaggcattaagtccatttactacatccggacttataccgatgaccaagaagaaatcggcagcaacgcttgtgaaagttgctcaatttgataatcttttaacagggggatctcccctgtttttacataaggagcgaagaaaatggtaaaacagtatattgcgattaactggaatgcaattgaagatgaagtagataaagccacttgggaaaaattaaccgaacagttttggctcgacacccgaatccccttgtccaacgatttggacgattggcgttcattgagtccggatgaacaatgggtcgttggccacgttttcggcgggttgactttactggataccctgcaaagtcaagacggtatggcaagtttacgccaaaacatccggacccaacaggaaaccgcggtgcttaataatattcagtttatggaaagtgtccatgcgaagagttattcatcaattttctcgacgctgaacacgcctgccgagatcgatgaaatctttgactggaccaatcacaatgagcatttgcagtacaaggccaacaaaatcaatgacatctatcacaacggctcggcactacaaaagaaaattgccagtgttttcctggaaacgttcctgttttattcaggcttctttaccccgctttattacctgggcaacaacaagctgacgaatgtggccgaaattatcaagctgattattcgggatgagagtgttcacggaacctatatcggctataaattccagttaggcttcaatgaattaccggaagcagagcaacaacaactgcaggattggatgtacgatctgttatacgacctctatgaaaacgaagaaaagtatacgaacgatctctacgctaaaaccaaatggaccgatgaagttttgactttcctgcgttataacgccaataaggccctgatgaatctgggacaggaaaccgcctttccggataccgccgatgacgttaatccgattgtaatgaacggcatttcaacatcaacggctaaccatgatttcttctcacaggtcggtaatggttaccggctcggtcaggtcgaagcaatggaagatgatgattattcattctcgactgaagataaagggcacaaggattaaaatgaccttgctcatgacagtaaaacagcctttgcagacaattatttttgtctcaaaggctgtttttgtttgcctgaaatcgtataaatactggggccaattctgataaatgacgcgtagaatggtgaccggctttcgcttataacctgaccacgagattacgattcggttttatcagacgcaatcttctcgtggacaagttccaaaaagtgttgcgcgatacgcgaaagctcccgatcccgtttccagaccaacgcaaccggatcggctagtgcaggtgctaacggacgaaaagtcaaggaagtattagacgtttgggtagccaggtattccaggcacaatgcccgccccaaaccgactgctgtcatgcctaatgcatcagcagttaagtcataagttccgacaatataggctggatccaatccctggccaagccaatgttcaaaactattgcggatgtgcgttgctcgtggcaggatcagttcactgtcactgatatcatttggcgtaattaacagattatcagtcaggggatcctcggtgtccatcaagattccccacgcatcacgcatgggtaacaacaaccgttcatattgcgtgtgctctttacccggacgcagaataaagtcatacatgccggcttccaggttagctaccagactttcatctgatccatacgtcacgtggacatgtaagctggggtactgaagccgcaaagattgcgctaactggagcatgagtcgtttgccgctagtttcgcctgcaccgatatagagatcaccgcccaaggcatgtttgccttgtaaattgtttttggtccgttcggcaatggcggtcaattcgcgtgctcgatttagtagataggtaccatcttcggtcaaggtgacgcggcgattaccccgaatgagcaacttgacgcccagctctttttccagatccttgagctggcgcgatagccctggctgagatatacctaatgttctggctgcagcggtaatactgccatgatctgcaatttcaatgaagttgcgcaacgtctgcagttccatgttctcccctacttcctatcagtcctaattatcacaagtgctttcctataacaattatagcccattagcggcactttgtattccctttcacacatcatcctttatcttggcaagtgttcgctggcaaaggtgttcgctcacctaatccgcttgaccgtgaaaatgatagtttgattcaaaaaagcatcggctcaagtgagccgatgcggatggtgctaccagatttgaacgcgcttttccggcggtaagtacatgccatcgcctggttgaacatcaaaagttgtataccaatcatctaaattgcgcggttggatgttggcccgtaattcatggggtgcgtggacatcgactgctaacaacatcttggcgcgctctaaacgcgattttgaacgccaaatgcgcgcccaattgatgaagaatgcgcgtaaatcagcatccttttcccgtttagccgtatccaacgccgctgctaatccgccggcatcggcaatattttccgaaaccactaatttgccgtttactttgccggctgccgtttccagaccgtcaaattcgtcaatcatggcttgggtcaattcatggaaatgatcaaaatcggctttttgccaccagttggccatgttgccgtactcatcgaactgggcaccattgttgtcgaatccatgagaaatttcgtgcgcaatgaccgcgccaatcccgccaagattttccgaagcggtttgctttaaggaataaaatggtgcctgtagaatggcggctgggaaagtaatgtcgtttttggacggatcatagctggcattcaccaagtgtccgggcatgttccataccgtgcgatcaacgggtttcgtcagtttatcaaagttatactgtacttgcaccttgcgcatggcaaataagttttctagcaatgagcgattgggatcaacatggagcagatcgtaaatggcttcaggatgatccggataccccatttttaataccatcttatttaacttaagaatggctttgtctttcgttggctgagatagccagtcagagttagctaagcgctgtttgtaagttgcaatcatcttttcaactagctgggtgacatcggcttttgctttttccccgaagtaggtccgcccataataaatgccaattggttcactgaagtaccggttggcgacccgataagcatgcttaagctgatcaggcgatttcggtgcaccagataatgcgcggttatatgtaccgctcaattgccgcagtggttcgctcaagaagccggccacgtcacctagcgtcatgacataaagccagtcgcgataaagcttgaagttggcttcattaaatagctggtcaaattcattcaaaaagcgcggatccgcaaccacaattgtttccggcacattcttgaaaatggtctttaagaggtcttcaaaattaaacggcttgagcttctcaatgaccgtgctagttggcgttggattataggccttaggataatcagcccattcttcagaactcttgacgtgcttggcaatttcggcatcaaacgccaacgcgccttccaaagtggccttttgtgcggcttcgtccaaatcagtgtacgccaacagttgctgcatcatgtctttgaaaatgccaagcaattgcgcgccattttgattgtccttagcgtaataggacgtatccggcaaaatcgtttttggccccatcagattaatcacatttttgctggtatctttcatgtcgacatcaacaaaaaagttgaatggcggatcgattaaatgctcctgaagcaaattagcagcgcgttggttgtaatccgccaggtctttaatgcccttcaccagatttaagcgtggttcagccggggcaaatccagccgcgtcccgcgttttaaagtccttagcctgttgatacagcgttactgcctgggcaaaatacttgtcaggtgcctgctttttgccagctgaaacggcggcaaaatcagccatcatcttctcctcgacttcatcggcaagatcctgaaacccgccggtactgcttttgtcgtcaggaataactgcttgtttcatccaagcaccgttcactgcttgatataaatcgtcttgatagcgtacttcacttgtcattaaaaagctcctttcaccatgaaacgttatgtcataatcttaacgcacttctcattttcttgcacgactgattcacgtttcagtgcaataggacgcaataaattctaatttggccttaggtttttctcttttaatgaaagcgtgccaagtattaaagtcggcgggacaaaattggatcgcacagcgagttagattggcaaaatagattgttgtcaatcgaaatcgctttctttttggcgcataactcgttaaaataggccatgtactaagtcaacgatcgactaatcgtgtcagtcgttactggataacgcatttgctggcagctgctgaagctgtcagccgatgctcataggaggatgtgcaaggatgtattatgtcattatgaagtctcacgatattcgtgaaaacttggcgactgagcaatatctgatgaatgccaagcagtttgatgaaccactgctgcttttttattatgaaaagccaagcgtgattgtcggccgtaaccagaacacgctggaagagttgaatcaaaagtatgttgaagatcacaatatcgttgtgacacgtcggctttccggcggtggtgcagtgtatcacgatttgggtaatttatgtttttcatttgtggtcgatagtgactccgaagaatttggtgattttaagtccttcacgcagccgattgttgatgcgattcacacgctgggtgcgacaagtgccgaagtttcaggtcgcaatgacatgctggttgacgggaagaagttttccggcagcgcaatgtacacccgcaacggtaagacattttcgcatggcactttgatgctggatgtcgatatgagcgtcatccctaatgtgctcaacgttcctgaagataaaatcaagagtaaaggaattaaatccgttaagagtcgggttacaaacttgcggccttatctggataaaaaatatcagaatctgacggtgccggaattccgggatattttattgacccgtctgttcggtgttgacgatgtggccgccattaaagataaggaataccacgtgacgccagaagatgaagttgagattaaaaagatttatgacgatgtttataataactgggattgggtttacggtcatagcccagagttcaccactaagaaacgtaagcactttgattatgggacgatcgatgcgcggtttgacgtgaaagatggcaaaattgccaacgttaaattttacggtgatttcttcggcccacaggatgttagtgatgttgcagcagctttaaaagacaagccgtacacatctgaagcggttaagaaaactttagatgcaattgatacaaacgcttatttcaccaacatccctaaagaagacgtcattaatttattagttccttaagcattcagacttacttttctataaaaaggggcagccatttgtcggctgcccctttttgatcattcttgcaaacaatcaattatatttaacctggctaattgcatatgcctggattcgtttggctccccgcccagtttcaacggtaatgacgccgcgttcgttataaggcttaacggttgcagcctcgatatcaatgacgcgaccctttaagcgatggcgatcaattgtattgattgccacctcctgttgcgtgtgcaaagcatcttgaagcaagttggtaatttcttctgggcgttgtgccataagaattcctccttcatcttaatggttagcatgcgtccatccagctaacagcacggatcaaggaaagttgcgctgcgaatttccttgaaactggctcttgctgacagacgtattcggttggggatactgtcgcaatctgatttgcaatcggcgtcacttaaaacgcgcgattgaaaacgattacggttccagtataacgattctgcggaaaaatttcagtatccgcggctaagatcaacttggtgactggctaactgaccgcttgctatcaaggattggaggttatcattaaaaattttaaaaacctgatcacgcagatgtggtacggtgccggaaatgtgcggcgtcaataagacattgcccatgtcccaaagtggcgaatcttgcggtaacggttcaggatcaacgacatccaaggctgcggctcgtaactgctgggtctgaagtgcctgaaccaacgccggtgtatcgaccgaagcgccgcggccaatattaataaacagcggctgattttgaagcccggaaaagaattctgaattataaaaatgcttggtggcagaagttaatggcaatgcattaataaggatatcggcgttttgagcggctgtgtgtgcgttagcgtctgtaacgacttcctcaaaccctgcagcgggacggccgtgtgcactcacgccaagcgtatgcaggcccagtgcatgtaattttgtcgcaatcgttgagccgatatggccagtgccaaaaatgaccgcggtttggccttttaacaacgtcattggcggccgttgctgacggaaagtccacatctgacgaccggcgcgaaccggtggtagaatgccgcggctgatcgtaaataacacgccaaggacatattcagcaatcggttcggcatgaataccactcgtgtttgccaataatacctgatgtttagcaaagtcagccagcggtagatagtcgactccggcagaaatagcctgaacaaagcgcaggtgatcgaaattcacttgcgcagattgatcgtgccacccataaacaacgtcaatttgctgggcggttgcttgatctaattgattatcgtcaatcaccacgtgccctgctttttctaaggcttgtcgttgctcaggtttgagattaaaactatttaaaattttcaaggtgtgcctccttacttgttatgatgccagttaggcttaccccagtattggaaaagatcggttcgaatggtgccattgtacaactttcgccgtttggttgcttgactgccatatgctttttcaaatcccatatcactggtcaaaatgtacttgctccaagtcgtcaacggcgcaaaggcttggcccatttccttgtaaagttggcgcaccatggcctgatcgctaagtcgcttcccatatggcgggttggcaacaatgaccccgttttccttggtggtgctaaaatccttgactgctaattgcttaaagcgaatgctatgcagtaagcccgcttgttgcgcattcagcttagccatatcaatcatatcgccattaatgtcactagcctgaatatccagctcacggtcaaaatcggcggcgtccatcgcctgatccttggtggtttgcaagacggattgatcaaaaaagccgaaatcttcaaacgcaaagtgtcgttgtaatcccggtgccagatgatggccaatcaaagcggcttcaattgcaatcgtgccagatccggtcgtgggatcgacaaacggcatatcaggatgccagttcgtcaataagacaagcgctgcagcaaagttttccttcagtggcgcctcgccttttgcaatgcggtaaccacgtttgaacaaactaggtccggttgtatctagcgtcagggtcgcaacgtcttttagaatggagacttccagtggataagtagcgccggtttcgggcaatcgcgtggttcgatgatagactgcggacatcttttcgacaattgcctttttggtgatggcttgaacatcgggctcagaatgcagttgggaacgaacagctcgccctgcaaccgggaacgcagcgtctaacggcaaaaagtgatcccacggtaatgccttaacgccttcaaataaatcgtcgaaggtgcgcgctttaaactgaccgatgacaattttgatccgatcagcgctgcgcaaccagacattggtcaacgcaatcgtttggtcattaccctcaaaatagactttgccattttcggtgcgggtttgaatacccaatgccttcagttctttcgtggtaaccgactcaaggccagccgccattgttgcgacaagttgatagttcatagcatgagttcctttcaaaattgtgagacgagattagtcattcaaggttagtttaactttttatgtacgttatggcgattgttgaggggcataactttatcgttgcggttgaggttgagtttggatggtggtttaggcgtggatggtcagaaagtgttcgggctttggctagtggaagtgactgttggccgatgctgctcataaacgcgctcacaggcccagaaacctgcacctaaggaaaatggccaaagaaggtttgggcattggacagtgaaatagaagttggccgatgctgctcataaacgcgctccccagcgcagaagtctgcgtgtaaggaccttgagactaaatggccaaagaccagccatttagtctcaaggccacttacactccgacttctaaccgcgctggctcgcgctctcaaaaaaacagcccgggtttccccgggctgtgcctgcatgtagatccctataagccatgttttgttccagaacctgttcaggcgcgggttccttcagtcatcatctatctcagcgttgccgctgtattgccgttgcttcagtttgcttggcaaaacgcccctaccaaaagtttgggttactcgctcgcggggtttacccgttccaccgttcaggtttccctgaacgtttcgtcactgtggcacttttcagacctactgacgcataaccgaagtcttagcgtggttggccgccgtaaccgttctcacggtccctaagcttattgggcttagcacgaacactacaagcatcgcagcttgtgcgggcatggactttcctcagcctgcagatgcagaccgcgatcactcaggatctacatgtgatcattaatactggtcaacgtcggaatggttgctgtcgtcgcggttatcaacactgccgctatctgacagttttgaaccgaaaacatgccgttccaaattactcagacgtttaagaatatcataatttgttgccgcagcattggtttgcggtgtttgtgcgctgacattcttggaaacactcagctgtttggtcagctcatcgacccggctaaacagctttgcattttcttctttcaaccgatcaatttcattggtgaaagcctcatagtcacgaatgatgccgtctaagaattcatcgacttcatccggatcataaccacgaaccttgtttttgaacttcttgtccaaaatatctttaggcccgtactggatactaaattttgtttctttgttactatccattccgacacacctcattgttttcatggaaccagactactaattagcttaccatatctcaatcattttgaaaatgctcattttcagcttctgccaattcttcggatgtttcttgtaaatcatccatcgtaatcagtgttaccggataatcacgtcgattagccatgtcttcggcggcacggtaatcccactgcggttttccgggaaattccggatcatagacaatcactgccgcatctgtgtgtgccgtcataaaccgcgtataaccttgaagttgggcgggcttttgataaggtgcttgtgagactgcatcagagaaatcaacttgctggcgtaatgcagccagttgggccttattgttgtcattccactgactaccaaagtcggtaaatggcaacatcatcgcaatcttaaactcaggatagagcggtttaagtgttaaggcaacttcgatggaccactgttcaacccccagttgaccgcctgtaatcagccagttgagcccttcatcaagaaactgggtcagcgtgttttttaatgaagttttaaggactttcagttttggatcctgagccccaaaaacattgagctcataggcacggtaaccggttatccataacctttttcctgccatgatttccctccaatcattaggccaacgcgcttgatattggtataatagcgccaggagtgtgatcgcatgaccatccgttatcccaatggtaatccatacaaagatgggacgcaattttcaccagacgcagtgtcgcgccctaccatttatggcggacgcgggatgactttagaagaagaacttaacctcagcaatcagtattaccgtagtatcgacaaggccgttgtctataagaagccgacgccagtgcagattgtgaaggttgactatcctcgccgaagtcaggcagttatccgtgaagcctattttaagacgccttccacaactgattataatggtgtgtatcgcgggtattatcttgactttgaagccaaagaaaccaaaaataagaccagttttccgttaaaaaatttccaccagcatcagattgatcattttcggcgttgcttaaaacaaaacggtatctgttttgttgtgattcggtttgcaacgattaggcggctgtttgttttcccggcaggacggctcattacctgctgggatcagcaaagtacaggcggtcgtaaatcgattcctttaaccaagatcattcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaaggtaaacagtcaaaaagccctaaaccccccaagaaattatggcggcggattttaaaatggaccttgctcggcttgcttctcattttcattgccggtgtcgggttattctcctggtatgcaaaagatgcacctgaagtcacccaagcaaaactcgaatctggcggatccagtacgatttatgatcgtagcggtaatgagattacaacgcttggactggaaaatcgcgactatgtcaaagcttccgagattccgcaacaacttaaagatgcggttgtttcaatcgaggaccgccgcttttacgatgagaaattgggcattgatcctgtccgtattctcggtgctgcttttaacaacatgaccggaaccggtgatggcttgcaaggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatctgagtcttgcacaaacggctttcatcgccggcctgccgcaaagtccggctggctacgacccttatgagtacccgcaaaaagcgactcagcggcgtaatgcagtcattgatgccatgttacgcgataagaaaattacggccgctgccgccaagcaagctaaagccacaccgattactgatggtttacagccaaaacaacaacagacaaacacaaccaccaatgataaagtgattgattcctacttgacgcaggtgattgcagaagttaagaaaaaaaccggcttgaatccttacacggacaatctggatatttacaccaatattgacatgagtgcccaaaaacggctctacgatatcgtcaataccgatgattatgtcagtttcccggatgatgccttccagaccggcgtcacgatgacagatccggataacggacaggtcttggcgcaaattggcggccgtaaaaccggcgatgtgcggttggcatacaaccgggcagcgcaaaatacccgtagtaatggatcgacaatgaaaccactcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgaacagtcccgcaacattccagccgtcaaaaccttgagtgcagtcggtatgacgaatgccgtgaagttcttaaagggactgggtatcgacttacctgcctcagaacaatatctttccagtgcgatcggggcctcggtcaacacggttgaagaagccggagcgtatggggcctttgccaatggcggcacttattacaagccttattacgtcaataaagtcgttagcgccgatggcaacacccaaacatttaacagtcaaggaacccgggcgatgaagtccagtaccgcctatatgatcacggatatgctaaaaggcgtgttgacaaaagggacaggaacctcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccatttcccagaagatctataaggcactgatgagttatacctcccagaaccttgataataaggattggacaaagccggatacagttgagtcttacaatattctaaaaggcagcaatcccggcacagcgattacgagtggctcagccaacaccacgaaggagttgtacgttcgtggtcatgggccaagtagtcataaagcagtggccgaatcatcatcctcttccagtgccagctctgaatccagttcctcaaaagaatccagctcagaaagttccaatgctgtttccgctagcgttgcgtcatctgcttcatcctccaatgtttcttctgctgcccctagttctgcaacaccttcaaaagaagaaccgagcgccagcagtgaacctgcttcatctgctggcggtcctggtggtaatcaataagattttttcacgtgatttgaccatcaagagttttccctgatgaggattgccggacatcattaaaaaagcaccgctactgatttgagatggtcagtagcggtgctttttatatgtgaaactaagcttgctgttctagatgaaccacggccacatggtgctgtgccaataacgtttcgccatacggatcattgcgatagtcatgcgcatacacgacacgcttaattccagcctggatcaaggccttcgtacaattcagacatgggaaaaagttaacgtagacggttgcgccatgggtactgaccccattagccgcacattgaatgatggcattcatttcggcatgtatggtccgaatgcaatgaccatcgcgcattaaatgaccggcctcatcacaatgcggatcaccactaatcgcgccgttataacccgtcgcaatgatccgatgttcctgaaccaaaaccgcccccaccgttgcgcgctcacaagttgaacgttctgaaacctttttggcgagttcaagaaaataatgatcccagctttcacggtgaaccgtacgcttggatggcataatggtatctgtcaatgttcttccccctttaatggcgcgtaatgggtagccagaaacgtccattccggtccggatggtggctgtgggtcacgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactgacatgggtatcaaccgccacgcccggtatgccaaaagcatcgctgaggaccacagtggcggttttcttaccaacccctggcaatttgaccaagtcagctgcattggctggcacctgaccatcatatttttcaactaaaatagcactcaacgcttttaaatgcgccgctttagttcgatataaaccaagacgactgatttttttggaaatatcagtgactgaagcagcagccattgccgcgggcgttggatacgcggcaaatagttcgggcgtaaccgcattaacggctacatccgttgtttgcgccgaaagcatcactgccactagaatctgaaaaggattttgcgcttgtaatgtcggctgtgggtcaggatacaacgccataatttgctcgaacaattgccgggcttctgaatcagtcacacaggttcccccttttaaaatcggcttgattgtgattccggtactgcctaatagctaaagttcttgatggcgcttgagttcggcttgaacctgttgcgcggttttaagatgccgccgttcccaattcagcaaaatgcgatccatgtacttcagtgaatacgcggcattcaaaacggcttcgcgcaacgccaataagatcacttctggcaagtagtgatccgtcgtcagccagtcgcgaattgtttcctgttcaattggtgaaagtggtcggccaaattcaatttcaatttgattaaagacattcgtttgcgcatcggcatttggttgggacatcacactgctatgggctttttggtttgctgggagtttcgccagcaacggcgcgagatcataatggtcgcgcattttaccctgaccatccggaatgctttcaagaacaatcgcctgtttttgaatcaacgtttcaattgctgtatagattgcattgggtgcgacgttcatgcgcgctgccaatgccttaagatcaggggcttgatgatgcttggattgccactgatcaatgaacagatacgttataaactcggtttgggtcagtcctaacgtaggatagttatcaaacagcagattagagacattaaactgccccgcttcgatataccgttttaaatcagtcatgatagggatcctccaaaaaaagccggcgcgttggcgtccgacttttggttgccattacggctttaggcgattgatcattcgtgggaatggaatggcttcgcgcagatgatccagcttgcagatccaggtaatggcgcgttcaaggcccaaaccaaatccggaatgcggtactgaaccgtacttgcgtaaatccagataccattcgtattcatctaaatcaaggccggccttttcaatggcagctttgagcttgtcataatcggtttcacgttccgaaccgccgatgatttcgccgtaaccttctggtgctagcatatcggcgcagacatattgctgctcatcttccgggtccgttagcatgtagaacggtttgatggctttaggataattcaacacaaagactggttgatcaaattgatctgacagatacgtttcttccggcgagccaaaatcatcaccgtatttgacgtccatccctgctgcctgcaacatttcgattgcttttttgtagctgatgcgtggatatggcagcttcgtatactgtttgagcacttccggatcgcggcctagcaaatgtaacggataggcgcagttatccaataccgcctgcaccatataggcaacataacgctcctgaacctttaaactctcttcctgatgacaaaacgccatttccggttcgatcatccaaaactcggtcaaatgccggcgggtcttacttttttctgcgcgaaataccggcccgcacgtgaagactttaccataggccattgcccctgcttcagcatacaactgaccggattggctaagataagctttcttatcaaaatagtcagtttcaaaaagttcagttgtgccttcaggtgccgaatcggtcaaaatcggcgggtccatcttgataaagccttcattgttaaagaattcaaacgtggcgcgaatcatttcgttacgaatttgttgaatcgcaaattggcgctttgatcgtaaccaaagatggcggtgatcgagcaggaactcaatgccatgctctttaggcgtaatcggatagtcgtgtgaatccccgacaagctcaatgttgcggacttcgatttcgtagccaaaatgactgcggctatcttggtgaatgacgccggtgatccacatgctggactcttgacgtaattcctttgccagctgaaagacctcatctggcacgtcggctttagaaacgacgccttggaaatacgcggaaccatcgcgtaattgtagaaaggcaatctttccggagctgcgtttatcggttaaccacgccccaattgttacttcctcgttcacatgttcttttgcatcaataatgcgaatcttttccgtcatgcgttaactccccacttcaataattatttaccaacaaactcccggatacgccgggcggcctctttcagactggccaaatctttacaataactaatccgcgcatggtccggcatgccaaacgcccgtccaggaacaatggcaaccccggtttcagtcaacagtgcactgataaagtcatcaaccgtaccataatgactcaattgagcggcacgcttaatattcgggaaaaggtagaaggcgccttgcggtttatctcccatatcgaaaccgggaatatctgccagaagatcatagaaaagattcagccgttcttcaaaggcacggcgcatcttttcaacaacctgctgatcgccagttaaagctgccaccgcggcgtattcggaaactgctgccggattagaggtcgtgtggctaataaaggtcgccatggcctgaatcagcttttccggaccggccgcataaccaatccgccaacccgtcatcgcatatgacttggagacgccggaaattaaaacagtattcgctgcgatatcgggatcgatactaatcattgaggtgtaagtcgtaccgttataaatcagatcccggtaaatatcgtcagtcactaccaaaatatgatgcttcagcgcccaattgccaattaaggtcagttccgtgcgatcatagacaacgccgcttggattttgtggcgaattgataatcaatgcccgggttttatcggtccgagccgcttcaagatcatcgacactgactttatgtccgactgctggcatgaccagatgtggcacgccactcgccaatttaatctgttcctcgtaggaaacccagtatgggacaggaatcagcacctcatctcccgggtttaagaaaacctgaaataaggcatacaaagcaaacttagcgccggtggttgcaacgatttgacgatgatcataacgaataccgtcttgggcaaatatccggtcactaatcgcctgctttaattccggaataccggttgctgccgtatagaaactggcattaccagcctgaatcgccgcaatagctgcgtcatcaatcgccttaggggttgaaaaatctggttggccaatagacaaatcaatgacatcggcaccttttgcctttaagtctttcgtctgattacttaaggccaatgtcgctgacggtgcgacgttgaggattctttttgctaaatgcacgactgcgcctcctacagcttcggcaccattgcggctaccgaatcatttttaattataaatttttgatcgcgttcaattgttcgccgctgcgaaaactgtacgtcacgtagttcagtttaccagactttgacagatagccaatatcccagacaaattccgatcctcttttacccagtgatgcattcagaattttcttgggagcgctggtttgggtcacctgttgaatggctttttgccgggtaattccggacttttggtttaaaatcgttaccttacctgtctttttctgaatcacaacgtaaactgactgattcttcttggtttgaccggcaacggtgagataactcttatcacggttgtaccaccagaagccgttcacggtttttaaatcagcccgattggtagcaattttttccgcttggtcgcgcaattgttggtaaggtgacagactcttggcataaattccgatggcagcgatgatgagaacaatcaggccaccgataaataagaatttgacccagtcgaatcgacgatgatgacgcatctgtgctcccctccttttgttgggtatggttggttgagaattaggtgatgattaagccaatgctgttcgtaagcgcgctcacaggcctagaaacctgcgcgtaaggaccttgattccaaatggccaaggtgtagttagctcgtgcaactttttggttaatgaaatagtgttggccgaagctgttcgtaaacgcgctcacaggcccagaaacctgcgcataaggacctcaaacccaaatggccaaggtgtggtcagctcggcaactttttggttagtgaaatggtgttggccgatacctttcgtaaacgcgctcacaggcccagaaacctgcacataaggaccttgattccaaatggccaaagcccggccatttggaatcaaggccacttatgttccggtttctaaacgggcctgttcgcgctcttgtttcttaaccacattctaatgtaacccggaatatcggtgagtggcaatgtcattggtttaatatttggtaaggatttttgcattttcttaccatacgcggtggtgatgaagcgtggatcgaggatgatgaaggcgccgcggtcggtttcggtgcggatgaggcggccgaagctttgacgcagccgcaagatcgcacgcggtagggcatcttctgtgaacggatcgccgccgcttaattgaatctgacggtatcgggctttggtgatcggcgcttcaggcgcatcaaagggcaaccgcgttagaatgacgatttcaagcagtcgatcgggataatcaatgccttcaaaaaagcttgctgcccctaatagtaaactctggtcgccaactgcaaaccgtttggcaattttttccgctgaaccggtgaccccttgagccaatagctctttatgcccggcaattggtcgatggatcaaacgttggtagacggcctcaatgacggataaagaattaaataagacaatcgtttgatattgattatccgccagttgttcaatggccatcgctaaataatcagcgtaggcatcatccgagacgtctgcggcatgaggagcatctgttgccactaaaaccttggcctgatcgcgataatgaaatggactgcggagttttaagaagctggattccggtaatttgtgatagcctaattgggcagttagaaaatcaaatgaacgctcagccgtcaaggtggcaccgacgaatactggcgcttcaaaatgatgaatcagttgctgaacggcagatccgacttggaaaacatcccaacttaattccagactcgccacatcggtaatctggcgtaaattaacggacatcatcaccgcctgcccggcaattaaatccggcaaccggcttagtaactcttgaagaagccggcgatgatctgccaaggcgattcgcagcgctgctaacgcttgaaactgctgaccatcgctttttaagaagaaatgcggtcggcggttaaaatcagcaattaatttgtcagttgtgaccgtcaaccgcccgagaaccttaatgagcgatttgatggtggtcgtttgtgtctgttcgagccacttggccgctgctgaatccaaacttaagttcacaaaacctgaagctgcagttgttttgccaaaaaagaagtggcgatggatctgacgctgcaaggtattcacagccgtctcggcagtggctgcctgttgattcagttgctgtaacaccgttagcatggcaggttcactttgataaatcgcagtcaaagaatgccgttcgtctggttcactcaattgccatacacgatgcaaatgatgatttaagtggtcaagcgccacccgccgtgcaaacgcggcagcagtattgtcggcaaagtgctgcgcctcatcgaccactagaaatggccgtttaaatggtaacgtgtctgcatgccgtgaaagaaacgcgtggtttgttaccaccaccactgcgtcagccaatttagcctgcagccgccgataaaaatcgaacgtataaaaaggattgataaatggcgtgccaacatcaccggtatgccggatttcagcaaacaacggcgcgcgataagtggttaaatgcagctcatctaaatctcctgtcgttgtttgagtcagccataccagtaatttcatttgcaacagttgggtttggcgagtcggtccttcttggtgaagactagcggcaaatttattgagatcaagataatgctggggacttttcagctcaaccgtgggtaacgtgcgcccaagcaaggcatcaagtgcgggaatggcttgcgttatcagctgcgtttgcaaaaccagggttgacgttgccacaaccaacttgtgctcaggtgtggcaaggtaagcataaggcagtaaatagcccaacgtctttcccaagccagtccctgcttcgatgaataatggtatttcggttttttgcgcatgcgtgaaaatggcatccatcatcttggcctgtgctttacgaaagcgatagcgcggctgtagcagatgttttttggctagttcggttgctggataagcgccagccgctgccaaatcggttggtgtagtcatcggccgacgtaacaccaatggcccgacctgaacaaattctttttttaacggtctgggaggtgacgcgatcattttcagataatcaccggtttcgcgaataaagccatcgtgacgctgaatcaaggcctgttgcgttggtgtcggtaaggcctgaaagcgcgcctttagttgcaacagtagtttcgcggtactggtagcgtcactatcggcttgatgcgggttgtcatgttggatcgcaaaatgagtcgtcaaatcactgagtcgaaaactgctgatttctggaagtaacacctgtgccaactcaacagtatcaatcgcctcaagctgtaattttggtaaaccgatacgctcaaactctgcatttagaaacggataatcaaaattaacattgtgcgccacaaagaccgtcttagttagcacttggtgaagcgcgggcgctacctcatcaaaatatggcgccgcgactaaccgttcagggctgattccggtcaaccgctggatcgtctgcgggactgaccgatccgggttgatcatttgtgaaattgtttgaatgatcttgccatggcgcaccaaagcacaaccgaattgaatcatacggtcgccgtctttgacactggttccggttgtttccaaatcaaccacagcaaaagtggtgtcagcattcatgaacttttaaccattcctgtctaaacatactgcatctatcatactatttccctgttgactctgctactaaatccacaatcgttcctgtccgtaacaagaccagataacgatgggtaaccggctcgggttgaagttgcgccagggcctgagcgtataagttcagttggccacgataacgcgcgactaactttgccggatcgggctcgtgatcggttttgtagtcaaacaacgtgacaccatcggcctcagtcacataaccgtccataatcccgtgaaccaaaacatcctcgccggggtcattttgtaaaatctcaaacaactgattggcaggcaacaacatggaaaacggcacttcccgttgcacctgttgcggcttagcttgcaataactgccctagatcggttgcaaaaaagcgcaccaaagcagttaggtcaatccgcttggcaacctctgccggcatgaccccggtggttatcaagtggtggcgcaaggcttctagactgttcagcgtaatcggtttggtcaggtcaaccaattggagcaataaatgcgtcgccgttccaatcgcagcggcattcccaccaccggaagtttcggtcaaaaatgctggggcacttaaatcgtgtagcggcggtttttgccctaaaaatcggtcggcacttacaagttccatcgtatccggatcgtcaaaagcccgcttgatttccgaaacactttgaaagcctgccgttgtcgtggcagcttggaatggatactgtttggcaaaccatcctgtcagatcaatcgcaggtgcatctgttttggctggcgttttggtcgccactccgactttaatttgcggatgagtctcgattgcaatggaaaactcggttggatcagctatcaaggccggtttgacggtggtttcagtcagtcctttgacttgcggatgacgaatgagggccggtccgatccaatccagataattcgttgccgccccgcgaatttgcggtgcaagtgtgagctgttcaccttccgcggctttggcccacttggcgaccgttttgtcagccgaagttaattgctgcccgctcatggttgcgccaacaacatagaggcgttgctgggcacgcgtcaacgccacatacaaaagacgcatttcttcagccaatgtttgattttgtcgagcggctttggcggcttggtattgcggtaactcatattccacccgggtttgcgggtcgagccacttaataccgatcccatttttagttaaaattgccggtccgctttgatcgcgacggttaaagtgtttgttcgtttgtaagacaaaaacaacggggaactcaagccctttactcttgtgaatcgtcatcaatttgacggcatcattatccggatcaacctgagccggtgtggcaaggtcctgatcctgcttttgcatcaaggtaatgaaatgaatgaaggcaaacaaacctttaaagccgccagattcataagtccgagcacgatcaaccaaggcaagtaaatttgcctggcgttgactgccgccaggggtgccgccaacataatcgagaaagccggtttcctgataaatggcccacagtaatgtcactagatcattttcccgggccagatcgcgaaaatgattgagttggtccaagaacgcggccaaagtagcgtgggtgcgtttagccagcggcgttgtcggtgttccggtgagaaaagcggtcaccgcgtcataataaggtacttgtttggctgccaatcgaatcaaggctaactgatcagctgagaggccgacaatcggcgagcgcaaaaccgcaactaacggaatatcttgcttaggattatcgatgattttgaggagtgccagcatcaccatcaattccgtcgtcttgaagaaattcttggtatcagccacgaataatggtacgccggctgcagcaaattgggtttgaatgaggctgttttgggtggtttggcgtgttaaaagcgtaatatcacgataccggatacgccgatattgctggttggcgcgatcccataattgtgcatgggggtccgaaactaaccgctggatctcggcaatgaccatttgcgtttgaccggtcgcaacatccagcggctcgtcatcttcatcggttgcagaccagtccgaagtcgcgtcggtttcgtcatcatcgtccgaagtcgctttgctatacagcatgactttgaccgctgggtggcaatcgccataatcaagcgcaccatactttaacgcagcattgtcgtcataagccaaatcgccgacttcaggatccataatctggctaaaaataagattggtgaacgccaaaacatttttagtcgagcgaaaattttctgccaaaataatccgttcaggtgcggtgggtgtttccggatgattggcaaacgcctgatatttttgaatgaataactgcgggtcagctaagcgaaatccatagatactttgcttcacatccccgaccataaagcgatcgccggggtcggttgtgctgacggctgccagtaacgcttcttgtaaggggctaatgtcttgatactcgtcgaccatcacctcatcgaaactggcgcgataattgtcagcaatcggtgcgccggtttggggatctttttgctgcaggattcgcagtgcgttatgcgcaatatcgctatagtcttgcacatgccgaaccgccttttctgcggtcagcgcatctaaaaaggttaaggccacctccgtcagcatggtcatcatcggttgcaccgtgcgcagtaagtcggtgatttgctcactcgttaaggcaaaatccggtgccaactgatcctgccatatttttttagcggcatcccgcagttgtttagcctcatttttgagtgctttgtcgtcgtcatcaagacctttgctggcgcgagaccacgccaagaagtcatgctgaactaaggcgtcgcgaaccgcttcatagctcggctcagggttgtctaataaactttgtaacgggttcaaatcggccgtgatttgttgatgccagactggatttggcaagcggttggccagctcatccgcttgcgtcagcgtggtaaatacttgcatgagtttgcgcttggttcgcggccaaatctggtgcgtgaaggtcgccgcccaagcttctggtgcataaggctttgccagttgttgcaagtaagctttaggatcggttgtggcagcagcttggcgcattaactcgaacattaaatcctgaaggccactatcatcccgatcgccgctaaagttagcggtcaattgctcgaattccgccgcttcgtcaccagcataaaattgttcgcgcaaatcgttccaaacctgttcttgtaacatatagcgctcagtttcatcagtcagtaatcgaaagcctggatctaaatcgataacatagtaataagtttggacgatttgcaagctaaacgcatccaacgtactgattttggctgcattcaccatggcaatctggttggccagatggcgccgatcctcagcatttaactcatgtcgcttggcggtcagtgtttgcttcaaggcagtctgaatcttagtccgcatttccgaagttgccgctcgcgtaaaagtcacgatcaacattctggtaatatcggcgtgttgtttgagaatcttttgaataatgcgttcaactaatacagtggtcttgccgctgccagccgaggctgataccaacatatcatggccgtgatggctaatggcagcttgttgcgatggggtaaattgcgtcatgactgtggatgctccttttcagaatgcggtatttgtgtcgggtcagcggtaaggcgtccgatcacgtctttacgctttaacttagggacgtgatggtaatgatcaaaaccggttgcagggtcaaacagcataatactttgatagtcgctgcgactgacaatcgtggaagactggccatattggaaaggctcaagtgcaatatccccagcgagaatttgcgtggctgcatcgataatcagcgcctgattgtgagccaaataagcccgcaacgcctcgggagtcaggacgtttgactgattttgattgaaactgccatcttttttaaagccaagcggtgcaatctcactacgaccgccactttccggtgaaatggtacgatccacggccgccagctcatctccgtgttcggcgactaagaaccccagatacttgaaggctttgagtcgctcaagtgccggttccaattcaggcgtgtatttgagtttaggatcctgcaagtgaaaatacagcgcccccgccggaacaaacggtggctctgctgtcacgttggtcattgcttcaatgtaagtcagcatttgcaaggcaatgccataataagcgtcactatcatcgaagcggcgttgcccacttttataatcgacaataataaaacgccgggcatcaggttcgcgataaatatcaagccgatcgattttaccgtgaacattgacgcgacccccatgcggcaacggccatgataagcctggcagtcccttggtatcgccaatccggccaaactgcagctcggtgcgcaccgggcggaagccgctgcgttgctgttgctggcgcatgttgagcaaaacctgaatgagcagtcgacttaagcgcttggtcaaataagtcatgcgatacgtactgccgaggatttcataccccggctgtttggcaatctcggcaaccattggcggtacggcagccatgatcgccgcgggttcaacatcggccaagttttgttgttgatcacgcaattgcgttaaataccgatcaagtacagcatgaaaaagactaccggtgtcggctggtgaaagctcaaattccggtcgcggttggagcagcaaaccatatttaaggaaatattcgaaatgattaagataatacgtctccaatcgcgacacggaaacattcatatcgcggccatagagttgcaccgccagctgtggatcaaggcggccaggatcattttgatacgtcaaacttccggcaaggcgttgggccaggttggctaaatcggtttgtttcaatgcgcttaacacactttgccaagccagactcaggggttgtttttgctgttgggcatcaccggcagcccgaatgaagtcgcttaacattgcccgcgggctgccaaggacagatttgaccgttgtcgcgagtgttaccggcgcccaggtttcgggcacgagatgaagcgcccgtttcagttgctgaaaataaggtgacgcctgattttcactattttcttgcgggttttgcatggggtaacttagcgtcaacgtctcgctggcggccatgaagcccaaatagttgataaacggatcacctaaagttgttgttggaccttgctcgggtaaaaagcggtcatccggcaactgtgcagctaataattggcgctcttcactgtttaaaacgccgtcatcattgggaacatccggcatggcggtgctggtggccccgataacaaaaacatgttttgctttggctaatcggactaacccggtttctgaaatcacaaccgcgtcaagtgtggccggaatctgtgtgtaagtcgcactggcaaagccggcagcaagcaactcatgaaattgctcgcgattaaacttagcgttgcccaaaatggtaacgtaatcatccagcaaagcggtaaatgtggtccatgcttgttcgtgcgctcgactgcgagcaagctcaccggctgcacttgctgcttctcgccacgcgttcaactggtccactaccccaattttcgttaaccagtggtacaaacttcgcgcagcctcaagtccggttttagctgcctgccattgtttgagtaaggccggcacagtttgagccaccagcgtttttatggcattgatttgagcggttttatcggcttcaggatccatttctgtctcatcagcagcgggattacgctgaaaataccgccatggttctgtctgtgtccagcgtcttttacctgcaatccctgttcgaaccaaatgattgtcgagggtatcgacggcatcacgaaaatctgccaccgccatcccctgaggcaacaaaagctcagtatgcaacaagcgcatgatgtcttgatactgatagtcatgatcctggatggcaaataggctttcgattaacaccaccaagggatgatccttcatcggccgctgcaagtcggtaaattgtggaatctgaaattcagcaaaaatagccggaatgatcgttgcgtacggatctaatcgccgagcaataatcacaaaatcccgataacgtgctccgttgcgaaccgcttgatagatagattgggccacatgccgcaattcctgatagggatcagtcgcagtggctaaatgcacatgatcggcaacatttgcggttggcgccggctgcggttcgatattggtattagcctgccaccaactcgccacctgtcgcatgcccaagcttaagtgccgtggctgagcaaaccgatccaaccgaattggaattcgcatcgttttggctttttgatacaaacgatgataaagccgaccagcaggtaaaaagagattaggagccacaggcggtgcagttggataaggccgatccaacacgaggccgatcgtcacttctgcggcggtttccagcatcgtttccaccagtgctgactctgaagcagaaaatacgttaaaatggttgagatagataaacgtgtgggtgagatcatgggtacgcatggcttgctgcagcccacttagcagactggcggttgtcgcataaggaccgatttctgcttcatattgatcaagaataatgcctaaatcacgcaacttagcccggtgccgatcgcctggtgtcagagccgcaacggtattggctaagtcttcggcggtaatccggccaatcatgagttcactcaattggccagcaagctgtgtgacaaacccagtgtgctgagcttctccggcataaatggttaagtccgcttgccgttctgcaagaattttggcaaccagcatcgtattgctagcttgatccagccgtggttgctgataaagcggcgtgttcttcaaataaaaccaggccagccgggaaaaggataagacctgaacgcgactttgcacgtaagtctccgagttcccctgttgcaattggcgcaagcgtttgagaagatcaatttctgcttcaaatttaatatggttcggtaccagtaaaaaaatccggttttgggaatcagcggtaagcttttcatgaatcatagccgccatggtttgggtatgatccgtcgttgcatcaccgagaataaactgcaaccccatgtgaaaacctcctaaggaaagtgagcgtgagccggcgcggttagaagtcggagtgtaagcggcctcagacgtgatggcccggatttggccattgcggctgaggtccttacacgcagacttctgcgccggggagcgcgttatagaaaagtgagcgcgagccggcgcggttagggatcggagtataagcggccttgggcgtgatggccgggctttggccattgcgaccaaggtccttgtacgcagatccctgcgctggggaacgcgttatagagtgagcgcgaaccagcccggttaaaacctaccccaacccgcatgttgcgatgtgagaaaaccactagcacagcagccccagtacaaagacgaccttaattttaatcgtcattctcttaaaccgcctacttaaaggctaccgcaccaacaaaaacagtctcactatttaaatacgtgtgcctgatgacttatgctttagtctagcataactaagtagtgtccgatcagggtttgcgctatcataagtaaagaatattaacgaggtgtttatatgaaaatcgggacggggaaaagttacgcaaaaattattctcattggcgagcacgccgttgtttatggggaaccggccatcgctttgccagtcaaaagtattcgattattagctaaagtcgagccaatacctgatggccggcaggaagtcacgtccgccttttttaccggcgatttgaatgcgggtcagttaaccaattttgccggcattgccatgctcattcgccagctgctcgtgttcttcaatgctgctgatcaaggctttcatctgaccattaccagtgctttgccatcagaacggggcatgggatcatccgcagcgactgcagtagccgttgtgcgcgccttttacgatgcgtttcaaacgtcgctcagccattcggttttgctaaactgggccgggatctcggaaaaagctttgcacggcaaccccagcggcttggatgcggctacggctagcgctgaaaagccgcagtggtttgtccgcggcaagtcgttacgatccatcatgatgccgcgcaatggcgttttactgattgccgacactgggatcgccggtcagacgaagattgcggttgatcaagtggctcagaaattaaaaaaggacccgaaaacgtatcagccactgatcaccgacattggtgatgcggtgcgtcaggcggctttggcactggcacaagatgacattatcaccctaggacaactcttaaatcgagatcaagcggacttggcggctcttggcgttagcagtcccgagcttgatcgactgattaatgttgcccttgataacggcgcatatggggcgaaactgaccggttccggcatgggcggctgcatgattgcccttgccgccgcggatcaggcgccgacaattatccaggcactaaaggcagccaatgccgttaaagtctgggaataccactttgaaacgaaatgaggctgctatgacaacttatgcacgtgcgcacactaacattgcattgatcaaatattggggcaaagcaaataagcaactgatgctgccggcaaccagcagtatttcgcttaccttgaatgacttttacacggacacggcggtaacttttgaccctgcactcgatcaggatcaattcacgttaaatcaccaaatgcagtcgcctactgctgtcagccgctttttggatcatgttcggcacctggcccaaattgatacacgcgctcgggtcaactcgttgaatcatgtaccgactgctgccggtttggccagttcggcttctgcgtttgcggcactggcactggctacaagtcgcgcggctggcctaaatttaacccctaccgctttgtcacggttggcacgtcgcggctcagggtcggccacccgttcaatctttggcggagcggtaatttggcaccgtggcagcgatgatcaatcctcgtttgccgaacccttaaccattcagccaactctgccgctgcggatgttggtcgtcacggtttccgatcagaaaaaggcagtcagctcccgcaccggcatggccaacacggttgcgaccagcccttattaccaggcatgggtacaatcgaatgaagcgttaatttcacctatgatcacggcattggccgaaaatgatctgacgacgattggtgcactcaccgaattatcgagtatgcgcatgcacgctgccattatggctgaggagccgccgttcacctactttttgccggaaactttacgcgcctggcaattggtgcaagaacaacgggcactcggcattccggcgtttgccacgatggatgccggacccaacgtcaagatcctcacaaccgcaccgtacgtggatgttctcatgaccgccttgcagcctgtttttggcgaccggattttgagcacccgcctcggcccggacgcgcaagtgattacaaaggagcaatttaatgacacagagtcagcaatcacatcgcaaggatgagcacgtctttttagcggaaaaatattttcaggcgactgcgcatgccggcttcgatcaagttcggctactacaccgggcacttccggaatcctcattagcagatgttgacttgacgcctcccattccttttggctggcgttggccgatttacattaatgcgatgacaggaggttccccgcaaaccggcaagctcaatgctcagctagggcaattagctcaggcgcttgatctggcaattgctagcggctctcaatccgtggccttacatgatccccaattggcccctacttttaaaacgctgcgtgatcataatccggatggttttattcttgccaatatcggtgccggacacgatcagcacgcagctgaaaaggcaattagtatgttagacgcggatgcacttgaaattcacgtcaatgcggcacaagaagtgatcatgccagaaggtgatcgcgactttttgtggcaggaaaatatccgtaccattgcagcaactgcttcggttccggttgtggttaaggaagtaggtaacggcttcatccgcgaagatctgcaaaccttgcagcaactaggcattcattatgtcgatatcggcgggcgcggcggcacgaactttgcggtcatcgaaaatgctcgccgcccccaccacgacttttcctacctgcaggattggggacaaacaaccgttgagtcactgcttgaagcccgcggactaccgttaacaatcctggcaaccggtggcattcgatcgccgctggatgtcattaaggcacaacgcttgggggcgcatgcggtgggcatcagtggactggtgctgcaccacttgattcaaactgactatgcggctacattagcctactttcaggaattcctgcaacaattacggcaactgtatgcattgctaggcgtgaccaactggcaagcactgcaaacggcaccggctgtgctcagtcctgaattagaacattatcgccatgtccgtcacttgccagcaatttgattttaggtcaataacaaaaggatgctagtaaacagacaatacctagcctgtcactaacatcctttttgattactttttaagatgctgatactaaattgcaagccaactaaactcgcagcccttttggatagaaattcttaaccgttccattgactaacttgccgattgcaaacggcttatgttcaaacgtgagtaagacgaatcgtttccctgacagcgaggtcgtgagcgtttcgccatgacggtagcgcgcataaccatcggcatccacctcaatcacggtttgaaaatcagccggatccagcgcagttgcgatactgtggctgggttcaaacctgtttttacggaaactcccaagttcaagccccgcgcgaaccaccttcactcggtcaaacggaatcatggttttcgggagtaacgacaggaagtccccgtggcggtaaaattgtccggtcaacggcttatgcaagctggtcgagaaaaaagtggtcacttcatcccgcgcggctttcactaaaggttttatctttagcggttttactggttcgttcggcaattcacccgcaagtcgcagtttggcaacgaaatggccttcaccgcgtacgagatgtggaaacagccgcactgtttttgccaattcaggattgccatctgcccattccggtcgaccagcaaccattcctggagactttttaatgggttcgagcgtcaaatcgtagtgagcaagcagccaagcaatgatttgttcgtcttcttccggactgaacgtgcaggttgaataaatcaaacttccgcctggccgcagcattttaatcgccgcttgcagaatgactttttgtcttgccgcacattctgctgggtagtcgcggtgccaatactgaattgcatctggatctttgcgaaacatcccctcaccggagcaaggcgcatcgaccaaaatccgatcgaatgtctgcggccaggctgcggctaacgtatccggatcattattggtcactaaaatattccgactcccccaacgttcgagattaccggaaaggaccttcgaccgcggcccgtttatttcattgctgaccagtaacccggtttcaccaagataactagccaattgcgtggatttaccaccaggagcggcacataaatccaacacgcgctcccctttttgcggtgccgcgactgtcccgacaaattgcgcactgggttcttggctataaaccagcccggaaacgtgatcaattccgtttccggcaactttgccataatacccccaaggactccaaggaatgggatccgtggtcttttcgtctaatggccaaggtttagccggatcgcgccggaatcccgccattggttcgtcatcaaaactagccaaaaaagccgaggcgtccgctcctaataactgggtatatttttctttaaacgcttcaggaagttgcacttgttcgatcctttctccgaatcaaatatcgcaggaaaacaacggtcgcaatcgttaaaataattaagaaaccccagatgctggcgcgggtcgtatagtaaaaccaccaattggcaaacaaaccgccaagcagcaaactgatgccgacgtggctggcacagctcgacaagacgccgcgcaaataccgcgcacgcatgttgatttctagtcccgatgtctgcaagggtccgatgagcaccaccattaggacgctcagcaaacctgcccctaacaataaaagcacacagaataaagctgtctggccgtatgcgcgccaccaggttgcggcattgctatcactgaaatgaacccgatgaactttattggcgcgcagaatgcttttaagcgcttttccatgctgatttgcaccgtctacatagacttttacctgcttgaggcgtaatccaccgtttgcggtattgggtgacgcattaagaaataccgccttgttcagcggactacccttacgcgtgcccacagttcccaacactggaacatattgatcattcacgctcaaataacgctgattattgctgccagtgtagagtttatccgctaagtcgtgaccgacaaccgtaaccggtaaacttgattcaaaatcgccattcgaaaaccattgaccagtttcaaccggcaagctcgcaaccgttccacgctgatacacgtagaccacttgcttactcacaaactgcacctgataccccgaaaagtcagtctttgccagctccgcaaccgcagtcgtcacccgccgctgactcttcgtcacatattcctgggcagtctcagacataccaagatgatccagctgactggcatattcattttgatcatgctgcgaccacaccaaaccagccaaaattgccaagccgatccatagtaagtcgattaagaatagtttcttcacagtggcctccttaggaaaagtgagcgcgagccggcgcggttagaagtcggagtgtaagtggccacagacgtgatggctggtctttggccattgcggctgtggtccttacacgcagacttctgcgccggggagcgcgttatggtgagcgcgagccggcgcgttatagaaaagtgagcccacacactaaagccaactccgcccatcactgcaaccgatacacccgttcatgaattgcatcaaaatgacccaatgcgcgattcaatgcaaagattcggcgatcaggtaccatcatcgcctcctgccaaaataaccggctattggtcgcaccatagcgctcgccaatcacaaacaattgcttatcaggaaagtatcgttgcatgatatgtaaaaaccgcacatcattggggtctttatctgggctccatgccatgaccaccgcatcaacttgtgccgcatataaaaataaagctgcattggcggtagcggttttcactggcactaatggttggcggccggtgacattttccgcaacccatgtatgagcatcggtggtaatagtcggatttccttgatcacgtaatcctgcactgacatagccattgcccgctgcgacttccagataacgttgacggccatacaactgttgccacgtcgcgaaaaaatctttatgcacaaacgaccacataccatcatgaaacgcaatgtaccgcctaaaattgtgaagcagatgatccaacgccatcaaatcggccaatttggctcccggcagtaacaatgcctgttcaatttgaggggtggttaaccccagccacggcaaggcatgttgcggtaattgctggttggcaagcgcaagccgccacgctgtcatggctgcgatttgtttttttaacggtgaaattgcctgatatttttcagccagttgtaagagtcgtgtccagtaagccatcctaacctcatattctaaatactggcagctacttagctaacccttttttcgcgcaaaagaacaggcaaaagccgccatgaacggcggcttttgcaacaggggcaacaacctcgtactaatgaatgcccagtgccatcttagcataccgactaagacgttccgggccccacgctgggtaccagacaaggtgaatctcaacgctttggatcccgtcaatcgccgttaacgcctgcttgatatcggcatcaagcatatcggtcaacgggcaacccatggtggtaagggtcatttcaaccgtacatttaccattttcatccaagtccaccccatagatgaggccaaggttaatcagatcgatccccaactccggatcaatcacggtttccaatgcatccaggatctgctgtttcattttatcaaaataggcctggtcttgggtggcggcttgatcatgcgtatttgccatcagcagtcccttcctttctgaacatcttcaggattatttcttgtcttcttcaagcacaccggcaactgaataatggttcttggccatttcattcaggacaatatggacatgctcagccggcgctccggtgtccttaacaatggcggcggtaacatctttgaccagtgctttaagctgctccggcgaccggccttcaatcaaatcaatatggactagtggcatcatgctccactccttcaactgagaataaggtgcgtgttaatctgctttattttagcatgtgaaacacgtttacgcacgtatgatcaaaaagtaagcgcgagccggcgcggttagaagtcggagtgtaagtggcctcaggtgtgatggcccggttctggccattgcgcctgaggtccttacacgtagacttctgcgccggggagcgcgttatgggcgtaaagtcaaactagtggccttggacgtgatggccgggctttggccattgcgcccaaggtccttatacgtagatctctgcgccggggagcgcgttatgggcgtaaaggagaaatagtggcctcagacgtgatggcccggttctggccattgtgtcttaggtccttacacgcagacttctgcgccggggagcgcgttatgggcgtaaaggcgagcgaaaacaaaatcaattaacagtcaaggtgcataatttcaagcgtgatagtccgtatttagccactgcaaataagatcgcacaatcaatccccttctctaaactcaagattcttccctttctttaaagtctcacacagtaaacaaattagtcgcctgctgcttcacccactgttgatcagcagtgagaacgatggtgtatccatgtgcctttaaccatgctaggatagcctgtccgcgcgccatgtcaaccacatcgaatgggcggtcaagaatcagcagctggctgctaagtgcggcccgtgccaacgcaattcgttgcttttcgccagtcgaaattgttgaagcattgatttgggtgtcagtgtggaagcgcgcggaaatgccaaggatgtccagtaagtctttttctactgaacgcgatttggcagctggtgttgtcccgactgcaaacccggggaatagatggatgttattcgccaaagactcatggaagacagctggattttcaggaagataacctaccgcaaagtcgggcaatttaaaattggcagccgacaaattcagatatttggcaggttcatttgccagttcgcgaagtaatcggcttttgccactgccattttgtccttctatacagagaatatccccaccacgtaaaacgaccgagctattcttaaattgctttttgagccggtcacgagtctggttatacccagcatcatcccgccctttacgcgggaaaaattgcgcgattttagcttcaacaaagcggatgcgctgaagcaactcaagggtttgatttgagatcgtcacaaagtcaaatcctggcgcgatataagttaggaataaggcaatggttcccggagaaatctccttagtctgattcgcaatcaatagcgtgaatgcaatcgccagcatattgataaaagcaatcatattggtcaaaaatgccgcatatgtcgcctgcttcagaccactgacgagttgttgcttattcttgcgatccagctcggcttcagggtgaagtacccccaagaagcgcatataccggttgttggaaataagatcaaacatgaaattaaaatagttaagtgaagcctttctagcacgcccatacaggacgccattgtatttttgcgcaactaaaataacggtttgtacaactatgagtgggatgatgaccgcaaccgtcaacgtttgactgtatgaaaacagaatgactaaagaacccaccaagaagacaaacttcacgcacaagtcggtgatggtcaaggcaacaaagtcaattgacggcaaatcaacattcacgacattcagaaggtcggcggcatgcttcgacccaaaatcaggcagttttgcaaataatttattgataaaggttttatcggtattaaacgtgattcgtgcgtcaagcatgccatagcgttggcgcgacaggttgatcaggatgacaaccccaatgaacaccagaatcgtcagccagaatagcgacccgtgatgttttgccaaagcatcaaaggcccgcttttgaatcaggccaatgactaacggtgcacattcctgtatcaacgaaaataggatcaaggcggcaatcagctttttattgtcgaaaaatagatcacgaatttttaacattttgttcgtcctcgtaggttgatgcccaatctgctagtttcgagaagtagacgcattcaccctttgtgatgccataaacatgatcggcaaaatgtagccggttggttttatgcgaaatcaggatcattttaatcttgaaagtgtccacgtaatgccgcagcaaacgggaaacctcggcaaatcgagcggtatcaagtgagctcagggtttcatcaaggataatcaagtccttttcttgcaaaagcgctcttaatatcagtaacagttggcgatcaccatccgccagcttgtcaatgttcgcaccgtcttcacccacctgagctgataaggttgtgcgcaaataatctaacctagctttcgacacaccaagttgttcgaggcgttgccagacattttgcgtggcattatttaccgaaaaaccttgtaagctcttctcaattgaaacgtggaaaagcgattggtcaacagagacgtaagcaacgtttgctcccatttcagaagctgatatttttgaaatcggcgtctttgaatagtcaatttgcccctcgtactggtgctgcaggccaacgatcgcctttgcaagggtgcttttccccgaaccggacacaccggacaacccgatgatttgtcccggtgcaatggccatatcgactttctttagtacctggtgatcaaaatttctcaagtttgaaatatggagccgaatagtaggtttagtaggatagggactgtttcctgattgcatcacaaatttgcgctccaattcagcaaggttggcaaatgcacctttgagatattgcacattattcgcgtgaaactgcatgctttccaagggtgcttgaattctggtagcgtaatcgatcatcatatacaccgtccccaacccgatcacgccgcgtaggaaactgtacccgcccagtgctaacgaggtaacttccaaaaaggcaatcagcaccagtgcggcgatccacgaacgataaataaagctctgagcatgtaattccaaaggcagcagcttatcgtactgtttattaaaccaagcaatgacgcgactcgaagcctgcatcggggccacgtcattgttattaacaaaaacatcttgcagaaaatcagccgtctttgcttccctttttcgcaacttagggatcacatcgttgccactggtattaacgtgccttaaaacgagaatcgagagaagcagataaccagtaaaagctgccccgatcaaaactgactgaaaaaacaagacgcaaataatcgtgatcacctgaatcacatctgaccacactggaattaaggtttgctggcaaaaaagtcggcactgatcaatgtccttagtcaggcggtcatttaagtcgccggtttgaaaggattcagaatcgcgaatttcatcaccaaaggaaattaagttgaggtatccttttcgtacccggtgcgtcattttcaaaaaaaccacatacgaaaaagcgctgaagactgtgcgaccggctaacaatatcaaccctagtgctagataaatataaaaattgtgaagaacgtttgcgctgccgggaactgtcacgccgttgatcatgcgctgaacaaagacttcagcgtatactgcactggcactcaacgccaaagatattaataagaccagtcctaatgtcagcttaccgcggcttgaagcaatttcggatttaagtattttaggcataagcgcttccttgttattagtatgaaatcttaactatcggcgagccgttaaaccggatggtatccttcattcttaatggcttttaatattaacaaccatccattgcgtatgtaggatagcagtcgcctgataatctcattttattatcatcaggctatcattatattgtgaaacggtcaactaatgatctaataagtcgtgaattattttttgacttcatcaccggatcacggctttacaggtttgattttcacgacaacaaaatagagccgtccaaccaattgaacttatcaacaccgcatctgcttagggtacgcggaattaataggtcagtcgataattagacgactctcttaactataaaaatgttagctgttacataaacgtaaacggatcggtcgacaatttcgatggaattgccttgacgtcccaaccttcagcaaccgcccattcgttgatcaacccggcaacttttcctttcatgatcgcttcgatgtgatggcccggatcaatcacaggtaaatccgccgccagcatatcgtgagccgtatgatagtaaacatcgccggtaatgaagacatcggcaccagccgctttggcatcgttgaaggcatcgccgccatcgccaccaagaatggcaacttttcgaaccggccgctccaagtcacgagcaacaacgcgtaagcctttgacgtgatacgctgctttgacttgttcaataaaggcctcaagccggatcgattcaggcaacaaaccgattcggcccatattcgcaccttcaccttcgttaataaacggcacgacttgagtcaaacccagcgcatcggccagccaatcattcatgccttcctgaacccgatccaaattggtatgggcgctataaactaacaggtcatcttttaaaatctgcgcgtacatcgcattttgcggaacccgtaagtccagattgtgaaccgaatgaaacattgccgggtgatgggaaaagatcatgtcagcatgaaccgtttcagcttcggccaccacctcaggacgaacgtctaaggtcaccaacacggttttaacgggacgatcagggttgcctaattgtaagccactgggatcgcgctccatagcaaggcttaaaggcgcatagtcttcaaaacgattgataatatctttaccggttgtcatgtgcacttaattcctccttaattaatgccagcaggtgctcctgttcacgaattttggccaatggtaccatttttgcatcggctaatccttcaagtaccgcttcagttttttcggcttcacggtgcatctttttcatgaaagtcgggcttttttgacggcgcagaatcggaccaaagcgcaggtctgcttctgagtagggtacatcgggtctggttttgcctgctgccatcatttcgtaaatatggccttcatcttctataatttgttcaccgataatgccataaccgtgtttatctagccatagtcgaacatcgtactggtgacgattaggtgccagtaccagcgtctcggtgccatccaactgcggctgaccggcctcgaggatgttcgtaatgagctggccacccattccggcaatcacaatcgttgaaatggcatcagcagggtgaatgccggctaacccatctgcttggcggacgctgatttggtctgtcaaaccagcgtccgcgacattttgcttggcaattgcaacgggtccggcgccaatgtcactggcaacggcgaatttaatgatgccgcgttgcacgaggtcaatcggcaagaaagcatgatccgtgccaatgtcggctaggcgctcgtttggttcgataaacgcgcgaatcgcctgtagccgttttgataaatgtatatgatccatgaatttactgtcccctcatctgattaacagcttttattataacaaactgatgtcacggtgctggtattgtcgctaaaaaggttcagattcttattgtgtggcggttgtgtttcaaaatagcatctgaccggccgcgccaagtcgcaaaaagccgccatctcaaatgagacagcggctttgtcagttgcttattcaagaaaatccttaagctgcttggaacggctcgggtggcggagtttccgcaatgccttggcttcaatctgacgaatgcgttcacgggtcacgccaaagactttgccgacttcttccagcgtgcgggtccggccatcgtcaagtccaaagcgcagccgcaaaacattttcttcgcggtcagtcaaagtgtcaagcacgctctccaactgttccttgagcaattcgtaggaagcgtgatcttctggactggtagcgtcttggccttcaatgaagtcgccgaggtgtgaatcgtcctcttcaccgattggcgtttccaaggacactggctcttgggcgatcttcaaaatttcgcggactttttcggttggcatatccatctcggcaccgatttcttcaggagttggttcgcggccaagatcctgaagcagttgacgctgaatccgaatcagtttattaatggtttcaaccatatgaacaggaattcgaatcgtccgggcttggtcagcaatcgcgcgggtgatcgcctgccgaatccaccaggtggcgtaggtggagaacttgaagcctttgcggtaatcaaacttctcgaccgccttcatcaagcccatgttaccttcctgaatcaaatccagaaactgcatgccacgaccaacgtagcgcttagcaatagaaaccaccagtcgtaagttagcttcggccagtcgttgcttggcttcttgatcaccttgttcgatcttcaaagcaagggcaacttcttcatcagcggtcagcaatgaaacccggccgatttccttaagatacatccgcactgggtcgttaatcttaaccccggatggcgcggacatatcgctcatttccttcttggaaacctttttttgcttcttgaggctgatcgtggccggttcgccgttttcgtcaacaatcgcgatcccgttgtcttcgattttctgcattaaatcatcgatggcggtactctttagctcaaatggcttgatcagtttagaggttaaatcgtcttcggtgatctgctttttcttcttataatctttgatgacagctttgacggcatcatcataagccttagtcgttgtgtgactcttgctagcggtagtcttcttggccgttgttttcttggttgcggtcttcttggtcgcagcctttgattcggttgctgctttggttgaagctgcagccgttgtcttctttgtggtcttgcttacttcagttgctgtttttttatcagccattaaagttcctcccctagccttgttgttgcttcaaaagtttcatgagattcacatattgcaccgttaattcgccttgtttctgtttgtcacccaatcgctgtgcctcggtaatggcttgtttaatcgcctgcagccgcgaaacagttgacgccgacgtgatcgtctggattaactcgtcaatcgtggcctcgcttgcttccggcagtgactgcatcgcgacatcagccgccaccccgctgagttcaggatcaacccgatctaaaaatcctgcaagctcaccatccggctgttcatgcaaaaagcgcaaccagccagtgaaaagtgtttgaaaatacggcgttggaaatacaaaagtcgcatttttcaagcgttgcatcacaaggtcatcgtgccagacatagtacaataactggcgctgagccgcggtgtagcgatccagcgggcgaacgggttgatcggcaatcggtggctgagctgcggccggtcgcctggtttgcggactcggcaggctttgattgagcgcggcaatgggcacctcggtcgtctctgccagctgtttgacgtaaaccgcccgagcaaccggatcactgattttgccaatgatgcgtaaggccgcattcagataagtcaacttggcctgatcgttgtgcatgtccacaccacgggccagaaattgtaacataaaagcagttggtgtcaaaaccgacttgacttgtgcttgaaaggcttctgctccccgtgcgcgaatgtactcatccggatccatgccatccggtaaaacgaccacatccgtttgcaggcgaggatgatcagccagcatggtgacagcccgttcaatcgctttttgacccggttcatcaccatcgtagcaaacggttaaccgtttgctcaaatgactgatgatatcgacttgttccgtggtcaaactggttcccattgaggcgatcccggttttaacgccagcttgatacgccgcaatcacatccatatacccttcaaaaaggatcgggccaccatcacgcccaaactcggctttggcgcgatgaaggttaaataaaatatcccgcttgttgaaaagcttggtttccggactgtttaaatacttagcctgggacttatctgactgtaaaatccgcccggaaaagccgaccaccttgccattagcatccgttaacggaaacatcacccgatcattgaaacgatcaaacaacttaccggcctgatcttcaacaaataggccactggcgcgctgatcctgatattcaacatggcgattattaagaaatgctaccaatagattacgttcttcaggcgcataacccagtttgaattcttcaatcgtttcgtcggttaacccgcgtttatgcaggtaagccagtgcagcttcacctttttccgtgtttaccaaaatatggtgataaagatcagcagtatcctgaagaatgtgttgctgcttggcaacttcaggatcaaccggcgctgcctgacccacttggacgtcaagcggaataccagcaaaatcggctacctttttaactgcctcaggaaaggtcgcgttgtcataatccatgacaaacttgaaaacattaccgccacgtccgcatgaaaaacaatgaaaaatctgtttggattcattaacggaaaaagacggtgtgtgctcttcgtgaaaaggacaaaggccaaaaagattttgtccggtctttcgtagttgcacatactgcccaatgtaatcggcaatattgaccgcttttaagacttgatcgactgtggcctcgggaatcattccggcgatatcagctcactcccttcccatggcgaatggcattgcaagcattgcgccaccacgacttgaaccgattgaaatagcggtaaaaagtcgcacttctgacgtgaaatgcgacttttatatagtctatcggcataataatacaagatatagtatagcctgatgaatcaagaaaagcaagtctatttgacaatcacttggctaacgtcaccaaattggcggattaactgggcaagctgctgcaaggtagcaaggcgattttcgcgaacagccttatcatctgccatcaccatcgtcgcatcaaaataggcatcaatcggcttagccaaggcttttaatgcttgataatccgcttcagtcggttcagcagcaaatgttttggcagttgttgtcactgcatcatgtagttgaccttcagtcggattttcaaacttagtcggatcaaccgctgtggttaccgtttgcttaccggtaatccgcaagacccgccccaaggctcccatcaccggcttgaaatcagaatcggcagcatgctgggtcagtagcttagcagcatccaaaataccggcaatatcggcatcgctgcgaacggtgacggcatcaacgatatcgtgccgaattttttgaccttgcaacaactgcttggcccgatcaatcatgaaatcgttaagttcttgttggtgcgcggcaaaatcaagtccgttcgtttgatcagcttcagccaaggctttagcaatggtcggctgtaggctagccagcgcaaacggccagtcatgttcggcaatcatgcgcacaataccgtatgcctgacgccgcaacgcataaggatcgttggaaccacttggaattaagtcaacggcaaagaagctcatcagcgaatctagcttatccgcaattgccagcaccgtgccgactagactttgcggtaaggcgccatctgccgcgattggttcgtagtgttccgcaattgcctgagcgacggcaggtttttcgccggcaagctgggcataatgttcgcccataatcccttgtaattcaggaaattcgccgaccattgacgtgacaagatcgaatttgtagatcgaagcggcgcgatctagatcagctttttcgtccgcggtcaagccgaattgatcagcaagtaacgcggcaatgactttggtgcgcgccattttgtcgtacattgagctgattttgtcatggaaactaaccgctttaaggcgctcaacgtcttcagcaatgctgcgtttctggtcttcggcatagaagaacgctgcatcttccaagcgcgccgttagcactttttcgttgcccgcaatcacattgttcaaatgatcgtggttgccattacgcacgccaataaacgcattgaccattttgcctgcctgatcacgagcatagaagtaacgctggttatctttcattgaagtaatcagcactgcttccggaattgccagatatttcggatcaaacgtaccggcaaaagctgtcggccattcgactaaattgttaacttcttccaataagtcactatcgagttcgatctgccattgatgatcagtggcaatttgctcgatttgttcccgaatcaactgtttgcgtgcagccggttctacaatcacaaactggtctttcaacgccgcaacataagcatcggcattaggcagcgtcactggcttaccgaggaatcggtgcccttgggtgacccgccctgcttcaacatccaataacttcatcggcacaacggtatcatctagcagactcactaaccaatgaatcggacgaatgtactcaaaatcatatgctccccatttcattcgcgtcgggaacgtcaggcctttaatgacatcaagcatgccaggcaaaatctcggcagcttccttacctttaatcgccttatgcagataaacataatcaacgcctttaatcgtcttaaacacgatgtcatccggcgtcatcccttgactgcgggaaaatccgatggcagctttggtccaattaccatccgcatcttgagcgattttcttggccggacctttaacatcggtttcaacgtctgcctgtttagcggctaaatcgtgaaccagcagcgcaagccgacgcggggtcgcgtaccggtcaatttggccatgctcaaggtgattggctttcaaaaaggcaacggttttgtcgtgaaattggttaatacttggcgtgacaacatgggccggcatgtcttcaaggccaatttcaatcagatagtcatgcgtcatgttattgcacctccgttttgtgctgcagcaatgggaaaccaagcttcttacgttccgcaacgaaagcgcgcgcaactttatgcgccattttgcggatgcgactcatataaccggcacgttcagtcaccgaaaccgcaccgcgcgcatccagcaggttaaacgtatggctgcatttaagaatgtaatcataagccgggtgaaccaaccctagatccatcaagcgccatgcttctttttcataagcgtcaaaaaacttcagcagcatagcttgatcgctgacttcaaacgcgtatttactgtgttcgtattcaggttctttgaaaatatcgccgtataaaacgccatcgccccattcaagatcaaagacactgttcacgtcttggatataggaagctaaccgttcaacgccataggtaatttcgctggtcaccggcgaaacttcaagaccgccaacaacttgaaaatacgtgaattgactgacttccatgccatcgagccaaacttcccagccaaccccggcacagcccatggacggattttcccagttatcttcaacaaagcggatatcgtgttccaatgggttaatgccaagtgccgccagtgaatccaaatagtaatcctggatgttttccggtgatggcttcatgacaacctggaactgatggtgctggaaaagtcggttcgggttctcgccataacgaccgtcagctgggcggcgtgacggctcaacgtaagcagcattccaaggctccggtccgattgcccgcaaaaaagtatacggactcatggtaccggctcctttttcaacatcataagcttgcatcaacatacaacccttatcgccccagaatttttgaagcgtctggatcatcgtttggatgtccatttttgtcgtcatgattacctctttcccggtgaatcaaagtctggcgtgggtagcataaatgtccatatacatgaaaacgtccctacgccaagatatggcgtagggacgcttctgcgcggttccaccctacttcagatagaccgaatctacctgcagctttgtcatttggttcgaaaacgccaatcacattcaccaccatcaggcttacactatccctgactcgcttgggtttggtacaaatgcgaccctttttctcatcaccgattcaatttccttattagtatagcatcgcggctaggggtgtcaagcggggtttctgaaaaggaccacggcttttccatcaaaacgatataaaataccctgaagtaacgtctaatcacgttctcgctaatcacaagtcatctcgtgtcattgaccagattgctaaatcaacttgccgaccatgaaaacaatatgactttcgaagcgttccttctatcttcatacctattcttgccatgagattcatcgattttagattgtcaaatgtatgtctcgcatacaagcgctcaccttcaagttcattaaagaagatgtcacgtaatttgattgcagcttcagttgcatatccatgcccttcgaattttttgttgagtacataacttaactctgcggatttgttacgatcgtctaagtttaagaaatagattgtaccaatcaatttttcattcaaaaaaatgccatatttgccaagcccattctctataaatattttttgaatgatgtcttttgtatctcccaaagttttattggtttcaaacacataataggcattctccggattacttgcatactcaaacatgtcaggcgcatcgtcaatcgtaaccggtgccaacacaagcctttctgtttgataagcatgttttaatttttcgcgcattggcttacctctttcctatccacataaaaaattaaaagacataaatataccccgctctcgatgtaaatcagaccgttctgaaaagacggtttggtttagcgataacgataaagcaatactgaaaagaaatatgaaatcacatataaacaggcaactgcagcaacggcgacaagaaacaatgaagctttgttttggctcatcaagaaagcctgtagtttcgcggaccggatccgcggtaggattgccataagaagaaggataatgatgaaaataaacatcaggccgctttgtgaaaaagcgtacatagccggaagtaagataatgccaaaaacagaacatacaacaaaaatgatcgcggttatcccaaataactgcatcggtgacgttttcggtacgataatctcaatgataaggctcatcacaaaggcaagaaatgatgttgcaaaacaagcgattgcatagaatacgtacctagaaccaacaatcttgaatggattcaggtgataaggcactaaaaaatctttccagtgactttgattatcaagctgaaaaagcgtttcaagcgcaacaatggcaagcgcagaagaactgaacacaaataactcggcaatgtctttgttaacgaaaactgcaaccagaaaagcgccaaacaaagaaatcaagacggggagtttaaggattcgtttcttgacaattataaagtctttaataagaaagcctgtcatttagtatcccccacttcttcgcaaccaaaagtgacttaagaacagcctcgtctgtttctggggttaaactgaagtctgttgtgatgctgccatttgttagaaccacaaaccgattacacagctggatgacatcatctaaaatatgcgttacgagaataatgctggcaccggtttgattttgataagcttttatttcattcagtatttcaatccgggtcagtggatcgatcccgctggtaatttcatcaagaatcaccaaatcgccgttcatcgataaacaaactgctaagccaagtttggtttttgtacctttagagagatcaataaaattccccagtttacaattcaagtgcaacaccctgacgactagaccataaaggccatgaagacctattcttgttagtgctaaccgatgcatggcgtaacagcctagaccactatcaagaattcgttatcatcgttgcacttgacttgaaaattgaggatagtaaactaaagcgctgataaaatatgacagcatgaacggcataatacgatgacgaacgaattgagcaatatatgcattcttacgtgcttgaagttgtttaagcaatccgtatcccgatataaaaaagaaaaccgaaactgccaagcgccctaatgcaccaacatgtacaagcatggaagacgatgacccaataccaagacgataatcactcatagcgatatggcttagaataacaacaaatacgagaacgccttcaagccttcctgttgtatcaactgataatacgccctctttgtagtctgaactaaagcgcagactacaaagcaacaggactccaaaaattcctaccaaaaaaagcacaaaaccacccctaaatttagtccccaaatactggtacttttattagatcacagcactggaagcgaaacctattgtatcataaggatacatcggacaccacaaaatatgactttgttaatttcagggcgtagtttcattgctgattgcgtttaggacggaaatgttgatcaattcggtcacatataattttagcgtatttattcaagatgatcacctcaattgatattatacaaacaaacgttcctttataaagcggttatttttaatttgcttacattttgcttgcgtaatattgctttcgtttaaattcgatacaatatcctaaaagcttttgtattctgaaatggccgataaatgcataaacagtactgtcaatataatccatttaaagtttatgaaatgttccctatataataggagagataagaagtcttcatgggtaaaaagttgcacttgagttgacaatttgttgctttgaagcacgggcataatgctgtaaaataagatacgtaagcaactaaatattttagtcagcctgtaataccttgtcgttctgcctcccttgctcagggaggcttatttttgtgcacagagttgacagaatcgactcaaaaaggcaaaaggtttacatatgccggattaggtaacttactatgagcaaattgtttgcatacccagcatgaccatgcgatactgacggtgaaggagaaaaactccaatagctaggagtaaaaagctccttaggagttggcaagctaagctgctacccaccccaagaataatcgcgcatacggactgtatactggtaggaacctgccccctcggcgggtcttcccgattaaaacaattccttgccaactccgccccgttccaactgtggacggggttttgcattcatttttttgatgtgcacacaatgtgcacaaaatgttattaaagtctattaaatagggatctagtttcgcccttactctccgttttattgtctctagttgctttccatagcttcccaaaacgctgatatgacagtgttttgggatttttattttctcttgtttttggatgttttaaaaattttgagactaaattaagacctgctggacgagactagatctttattcttaaagcctatgctacaaaagtaaaattgacgctaatttttatttgtaataaatgtttaaagtacttgccattcttggctgtctccggtagtcttgtacaagtagtaagtaatcgtcatggaggattagctcagttgggagagcgtctgccttacaagcagagggtcacaggttcgagccctgtatcctccatcagtttacgtccgctgtcactgcgggcgtttttttgaattgttaagctaattcaacgtctaaactttgattgtgacatcgtgaaagttaaaaaaatcctccctaaactgttgaattaagggaggagatttagtgttgacggtggtatttatgctaaccatgcatgcgtgctaagtagagtaaaagggtcatgattaatggactgaattgataaatgtaacgaggcaatttaaagggacgacgactgttaatgacggtgacaatgatgaacatgccgccaatggcaatgaagtttattcgttgctgtacatagccaaggatggcaacgaccagtagaagaatcagatcggtccacttaggaaaacggttggcccaaagcccgatcagcgcaggtaaatagagaagcgctaggtctagtagcatggtgcgattgaagaaatgcaggctggcatagattagcgtaatttgaagtagcagggcctgaccaaaaacgacagtgtcaagccagagcgcaggcattttttgcgtctgtaaaagaaacgcaatgacgatttgaacaataatgagtggcagtagcagccattgattgattgtgccgatgataccgctaacgcctgctatgagcagtaggagcataagcttgtttgaactgacgagtgttgttccagcaagacatattgtcataaacagtaatgcgacaagttgaaaagtccagttgacttgcagcgccatagcaattaaaaatgggtaagcaagtgcctggcctaagaatgcgattgcgtaggcgctttgatcgatttttttcaagatggatgtcctttctatatagcctcattttacaaaaccacgttgccagagacaaagattttcggaatttttatattttttatgttatgctactagagttgcaatacattcccgatggggttcgttagcgattaacgaacatgccttgtaaccgaaaatcatgagggggaaacaaacgatgcaagaacgccatttatttacttctgagtctgtatcagaaggacatccggataaaattgctgatcaaatcagtgatgccattctggatgcaatgctcgaaaaagatccgaattctcgagttgcgtgtgaaacaactgtgacgacgggattggtgttggtggtcggcgagatttcgaccaatgcttatgttgacattcagtccgttgttcgtggcacgattaagaaaattggttatacaaaagagtctgggtttgatccggatagtgtcggtgttttggttgcacttgatgaacagagcccggatattgcccaaggtgtggatgaaagtcttgaggcccgcgattccgataccgatccgttagataaaatcggtgccggtgatcaagggatgatgtttgggtttgccattgacgaaaccgacacctatatgccattaccgatttcgttggctcatgccttgatgcgtcaaacggataaattgcggcacgctggcgaaatcagttatctgcgcccagacgcaaaggcccaggtaacagtagagtatgatgataatgagcagcctgttcgggttgatacagtagttctttctgttcagcatgatcctgacgtcacactggaagaaattcggcgtgacgtagaggctaaaatcattcggaagatcattccagctgacatgatggatgatgacacgaaaatttatgttaacccgaccggtcgctttgtcttaggtggtccgcaagccgattccggattgactggtcgtaagattattgttgatacttacggtgggtttgcccggcatggcggtggggccttttccggtaaggatgcgacgaaggttgaccgctctgctagttatgcagcgcgttatattgctaaaaatattgttgcagccggcttggctaaacgcgtggaagtgcaactggcttatgcgattggcgttgctaaaccggtgtcggtatctgttaacacatttggcaccaacgttatttctgaacaagtaattgaacaggctattcgcgagaactttgatttgcgaccagctggtattattaaaatgttagatcttaagcggccgatttatgaacaaacagcggcttatggtcattttggacgtacagatgttgatcttccttgggagcacttagataaggtgcaagcacttctcaagtatcgagattagcgagaaaagaggcggccttggacgggcgtattcccatccgggtcgtttttttatgctttggtagtgtgagattagcactggcatcgcgccggctcgcgcctcacctaacgcgctccccggcgcagaaccctgcgtgtaaggaccttaggcgcaatggtcaaagtgtgaccagcacggctaaagacggcttgattttaagaaaataggcgggaggacgggaaagttttctgatttaggcgattaagggaactgacattgcgttctataacacgctccccggcgcagaagtctgcgtgtaaggagaccttaagcgcaatggccaaacccgggccatcacgcttaaggccgcttacactccgacttttaatcgcgccggctcgcgcctcaccataacgcgctccccagcccagaaacctgcgtgtaaggaccttgggcgcaatggtcaaagtgcgaccatcacgcccaaggccacttacactccggtttctaaccgggctggctcgcgctcacattttttaaggagtaatttatgaagcagagaaaaacaaatgttgctgttgtgacggcggcaatttttatgggtacttttatgaccgccatcgaggggacgattgtctcaactgcgatgccgacgattattggtagtttacatggcgtgcatcttatgaattgggttttttcaatttttcttttgactaatgcgatggcaacgccgatttatgggaaattaagtgacaaaattggccgtaaaccggttttcttgattgggctgactatttttgttatcggttctttgttatcgggtttgtcgcagtcgatggtgatgctgatcgtctttcgcgcgattcaaggggtcggtgctggtgccattatgccggtgacgtttaccatcattgctgatatttatccgtttgaaaagcgggctaaaatgctggggtttaatggttcgatgtgggggattgcatctgtcattgccccgttactgggtggcttcatcgtggatcaattgagctggcattggatcttcttcattaatgtgccactcgggttaatcacttttggtcttgtttggttctttttgcaagaagatcggcgtcaggtacggcaaccgttggatatgcgcggtacggtctggcttttggttgcgttgttagcactgatgtacggattccagacgcttgctgaacccaatgcgatttggcagttagcggggatggcacttattgccgttgttggcttttggcgtttttggcaggcagagcggcaggcagttgatccgattattgatctaaaactctttgaaaatcgcacgtttatcattcataacttgattgccgcgttgatttcagggtttgtgattgggtttgaagtttatatgccgatgtggattcaaggcattcttggcatggatgcatcacttggcggttttgccgtaacaccgagttcgttgatgtgggtggtcggttcgttttttgccggtaagttactgggacgttttcaacctaaaccgattctgacaggggccatgttttggctacttgggggaagcttggtcttagcgctggtgccacagtcaacgccgtattttgtcttcctgctagttgctggctgtcttggcttgggatttggcttggtcattacgatcacaacggttacagctcaggcggtggtcagccctgatcaagtgggtgtagcgacgagttttaatacgttatcgcggacgctggggcaaactttgatggtttccgtttatgggatcgtgcttaacttgcggctgactcaaggcgtagcagctgatggccggttaaacagtaatatgttaaacgaactgatcaatccgcatacggcaaaacagttaccggctagcgttttgccaacgttacgtcaaatcctttatgaggggctgcacaatatttacttcttttcaattgtgattgtggcgctcgctttggtggccaatcattttgaagccaaaaaggttttagcaaaagctgccacgcaagaatctgatgaagaagcttgagctatgaagccggtagttacgttagccagttgtttgagccaaaatttttctaatcaagccgttgtattatttagcggacgggcataaaaaaatcggccttagagaacgtcaattcgtttctctaaggccgattttgcatagcagcgttcatcatcaagcgcgaaaagaggtatcaatcatttcagcaggttatcggtcgtttgctgattgatcgcggcggacggtttaatcggctgtttatataatttagcatttttttcatttacgacggccacgacatcatatgtggggtcattttcaagaggcccaaagtttagcaaggtttgctggtcatcgtattgaatgtcttgaaggcgggtactcatgaggacatgaagcatgtcggctttttgatgcgactttttgatttcttcactggctttagctaaggtataaccttcatccagcatggttttgatcatgacaattaacgcaatattggacagcgaataacgtttgttgccatttgcttcgtggcgacgtgaatgaatcaggtgctttttttcccaataacgaatttgggtaggggttgcaccggtgacacgacttgtttcgccgatgcctagtgaaatatcgagtgatcgcaaccgcttattaaacagttccatgaaaatctctcctctgatgagcgtgcgccgggaagcacgttatggtgagcgtgaaccagacgaatttgttaaaactgaatccgctgcctttaaaaaatatgcagcgactttcaaatcacaaccttgacaactagttagtttaaatgtaatataatctcttgtcaatattacattatgtgatattaaaagtatgaaacattataaagaaatcaggcgaagttatggacgttaaagatatcaacgggaaacctgtgaacgtaccgatgatggtgattaccctcattgtcgggacattcatcacggttcttaatcagacaattctctccaccgcgtttccaacgttgatgaaggcttttgatatttcaaccgcaaccgtccagtggttgtcaacgggattcatgctggtaaacggtattatgattcctgtttcggcttatttaagcgcaaaagtcccgtcaaaatggctctatatgagtgccatgagtactttctttgttggcacgctggtggcgtttgttgctaatagttttggcgtcttattagccggacgattgattcaggcgatcggcgtcggaattaccatgccgctgttacaaaacatcatgatgtcgattttcccaccaaatcggcgtggagctgctatgggaatggcggggatcgcgattggggtggcacctgcaatcggaccgacactttccggctatgtcatcgataatttcggctggcgggttttgttcggcatgatcctgccaatcgcggcgttggtgattcttgcggccatgttctttttcaaaaacgtgttaccactttcgaatccgaagctggatgtgccgtcgctgattgagtcgtcaattggatttggcgctttgttgtacggcttttctgaagtcggtaatgacggctggggcgatccaatggtccttggttccattgctgtcggactcatcttcattgtcatctttgggtatcggcagttgcatcttaaggagccgtttgtcgaattacgagttttcaagagtaagatttttgcgttatcgactgctttagggacgattgccaacatggcgatggtcggcgttgaaatgattttgccactgtatctgcagatcattcatggtaaaagtgccttggaatcaggactaacgctgttgccaggggcgcttttaattgccgtgatgagtcccgttaccggtcaggtttttgatcgcattggggcaaaacgcttagcccagttaggtctcttcttcctgacgattgcaacgttgccgtatttcttcttaacgacgaatacgccgtcaatcttcattaccgtgatttatgcggtgcggatgtttgggatttcgatggtgatgatgccattgaccaccaacgggatgaatgcactgacacctgatatgattcggcatggtaccgcggtgaataacacggtacgctaggttgcgacttccatgacaacggcggttttgatttccgtgttgtcaaatgttaccaacctcgccaagccggctgccagcttgttgaagcgtaatcctttgcagtataaacaggatttcctcaatgcaacattaaacggttaccacgcagcctttttattagcagttggctttagcctggttggctgggtgcttgcatttttcctgaatagccacgccatgtcacaggaaatcacgattcaaccagaaaagaaggtgaaggcatgattctttggttcttaggtctaatggtcattggcctttatctcagtttcatcatgatgcatcgatcggcaaagcggagcacattaattgccattttcagtattggcttgatgggcagtctgttactgatggtgcttaacgataatgcccattttggaatggaaaaacgaacgactacggatgaacaaacgatttatacggcatcacccaatgcgcagatgccaatgttattgaagcaaaatgttggcactgccggtaagcatgttgtctacatctataaaaccgatcctaagaaaaaagcggtgcataccaaagcagatctggctgtcagcaatcaggttgtgcagacgacaggaacaacggcttcgatgacaagtcgcacaactcgctgggaatatcaaaatagctttttcagtgcattgtttaaccaccaaggtgcaggccagttggtggcacagcataatcgactcgtgatgcctaaaagttggattgagctgacgacgacgcaagccaaacgtctcggcactaagctcaaagccttgcaacacccgaatgctcagcagaaagcaaccatggctgccgcggtgaaagccaaagctgctgagttggctcatgcgaatccgaaactggcgagcgatcaggctgcactgttgaaacaagcacaagcaacggttcaacaagcaatgattcaacaggcggttaaagaagttcaacaacaaaaataaccggtccgagttaatgttgatgacgatgcgacaatcaaaaagcagatatcagccgttaaagctgttatctgcttttttcatggcgctgatgacggcgggagaaatacgggctaaagtaccaccagctgagcattaataaggcaaacccgagcgcgaagcctgcgaagacatcggttggataatgaacccgcacaaaaattcgcgaataaccggtcaatccaatcatgccgccagccaataaggttatcgtccatttaacagtcggtcgcctgacaaaagtccatgctaaaagaatcaaggttccataaaacatcatcgtgccgcttgaatgcccacttggaaaactgaacccgccagcctgtaccaaagcgcgaatttgcgggtcggcgatgaatggacgcggccgttggactagatatttaataccaatatttagaatccccatcatggcaccgacactagccgtaaataaagcggcgatacgataacgatagatcaaaagcacccctgctaacccgagcgttaaaaaaatcagaatgctcggattgcccagttcggtaatgacgatgaggattggctttagcgcatccacatggaaccgggtcacaaatgcgatgacatgctgatcagtcgtttgaatccagctggcttgattgaggatgccaattaagaaaataatgaagatcataaaagcagtacctgaaaaataaagtggcaatgaccgacgatgcaacaagacaacctcctgtaaacgtaaattgataaccgactgaataccgtttagtcggcttttggttaatccacggtgacgcgttgacgtttccgcagattgacaaagaaaataactaatatgactagaatagcataaagaccattgaacactttcatggtttttgctatgattgacgcaatcatcaaacgaacaaaggagtagtaagtcggcgcgggtttcagagagcaggcggtggtgcgagcctgacgatgctaagactgaactgacctttgaagttgctgcggtgaacggagtaatcgcagccggccggaccgttaccccttttgagcgctgtgaaagcagaacttaggtggtaccgcggctgagccgtcctaatgaagactagggcggctttttgtttgaaaataagtgggaggtaacaaaatggcatacgatcatcatgagatcgataagaagtggcagcgttattgggccgaacataacgaattcaacaccacaaccgatccgaagaaaccgaattattatgcattagacatgttcccatatccatcaggccagggcttgcatgttggacatccagaaggctacaccgcgaccgatattgtggcgcggatgaaacgaatgcaaggatttaacgttttgcatccgatggggtgggatgcattcggtttaccagctgagcaatatgccttgaataccggtcacaatccccggacttttactaagcaaaacattgaaacgtttaagcgtcaaattaatagccttggtttttcatatgattggaaccgggaaattaatacgaccgatccgaattactacaaatggacacaatggatttttgaacaactgtataaacatggactagcgtatgaagctgaagttccggttaactggagccctgatttgggaaccgtagtcgctaacgaagaagtgattgatggtaaaacggagcggggcggttttccggttgttcgtaagccgatgcggcaatggatgctaaagatcacagcgtacgccgataaattacttgcagacttggatgatttggattggcctgaatcaatcaagcagatgcaacgaaactggatcggcaagtcaaccggggcgcaaatcacgtttacggtcaccgatactcaggaaaagtttgacgttttcacaacgcgtccggacaccctttttggcgcaacttatgtcgtcatggcaccagagcacgacttggttgaaaagattacgacgccggaacagcaggcagttgttgatgcttatattgaagaagcggcacataagtccgatcttgaccggacggcgctcgataaggaaaaaaccggcgtctggacaggtgcttatgcgaccaaccccgtcaatggcgagaagttgccgatctggatctcggattatgtgctggcaacttatggtaccggggcgattatggcggtgccggcccacgatgatcgcgactatgcttttgctaagaaatttggcatcgaaatcaaaccggtgattgaaggtggcaatattgacgaggcagcttataccggcgatggcgtgcacattaattccggctttcttgatggcttaaacgaacaggatgccattgatcggatgatcgcatggctggaagataaaggcattggccaggaaaaagttaactataagttgcgtgactgggtcttttcccggcagcgttattggggcgaacccattccagtgattcactgggaagacggcgagacaaccctggtaccagaagatgaattgccgctgactttgccggaagaagttgatatcaagccaagtggaaccggtgagagcccgctcgccaacctgactgactgggtcaatgttgtagacaagaacgggcgtaaaggtaagcgtgagacgaataccatgccgcaatgggctggttcttcgtggtacttcctgcgctttgtcgatccacataacaaagaggccttggctgattatgacaagctcaagcagtggatgccagtggacctttatatcggcggggccgaacatgccgtgctgcatctgctgtacgcgcgtttttggaatctgttcctttatgatatcggcgcgattccaaacaaggaaccattccagcgcctgtttaaccaaggcatgatcttgggtgataatcatgaaaagatgagtaagtccaaagggaatgtcgttaaccccgatgacgtggtggacgaatacggtgccgataccttgcgcctgtatgaaatgttcatgggaccattggatgccggtatcgcttggtccacggatggtttggcgggtgcccgcaagttcttggatcgagtatggagcgcctttattgatgatgaaggcaagctgcgcgatcgtatcaccaccattaatgacggtcgtttggataaggtctacaacgaaacggttaaaaaagtaaccgaggactatgaggcgttgcattttaacacggcgattgcccaaatgatggtcttcatcaattcggcgcgcaaagacgatgatttgccgctagaatatgttgaaggctttgtcaaaatgctcgcaccgatcgcaccgcacttgatggaagaaatctggcaacggctgggacatgatcacagcttaacctatgcgccgtggccaagttatgacgaaagcaagcttaaaaccgacacctacgacatgatggtgcaggtcaatggcaaacttcgtggttccatcactgcgagcgttgatgagactgatgacgagatcaaacaagctgctttagccaatgaaaatgtccagaagtatacgacaggcaaggatattaaaaaaatcattgtcgtaccacgtaagattattaatatcgttgctaagtaatgtggttgcattttggtcagactgataggataagtttgattgccacaattgcggttctagagacaaaaactgcctctggaatcgcttttttggtgagcgcgagccggcgcggttagaaagtaagcgtgagccagcccgcttagaagccggagtgtaagtggccttgggcgtgatggccggtctttggccattgcgaccaaggtccttacacgcaggcttctgggctggcgaacgcgttatgggcgtaaaccagaatataagtggcctcaggcgtgatggccggtctttggccattgcgcctgaggcccttacacgcagatccctgcgccggggagcgcgttatgggcgtaaaccggagtataagtggccttaaccattatgtgaaggcaatggtttagtttacgtgactacgattttcaaagatttcttttgattcaacaaagaaactcagtaaagattgcaagtgaggctgggattgcctaaaatataaaggattacgcaacacgacaggagcttatcatggaaaattcgctgggcggcgggacgcaaccgccacgttcagacaaggaaaaaatgatccgcggttcggcgtggatgactgccggcagtgttttttcgcggattcttggtgctatttatgtcattccgtggcgtatttggcttggagcggcttttttaacggctaatgctttatttactaaaggctatcagatttacagcctgtttttgattatttcaactgctggtgtgcctggcgcggtttccaaacaagttgcccgctataatgcgatgggtgaatataaaaccggtatgcggcttttttatcacgggacatttgccatgttcattatggggatcctgtcttgtggggcaatgtggttgctagcgccattgctcgcagcaggggatgcccggatgattccggttttccgctcgttggcatggccactgttgctgattccatcgttgagcctgattcggggctttttccaaggctataacgaaatggcgcctagtgcgatcagtcagtttattgaacaggttgcccgtattctgtatatgcttgtcatgacttatgccatcatggttgccggtaaccatgattacctgaatgcggttgtgcattcaacctttgcggcattcattggggcagtttttggacttggcttattggtcgtgtattttgttcggcagaaaccgcgattggatactttggtggcacacagtaaacaggcgctcaatatcagcgttaacgaaattttagttgatgttgcgcggcaggcgattccgttcattatcatggattcaacgattaatatttactatattgttgatcaatacacgtttaatccaatgatgaaggcgttctacttagttagcgaagatcagcttgatcggttctatgcattatttgccggcaacgccaacaagctgatcatgatcattgtcagtcttgcagtggccatggcaattacggttgttcctttgctggctggcgcaaaaacgcgcggggatgttgaaggtttagcgcggcaaattacgaacacgttgcagcttttcttcatcgtcatgattccatcggcgttaggcatggtggccgttgcgcgtccgttatatgttttgttttatcgtgatatggacttccttgggattcgcttgttacaattttcgtcaattttggcgattcttctaggattatttacggtattggctgctattcttcaagggttgtttaataatcgattggcgattcaggagatgctggttggtctcgctgttaaagtcattgcgcaatggccgatgatcttcttctttaatgtttacgggccggtgatggcgacaatgttgggcatgacggtgtctagtttgttgatgttgtattcgactaatcggatgtacaatattcatgtcagacagaccattcggcgcggcgtcggtattttagctttttccctgattatgtgtgcggtttgctacttgatcgtggacgtatccggtattctcattaaccctgagagtcagtttggcgcagcgtttgttttactggtagcagttggtgttggcgttttgatttacggttatttgattttgaaaacacgtttggccgatatgatcattggtgcacgggtcagtcggctgcgcgaaattttacacatccggtgattttatgcgattagataaatatttaagtcatttacagtttggtagtcgaaaagaagtcaaagccttgattcgcgacaagcgcgttcggattgctggggagttagtgacggatccgggctacaatattcttccgggtgttgccgttgaggttaatgatgctcaagcggacgggccacttgaagtcgattatttaatgaacaaaccggctggcgtcatcaccgcaaccgaagatccaacgcaatcaacggtattggacttgattcgaccgcatgattatcggcccggcctttatccagtcgggcgccttgataaagatacaaccggactgctattgctcacaactgatggcaatttagggcatactttgttagcaccgaaccaccatgtgccaaaaacttatgccgctaagttagccaaggcacttacaactgagatgaaacaccagttagaacatggcgttgctttaaaagactttacaacggcaccagctgatgttcaggttgtaccggcgactgacaataaagaaatttatatcacaattacagaaggcaaataccaccaaattaagcggatgttgctggccgttgataatgaagtcgtcgcattgacacgaattgcaatgggaccattacgtttgcctgaggacttagacgccggtgagtatcgggcactgacggatgatgagcgttcgctactggatcagatggtacgctaagtttaagctttactttttcgttaacggatccattgtcatggcatagttgcacccctatactgatagacaagaaagggtgagcgcaatggaccaacaacaatatatttgccccaaatgtcaaaatacaagctatatttcggatcggtttcaggcaacgggcggtaatttttccaaaatctttgatgttcaaaacaagaagttcgtgacgatttcgtgtacccgctgtggttataccgagctatatcgcagtgaaaccagttcggggatgaatgtcttggattttctattaaatggcggttgattttgaccgatttggcgggtcgtgttcgttaagattcatgaagatgagcgccgcagacgacataaaaacgtccttagaagttcgaaattctaaggacgttttttgactgcgttgattgtcatcttttgagctaatttgctgattcggataattgcttcaggtaggctggtagttcctgaatgaccatggttggtaaggcgacgtagctgttcatagctacaatgtctgctacatgcgagtgaacaaaaaccgcagctaacacagcttgggtcaaaggatggaattgccccgcaaaagcagcaatgatgccggttaaggtgtcaccggagccgccagttgccatggctggtccgccagctgtgttggcatagatttcgtttccgatgaatacatgcgtttgggcacttttggcaatgatgattccagggatttttgcggctgcttgttgactggcttcaattgtttgcgctgcgagtgccaagccggagagacgttgccattcgacttgatgcggtgtccaaattagctgggcttggggataggcgaggtgatgagcggcgacaagggtaatggccgaactgtcaataatgagcacttgggcttgactaacggctgcaaagacacgctttaaaattttcaaagcagtcgtgtccgtgcctaatcccggtcccacaacaatgacggtcgcttgatggatcgctgtctccagtgccgaagtggaagcatccaggatcatcgcttcaggtaagcgggcgtgtaaagcgctgcgattgacaggattggtcgcaacactaaccagtccggcaccggtgtaaacagccgcactggcactcataattgctgcaccaccatattgcgcattaccgccgatgataaggattttaccgaagctgcctttataagtattccgtgatcgcggacgaacaatggcacgcgctaattgttccgtcagttgtttcatggtgtgggcacctcttttaaaaccgtccagtcattaaatgtttgcgtggataaattcggggtgccggtttgcaggtagtctttggcaaacatgacaagtggtgaggcgttttcccaagttaactttgctagcggcagggcacatgctcccagtgagtcttgacctgtaaactgtgggactgacgatgccaactgtccaccggttaacgtcaatgcatagaacacgcaaatatgttgattaatcgtccaacgttcatattgccacggataaacaaagctggttgcccctaactgtcggtcgattgtggcagttaggccggtttcttcgctaaactccctcaagacatcatgctcaagtggttcgggaccatccaagctgccaccgggaagatcgaatcgatgaatgtacggtccgccatttttccgaatgacgatcaagcgctggtcaatggttgcaatgccataacagccaaacgcgcgatgggttttatgtgtcattgtctcgcctccatcgtctaagcgtagcacggagagggaggtgagacaatgagtaccttggctggtccccattttgtccccctggaaacaaaaacaaagccctcctaagataacctaggagggctaaaacgttgatgtataggcatttcattttctaaagaaggctaaaatatcctatgaaatgccgcgaacaggaatcgaacctgcacgggaataaatcccacagcgacctgaacactgcgcgtctgccagttccgccatcgcggcaacaacaataatgattatagcggatgcgtagaaggggcgcaagcaaaactttaaatatttttccgggttgtccgattcaaaaaatgttaggataaagcaacgtgattatttgagaagggtggtagcatcatgtcaatttacgattttgaagtaacgctagaagacggttccaagtattcattgaataaatataaaggccggccgatgttgatcgtcaatacggcaaccaaatgtggttttgccccgcagttcgacggtttggaagcattgtataaaaagtatcaaaaagcaggcttgatcgtgttaggatttccatcaaatcagtttaagcaagagctggcggatggacatgctgcagcagaggcatgtcgaatgaagtacggggtcagctttccgatgcatcaactgatcaaggtcaatggtcagcagacggcgccgttgtttaagtatttaaagaccgaggctccaggtgaattgggtaagtcgatcaaatggaacttcaccaagtttttggtcgatcgcaacggtcatgttgtgaagcgctttgcacctaaaacaactcctgaagcaatcgagccagcggttgaggagctgttatcctaaggctttaaaaggattgccggatgactgattgggtacttgatgacggtggacatggttctactggatgcgtacaatgacaacaaaagcaagaaagcagggatcattgatggaagatttgccaactgatattgcaacgtttgtggacacgcacttagttgatcgccataatagcaatgctgtgaagtgggacggtctgaaagaagaatttggccgggctgacttgttgcctatgtggattgccgacactgagtttaaggcgcctcaagcagttttggatgcattgacagctcgcgtcaaggaagggacgtttggctattccattcgcccgcagtcttattacgaagcgttcattaactggcaaaaagaacgacacggcatcacggttgaacctgagtggatgcgttttggcgttggcgttgtcaaatcactgtatgcgatggtgaactggctgacagaacctggtgatccggtcctcatcatgcagccggtttattatccctttatgaatgccattaatgatcttggacgtaaagtcgtatcagttgacttgcaattaaccgctgatggttggcgcatggattttgaccaattagaaaagaccttggcggcgaatgaaattaaagcgatgattctgtgttcaccgcacaatccggttggtcggatctggacccgagatgagttagaacaactttttgccatcacaagtcggtatgatgtgacagtggtttctgatgaaattcacggtgatcttgaagtgagtgggccgaagtttacatccgctctacaggtcgctgaaggtaaagctcgaaaaaagcttgttgtgctcaatgcgccgtcaaaaacatttaatttagccgccttgctgaattcacacattattattcccgatcaagcgttgcgtacgagttatgatgccttcattaagcagctgcatccggttgatacgagcttgatggggcaagtggccggtgaagctgcttatcggcatggcgctgcttggttagatcaggtcttacaagtggttcgctacaattatcggcaactgcaagcttgtttagccgcggcggcaccacaagcgaccctggccgacttacaagggacttatttggcttatgttgatattggtgcttatgttgcgccaagtcagatcaaagactttgttgaaggggtgtgcggattggccgttgattatggtgcatggttttcaccgcaaacggcaacttatattcgtttaaatttagctactgatcctaagcttgttgccgaggcgattaaccgactaaccactcatttggcacagcagccgcagcggtgatcgggacaagaattaaattgcctttttcaagataaaactcgaattcaaagagacggaatggttctccttgaatccgagcttttttaatattgtgctgcacaaaccagtttacttgatatgggacgtgttatcgaagcttgaggcgtaaatactgatcgcctagattgtgatcctgaacaatggttttcagatatcggcgtaacatggctgaacgttcaagcacggaccaaccggggtcggcatgcaaccgtttaagttcagcgcgacttggatgatcatttccggtgaaaaagcgccaattcaaaatacccattaatctggcagcggcgtcaagatcacgctgattggtcacattattgtccattaaatcaccataggctaacgcttcaccatcttgcagaaataattttttcaagtaacgctgatagtgcaagagatcaggattttttcgctgttttgcggtgagataaggcgtcaggtcggtgatctgtttttgataagtaatttgctggggaccaaacgtgacgaccccataactagcgggactaatagaaaatgcaccactgacaatttcgatagtcgggcactggccagctgggtcgcggctgatgtcttgagcatgaatatgcccggagaagactaagggcacgtgatagcgggttaacaatttttttaacgcgtcactgttgtctaaaacataaccttgattgacggcttcgttatgcgtgtatagattgtgatgcatgaaaataattgacttgcgatgcgcgcgggcacccagcgctaattggcggcgcacccaggtcatcgtttgcggagaaagcttaccacctgtattaggcggacgattagatggctcaatcgtgtaaatgttgctatctagcagcaataattggtattggtgattgagatttacgcgataacttagactgttcccatcttgggcagcagcttgttcataactgctgtggaagatctggcgccagtcgctggggctaatttgttcagtcaggcgttgttggcgtcccttataagcgcgggcccaaccgtcataaatatcgtgatttccggggatgattaacactttaatgccgtggtcaacaagcggttgtagtcggtgcatcaagctttcagcactggttttctcaccgttaaacgtcacatccccagtgataattaaggcggttggccgtgattttaaggcgttttgcactaatgcatgaatagcaactggttgataatccatatctttacccgcggctgatcgtttgatttgggtataggcgctgcgttcatcgtgcaaactaggcgcaataaaatgcgtatcactaagcacccagatgcgtggatgggcatcgtcagttaacggtgtttggtgatcagggtggatttgggttaatcctaatgcgagcaggaacataccaaacagtgctaccaaatatttaccgactttcattttctgcctccaaagttgattctaccatgacaaaagaccagcgccagattgacttatttaggtataagcattaattgccggatgcgaatttgggagtggaggactgcaggcagttgttgaaaatcttcgcagcttacttcatcggttatggtaaaataaagcatcgtttcaccgtatgaaccaaaataattgtttttaaagagaggaaagaatcatgcaagtcatcgtaaccgttattgggacagataaggtcgggatcatagcgcaggttaccactgcactcgctaatttagatgttaatatcttagatgtgtcacaaaccattatgcaaggcgcctttaccatgatgttattggctaaaattccggatgatgccagtttcaaaactgttaagcaacaactaacagctttaggcgacaaaatcggtgtggagatcaaagtttcccgtcaggagatttttgacgcgatgcaccgtctgtaagctggtttagtcataacgcgttcgccggcgcaggggtctgcgtgtaaggaccttaagcgcaatggccaagaagcgggccatcacgcttaaggccgcttacactccgacttctaagcgcgccggctcacgctcactataaaggagtagcttgatcatggagacgcaacagattaaagaaacaattgaaatgatcagtgaggaaaatctggatattagaacgataaccatggggatttccttgctggattgtgtgacgggtaatttacaaacaaccgctgatcatgtttacgctaagattatgaaaaaggcggccaatttggtagcggtggcggatgccattagtgatgagtatggcattccgattgtgaataagcggatcagtgtgaccccggttagtcttttagctggagcggatcaaatgcttgattttcggccggttgcctatgcgatggatcgtgccgctaaggatctgggcgtagatttaatcggtgggtattcggcattagtccaaaatggcagtaccaaggccgaaaccgcgctgatgaagagtttgccggaagtgttagcaacgacagaacgggtctgcgcttcggtaaatattggcagtacgcgtagtggattgaacatggatgccgttaagttgatgggaacggtggtcaaacaggtggctgatcggaagccgcaaaatgccatgaagctggtcgtcttttgtaatgcagttgaagataatccgtttatggcaggagccttctgggggatttcagaaggtgatgttgcgatcaacaccggtgtttccggtcccggcgtggtacagcgcgcactcgccgctgaaccggatgccagttttgaacaagtatgcgaaacaattaaacaaacggcatttaaggtatcacgaatggggcaatttgttggaaaggttgctgctgatcggctaaaggtaccgtttaatattgtcgatttaagtctcgcaccgacgccggctcaaggtgattccgtcgcccagattttagaaacgatgggtcttagccatgttggcacgccaggaaccactgcggcactcgctttgcttaacgatgcggtcaaaaaaggcgggatcatggctgctgaacgagtaggcggtctatccggtgcgtttatcccggtttctgaggacgccaacatgatcacagcagcggctaatggtcaaatcagtttggaaaaattggaagcgatgacggcagtttgttccgttgggttggatatggttgccgttcctggtgatacgccagatgcagcaattagcgggatgattgccgatgaagcagcgattggcatgattaacaataaaaccactgcagtgcgcgtgattccggtacccggtaagcaaatcggtgatcaagtcgaatttggcggcttgtttggaactgccccgattatggcggttaatgatggggatgccagtcaatttattaatcgcggcggtcgcatcccggcaccaatccatagctttaagaattaacccgctactttaaattcttagcatggaagcatttctgatggccggtttatttttttaataacgtactttgcagttgcattcgaaaaatgccttgcccgtctcatgattttatggcggcgcaaggcatttttaattgacggcgtaatctattcatgaggtgagaatgatgtttgtagcgttggatgaagaaaaccggcgagtcatattaaccagtcatgaacaggcgcaacaactacgcaaccgatcgttccattgtccaatctgcaaacaacacgttttgattaaaaatggtgtggtgatgccggcacattttgctcatcggcagcgatcagacaatgaaggagaaccggagagtgtcgaacacctgacaggtaaaagttggctggtaacctggcttcgattgcatcagcaggcggctacgttggagtactatgatgccaacattcggcagcgggcagatattcttgttcaccgtaacccgccaaaagtattggaattccaagccagtccgttaagtattcccgatttgaaaaagcgtaccacgatgtatcacgcgcgtgggtgggaagtcacttggattttaggacggcggtatcagcataaccgtggtaaaagacaggcacgaaagtttttaacgttggaagacaacttgttgacactgtggtatttgaattcgcaagctggcaaacttacacgggttcagctgatgccaaatggacgtctattgacttattatgttcagcggtgctctcctaaacaatgttggcaaccggaactggtagatgggttgcgtcagactaggcatatcggtttgtctttacaaaagcgagtaccttcatggctggcgcttcaggcgttagcatatcagcagcatcataacttacacggggttccatggattgtgcatcaccgttcacatccgctgcggcattttggcatcccggaattattgttaagggttaaatggttactgacgtttgaagggcggacgtttacggatcgcgacaatttaaacttctggctggcggcgctaccgaatgtctggacgccgttgttgccagcaggaaccctcggcacactaatcggtaaacactggttggaactgctacaaacagctgggtttattcggcgtgatcatttggggtatcgttggcgtcagttaccgcactggtttacggatattgatcacaaacttgttgctccatcatgcatcgtcccaagcgcaaagccctgagagaaaggactcagaagcaataacgacgatgggacagcgcggtcaattgcttcgttaactcctaagtgcgccggtttaagcgtaaaaaaaaccctgcataatcgcagagcccgctaaaaaccagtaaattttagtttatttgatgttgccgctagcaaaaaggttgggttaaaatccaactacaaaagttgcttcattcagacgaagactaagtgttggtgaaatcaaagttgcccatagttagaaaaatcggaaatgactgcccatgttttctggtcgctcagtaaagaagtgggagggatcggttcgaatgagctcgcaaaggcggggaataagatcaggatcactaatctgttcaattaaaacggcatgcccatcatcaactttgcgatcggtatcgacaatcaccaaagatggggtttgggtaatgcccatttgattagcagtgcgttgatcggaatcaaagcccattttgacttctgaccgttgtcgatcttcgtaaaacatctcatgatctaagtggcatttggttaacattttcgccacaaacgctgcatcgtattgatattgaactaaaggcgcgtgctgttgtagtcgtaacagcaacatccgggcctttttgtttccttgatattgggcagctttgtaatctaaagcaagattataagcagctcgcaataactggttgcgtttggcgaggctgtgaacatttaattgttcgcactgcataaactgttcgataatatccagatttaaaaccggaacaaagtgaactttgacttcctgttcgaatttgtccaactggtgtagcagcttttgttcggtgctaagacagacactgccaataggattgaaaaaaagaaagatttctaacacggtcatggcctccaatttgctggcaacaaatttctatacttactttatcagaaaaccgaaaagtaacaattatttagcttgtgaatcgtgcacatgcatgtatgcacgttgcaccttattaataacgggttgtttttttatgtgaaaatggcgtagtaaatcatcgtaaaatttttgcgctacagcaagattctgatactccatttccagttcaaaatcagaagtctggtcgatataaaaggtctgatcgagcgttaacaaaccagccggcaaatgggcaagtcttctggttgtcttggcttgggtttgaggagcaaccgttgccggatcaatcccccgggcagccagagcctgagtcacttggcctgatttgagctcgccttgttcgattagtttctgtgcctccactaaactcaatggatcggtgatttcttctaagtcgcgctgggtactttcattaggtactttaagggtttgttccgcatggtcggcaaactgacggatacgcaaaccaagccgcgctgctttgacagcaccgtcagctgtgtcataataggtgttcatttggctaaaggccggttcaaaatcaaaataattcaaaagcgctaagaaagcatttttgcttaaacaagttttgaattcctgctcgcgggaaatagacatgatttgcctccagaaacaacggcaccggttacatgccaaaaatatgatagaatgatggtcgtgagtgtcatatttagccaaagtcaacatcgcgtttagctgacgtggtgacgactagccagatggacatcacattatctagtagtttagtatgggagggccagtaatgcaaagggactgggacagtttcttaatgccatatgaacaagcggtcggggaattgaaaatcaaatttcgcgggatgcgtaaacaatttcaacaggcaaacgagcatacgcccattgaattcgtgacggggcgggtaaaaccggtcagttcgattatcgaaaagcaaagtcggcggtttatcagcgatgagctcctggaacaagacatgcaagacattgctggcctgcgcattatgtgccaatttgtggaagatatttaccaagtggttgacttgttgcggcagcgaaccgacatgaagattgtggaagaacgcgactatgtgaccaacgtcaagccctcaggataccgcagctaccatgtggtcatcgaatatcccgttcaattgattcatggtgaaaaaaagattcttgcggaagtccagattcgaaccatgtccatgaatttctgggcaacgatcgagcatagtctgaattataaatataatggcgagtttcccgatacgttaaaggcgcgactcaaacgcgctgctgaagcttcctttatgcttgataaagaaatgtcggatattcgcgaagaaattcaggaagcacaacatttatttgtctacggtaaaggccaacagccgtattcagatacaaccgatgactcaaagcctgatgataaaaaggatgaataagatgcgtgtgacagtttttcataacagcatacctgcttcaattaaagcagcgcagaaactacttaagttattaaaaaatggccattttgaactcgatgagcgccatcctcaagttgtgatcaccattggcggcgatggcacgctgctgtcagcctttcaccgttatgccgaccaattggatacgattcgctttatcggcgtgcatacagggcatttaggcttttatacggactggcgtgattttgaaattgaggatttagtcattgctttaaaagaagactcaggccaaagtgtcagttatccgctattagatgttcgggcgatttatgcagatgctacgagtgcccattatttggcgctgaatgaggcaacactgaagcgtctgaatggcacgatgcggacagaagtttatattaaaggcgacttttttgaaagttttcgcggggatgggctgtgcgtctcgacaccgaccggatcaactgcctatagtaagtcaaatggcggggccgtgattcatccgcgtcttgatgccttacaaattacagagattgcctcaatcaataaccgggttttccggaccctcagttcaccgattattaccgcaccagatgaatgggtcactttggaaccaaccgggcgggatgattatgtgatgacagttgaccagtttgtgattaatccgccgacgattaagcagattcgttataaaattgcaaaagagcgcattcactttgcccgttatcggcacatgcatttttgggaccgtgtggaggatgcgtttattggagcaaaacattaatgcgatttgaatggcaatacgagggaccgccgctcaaattggcggcttttttaaaacaacagggtttctcccgggcccaacttaaaaagctgcgttatcaaggcggctttatttttgttaataaacggcagcggcatacagcttatccgctgcgaaacggcgatcggattctggtccaaaccgcgcctgagcaagccgccgctagtgttgtcccgtatgaacatgaatttccgatttgttatgaagacgatgattacttggtcgttaataagcctgccggggtagcatcgattccagcagttggccggcgaaatgacagcatggccaatatggttaaggcatatttgattaagacccatgcagaaagtcaggcagttcatgttgtcacgcggctagatcgcgacaccagcggcttaatggtgtttgctaagcatagtttggcgcacagtttgctggatcggcaattgcacagcgagaattttttaaaacagtacttggcgctggtgacgagtaagtcattgctgtccgcacatggctggattatattgccaattggtgtcagcacaggattttacatgcgccgtgtcgtcagtgagaccggtaagccatctgtgactgaatatcaaacacttgcgcaaaattcgcacgccgccgcggtactggtaacgttacacacaggccgtacccatcagattcgcgttcattttgccgcgatcggacatccgttgtttggcgatgatctgtataatcggcaagctgatgatttcaagcggcaagccttgcattgcgcgcatttgcggttttggcagccgttgcaaaaacagtgggtcgatttgcatgcaccgttaccaactgacatggcaaagcttagcgaccacttgcatttaccagttgtttattaggcatggcgtcattgatgaaggggacactggcaagtcgtttggccgcatgaagactgagacatcatttgcagcttctaaataaaagtatcccattttcacgcgatcgcgaaaatgggatactttttatttttgccactgtcaggttaaaaattccctttatgatagccggaatcagcatcgaacttaaattgtttcttgagtccgttagttaagtaaatctttttgtcgttggtgataaagatggcttgaatgtgctgactgtttttggcattcatgtactgtaagccatccttgagccccttgtcaaaagcggcgtttgacaaggcatccccgtccacgctgtttttggaaacaatggtgaccgaggccagattgttgtcgtatgggtaaccggttttgggatcaaagagatagatatatttgtgaccgtgcgagattaggtattgctcatatgtgccggcagtgacgatggattcgttgctttccgggattgtcccaacggcagtaccgcgcgcggctgtcgggtcttgaatcccgacatgccaatcacgtttcgctccaagtggtgaatgacccatgaccacgacattaccgccaagatcaataatggcggcggtcaccccatctttacgcaagacttcgcgaaccttgtcggcaacccaacctttggcaataccgccaaagtcaagccgcatcccttttttggttaggtaggccgtgttgtttttggtgtcaagcttgacatcgcgccagttaacgagcggcaatgcttgggtgatttcgctttgtgcgggaacacgcgcaccaggcagcccgatttgccagagattggtaacagcaccgattgccatgtcaaaactgccatttgagtttttggagaaataataggccttttccagtagcggcataaaatcttttggaaccttgacaggcttgacaccggcattggcgttgattttatcaagcactgaaccgccacgagtcaaggtagcttcggcgtcaacatgatggatcatcgcaaaaccatcttttaaagctgactttttgcctttatcgtaaatggtaagcgtacatgttgtccccatgacgaattcattacgtgtatatggcgtttttagataggtcgcctgtgttttcttttggcacccggctaatgttaaaagtcccatgaaagcaatgagaccgatgaatattttacgcatgttacttaaccctcatttcatttttccctttaatatcataacgctcgttttctaaaaagaaaaacgcgactcgcctcactgtgatttagacgaaccgatattggccaagtcaggtttaccatcaacgaattacttgggtacattaaaaaggccgacctcagagacgaatttgtctctgaagccggcctttttagtgtcttgaataaacaaaaaaagctagaaggcgatcaatttggtgccatgaagctccttaacgcctaattgttcgctgatagtagcggcattttggctagtgatgccgccgccgggaagaatcgtgatttgtttttccgctgcatgggcgatcagcgcctgtagatgtggcaaggttgtttcaattggcgttgatagtgggccaccatgcgtcaaaatccgatcaacgtgatgtgcggctagccagtcaatggcggccagctgcttggtttcgggaatggcatcaaaagccatgtggaagacaacactcataccggcgcttgctgcgatcaaactcgtcatggcatcttcatcaattgtcccgtccggcagtaaggcaccgaatgcaacgccatcaacgccaagtgcctgcgcctcgaataaatcggcttccatgattttcaactcggtgtcattgtaaacaaaattgcctccgcgcggccgaatcatagtgacgaggctgcgaccatgttcatggacatacttggcactttcagccatcacacctttggaaacggtcgtcccaccaaccgccaaattatcattgagttcaattcgatcagcgcctgcagcaagtgccttgggaatgtcggtatagttttcaacagcaacttctcgtaacatggtaacctcctgtcgttatttaaagaaacatcacaagtaacacgatggcacccagaatgattcgataccagccaaacggtttgaagtcgtgcgtttggacgaatttaagcagccatttgatagcaacgatggcgactaagaaggacacgactgagccggttagtaacacaacccattgctcgccggtaaagccattgccttgcaacaaatacttgccaatttttaagatagaaacgccaaccatggtcggaatagccaagaagaaagagaactctgtcgcaacatagcgcgatgtcccaatcaataaggcccccaaaatggtggcaccagagcgggaagtccccggaacaattgacagaacctggaacaagccgattaacaaagcggtttgataggtgatgtcggccaaacttgtaatgtgcgcctgcttattcttgaggtaattttccaaaacaatgaataaaaccccgtaaaggatcaaagtcgttgcgacaacgagtggtgtatgtagatgtttgtccatccagtcattgagcggtaagccgacaacgacagatggcagcaccgcaatgatgactttggcccataactgccaagtatctttttgcgcctggacagtcggtttggaaaatgggtttaatttattgaagtaaagcaaaataaccgctaagattgccccaaactgaatgacgtattcgaacatgttcataaattgccgtccttgcgacaacttaacgacctggtcaaccagatcaatgtggccggtggagctaatcggcagaaattctgtcagcccctcgacaatgccgataatcacggccttgataatatcaaacataataaccctccaattctcaatgttaacagtatacaaggttttatcctacttgccatagtgcaaatgcaatttagcgagatcttatataatctgtgtggttaatggtgaactgatttgtggcaagcaaaaagcggcttaagcaaattgcgttaaagccgctgttaaaagatctgatttaaagccgcttttcagtttgaaagtcggctatttggttgccagaaacaaaacgttaacggcttccggagttggaatatcgcgctgttcttcggttagcagcccggttttagaatcccggctgtataaagtcccgttgctagtgttttgattaactgccaagacatagcgttcggtgaggtcgaagttgaaatcacgtggaaaatcgccggcggtactgatttgttgcagttgtgataagttgcgaccatccggactgacagcaaaaacggttaaactattgaagccgcgatttgaaacatataggaaccgttgatcactgcttaggcgaatagctgcggcaccattatgatccgtataatcttccggaatagtcggtaaggtagcaataagttcaaaacttccggtggcagcatcatagcttaagatgctgacctgactcgagagttccccaagtaaataagcaaccggattgttatgattaaatgcaatatggcgcggaccaaacccaggttcagcgtggaagacaacgggatcgccaagcttgccagcatcactaatcgtgtaagtggtcaaagtgtcattaccaagatcagcgactgccaagcgttgaaaatctggcgtcacggcagcgaaatggacatgggcgccgtcttgttccggacgcggaccgttaccggtgtgcacaatttcgtctgtcgcagttaagctatgatcacggttgatcttatagacgttgatgcgcccttcatgataattgctcgcgtatacaagttgacgattttcatcgattgagatgtgggcaggagaagagccgggttgtaaaacgcgattaatcagcttaggaggattaacgttgagatcataactggctacaccgccttgatccccttcagcatcaaccgcatataaaatatggtcatctgaaacggctaaataagtaggggaacctaaatcggtaatatacggttgcggggcagttaattggccttgtgtgtcgtcaaacgtaccagtataaataccagcaccgccgtgacgggtataaccgcctaacaagagtctttgtttcatagacaaaacgctcctttcgaatttgctttgagtatagcatgttttggggatgcttatgctatgatatagagcgtgagccgccccaacatagctggttaacttgctgccagctgtccttcaaagcagcggcttatctgtcacttttcgaggtacagcaagaccgacaaaaacgaacgtaccgcatcttttttagtactgcgatataggcttaaaaatatcacaagtaaaaacggaggcaacaacatgcaatttacggcaacgatcactgccattggtaaagacgctttaagttcaaaagatcccatgattattttatttggcccggaagccacagatgcactgcgcgatgttgcagtgattcagcagtttgatgatcccgcggccttatcccaattctccattcaggcgggggatcggctgacgattgacgggacagctttcaccatgacttacgtgggccagttagccatcagcaatttgaagacaatcggtcacgtcaccttattattccaagacgtaccagccgaaaagccaatgcaaaatgccatttatctcaaacccacccaacggccggcatttcgtgttggaacaacattgacctataacacgcaagcttagcggttgttaattggatattaaaaaacacctgtaatgacaggtgttttttttaccatgatgccttgcgaacaccgggaatttgacctttgtgagccaaatcgcggaagttcaagcgtgacattttgaatttacgcatgtaagcatgtggccgaccgtcaagttcatcacggctgtgtgcgcgaacaggggaagcattccgcggtaacgcctgcaaagcagcataattatgctcggccttgtacttggcacgcagcggagcgtacttggcaatcgtcgcttcgatctttttttctttggcaatctttgacttcttagccatctatgcaatcactccttgtttgtcgtttgtattggatactggtattcgaacagttcaacccacatagcatagcacagcaataagtcactcgcaacacttacaaaagataagcggttagtattgatcaccattgaaaatcgagtttttgacaatgacataatcgaccttggttaaagcttccagatcgcgaccaccggcataggaaacagcggattgtaaatcttcttgcatttcctttaatgtatcgccgatcttacccttaactggcagcaggatttttttgccttcaacgttatgatgggtgcctttttgatactcggaagctgaaccgtaatattcctgatattctttgccatcaatggtgacgtgcttaccaggcgtttcttcatggcctgcaaatagagaaccaatcatgcacatggtggcaccgaagcgaatggacttggcaatgtcgccattgttacggataccgccgtctgcgatgatgggtttacgcgctgctttagcgcaccaacggacagctgcaagttgccaaccgcctgtcccgaaaccggtcttgagcttggtaatgcagaccttaccgggaccgatgccgactttcgttgcatcggcgccggcattttccagttcacgaacagcttcaggcgttccgacattaccagcgatcacaaacgtttttggcaaatagtgtttgatatgctgaatcatgtcaatgacgatttgggcgtgaccgtgggcaatgtcaatggtcacataatctggcgtcaaatcgttagcagccagcgcttcgataaaatcaaattcttcatccttaacgccaacactaattgacgcgatcaaaccgcgctttttcatgtcgcggacaaaatccatgcgccgctctggctgaaagcgatgcataatatagaagtaatcgtgttcggccagccagatcgccaaaggttcatcaatgatggtctgcatattggcaggaacaaccggaattttaaacgtgtgtgggccaaatttcacgctggtatcaacctctttacgtgagcgcaccacacatttgttgggaatcatttgaatatcttcgtaatcaaaaatctgcatgccgttgttcatcggattcatcctttcgcaaaagccgaacattgttaagtattattggtgttattcaaaacaccaagtgctaagatacgcgattaaaatgtaaaagtcaaccaaaatactttcttttctttttaatgttcgtgttttgcttaaaaataagaaaagccgggacatcccggccaggtagcaagtggattagaaaaatttgtttcgccaaaattgaaaggcaagaaccatcgcaatcgcaattgaaatggcaatcgtgatgatccagctcaccttcatatctgctagtggcaagtggacattcatgccataaaatgaaaagaccaacgtgggaatggtcagtaagattgaataggatgtcagaaatttcatgacgccattcatgttattgttaatgattgacgaataagtatcagccgtttcgttaataatggaattgctaatctgcgccatttcaaccgcttgctgattttcgatgatggtatcttccagaagatcctgatcatcttcgtttagatgcaatgggttggtgcgtttgagttgttccaggacattacggtcggttcgcagactcatcataaagtaaaccaaggagcgttgaatgcccattaatccgtaaagttcttcgttgcgcaagttgcgttgaagtttattttcgttggcttcgcgggctttgttgagatcgcgcaggtaggtcaggtaactgatcgagatctgatacagtatctgtaagacggtgcgattttgatgttgcggattgaagttgcttattttgccttccgaaaaaaggctcagcaacggtatcggttcttcgttaatcgtaatcaccgcaatatttgtaataataatggcaagcggagccgtttcataaactactttttttcgggcgtcacgggtaacaacgggcatgtcaaaaataaacaagtggctgtcattgtcttcatcatactcataccgtgcgccttcatccggatcaaggccatatagtaggaatgcttctgatagattggctttagtctgcaattgttcccgttcttttggggtggggttgaccacattgatccagacgccgggactgatccgcgattgtggatttagccggccggttttgtcatcgaaacgataaattgaaagcatggcagtctccttggctttttctcttagtttacaacaagcggccaagctatgcaggaaggaaaatcatgcgaaaacgtgaagcaaaaattgaattggcggctcaacaaacgcctttatttgcgtgtccggtgtgcgctcagccaatgcaggtcaaagccggatcgcttatttgttctaaaggacaccggcgcgatttcagtcgtaaagggaccgtgaacttcttgaatcaacaagtcgcgactgaatatacagctacgatgctagcagccagacggcgaatgttgacggcgggattgtttacaccgtttttggacgctatggcagctaaattagtcccgcatcagcgcctattagatgttggttgcggtgaggggacaccaactgcttacttggctcaccaaaagcaacagatggcagtcggtttcgatatttcagcaccggcaattaacttagcgggtagtttggcagcgccagtattatttgccgtggccgatttggcgcacctaccatttgtcaacgatgcttttgacacggttatcgacattttctcgccaggcaactaccgggagtttcggcgcgtattacgaccaacaggacagctgctgaagattattccacgcgccggctatttaaaagagttgcgtgaagggttatattctggaacacgtaaggctgaatatgataaccagcctgtgcgtgaacggtttttagcagcgtttcctcaagcaaccatccaatcaataacgtatgattttccactggttgcagatcagtttaccgatttgatgaccatgacgccactgtcttggcaagcaccggctgaacggcgccaggtaatgttaaccaatccgccaaaaagtattcatattgaggttgatttactcaccgtttcgaatcttgtcaagtaaaagggttgaaaacaggaataaccggtgttaatatgcttttaagctatttatttcgggcttttatcagggctagcttttgggtaattgataaaagtttgcgataaattacttcactaacgtatcgcttcgctgagtgcgctccgaagcaatgcgtttttttcttgcttaaaatcaggttggcgccaagtttttgctttgtaacgcgcttcccggtgcagggatctgcgtgtaaggacctgagtcgcaatgaccaagggcgggggacatcacgctcggcgctaagtccgcctttacgcccataacgcgttcaccggcgcaggaatctgcgtgtaaggacctgagtcgcaatggccaagagcgggccatcacgtctcaggccgcttacactccgattcctaaccgcgccgattcacgctcactgcgggttggtgttaacacaatagaatgtgctacactgaaagcacttgtgttgaagggacgataacatggcgaatcatattgttttatttgaaccgttaattccagcgaacactggtaacattgcgcggacttgtgcagcgaccaatagctatttgcacttgattaagccattgggatttgagactgatgataagcatttgcgccgcgccgggttggattattgggccaaggttcgaattgtctatcatgatagtcttgatgacttcatggcaacggtcaaggatccgcagcatttgtatctcatcaccaaatttgcagatcaaacctattctgatcgcgattacaccgatacgcatgccgaccactatttcctttttggcaaagaaaccactggactgcctgagggatttatgcgggaacatgaagatcagtgccttcgtatccccatgacggcaaacgtgcgcgctctcaatttatccaattgtgcagcattagtggtttatgaagctttacgacagcagcattttgccggactggaaaccgtgcatacctatgaacatgacaaactaaagtgaaaatacgctaggaggcgcaacccatggaagcaaaacgttatccgattacggttgaatcatttcattatgatctcgtgaaacaaggaaccccagtgaagaacgatttacaggtagccatgcgtcagattcagtggtctgaccctaagaaacaggcagaattaaaaaaaggcaatctttttgaaatgatgattccctttgacgtggtgcctgacaatgccggatttgaaatttccggtaagatcacccaaattgttcaggttatggattatttcggtgaagcaaatgagctgccacaagaagaactgggcaaattgagtcggccactggttgaaaccattgaaaccttaacctatcaggtgacagcggtagccttggatcaaggcgttaatcttcagttcggcgcaagtgacgaacaacctggccaagcttaagcaggtagtgaataggaaaagatcaaaaaggcggccggaaagctgccttttttgctgagcgcgagccggagcggttagaaaccggagtgtaagcggcctcagacgtgatggcccgggcttggccattgcggctgaggtccttacacgcaggtttctgcgccggcgaacgcgttatgggcgtaaaccagaacataagcagtctcagccgtgatggccaggttttggccattacgcccaaggtccttacacgcaggctactgggctggcgaacgcgttatgggcgtaaaccagaacataagcggccccagccgtaatggcccaggctttggccattgcgcccaaggtccttacgctctgacttctgcgccggaaagcgcgttatgcccaaacataaccccggctattgtaaaaaccggcataacgacccaccgcatatctcaaaagaacatagcaaaatcaccgcagtggctttttaaatgcgggctcagctcgtgtataataggcaggaatgaaaggagcatgaccatggcacaaaaacgtggcgggcgcaggcgaccgcgcaaaaaacgaccaactaaacagcaacagcacaccttaagttgggttggcgcgctatttgtcgtgttcgcgagcctggcatttttccgtctcggcattgttggaacggtccttgccaacgtttttcggttagtagttggcgatagttttctggtagtcagtgctgcgactgttgtgaccggtatctggtttttattggcagatcggttgccgaagttggcgcggcatgtctggatcgggttaagtatcattctgatcgccgcactggttttactaacagcacaggcaatggcgacactgaatgtccacagtcattatttgctagcgacttggcacctgttgcaaaatgattttgggttaatgacaaccgcgtcacaagtcggaggcggcttgcttggtgcaggactttttgcgttgttggcgccattattaagtagcttaggcgcaaccattcttgcgtggtttggtgtcattgccggtatcctcgtgtttttgggggtgggcgccaaccaggtttttaactggttgcaagcttttggacaggcttgcaaacgtggattgattcaggtatctgatcacataacggcgctaaaaaaagcagatgctaaaaaggctgccactcgtccaacatcgacgccagaagctgcaacggatgctgctcacacgcaatcagaaccatcatcggagcgagccgatgacttcacgattaaggggccaactccggttaaaccgttgccgcaaagtgaagcgcctgccccaacgaaaccagcaagtgccgcacctgtgagtgagtcatctgctgccactgcgcaggtgcccgccagcaagctggacgcagacatgccggcttcagactatcagttgcctagcctagccatgctgacggcgacaccgcctgtcgaccaaagtgcagaatatcaggcaattaaaacgaaccgtacaaaactgaaggaaacttttgaaagctttggggttaaggtgggcgttaaaagtgcgacattagggccgtcaattacgcaatatgagattcagcccgcggtcggcgtaaaggtttcaaaaattgtgaatctatccgacgacttggcattggctttagctgcaaaagatattcggattgaagcaccgatccccgggaaatcgttaatcggaattgaagtgcccaatcaacatattgcaacagtcgggtttaaagaggtcatggcggagacgcctaaggcaccgaatcatcccttagtgttaccacttggccgggatgttaatggtcaagtggtcacctttgatctaaccaaaatgccgcacctactaattgccggcgcaaccggttcaggtaagtcagtgatgatcaatgtgatcctgacgagtatcttgatgcgtacgaagccaactgatgtccggctgatgttaatcgatcccaaacgtgttgaattgtccgtttataatggcgtgccgcacttattgacgccagtcgtgaccgaagcaaaaaaggcgccaagtgctttaaataagattttaaccgcaatggatgaacgctaccaacgatttgcggcagcaggcgtgcgtaacatgaaagaatttaatcaaaaagtagcagcaaatcctgccagtggtcagtccaaaatgccgtatatcgttgtcattattgatgagttaagtgacttgatgatggttgcgggtcacgaaattgaaaccgccattgtacgactggcccaaatggcgcgcgctgccggcattcatgttatcattgccacacaacggccatctgtggatgttatcacggggttgatgaaggctaacattccatcacgtattgcttttgccacatctagcggcattgattcacgtacgattcttgacagtaatggcgcagaaaaacttctgggccgcggtgatatgctgttttcaccgattggcgcttccaagccattacgagttcaaggtgcgtttatcccgtctgttgatgtagaacgggttgtgaaagctatcacggatcaagtggcaccagcttatgtagacagtatgacgccgactgaaaatgttgaaaccgagcaacaaggggattctgaagacgagttgtacgatgatgccaaggcatttgtcattgcacaacaaagcgcttctacatcaatgctgcaacgacgctttcgaattggctataatcgtgcggcacgattgattgacgatcttgaagctaatcagattgttggccccagcgaaggcagtaagccccggaaagttttcgttacaccaacagatgggaatcagtcatgagggagactatgcaaaaagaaatcaagccgggcgtttggcttatggttttgccaaccacccaatttaaaactactcggatcaatattcagtttttaaccccattgcggcgagatacggtcacaaaacgaacgttgctgaccagtcttttggagacaaatagtcaggagtatccaactcaggcagctatggcggcccatttagagtcactttacggtgcaaacttcagtattggtgttgcgcgcgaaggccgactgcaccgggttggggtgacaatgagtactgtggacgatcggtttacggatgcaccgttgttaccaaaggcagcagcgtttttgaagacggttttgttttcccccaactttcaagctgggcaatttgacgcggcaacttttgatcgggaaaagcaaaacttggatcactatctggccagtttagatgatgatcgtcaaacgcaggcagcattgggtgtccagcgtctgtatttcggcgttgatcctgatcaggccatccccagctttggcacgcgtgaagatcttgcgccgatcacgacagcgagtttaaccgcctattaccaccaaatgatcagtgaagatcaagtcgttatcaccgttttaggcgatgttcaggctgaaaaagtggcggctttgtttgctgattggccactggcggcgcgctcgcaaaccacccccgcgattgcatttaatttaccggagcatgccgaagtcgtcagccaaaccgccaaagtcgttgcccaacaagctaaatttgatcttgcctatcatgtcagcacggatttgatgggtccaaagtatgcagctactttagtggcagaagaattgtttggcggttcaagtttgtcattgctcttcaccaacgttcgcgaaaaggccagtctggcttattatgcgagttccatgttggatacttttcgcggcttgatgttggttcaaaccgggattgaaagcaaagatcaggcgcgggttgcggatttgattcagcagcaactggcagccattgtgcgcggtgatttttccgatgaccggttgcaggcgattaaagatggcattttggatcatcagcgtgcagcgtatgatagtccgcggtttttgacaaatcaggcgctgtatcgactgttagtgccggacgcaccgcaagactttgaaagctttgctagccgaattcaggccgtggatcggcaggcagtgcaacaagcggctgccgcgatgaaactgcaagcgacgtattttctgactggggaggacagcgaatgaagacacaatatttccgtgatgttgatgaaacactcatcacaacgacgctgcccaacggtttgcgcctgcaagtggtgccgcgcccggcgtatcataaaagttatgcgatcatgaccactgattatggtgcgattgatacgcgctttgcaccggacggcaagcagatggtgacttatccagccggtatcgcccattttttggaacataagttatttgaaaaagaagatcatgatgcatttgatcttttcggcgagaccggtgcgtcagccaatgcgtttaccagtgcgacaaaaaccagcttcttattttccacgaccactcaattaaataagaacctgcaaattttgcttgattttgtgcaggcaccgtttttttccacggaatcggtggctaaagagcaaggcattatcggctcggaaattcaaatgtatcaagatgatccaggttggcgggtgtacgctggtttgctggaaaaccttttccccaatcatccagcgcatgttgacgtggcagggacagcagcaagtatcgctcagattacgccggagatgctttataccattcaccgcgttttttatcaaccaagtaatatgaccttggtgattgttggcaatattgatgcggagaatgtgattgattttgttgctgccaatcaggctcaaaagacatttccaacgcgacagccaattgtgcgaggcgttgaagcagacgtgcaaacagcagatattattccttatcgggagttgaaaatgccggtcagtcgtcccaaaacgctggttggctttaaaggacaggtggcaattccgcagacggctgctggttggcggtatcaattaagtattcgcctattgctggaagttttgtttggagattcatcgcagctttatcaagcatggtatgatcgcggtttgattgatgactcgtttgattttgattttacgaatcagcgtagttttagttatgggcttgttggcggcgacaccgatgatcctcaaggcttaagcgccgccattaaggaagtattggcacatgctgcggatcaggctgatttgaatagaaatcgggttgcgctaattaaacgcgcgtcactcggcaaatactatgccggactgaatgggttaaatggcgttgccaaccaattaagcgccttaagctttggcgaagcgtctttgtttgattttccgcaaatattaaacaggattaggtttgaagatcttgagcagttaattcctaaactttttaatgctgaagctttaacggttttgacaatgcttccggagggaaaataatgcgatcggctttaatcattggcgcttctggtgatattggccaagcggtagcagcaaaattggcggcagcagggtggtcgctttatctgcattactttaagcatgagcaagttgtgatggatcaaatgagggcttatcaagcagcatatccgcatcaggactttattccgttacaatatgatttgacggatgaccgtcatctagacgaactcacaaatcaactttttagtcttgatgctgtcatttttgcagccggcatgacctattatcatctttttaaagaaaccacggtccctgagatgacgactttgatgcgggtccatttgttaacgccgatggttcttttgactaaagtggagcgtaaattggcacaatctggtcatggacgcgttattttcattggatctgtctatggtggtaccggatcagcgatggaggtggcctatagcacggtcaagggagcgcaaagtgcctttgtgaaggcttatgcacaagaagttgccagtcttggcattaccgtgaacgttgttgcccccggagccgtcaccaccaaaatgaatacaaagatgtttgactccgatacactcgccaaagttcaggcagagattcccgcggctcggtttgcgaccccccaggatattagttactatgtcagtatgctggttgccgaggaagcggcttatctaaccggacagacactgtacgtaacaggcggctggcgcatgtagtaaacaaaggatttcttaaggctttcagacggtttttcatgctatactaaaaatggttaataaaaaatagcgggtgaagaaaacatatggatgaaattgggcaaaaattacgggacgcccggattgaaaaaggctataccattgatgatctacaacaaattaccaaaattcaaaaacgctacctgattgcgatcgaagaaggtcatttcgatgcgttgccaggcgacttttatgtgcgtgcctttatcaagcaatatgccgatacggttgggcttgacggggatgaattgttgacgcaatttcagcaggatatcccggaaccgcaaccccaagaatacgctgcacagtcagttgaaaataagactcgggcgacccgcgccgaagaagcgagtccggttaaccgtttgcggcgctatcttccgcagattgcgattgctgcctttgtgattgttgccatcatcgtcatttatgtcgtgatgctattttcacaatccggaccgaaacaaacgattcccgcggattccgagagtgttgcggtttcgtccaagcgcagtagttctaaggcatcgaaatcatcaaaaacctcatcatcctcgaagtctagcaagtcttctgcatcaagtagttccaagtcatcagaaaaggcatctaaagaaagcaaaaagaagagtgacaagctcgacatttctgttgctgcggcaaatggtgctactcaggcagttacgttgaagaatttgccgaccagcgggaataaacttacactcggtgcaaacggggcgaccgcttggatttcagtcattgtcaatggttcgacaacttggcagggttccttgacatccggaaatacacaagaggtgacattaccagataatacgtccaccttccaagtccgctcagggaatgcgactgctacaacgattgagttgaatggcaagaaggttgacatttcaaacggtaccagtgttgttcggacgattaccttcacaagcagtacaagtgaaagtgaggcttctcaagaatgaatctccctaataagttgacgctgattcgcattttcttaattcctgttttcactttgttattggcattcaattggccagctggttatctgacaattgccgggacaaaagttgccatgagctggtttatcgccttgatcatcttcattgtggcttcacttaccgattttgcggatggtcagattgcccggcgcaaacatttagtgaccaattttggaaaatttgccgatccgttggccgataaattgttagtcatgactgcatttttgttcctgacagcagctggacagattccggcatggggaacggcgattatcctatggcgtgagttagcggtgacgggattgcgactattgctttccaatgaaggagaggtactggctgctgcttggcccggaaagattaagaccaatacgcaaatgtttgcgatcatctttttgatgctcaataacgcatggttcaacaacattaacattccgtttgcgctaatccttttctatgttgcagtgttcttcacgatttattctggcgtggaatatttttacaagaatcgcggcgtttttgcagattcatttggatctaaacagcagtaatatcgtttttttacccaggctgatagcttgggtttttttgtgcccgtcattcggcgcaaaacggaacgggtagtaaaataaaactgaaccttgttgggcttggaggcattgtttatgttaatggttgggtgattgcagcagattggcagcagaatttttgaatattgagtgaatgcattaaagggcagatgtgctaaacatcgaattctattgttaggtgggaaaaatatgcaagcagaaattattgctatcggaacggaaattctgatgggacaaatcacaaatacaaatggcgcgtatatggctaaacaactggctacattaggtattgcaagctatcatcaacaggttgttggggataacgcaaaacgactggctgacgcgataagtttggctgaacaacgcagtgatatcgttattttgattggcggtttaggaccaacaccggatgatttaacgaagcaaaccctagccgcacacctgaatttacccttggtggaagacgctggcgctatggccaagttggctgcgcgggttaaacaacagcaacgtccaatgacacccaataatcgcttgcaagcgatgtatcccaaaggcgcaatcgtattggccaatcgtgttgggttggcggtcggcgcatgggttgagcagcgccaacacgcctatgttttattgccgggaccacctaaagagtttgtgccaatggttgatcatgaactgttgccacgactggcaaaatatagcgggcatcaagaagttttggaaagtcgcgtgatgcgtttctttggtgtcggcgaatcgcaacttgtgacagatttaagtgatttaattgccaaccagacgaatccgacacttgcaacttatataaaagatcatgaggtgacagttcgggtaactgcgagtggcaaaacacaagcagaagccgcggcaaaacttgagccaatgatcggcatcattatggatcgtgaaggccgctacttttacggctacggtgacgataacagtcttgctcaggaattagtcaaagcattggcggctagtgataagcaaattagtgccgctgaaagcctgactgcaggtgcatttcaagcggcattgggagacgttccgggagtctcggcttatttcaaaggcggcttcgttacgtacgctttagcgacaaaagctgcatttttaaatatcgatgcccgtcagctagcagaacatggtgtggtgagtgaatttactgccaaagcaatggcagagcatgctcgtcaacgagccgcggcagacattgccgttagttttaccggagttgccggtcctgacaagctggaaggacagccagccggcaccgtctggattggtttggcgcggttaggagagaaaccaatagcacaagtttatcattttccgggtgggcgaaatgacgtccgcaagcgcgccgttatgacggggatgatgatggtgttgaagcgtttacgcgaataacagcaaatagttgtggatggaacaagctcattaaacaggaggcggtaagagatggcagaaaccgaacgacaggaagcattggcaacggcgttaaagaagattgagaagaattttggcaaaggggccattatgcggatgggggacaaagtggagacacgcgtttctgctgtttccagcggatcacttgcaattgatgatgcacttggtgttggtgggctgccacgtggacgaattgttgaaatctatggtccggaaagttccggaaaaacgactgtggccttgcatgcagttgccatggttcagcaacacggtggcacggccgcttatattgatgccgaaaatgccatggatcccaaatatgcagcggcacttggcgtcaatattgatgagctgttgctttcacagccggataccggtgaacaaggattggaaattgccgatgagctggttgcatcgggagccattgatattttagtggttgattcagtggcagctctggtaccgcgcgcagaaattgaaggggacatgggtgatgcacacgttgggttacaggcacggctaatgtcacaggccttacgaaagttgtctggggcgatcaataaaaccaaaacaattgccttgttcatcaaccagatccgggaaaaagtcggtattgtattcggcaatcctgaaattacgccgggcggtcgggcgctgaagttttatgccactgtgcgtatggaagtgcgccgttctgagcagatcaaaaacggtgccgatattattggcaatcgcaccaaaatcaaagtggttaaaaataaagttgcaccgccgtttaagactgccattgttgatattatgtatggtcaaggcatttcccaaagcggtgaacttgtcgacatggcggttgaaaaagacatcattgaaaaggcgggttcgtggtatgcctaccaaggcgagcgcattggtcaaggacgtgaacacgctaaaagctatcttgaaacgcatgaggagctgcgccgaaccattgaaaaacaagtccggcttgcttatggaatgtcgccggatcacgttatcgatcaagcggacacggagacagatactaccacatctgctgcatcatgactggttaaaaggggtgcttgttgtgctgcgagcgaatcgtgtgtggaaatggctcacgcttttcataacgcgctcgtagtcgcggcaatcgaagtgtaaggaccttgatcgcaatgaccaaagcccggccatcacggctgaggccacttatgttctggcttacgcccataacgcgctcgccggcgcagaagtctgcgtgtaaggacctcaggcgcaatggccaaagtgcagccattacgcctgaggccgcttatgttctggcttacgcccataacgcgctcgccagcccagaaacctgcacataaggaccttggtcgcaatgaccaaagaccggtcatcacgcccaaggccacttatgttctggcttacgcccataacgcgctccccggcgcagaagtctgcgtgtaaggacctcagtcgcaatggccaaagtgcggccattacgcctgaggccacttacactccgacttctaagcgcgccggttcgcgctcactaaatttgcctccagttgacaccttgcaggccagcacgtaaactaatagaggtgtaataatttaaaaaaagcatcaaagattttgatcaacttgatgattgaatcgcttagatgatgcggaggtgaaatgatgagttcagtaacactggtctcaataaccctcgcagcagtcatcgctttagcggtcggtttattgatcggatttgcacttcaaaagaagctccaccagaacagtttggatcgagcgacgcagacagcagaaggtatcattgaggccgctaaaaaagaagcagcgactttaaaaaaagagaaactgctagaagcaaaagatgagaatcatcgctatcgaacccaacttgaagacgaattgaaagatcggcgggcggaagtccagaagtcagaacatcgactgaaccagcgagaagatactcttgatcggcgtgatgacacgcttgatcgtaaagagcagagtcttgctgaccgggaagcaaatttgaacaagcggcagcaacagttagatgaacgtgaacaagctatctcttctgaaatcagcaaacaacagacagaactcgaacgaattgccgagctaagccatgagcaggctcggactcagatccttgaccagacacaatcagaattgacgcatgaacgcgccgtgatgattaaagaaagcgaagatgaagcaaaggaggccgcagataagaaagccaaggtactgattgcggatgcaattcagcgcagtgcttcagatatcgttgccgagacaacggttacggttgttaatttaccaaatgacgacatgaaaggccgaattatcggtcgtgaaggtcgaaatatccggacacttgagactttgacggggattgacttaattattgacgataccccgcaagccgttgttttgagcggatttgatccgattcgacgggaaatcgcgcgaatcgcgttggagaagctcattcaagatggccgaattcatccggcccgcattgaagaaatggttgataaggcacgcaaagagatggatgaccgcattcgtgaaatcggcgaacaagctatttttgatgtgggtattcataacatgcaccctgacttgattaagattttgggtcgcttgcattttcgtacgagttacggtcagaatgttctggatcattcgattcaggttgcaaagctggccggtgtgatggctgctgaattaggagaagatgttaccttagcaaaacgcgcggggttattacatgatattggtaaggcgctcgatcatgaagtcgatggatcccacgttgaaattggggtcgagctagcaacaaagtacaaagaaccaaagacggtgattaatgccattgcgtcccatcatggtgacgttgaaccaactagtgtcatttcggtactagtcgccgccgctgatgctatttccgccgctcgtccaggcgcgcggtcggaatcacttgaaaattacctgcatcgcttagagaaattggaggctattgccaacagtcatgctggcgttgaccatagtttcgcgatccaggccggtcgtgaagtacgggtgatcgttcagccagaaaaactttctgatgatcagagtgtcattttggctcgcgacattcgcaatgaaattgaaaaagaattagagtatccgggtcacatcaaggttacagtcattcgagaaacccgaaccgttgaatatgctaaataagtttgcagttaggccttattaaagggcactatatgtaaaccaaaaagatccgcaagcggtaattgagcttgcggatctttttgcgtttttaaggcttgtgaacttctgacgtggcatatgggacctcacgatactgacttgtaccgatctgtgggtcaaattggccgtgtaggaaatccttgattaaggcgaggttcttgtctaactggtcagcatcaagatgtaacgtcagtgtcactgctacgccataatcaatggttgcgattgtgaggttgtgcgtttctaaaaaatgctgcagtggattaagatccgcatatggaatctgaaaagtaacagccttttgcttaattcgggctacaatgccaattgtttcaattgcggcgttgacattgccggcataagcgcgaatcagaccgccggcaccaagcttgatcccgccaaaataacgcgtcgtcacggcgagtgtatcgcgaagttcatgttgcaagaggccttcaagtgtcggggagccagcagttccggatggttcgccgttatcgctggcccgctggatttggttttcgttaccgagcacgtaagcaaagacattgtgatttgctttggcatgctcgtggctgatgcgatcaataatagcctttgcctcgtcttcatcatgaatacgagcgaggtgggtgatgaaacgagactttttaatgatttgagtgtaatttccggattcttttatggtgagatatggcttcattatgcgtaatctccttttgaggtgatgaaaatggatctggcaggtgcccaactcacacagcgtgaactggcgcgtttagctgtctctaatatatcacacgcaactgttgtgccggcattggtaaaagaccatcatcagtggcaatgtcagcgatgttgcagccgaagacctgttgcactgccagatggccgaatttattgtccggagtgtgttgctttaggacgactgaccaatgccgatcatctttatcggtttgaacaggcgcatctgccggttggtgatggtcaattaacctggcatggtttactaacacctgatcaacaggcggcatcggatgcattacaggcgagtgtcgcagcaggtcgtgaacatttgatttgggcggttaccggggcggggaagactgaaatgctttttccgactattgcccagctgatccagcagcaaaagcgggtggccattgtttcaccacgaattgacgtgattcgggaactggcaccacgatttcgaacggcatttgcaaccacacccatttccgtgcgttatggtgggcattttgatcaaacggatagtgatttgctcttagcaacggttcatcaattattacgcttttatcgggcatttgacttaattgtcgtagatgaagttgacgcgtttcctatgcgcggaacaccaatgttacatcaagcagtgaggcaggcacgccgcggctcggttgcttatttgactgccactcctgatcgtcaattaaaacaggcaattcggcgggggcggcttggggttagtcgactttttcgccgttttcacgggcatccattaccggttcctcggattcaattagtgaacttacggcatgtgccccattcgcttcccaaagcagtcattatgtgggtgcagcaagtgctagcgactaaaagagtctgtctgttgtttgtgccgaagattagttgggcagaacaacttgccggtaagttgcgccaaatagggctaaaggcggctggtgttgcgagtactgatgcgcagcgggcggaaaaggttacagcatttcgacaaggacaattggaggttttagtgacgacaacaattctggaaagaggcgttaccgtccctcgctgtgcggttgcagtgctagcagcggcagatcccgagttttcggcatcagctttaattcaaattgccggtcgagctggtcgggcagcggatagtccggacgatccggttgtcttcttttccgatcgttatacccttgcgatgttggcagccagacgccaaattgtgatgatgaatggcaggtgaagacgatgcgctgtattggttgtacccgcccgacagatcgcggcttgaagctgacaacgttattttcccgtggtccattgctagcgccgaggttatgtcacagttgcttgagccaatttagtttcattaccggtataacctgctccggctgcgggcgaatgcaggtagccgcggagccgtgtttggactgtcgaaaatgggcgaagcatgggccgcttttaaataaccgggccttatttgtgtatgacgcaaaaatgaaggcgtggatttaccaatataaaggactgggtgactatcggctgcatgtagcttttcaggatttgattgccgagcgtctgcgacatgcagaagcgttggtccccattccaagcgaagctaaacattatgaatggcgcgggtttgatccgattttaggattatttggttgcctgccattacaaaactggctccaaaagtcggcaacagcgcgaccacaagctcaaaagacccgccgagaacggctgaagacgccacaaagttttcgggtgctcgtttcagccaaaaccttaaaccgcgtgcgtcagataacattgcttgatgatttgtatacgacagggcggacgttgtaccacgcgcgggatgctttagtggctgccggtttcaaggggactatccaggcgtttacattaattcggtgaaatgtggcttttgttgtgtctggtggtaacattcgggtataatgaaggtggagattggaagggttttaccccagccaatcagcgtgtaagcgtttgcctacacgcaggaaaggggagaagttttatgctcacatacaatgttcgtggcgaaaacatcgaagtcaccgaagccatcagaaattacgtggagaagcggattagcaaactgaacaagttctttggtggttcagttactgcgacagcgcacgtcaatttgaaggtttacccagataagaccgcaaaagtagaagtgacgatcccgctgtcgttcttgaccctgcgtgcggaagaaaccagtccggatctgtacgccagcattgatcttgttactgacaagctggagcggcaggtgcgtaagttcaaaaccaagattaatcgcaagtcacgtgaaaaaggctttggtcagattgacatcgatagcaatgcaccggctgaaccgaaaccggccgaagatgatgataatctgaaggttgtgcgaacaaaacgcgtttcgttaaaaccaatggattcacaggaagccattttacagatggatatgctgggccacaacttctttatcttcgaagatgcagatacaaatggcacgagcattgtttacaagcgtcgtgatggccgttatggcttgattgaaacgaacgaataatagcgattttcttaaaagagaggcaaggctgctgcttatcggcgggcttgctttttatttgcctgtcagctccatcatgcctataaaacgatgcgtgtggctattgcagtttatgagaagtgtggcaattaatgtgatttttgacgcggggatctgcatttaaggatcttggtcgcaattggccaagagcgggccatcacgcttaaggctacttatgttctggcttacgctcataacgcgctccccggcgcagaagtctgcgtgtaaggacctcagacgcaatggccaaagtgtggttatcacgttcaaggacgctaatgttctggtttatgcccataacgcgttcgccagcccagaaacctgcacataaggaccttgggcgcaatgaccaaacccgggtcatcacgcccaaggccgcttatgctccggtttctaaccgggctggctcacgctcaccaagttattttcaatctcccctttaaaatgttaagatgttagaatgtataaatgttaagatgtataaatgttagaatgattaaagtagtgttagttctacgaggtttcgacagagaggaatccattaatggccaatattcttagaaaatgggtcgaaagcgataagcgagaaatcggtcgcctcggcaaaatcgctgatcaagttcagcgctatgaagatgaatatgcagcattatcagatgatcaattaaaagcaaatacccaaaaattcaaggatcgccttgcagcaggggcaacgttagacgatattttaccggaagcttttgccaccgcgcgtgaaggggctaaacgagttttagggttattcccgtttcgggttcaaattattggcgggatcgttttacatgaaggcaatattgcggaaatgaaaaccggtgaaggtaaaactttgacggcaaccatgcccgtttatttgaatgccttgactggtaaaggtgtccacgtggttaccgttaacgagtacttgtccacgcgtgatgcaacggaaatgggcgagttgtacaattggctcggtctcagcgtcgggttgaatcttaactccaagaacagtgacgaaaaacgcgaagcctataattgcgatatcacttattccaccaatagtgaactcggctttgactatttgcgagacaacatggtggtttataaggaacagatggtacaacggccactgaattttgcaattgttgatgaagttgattcgattctcattgatgaggcccggacgcctttgattatttccggtggcgcagaaaagacaaccggcctttatattcgggcggaccgcttcgttaagacgcttaaagccgatactgattacaagattgactggccaacgaagaccatttcgctcactgaaagcggcattcgcaaagccgaaaagaattttggcttggataacctatacgataccgaaaatacggctttaacccaccatatcgaccaagcattgcgggcaaattacattatgcttaaagatatcgactatatggtgtctaacggcgaagtgctgattgtcgatcaatttaccggtcgggcaatggaaggccggcgctattccgatggcttgcatcaggcaattgaagccaaagaaggggtacaaatccaggatgaaaataagacgatggctaacatcacttatcaaaacttcttccggatgtacaccaagctggcagggatgactgggaccgctaaaacggagcaagaagagttccgcgaaatctataatatggaagttatttcggttccaaccaataaaccggttatccgggttgactcaccggatgttttgtacccgactttggatgctaaattcaatgcggttgttgacgatatcaaaaaacgccataaaaaaggacagccgattctggttgggacggttgcgattgagtcgagtgaacgcctgagtaagcaattagatgatgaaaagatcccgcacacggttttgaatgcgaagaaccactttaaagaagcggaaatcatcatgaatgccgggcaacgaggcgccgtgacaattgcgaccaacatggctggtcgtgggacggatattaaattaggccctggtgtcaccgagttaggcggtttggctgttattgggactgagcggcatgagagtcgccgaattgataatcaattacgtggccgttccggtcgtcaaggtgatccgggttctacccaattttacctgagtctagaagatgacttgatgaaacggtttggctctgagcggattaaagcaatgctggatcggttcaaggttgccgatgacgatcaggtcattcaaagtcgaatgatctcacggcaggttgaatcagcgcagaagcgtgtcgaagggaataactacgacacacgtaaaaacacgctgcagtatgatgatgtgatgcgtgaacagcgtgaagtcatctataagcagcgtcagcagattatcaatgaagacgagaccctcaagcccgttttgatggcgatgattaatcgaaccatcacccgcatcgttcaaacgcatacccaaggcgatcaaaaggattggaatcttgatgcgttgtatgcttggatcaccgcaaacatggccgatccggagaaattcaagcgcagcgaacttgatggcaagtcgcaagatgagctcatcggtttactggcggatatggctgaaaataacttccagcataaaaacaagcaacttggcgatgacgcgcagatgctagaattcgaaaaagtggtcatcttacgcgttgttgactcagcttggacggatcacattgacgccatggatcaactacgccagtctattggtttgcgtggttatgggcagatgaatccgctagtcgaatatcaagaagaaggctaccggatgtttgaggaaatgattgcgtcaattgatgatgatgtgacccgactgttcatgaaagccgaaattcggcaaaatattcgccgttaatggtgaaccggcgccccggcactgcaagctcaaatttgcggtactggggtgttttgaggataacagaagcagaagctaaatgtgggattgaggcaacccagtcatcactagaatcaacttaaaaaagaggagcaattatcatggaactcagtgtcatgcgtaacaccttggccgccatgcgaaccaaaataaatcaattcagggggtctctttgacctcgatgcgctgaatgaacgcattagtgaaaatgaaggtagaatggcggaaccgggcttttgggatgattcggaagcagcacaaaaagtgatcgatgccaacaataaactcaaagaaaaacacgatcgcttttacgcacttgaaaatgaactggaagatcttgaggccggattggagttgttacaagacgaacccgatccggatttgcaacacgaagaagagaccaagcttaaagatctgcaggaaaaacttgatcagtatgagatgcagttgcttttaaatgggccatatgaccacaataatgcaattctcgaaattcatcccggtgcaggtggtacggaatcacaagactggggttcgatgttgatgcggatgtatcagcgctgggccgaccagaatggcttcaaggttgaagttgctgattaccaacctggtgatgaagccggcatcaaaagtgtgacgcttttgatcaacggtgaaaacgcatatggcttattgaaaagtgaaaaaggcgtccatcgcctcgtccgcatttcgccatttgattccgccggccgccgtcataccagttttgcctcggttgatgtgatgccggagcttgataattcaattgaagtcgatattcgcccagaggatatcaaaatggaagtctttcggtccagtggtgctggtggtcagcatatcaacaagacttccagtgcggttcggctgattcatctgccgaccgggattgtcacttccagtcaggcacaacgatcacaatttcagaacaaggccacggcaatggcgatgttgaaggccaagttgtatcagcgtgaagaggaagccaaaaaggccaaagccaaagccattcaaggcgagcaaaaagatgttgcttttggttcacagattcggtcttacgttttccacccgtacacgatggtcaaggatcaccgaacgaattacgaaaccggtaatgggcaggcagtgatggatggcgatcttaatccatttatcaatgcatacttgcaatgggagctcgcccagaaaaatcctgattaaactgtaacctgcctgaaatcttgctgacttaatcggctgttatactaatcctagcttagaaaaaggagcaaaatgcatgattcaaatggaaaacgtgacgaaacagtatgctaacggcgtcactgccattaaggatttgaatcttaaaatccaggatggtgagtttgtttacgtcatcggtcctagtggtgccgggaaatcaacgttcgttaaaatgctgtatcatgaattaaagccgtccagcggtagtattaaaattgatgattttgatttttcaaccatgaagccgtcgcaggtgccatttttgcgtcgtcacatcgggatcgtctttcaggatttcaaacttttaccacgcttgacggtgtacgagaatgtggcttatgcgatgcaagtcattgaagcgccggacgataaaattaaagaccgcgtgctcgaagtattaggactcgttggcttggaacagaaattgcggcgttttcctgatgaattatccggtggtgaacagcagcgggtgtcagtagcgcgtgcaattgtcaacaagcctaaagtgttgattgctgacgaaccgactgggaaccttgatccgcaaacctccgatgaaattgttgatattcttgaacgtatcaatgcaaatggaacaacggtgatcatggcaacccataacaaggatattgtgaatgaacgtcaacaccggctactcgaaattgccgggggtcgcttagtgcgtgacgaagaaggaggcacatacggcaatgaagagtaaggtctttttccgccatgttaaagattccctgcgcagtttgcggcgtaacggctggatgtcggttgcagcggttagtgcagtcaccgtcacattactgctggtcggtatttttatggccttgattttcaacctgcaccacatttcacaacaagttgaaaatgatgttcaggtgcgggtttatattgataaaaaaacaactaccaaacaacgtgatgaccttaaagacaaacttaaaaagctggatcatgtcaacaaggtcacttaccgttcacgtcaacaagaattggatacaatcatcgggggttatggttcgcagtggcggatgttctccggggaccaaaacccattaagcgatgtgttcatggttaagacgaatagtcctaaggccaccattagcgtgtcaaaagaagcacagaaactggatcatgtggttgatgcaagctatggcgggcgaacggcaaagaaactctttaattctgtggatgtagcccagaaatgggggcttgctttcacgattctgcttttgtttgttgccgtgttcctgattaataacacgattcgaattaccattttgtcacgttccgacgaaattcggattatgcgactggtgggggcaaccaattcctacattcggtggcctttcttgcttgaaggtgcctggaccggtttgtttggggcagtattaccgattattattgtggatgtcggttatgcgattgtctatcggagcttcacttatgcaaacggagccagtggttatacgctttatgccaacatgccgttcttgttctggcttgacttgatgttagccgggattggcattgtcatcggggcactgggatcagttatctccatgcggcgttttcttaagttttaatttcaaaattgaacatttgagttgctgctatcgactcaatgtgaaaggattgctcttttccgggcagtccttttttggtgggcggttttaatgaatgtcagtacgatgttttgaatacgcaagcttatgtcgaaaataactcatacgtgttaatcgatgggacaaaaatggccgtttttcggcattttctgtttgatgagcccaaaaccttgtaggaagcggtcgttaatttctgctatactggtcacagtgaatattggagggttaccgatggcagtgatcattgccttacttatcagcccgattggtgccgtattctggcttgctttagggttgacgattttgtatgcggttagccggacaagccgcgaacgccatcagtacttgcgggcgattcatccccgacatagcgaaattgccccattcttttgggtcggtattttgctaggcatcgttatctcggcactgatgttggttgcgcgcttacaagttagtttgcccgcattattagcattaagtggcttaacgctggtcgggctaatcttttctggctggcggttcagtccatggtggctaggattagcgggcttagttgaattgctgcggccgacaacgagccaaatgagtgctgatttagccgttttagttggtgtgttgtggttagcgcaagccttgatcgcgcggttaaatcggggcactcaaattgagtccccggttattttgcaggatcgacgtcaacgtcaacaggttgcgtttcgattgcgacagttttactgggtgcctttgttcttaccggtgagtgttgaccaagttgcgggattgccgctcttatcaatcgcaacggacacttttgttgcggttgggcttccactggtcttaggcgcggcatttaccacgcagcgtgatcgcgttcaaccgtatttgcgccgaagttggccatggtttgcagttgccggtggcggtttgatcgtctttggactggtgggtcggatccttaccatacctgtgatggtaatcgccttaatacctgtgttggtgagtttgatactcggtgccggcttaatttggcaagcacatcaagtacatttaaacgtgacacaaaccaatcacggggtggttgtcatcggggttgtcccacagacaccagctgcacaaatggatttgcagccgggtgatcgggtcttaacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagataaagtacgtagcgagccgtttgattttattattctcgatctcatgttgccgagtttgagtggactggatgtcacccgtaagattcgtgaagaaaagattcaaacgccaatcatgattctgacggccaaagacaacgaaaccgataagatcgtcggacttgagcttggtgccgatgattatgtgaccaaaccgttttcgccgcgggaaattattgcccgaattaaagccatcgaacggcgtagtcaaagtcaaccacaagcgccacttcccggtaatgccaatcaaattacggttggtcaaattacgattgatcctgaaaattataaagctagcaaagccggacaccgactgcaattgacccctaaggaatttgaactattggtttattttgctcaacgagttggcaaaacgctatcacgcgatgccttgcttaatggggtttggggcttcgattacccggcggaaacacggatggtcgatattcaggtcagccatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccattagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaacttggatcggattcgccagaaaaaagagcccgagcctgtgattctgccgccacagtcgccgtttacgcctgtggcacggcgaattaatgccttagctgcggaacaaacccatttacgtgagaaagtcgcagtacggcagtccagttttgatcgtctgattgataatttgccactaggcgtcatgttgattgataccaataaggatgtcattttgcataatcatgccatgtcccagcttttgggccatcagattccgcagccgcggcacaattatctggacgatgttaagacttatgcgttggcccggatgattgagcacacttttcgccatgaaaagactcatcatcaggagttgaccgtcctggcaacccaaaagtcggttgatgccagtgtcattcctttaaaccaaggaactagtcgtctccaggtgttggttattttgtacgatgtcacgtatttgcgccaagtcgagaaaatgcagctcgattttgttggcaatgtgagtcatgagctaaagacgccggtgactgctatttccgggtttgccgagacactattaagcggggctaaaaatgatccggcgacgctagataagtttttgaagattattttcgatgaaagtaagcgactgacccagctcatcaatgatattctaacgttgagccggcccgaatcgaatcaaacggtgcaggcacaagtaccacttaagaagttagtcgacgatgcattgcgtaatttagctaaagtgattaaagacaagcagattcgggtggaggtggcaattgcaccagacttacaggttgtgaccgatgagcgcaagttaactcagattgtgcggaatcttttgaacaatgccgtgttttataatcgattagccggacatgtgacgatcacggcccaagtagtcgaagggcacttgtcattggcggtcgctgataccggtattgggattcccgagacagagcaggcacggatttttgaacgcttctatcgggttgataaagcgcgcagtcgtcacaatggcggtactggtttgggtctggcaatcgttagtgagctggtgaaaagtatggatggtcaggttgccgtttcgagtcaagtcggggttggatcgacctttaccgtgacattgccggtcagcaagcgccagcagcaagattgatgagatatttacagaacctttacattcaacgacatgaacatttacacgcaactgttaagatgattggagcttgaaatggaggatttcgtgtgaaaaaaattgtgaccctgttttcgatcgtatttttggcgctgttagcaagtgcatgtggcagcagtcatagttcgaaacagtcgggtgaatcaatcaccgcagttggatcaagtgccttgcagcctttggttgaagcggcgggcgaacaatatcagacggaaaatctcggcgtgtttatcaacgtccaaggtggcgggagcggtaccggattaagccagatccagcaaggggcggttgatatcggtaattcggatctttttgctgaagaaaaacctggcattaaagccaacgccttggtggaccataaagtggccgttgtcgggattgcgccgattgttaatccaaaagtcggcgtgaaaaatgtgtcaatgacgcagttgcaacagatctttcttggtcagatcaccaactggaaacagttaggtggcaagaatgtgccgattgtccttgtcaaccgcgcacaaggttcagggacccgcgcgacttttgaaaaatgggcgcttgaaggcaagcaaccgattgccgctcaggaacaggattccaccgggatggtgcgacaaatcgttggcagtacgccaggggcaatttcttacgtcgctttttcttacgttgataaaaccgtccgcagcttgtctgtagacggcgttgcaccaactgatagtaacgtggcaacgaatcgctggcatatctggtcgtacgaacatatgtatacaaaaggtcggccaagtggtttgaccaaacgatttttgacttacatgatgtcaccggccattcagaagaaactggtccaaaaaatgggctacattccgatgactaaaatgaaagtagtgcgtaacgccagtggccagattagtcgtccataagcgagtctagcgtctaaaagctttttcggctcacggattgatgaaacaagtcagtgtgggcagttaggttcaggcaacctagcagatcaatgaaggcagatgcggccaggacaatggctagttgcggtgaggttttaggaggttatgatggatccaattcgagaagcgatgctaaaaaaatcgcgctcatcaaagttagagcggcgcggcaaaacgattagcctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatgggaatccggaagttggcgcgttaccgatgattgtcgggtctttcggcgtgacttttttatcggcaatcgttgcaacgccatttgcggttggcgccggcattttcatgaccgagatttcccacaagtgggggcaaaaagtgttacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgaccgtaacatccatgaccgtcgatgcgttaaaagctgtcccacgccattatcgcgaggcttcattggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggctttgttgccaaagaaccttgtttcgccagcttcgacgttgacttctgttttgacgagcgggattggtaatacagtcatgggttcgctggaaaataacgctttatggtccttggcattgctgctgttgctgatgtcattagcctttaacctgttgattcgttggatcgggaagaaaggggagctgaacaaatgaatccaaaagttgttgataaaattgccacaacggttctgtacattgtttcagggattatcattgttattttggccagtctcctcgggtacattctttttaaaggggtaccgcatatttcctggcattttctcacgagtccagcacaaagctttgaagctggaggcggcattggcattcaattgttcaactcgttttatcttttagtccttgcgatgctgatttcaacaccgatttcgttaggggcaggcatttacctcagcgagtatgccaaaaagaattggttgacggatgttattcggacttcgattgaaattctaagttccttaccgtctgtggttgttggactgttcggttttctgattttcgttttacaattcaaattcgggttctcgattttatccggggccttggcattgaccgtcttcaacctcccgttgctgacgcgaaatgttgaagattcattacgcggcgttggctttgaacagcgtgaggccggcttagcgcttggcctatcgcgctgggagacggttttacatgttgtcatccctgaggcattgccggggattattaccgggatgattctaggtgccggacgggtttttggcgaggcggcggcgctaatttacactgctggccaaagtgccccggcgctggatttcaccaactggaatccggctaatattgcgagtcccctaaacccatttcgaccggccgaaacgttggcggtgcatatttggaaaatcaactctgaaggcattcaacctgatgccgttgctgtttctgccggagctagtgccgtacttgtgatcgccgttttggtcttcaacgttggcgcccgctatttaggcaatcgactatttaaaaagatgacggcggcttaaacgggttaggcttctagtatcaatgaggcttacccggtatgataatcgcgataatacgtggaggcagaggatgcaagaactggaaaagtattcattagatgacacttatattcgaccatttgatcgcgaaaggcaggaaattgcgcttgaaacggaagatctgcatgtcttttatggtgataatgaagccattcatggcgtttcgctgccgtttgaacgctataaaatcactgcattgatcggttcaagcggctccgggaagtcgacatacttgcgctcactcaatcgaatgaacgataatattgaaagtgcgcgagtcaccggtaaaatcatgtaccggaatattgacatcaatagtgatgcggttgacgtttatgagatgcgtaaacacattggaatggtgtttcaacggcctaatccattcgccaagtcgatttacgacaatattgcttttgcactgcggcggtttggcatcaaggacaaaaagaaactcgacgaaattgttgaaaccagtttgaaacaggctgccttgtgggatcaagttaaagacgatcttaatcaaagcggtatgtcgctttccggtggccaggcacaacggttatgcattgcacgggcgattgccatgaaaccggatattttactcttggatgagccggccagtgccttggatccgatttcgacatcggcagttgaagataccttgttgtcattaaaagataagtatacgattatcatcgtgacgcataacatgcaacaggcggcccggattagtgactacacggcgttcttttatagtggagcagcgcttgagtatgatgaaacccgtaaaatcttcacgcgtcccaagattaaagcaaccaacgattatgtttccggacatttcggctaggaggttcccatggctgaagcacaaaaaatcattacaagttcagatgttcatcttttttatggtaagtttgaagcgctaaaagggattaatctggattttaacgaacatgagatcacagctttaatcggaccttctggctgtggtaagtctacgtatttacgaacgttgaatcggatgaatgatctgattccgggggtgacgattacaggaaccatcagtttacgcggtcagaatatctatgcgcctagtgaagacgtggttcaattacgtaagcaagtgggcatggtcttccaacaacccaatccgtttcctttctccatttacgaaaatgtgatttatggattgcgtttggcaggggttaaagataaaagcattttggatgaagcggtggaaaccagtctcaagcaggcagccatctgggatgaagtgaaggatcatctgcatgacagtgcattatcgctttcaggtggccaacagcagcgggtttgcatcgcgcgggtattggcagtcaaacctgatgttgttttgctagacgagccgacgagtgccttggatccgatttccagcacgcaaatcgaaaacatgttactcgagttgcgtgaccaatacacgatcattctagtgacgcatagtatgcatcaagcatctcgaatttccgataaaaccgcctttttcctgacaggcaacctgatcgaattcgctgacacgaaacaaatgtttttaaatccaaaagaaaaggaaaccgaagactatatcactggacgcttcggctaggaggggtagtatgcgacgactttttgttgacgaattgaacgatcttcatgtacgtttttcggaaatgggaatgatggttaatgaggccatctataagtccgtgaaagccttcatcaatcatgacaaagctttagcccgcgaagtgatccacgaagacaaacacattaacgagcgtgaagttgatttggaaaaacgcagcttcgaattgattgccttgcagcagccggtgacgaccgatttgcgggtgattgtcacggtgatgaaggcaagttccgatctggagcggatgggagatcatgccgtttcaattgctaagtctactattcgagttaaaggtgaaacccgggtaccgcaaatcgaagctgatattgccgggatggcagacgcggtaaaagagatggttgaacaggtgctggatgcctatgtgaaggaagattcagcccgtgcacgtaaaattgccttggaagatcacggtatcaatgacttttcatcgcggatttacaaagagtgtatccgccagatgcaggaaaaccccgaaaccgttgtcggatcaatggactatatgctggtttcgtcctatcttgaacgaatcggcgactatgtaaccaacatttgtgaatggattgtctacttaaagaccggtaagattaccgaattaaactcaaacgcaattgaagacaagttctagatcctggagacttttttaacgaggctggggcatcattcattgtttcaaaatataagcgtaccatttctcgattttttaagaaatggtacgctttttggcttcttcatattagtataaatgagctttaacaattccagtgccaaaacggagcaatcgtaggccagatggggctcagccgtggaacaacacagcgaccggtttttgtcgctgatgttgttaggcgacttggagactgccgggcttgcaagctccaagcgccgtctccgctctagcttcgcgtcgtcaccccatctggccggagattgcgtagtttggcacggcccggaactactttagttactttctcagtcatagtattcggattttagtgcgcatcacatcctgagatagaattatgcctcagtcccttggcttattcatatgagtacaaatgagccttgacgattgcggcgtttggcgcgacacgggactatttgacttattttctagcgatgatattcgaatttggtgagtagcgaatcctgaaatggaatgatgccacaccctcgttcattccgcttttttagaaagcagtgaggtgtcgggatgaccacaaaactgatcgcgtccgccttacgacctgtttaaaaatcaacctttggacctatgcgccttggccgaattccgtgcatactaatcatgtaatcaaatcctggagggataacccatgaatgaacgcgaaagaattttagacctcgttaaaaaaggcgtcatttcaagcgaagaggcgcttgtgcttttggaaaacctcgcaaaacagcaaggtacgcaagccggcagcccggccgatgatactgctcccgaagctcattcggaacagaccgaaaccgatgatcaatcaacgcaggaacaacaagaagctaataaagatacggatgctgcattgacagagcttaacaccgaaattgccgaagccgccggtgccttggatgctgcgacggcgcaagtgacaagcatcagtaagcaaattgaagcgaataacgaacaaattattgttttagacacaatggaagatcttgaagcactttccccggaaaaatatcaaaagcgcggggaattgaagcaagagaatcagaaacttaacgatcagttagccgagctaaagggacaggttgaaaccatgaaggccaacctggcaacgttgcggcgtcaaaagcatgatcttgaacgccaaaagatcagtgacaaaatcttcaacgatgactggcaaaaagatgctcgtgatgtcttctcggagtttggcaagaacatcggggatgccacgtcacaactaggcggtttcgttaaggacactgtcaacaatgtcctagataacgttgactggaagaatgttactgtaacggttcccgggttggcgactgaaaaatttgaacatgttttcaagtttccagacagtcaggcgacgattctggatgtcaaagtggccaacggtgatgtgaagtttaagacttgggatcagccgggaattcaagtcgaagcagcgattaagttatacggaaagatggatgccgattcaccgtttgaagcttttaaagatcgtagccgcattgatgttaccgacgatcattttagcttccaagtgccaaataagcgcgtccaggccgatttggtcatttcgttgccaaagcgcacttacgaccacgtgtcagttcgtttgctgaatggcagtgcggatttaaccggtctgaatggtaaagacttttatgttaagagcaccaatggccaaatgaattttaccaacgtggatggtgtgatgattgaaagtgaaggcgtcaatggatcgattaaggtccaaggcggccatacccatgacttattgttgacgactgttaatggtgatgtttcagtggatgccgatccggcaacagcagcactaaagacggtcaatgggacggttcgagccacttatcacacggactttaccaaaattgaagggacttccatgaatggcaatgtgaaagtggcggttccggcttctattgcactgaaaggtgaagcccgtacccattttggtagcattaagagccgacttagcaacgttgcggagccagccaaaggactcaagcgttttgagttagaccggcccggaaccggcaacagcgagttgaaactcaatacaacaagtggcaacattcaattaaaagattcaaatgactgaggggatcgcttatgccttttctaataattccaattatgttcttcatcgttggcctggtactggtggccgtgtttgcaatcggtattttcttgctaaaactgttaatcgttcccgccttgttagtggtgttagcggtttggctgttctcacgccatgatcatgagaaacggcaaggtccgcgccacccttaccgtgaccagagcacgtctcgtccgcgaaaaaacgcaacgcatgtgaccgaatcacgtgatgatgattggagcgatttctaatcatgaacttcatcaaacgcgcagttatcacaacagctgtcttcctgatttatgctcaggtgtttcctggtcagttgttcgttgcgagctttggtgttgccgttgtcggggcactcgttttaggggttctcaatggcttgttgcggccgattctggtcgttttgtccattccgattacgattctgacactagggttgtttctgattgtgctcaatgggctgatgttaagtatgatgacatggttcgttcccggaattgttttcagcagtttcgggtcaacgatggtacttgccatcatcatatccgtcttgaatatgatctttgtcggcaaacattaagtcagcttaacgataaaagtgtgcgtcacgagattatcatcatgtaaaaataaatcggtcttaaagatgtttcctgtctttaaggtcgattttattttgtctaaagagattggttagtggataagtgcgtggaaaatgcccattttcaacattgacatattaaacgccatcgtttcagaattaggcgaatgttttgaagcgagctgctatgagggccggcgagttatggtaaaataaagcaaatacggcgaaagaaaggtggacttcatggcagacagcgtgacagtacggcaacttgtcaaagcgacaaagcttgaggtatacagcggctcggagtatcttgatgcccggcaagtcgttttgagtgatatttcgcgtcccggccttgagttaacgggttactttaattattatccacatgaacggattcaacttttcgggcggacggagatttcatttgctcgtaatatgtcttcagaagagcgtttattaattctgaaacggatggcaacagaagatacaccggcctttctggtttcgcgaggattgcagccaccggcagaaatgatcacggcagccactgccgcacatattccggtattaggatcacggttgccgaccaccaggctgtcaagtttgatcaccgaatacttagacagccaactagctgaacgtcgcagcatgcatggcgtcttggttgatatttacggtctgggcgtgctcattactggcgattccggggtgggaaaatccgaaacagccttggaattggttcagcgtggtcatcggctcattgctgatgatcgggtggatgtttatcagcaagatgaacaaacggttgtcggagctgcaccgccgattttatcccacttgttggagattcgcggattgggtatcattgatgtcatgaatctctttggtgccggggcagttcgtgaagacaccaccatttcgctgattgtgcacttggagaattggacaccagacaaaaccttcgatcgcttgggctctggcgaacagacgcaaatgatctttgacgtgccggttcccaaaattacgattccggtcaaggttggtcgtaacttagccattatcatcgaagtggccgcgatgaatttccgcgccaaatcgatgggctatgatgccactaaaacatttgaaaagaatttaaatcatctgatcgaacataacgaagcgaacgaccagaagagttcggaggaaaaataacttgttattaacactcaatccaattgcttttcagttgggtgggctggaagttcactggtacgggattattatcgccagtgccgttttactggcggtttatctggcaatgaaggaagcaccaaaacgcggtattaaagaagatcatattttaaatctgattttatgggcgttgccatttgcgttaatcggtgcacgcctttattacgttgcttttgaatggtcttattatgcggctcatccaagtgaaatcatcgcaatttggcatggcgggattgccatatacggcgctttgattgccagtgtgattgtttttgcgatttattgtcgcgtcaaatggctgccggcttggctggtgttggatattgcggcgccaaccgtgatgttagcccaggcaattggccggtggggtaatttcatgaatcaagaagcccatggtgccatcaccagcttggcttacttgcgcggcttgcacctgccagaattcattattcaacaaatgaatatcggcggtgcttatcgccagccaaccttcttatacgaaagcatgtggaatctcgttggttttgctttaattatgacggttcgccatcaccaacactggtttaagcaaggagaaatcgtcttgagttatgtcatgtggtatagttttggacggttctttgttgaaggcatgcggacggattcgttatatgtcataccgggcttacgtgtttcccagcttttgtcgattgttttattcgtggtggcggccgggctcatctggtaccgacggcggcgtggcgatgtcgcgtggtacttagacggtaatccactgcaggcggttgaataggagtgattttgtgccgacaaaaatagcggttttaggagcgggctcatggggaaccgtgttagccaatttgttaacggaaaatggccacgaagtcgatttatggagtcataatcttaaacaggttgcgaccatgcgagaaacccgcaaaaatgaacattatttaggtgcagaatttaccttacacgatgcgctgcatgtcacggctgatttaggccaagcattagatcaagccaatgtgattcttttcgttgtgcctaccaatgcgattcgcagtgttgccgagcagattagacccattctgcaggctcatcgtggtcgtggtgaacagccgattattgttcatgcagccaagggattggaacgcggcagtgagctgcggatttcacaagtcttagctgatgtcctgcctaaagaactcattcaaggcatcgtggtgatttcgggtccaagccatgccgaagatgtagcgactcatgatatcacaacgctgacagcagcatcggcagacttatcactggccaaaaaagtccagcggttattcatgaatgactattttcggctgtacaccaatactgacgtgatcggagttgaaatcggagctgctttaaaaaacgttatcgcaatcggggctggcgcgttgcatggtctcggatacggcgataatacgaaagctgctttgatgactcgcggtctggcagagatcagtcgggttggggtcaagttgggcgcagatccgttgacgttcatcggcttatccggcgtcggtgatttgatcgtcacctgtacgtcggttcacagtcgtaattggcgtgccggtaatgcccttggccaaggtgagaaacttcccgatgtgttgaaaaatatgggcatggtggttgaaggtgtttcaacgaccaaagttgcccaccacatggcaagtgagttgggtgtcgatatgccgatcaccgatgcgatttatcaggttttgtatgaagacgcgccgattcgaacggtgattaccgatctcatgaagcgaactggcaaacctgaatttgattttgataatgccagtttacaaaaaccataaaaccctgtatattagaacatgtagcttactatttgtaagcaataaggcaaaaggagagactgcccatggcaaaaaaatatgatgtaatcgtgatcggtgccggaccagggggcatgacagcagcactttatgcttcccgagccaacttatcagtgttaatgcttgatcgcggcgtctatggcggtcagatgaacaataccgccgaagtagaaaactatccgggttacaagtctatccttgggcctgatcttggccagaagatgtacgatggtgcaactcaatttggtgccgaatatgcgtacggcaacgtgatcagtgtccaaaatcacggcgctactaagttggtcaaaaccgatgaagacgagtttgaagctaaagcgattgtcattgcgactggcgctgaacacaaaaaactcggtgtacccggcgaagaagccttcagtggccgaggggtatcgtactgcgcggtctgcgatggtgcgttctttaaggatcgtgaacttgcagtcattggcggcggcgactcggccattgaagaaggactttatttgacgcagatggccaaaaaggtcaccgtcattcatcgtcgtgaccaattacgggcacaacaaatcattcaaaagcgagcctttgcaaacgacaagatgcattttgtctggaatgcccaggttcaggaaatccaaggcgacgatatgaaagttaccggcgtcaaatatcgtgataaagaaaccggtgaggaacatgttttgccagttgccggtgtcttcatttacgtcggcatcatgccaatgaccgagccattccaggatctaggaattctggacgatcatggctggattccaacggatgaacacatgcgaaccaaggtgcctggcatctttgcgattggcgatgttcgcgctaaagacttgcggcagattaccactgctgtcggagaaggcggcaccgctggtcaaggcgtcttcaattatattcaaagtctgaatgacaccagtgttgaagtaaaagcctaagttttgacgagtcttttaagattatccaccaattgaatttgatcaaggaacggttctagcagacacgaaaatctgttagaaccgtttttgcttttaaaaataccacactattgcgaatatgatggcaaaaatcgtaaaagaattttcttatttgagcgcgttttcaacccagcgttggtcacttatagtatgattggacagggaagggtagtacccgaaattatcaatttagacagataggagctgatcacgtgagttatcgtgatacgtatcaacaatgggtagatgaaccaacgcttgatccagagctaaaaactgaccttaagaaaatggcagacgatgaaacaaccaaagaagaagcgtttgcggaaccaatggcatttgggactgccggcatgcgcggtgtgcttggtgccggtatcggccgcatgaatatttataccgtccggcaggcgactgaaggtttggcacggtttatggataccttgactgacgaaactaaggctcggggtgttgctattagttacgattctcggtacatgagtcaggaatttgcctaccaaagcgcaggcgttctcggcgctcatggcattaagagttacgtctttgatcaactgcggccaacaccggagctgagttttgctgtccgtcacctgaagacatatgccggaattatgatcacagctagccataacccgaaacaatataatggctataagatttatggccctgatggcggtcaaatgcctccggaagagtctgacaagattactaaatatgcgcggtcggctgatgatctttttgccatcaaggccttgaacgttcacgagttacgggctaaggatttgatgcagccaattggtgaagatgtcgatgaagcttattatgctgaagtcgcaacggttacgattaatcatgatttgatcaaaaccgttgggaaaaacatgtcgctggtttatagcccgttacatggtaccggtcggattccggcacaaatggtcttgcgtaatgccggatttgaaaatttccggttggttgcgaaacaaagtgttgctgatccggaatttgccacaacgccatttccaaatcctgagtttgcccaagtttttgatttgccaattgaacttggcaagaaaattggggccgatgttctgattgccactgatcccgatgctgatcggctgggaactgcggttaaagttggcgatcactatcagttgttgaccggtaatcaaattgcgtctgtgctattgcattatattcttgaagcacgtaaacaagccggaactttgccaaagaacggtgcggtcgtcaagtcgattgtttccactgagttggcaacggccattgccaaagattatggcgtggacatgatcaatgtgctcaccggcttcaagtttatcggtgatcagatcaaacatttccaggcaacaggcgaacatgaattcctgtttggctttgaggaaagctatggctatctaatcaaaccgtttgtgcgtgataaggatgccatccagtcaactgttttgctagctgaagtggccgcatactatcaatcacaaggcaagacactttgggatggcgttcaggaactttacaagaagtatggctactacgccgaaaagactgttggcgttgattttgaaggcgttgacgggcctaagcagatggctaatctgatgaccaaattccgtgaagaacagccagatgattttgctggcgttaagatcgcgaaagttgaagatttcctgagtcaagaagctaagtccgcagatggcacagttgaaaagctgacgatgccatccagcaatgtgctgaagtatattttggcagacggtacctggattgccattcggccatccggtacagagccgaaagtgaagttctacgttggcaccaaagccgatacggatgcaaaggcgcaagaaaagcttgatgcctttgagaaagctttggatgcttttcgtaaggaagcttagatgaacgattcacgtggtcagcggttgcagtcgtgctagtgaatgcaatgtgataaccgcggataaaagtgtattttaaccgatagatcctaaagggcagcctttggggtctattttttgattttgcgctaatgcaaccgtgacgctaaatctagcgttggagctaaaagtatacggaaaagtaagcgttttctgtttctgccacagctttctttagtatactttggttactatgacaaattgacaggcggggggcgattgcgtgacgtatttaatcattgaagacgaaccggcattggggaagacgcttcagacctatttcagtcgtgacgaagaggtttggctagcggcgacactggcaaaagccaccacgattgtgaaaacagaacatccggcgttgatcattttagacttgggcatgccggatggggacggtttggcgtggttgaaacggtggcgggcttatttgacggctaaagtgattgttttgacggcaaatgatgacgagtcaaccacgattgccggcttggatcttgccgatgattatgtggtcaagccggtgagtcttaaggttcttaaagcacggattgccaaacaattaccgggagagtcccagcaatttggggccgttgcgctaaatctgcggacaggtcaggtcactaaaaacggcaaaccagttaggcttacaagtgccgaacaacgactgctggcctatttctttgttaatcccaaccaaattttgacccgtgaacagttgctggccgctttatgggatacgcgcgaacaatttgttgctgataacacgttgacggtaacgattaaacggctgcgcgaaaaattggaagatgatcccgccaagccaacactcataagaaccgtacgaggaatggggtattttatcgatggttaagcatgcttattggacgatgcctgagacgcgtcaagtgtttcaattgacagcgatattaattgggattctttggacggtacttttattaaccagtatcaccgtaccggatatgcgcatatggttggtgctggtgggcggtttggctactggcataagtgtttggttaacatggtgctgggcgcgaaagtttagttatcattttgatcaagcgcttttgcaattggatatgacgaaggaaaccgaggacaattacctaattgatcgcaatgatgaaggtttattttctgacttcaataatcgtctctatcactatgcgcgccaaatgcaagccgagcgtgaggctattaagcgtgatcgtgatcatctcaatgaggcgattacggatattgcgcatcagttacggacgccacttgcagccaacagtaacttgcttgagatgatgactgaatcgaattggaaaacgacgcggctggctttgcaggcacaacagcagcaccaagcgcaattaatcgagcagctgatcttactggcaaaagttgatacgcatacgttgagtcagcggcgggaaatcgttgtgttgaccgaccttgggaaagcagcccttagtccattcttgcgccagattgccgacaaagagattaccgttgattggcaagtgccaccagcgctgacgatcaacgttaattcggtattggtcaaagaagcctttgccaatgtttttaaaaatgcagtcgcgcataccccggttggcggccgaatgagtgtgcgcggaatcggtgacccggtgcgcacgcggcttatgattatgaataccggtcaaccaattgccgctcaggacctgccacatttgttcgagcgcttttaccgtggtcaatatgctactgccaacaatgtgggcatcggactggcaattgctgctggcatcactactgccaatgatggtcggctaactgcagctaatactgccaatggtgtccaaatgactttcgaatttttccgctgatacggtggctgtcactcacctgtcacttggcgttgctaaaatgacggcaagaaaccgataacaggataggctgttgtcgggtaaaggaggagatttgggatggcaattttaacggcacgccaattgaccaagcaatatgctggtgaagcgcatccggcactggatcatgccaatttgacgattgaacaaggcgagtttgttgccatagtggggccgagtggttcaggaaagtcaaccttgcttcatttgttaggcgggattgatcagccaaccagtggggaggtccggttatatgacacggatatctacgcactgaatcaaacgcaactggcgatttttcgacgtcggcaagtcggcttgatttatcagttttacaacttgattccgaacttgacggtggctgagaatatcacattgccagcggatttggatggacggtcaattaaagaagccgttttgacggagatgttaacaaccttgggccttgtcgaaaaggcatctgctttgcctaatcagctttcaggcgggcagcagcaacgggtggcaattggacgggcgttaatcaatcatcccgcggttattttggccgatgaacctacaggcaatcttgatcgccggaattcacaggatgtgatgacgctactacgacaagccaatattaagcaggggcagacactggtcgtgatcacccatgatccagacattgccagtcaagctgatcgtattgtccgcattgacgatggggtcgtgagcggggggcggtgagatgatggggatcgtgggacatttgactaaagagcagctgttgggtcaaaaagcgcggaccgtgacgaccattttagcaatggcagtcgctgccaccttgacacttgcaaccttaatcggcatttattcggcgagacattcgatgtatcaaaagaatatccaaagtactggcggcatgcagtttgcaatctcgcagttagatcgacaaacggcaaaggcaatcgggaaagactcagcaatcgccaaaagtgtggtttatcaacggcaaggaacggttgatattaaggaaccgggagtggcaaaaacgatggcatcaccgttactaacgttaccaaaagcggccatgcaacgattagtgaagccggtggtacttgccgggcggttgccaaaacagccaaacgaagccattcttgcccaggatttggtgacaaagcagtatcgaattggtcagattattcaaagtcggcagcagggcaaaaacattcagttgagaattgtcggtagttatcgcggatacgcaggactgttgccacctgatggcgttttaacacttggtacggtgaccgggtccaaagattacacggtggcagctgcttttagagactacagtaatttttatggaaagcttcatgcactgacatcgcagcatcgagtgcattcgcgtcagctggcaattaataacatggcattagaacgggcaggcgagtcacgtgatgttaagctgagagtcatgtttgccttattggtagtcgttattttaagtgtgattgggttcgtatcgctagcgttaatttatacaagtattaatcttagtgtccggtcacaaacacagcgttatggcttattacgttcaattggcgcgacccctaaacaattgcgcagactagtttattcataggcggcgatgcttgcttttccggcgtttttaattggtatcggaatgggaatcggtggcttagcagtcgcatttcacatcctcaatcagcgctttatagtgcaaggaaataccttcagattattccttgtgattgattggtggccaatttttctaggggcgatcttcatgttcttagtgacgttggtagctgcgtggcgcccggcacatcgcgcggcttcagtcagtccgattgcggcggttcaaatgctgcctgagagtgtgaagattagtcgccggtcgcgtcggcttagtccgatcgagcggctactccgttccccaactgcaaagctagcttataagcagtatcgccggttagggtggtcaaaactgacgatgatcgcgactttatcactctcactgatgatttttattggtttaaccggtttctttcgaagtgttttgacgttgaacaatgaaactttcacgcagcaagctgatgttaccattgccagtaccgctgccgtggatgctataccctggacatttgaaccttcagaagatgcagggatcaagcaggcaactgtgactggaaccaagcaaatgcagctggctcatgcgccgaaagcttttggagacaaaataaatatcatcgttgttagcgaccggctttttcaaactgcttttcagaatcagccgactgttttgaccagtagccaactggttgtgaattcaaagaccggtcagcgtgagcaacggtggcaactgccgagagacttttctgggaccttacagctgatcaatcggcgcggagaaaagcaattcacgcaatcaattcgcgtcgtgactaaaacaacagcggcgttgggtaagtggcaatttggcgatcaatccggattagtcctgtcccgtgatcggtatctgaaactattaaaagcattggccatcaatgatcgtgagcttgattattcgattcaaacgcaactgacccaggctaaatttcatgattcggttgcaaaaatattacgcaaaatggtgcctcaaggagcactgaatgatcagattgctaatcgagcccaggaaagttcgtttggattggctattcaagtgatggtttacgggtttttaaccttactaaccttggtgagtcttgctaacattgtcaatcatatttttgccaacttactgcaaagacggcgtagtttggcgatgttgcaaagcgtggggatgacgccgcgtcagatcacaagcatgattggccttgaaaatggttttttgtttggaacaagtttagtcattggcagcattctcggaaccggactgacatggttactttatcgcgtggcaaacactggcatagcgtttaattatcgcgtgccatggcaagagatcttgattgcagggggaatgttgatgcttatttgggcggtatttaccggcgtgagtcatcaaatactgaaacatcaagatcttgaccaattgatttggttgagttagcaagagcctgtttttaggtggtgtcacagttgctgctttagggtttctatcgctttgatcaatgttatccatattcgttattgggatagtgactgacatcatggagtggacaatgcttcagcgttttaattggctctagccgcgttcgcaagcgcaaaagtctgcgtgtaaggaccttggtcgcaatggctaaaatgggtggctattatgccagaatgtaaatccctgtatacacttataaacgcgttcacagggccagaaacctgcgtgtaaggaccttgagcctaaatggcaaagcccagccatttaggctcaaggccacttacactccggtttctaagcggccctgttcacgctttctttctataacgcgctccccggcgcagagacctgcatgtaaggaccttggtcgcaatgaccaaagtgcggccatcacgcccaaggccgcttacactccggtctctaaccgcgccggctcgcgctcactgtgaattttcttgcaatgcctacttgatggtggtagtcttttaacaatttaagtaaatttcacgatcagacacgacaactatcaggaggtcatttcgaaatgggcatgcaccaatttatccaaggactgagcaatctggaaacactgcggcgggcaccgggctttttcaagtatcaggagcattcggtggcggctcacagtttcaaggtggcggagatcgcgcagatgttgggcgatgttgaggagttagctggaaacaaggttaattggcagatgctctatgagaagtcactcaatcatgattataccgagcgcttcatcggtgatattaagacgccagtgaaatatgcaaccccaacgttacggcaaatgttggctgacgttgaggctaccatgacggaaaacttcatcaaaaatgaaattccacacgattttcaggatcgttatcgtcggcggttatctgagggcaaagacgaaacgctcgaaggtcagatcctgagcgttgcggataagattgatttactgtatgaaggttttggggaaatcgaaaaaggcaatccggagcaggtttttctcgatatctattcggaaagtttaagtactattttacagttcaagaatcgtccgagtgttcgctactttcttgatgaagtattaccggatatgctagatgagaagttcgccagtcgggatcaactggctaaattgactaaagaaaccatggcagaacatgagactggcaagtagcgaaagtatgttcgctatgttataatatgcaggatgaaagttgggatgcgtttcttatcggttccaacttttttaatgagaaggttttagtgtggttgtgagctttgcgttggccggttagcgctcgccataacgcgttcaccggcgcagggatctgcgtgtaaggaccttggtcgcaatggccaagagcgggccatcacgtctaaggccgcttacactccgacttctaaccgcgccggttcacgctcaccataacgcgttcgccagcccagaaacctgcacataaggaccttggtcgcaatgaccaaagaccagtcattacgcccaaggccgcttatgttccggtttctaaccgggctggctcacgctcacttttctttggaggtacatcgatgattgaacgaattgctgatcgtaaatttgatttggtttcgccttataagccagccggggaccagccccaggcgattgctaagctgactaaggggtttgaagaaggtaaaaaggcgcaaattctgttaggtgcaaccgggaccgggaagacgtttacgatgagcaatatcatcgctaacttgaacaaaccgactttgattttatcgcataataaaacgttggctggtcagctgtatggtgagtttaaggagtttttcccacataacgcggttgagtacttcgtgtcttattacgattattaccaacctgaagcctatgtgcctagcacggacacttatattgaaaaagacagtgccattaatgatgagattgataaattgcggcatagcgctaccagtgcgttgcttgagcgtaatgacgtgattgtcgttgcttcggtatcttctatctttggcttgggtgatccgcatgaatataagaaccatgtgttatcgttgcggactgggatgaccattgaccgaaatacgttgttgcggcaattagtagatattcagtttgatcgtaacgatattgattttcaacgcggtcgttttcgggtacggggagatgtggtggaaattttcccggccagtcgtgatgatcacgccatccgcgttgaatttttcggtgatgaaattgatcggattaccgaagtcgatgctttgacgggtgaagtgattggtacgcgagatcatgttgccattttcccggccactcatttcatgacgagcgatgaacagatggaacgcgcaattaagagtatttctgcagaactcgaggatcgcttaaaagtgttgcgcggtgaaaacaagcttctagaagcccaacggttagagcagcgtactaattatgatattgaaatgatgcgcgaaatgggctttaccagtgggattgaaaattactcgcgccacatggatggtcggaaacccggagaaccgccgtatacgttgctcgactttttcccgaaagactttacgattatggttgatgaaagtcacgttacgatgccacaggttaaaggcatgtataatggcgatcgggcccggaaacagatgttgattaattatgggttccgtctgccaagtgccttggacaatcgacctttgaagattgatgagtttgaaaaacatgtcaaacggattctttatgtgagcgcaacgccaggaccttatgaactgagtcgcgttcctaaagaagatattgctgaacagattattcgaccgaccgggttgttggatcctaaaatcgaagtgcgtccggtgatgggtcagattgatgatctggttggcgagatcaacaagcggattgatgcgcatgaacgagtcttcatcacaacgttaactaagaaaatggcggaagatttaaccgactatcttaaggatatgggaattaaagtccgttatttgcatagcgacattaagacgcttgaacgaacccagattattcgtgatttgcggctaggtaagtttgatgtattgatcgggattaaccttttgcgtgaagggattgatgtaccggaagtatcattaattgcgattctggatgccgataaggaaggcttcttgcgggcagagcgttcgctgattcagacgattggccgggcatcgcgtaatgaacatggtaaagtcattatgtacgctgacaaggtcacggattcgatgaaagccgcgattgatgaaactcggcggcgacgggcaattcaagagaagtttaacgaagaacatcacatccaacccaagacgatcatcaaaccaattcgggcggctatttcaacctatgaacaatcggatgacgaaaaagccgatgcaaagaagacttttgctgaagttgattacgaagatatgagtaaagcggataagaaagaactggttgccaacctccgttcacagatgcaggcggcggccaaaaagttggactttgagcaggcagcttctttgcgcgatacgattttggaattgcaagcggatatgtcttgagaatgaggtggacaggacttgcatgatggcaccaactcagccatgattgctatgagcagatccggcgatcatggctgttttcttgctttcgaattaggcgcaagtgctgaggcatttctagtttgttcccgccagcgctaccagttgtcggcatgttttaattgaggagatcttttgtgaatggcaaatgataaaattgtaatccacggggctcgggcccataacttaaaaaatattgatgtgacgattccgcgcaataagcttgtggtcatgacgggcctttctggttccggtaagtcgagtctggcgtttgatacgttatatgcagaaggccagcgccgctatgtcgaaagcttatctgcttatgcacgccagtttcttggtcaaatggagaaaccggatgttgattcgattgatggtctcagtccggcaatttcgattgatcaaaagacgacttccaagaatccgcgctcgacagttggaacggtcactgaaattaatgattacttgcgactgttgtgggcgcgggtcgggcatccgatttgtcctaacgatgggacgccgattaccagtcaaagtgttgaacaaatggtggaccgcgtcttggctttgccggaaaagagccgcattcagattctgtcaccgattgtgcggcggaaaaaaggcagccataagaaagtctttgccaaaattatgcgtgaagggtatgtccggatgcgcgttgacggtgaagtcatggatgccacagcggattatgaactagacaaaaacaaagcccatgatattgatatcgtgattgatcggattgtggtgaagccagaagcccgcagtcggttatttgactcttttgaagcggcgttgcggctttcggaaggatacgctaatgttgacgtcattggtggcgatacattgcgtttttcggaacattttgcttgcccgatttgcgggtttacgattggtgaaatggagccgcggttattttcatttaatgcgccatttggagcgtgcccggaatgtgacgggctgggtgtgaagttgactgttgacatggatctggttgtaccggatccaagtatgactttagctcaaggtgccattgccccatggaatccaattagttcgcaatattacccggaactgttggcacaagcggcaactgcctttaaggtgcgaatggatgtaccgtttaaaaaactgaccaagcgcgaacggaatgttgttctcaatggcagtgatggcaagccattccactttcattatgaaaatgacttcggcggtgttcgcgatgttgatgtgccgtttgaaggcgttttgaccaacatttcccggcgttatgccgagacaaatagcgacttcacccggcaacagatgcgcggttatatgacggctttgccttgtccggtttgtcatgggaaacggctcaatcgtcaggcactcgcggttaagatctccggacgtgacatcgctgaagtatctgacttggccattaaggatgcgctgccgtttttcaagcaagtacatttgagcgaagccgagaccgtgattgctcagccaattgtcaaagaagtggtggatcggttaacttttcttgtcaacgtgggcctcggctatttgaccttaagtcgaagcgcggggacgctgtcaggcggtgaagcgcaacgaattcgattggccacacaaatcggttctaatctaagtggtgtgatgtatgtgcttgacgagccatctattgggttgcatcagcgcgacaacgaccgtttaattgcctcgctgaagaaaatgcgtgatttaggcaacacgctaatcgttgtggagcacgatgaagacacgatgcgtgcagccgattatctaattgatgtaggtcctggcgcgggtgagcatggtggtcgaatcatggcatcaggaacccccaagcaagtcgcccgcgtgcgtaaatcaattaccggccaatatttatcgggtcgcaagtttatcccggtaccgttaaaacgacggccgggcaatggcaaagtgattcggctggaaggtgcgtctgatcacaacttgaagcatatcaatgtcgattttcctttaggtaagttcattgttgtttccggcgtttccggatcaggtaaatcgacgctggttaattcgattttgcggcgggcactggcgcaaaagttaaaccacaattccgaaaaacccgggccatatgataagattctcggctataaaaatatcgagaaactcatcaacattgaccagagtccgattgggcgtacaccgcggagtaatccggcaacgtataccagtgtttttgatgacattcgcggtttgtttgcggaaaccaatgaagccaagttgcgggggtataaaaagggacggttcagcttcaatattaaaggcggacgctgcgagaattgtaaaggtgacggcatcatcaagattgaaatgaacttcctgcctgatgtttacgttccatgtgaagtctgtcacggcaaacgatataattccgaaactctggaagtcacttacaagggcaagaatattgctgaagttctggatatgaccgttgaagaagcaaccgcattctttaaaaacattcctaagattcgccggaagttacagacgattgtcgacgtcggtttgggttatgtgaagcttggtcagagtgccaccactttatcaggcggggaagcacagcggatgaagttggcaagtgaattgcaaaagctatcaacgggtaaaaacttctacattctcgatgaaccaacaacgggattacacaccgatgatattaagcggttgttggaagtcctcgaacggctggtggatgaaggtaacacagtcctggtgatcgagcataatctggatgttgtcaaaacggctgattgggtcattgacctaggaccggaaggcggagatggcggtggtcaggtgattgctaccggtacacctgaagaagttgccgaggtagcagacagttacaccggccagtaccttaaaccggttttaattcgtgacaccaaacggacgaaagaagccgcggccggttcgtctaagcaggcaaaagcgactaaaacatcgacgaaatagcatcaaaaatagtcgcgtgaaaagcgcgactatttatgtacataacaaacgtttggctttctttgagtttgacgaaaagttatccaccgcgacttcaagccggaactttggggtggaagtcagtaaacagccaccttagacactttttaaattgctttttgaaatggtatgattgaaacgattaagaaagtagggaattaaatgttaaatcgaaagagttttggttttgactggggacagtttatcactggtattttattcctgatcgctgcttttgtggttttacgctatccgttagccactttaaaaaccgttacctttatttttgcggtcgtggcgattattcgtggcattgcgattcttgccggttattccaccttgcgccagtttacaggtaagttagcgtggatttccttactgatggggatttttgatctcgttatcgggttggttttcctgttaaatgccggctttgggatggcaacgattaccatgatgtttgcaatttggttcttggttgattctgtcgggtcattatttaacgtcggccatctgcgcattgccggtaccggctggttcattttatatttgattttggacattctggcggtgattgtttcgctgatgctattcatgcagccggttgttgcagcagtcaccttagtcacactgttggcaatgttcttcgtcttattcggaatcgaatgtatcgtgattgcgttcgcccggcggaatatttaatgtttcatttgaacctgatgacgtggtgatcaaaccgtggcattgggttttttagtaagcgcgagccggcgcggttagaagtcggagtgtaagtggccttgggcgtgatggccggtctttggccattgcgcccaaggtccttacacgcagacttctgcgctggggagcgcgttatgggcgtaaaccagaatataagcggccttaagcgtgatgaccggtctttggccattgcgcccaaggtccttacatgcaggcttctgcgccggggagcgcgttatggagcgtgaaagccaccgactcacggatcgcaccgctgcaagagaaaagtatgaagcagtatgaatgacacgcccggaatgttatactgtatagaatatgatcacaaaggagccgtttatgactgaaagtttggatcttgttattattaccggaatgtctggcgcaggtaagactgtcgccatgcaagcatttgaggatttggggtacttttgcgttgataatatgccacctgcactattgcctaagttttgggaattggtgaaggaatccggcaagatttcaaaagttgcgcttgtcgtcgatctgcgcagtcgggctttttacgatcaaatcatcgatatgctggcaaatttagataacaatgcgtatgttcattcccgaattttatttttggatgctaccgacgaagaattggtatcccgttataaagaaacccgccgttcacatcccctggcaatggaaggccggttgatggatggcattaaaaaggaacgggtgttattaactgagctgcgtaatcgtgcgcaagtggtcattgatacgacgactttaagcccgcgacagttacgcgaaaaaatcttcctgaacttcaaagaaaataatagccaaccggcgtttcatattgaagtcatgtcctttggttttaagtacggcttaccgattgatgccgatattgtgatggatgtccggttcttgcctaatccgttttatatcaaggcctatcgcccgaaaaccggcttggatccggacgtttatgattatgtgatggacaacgaagacgcggaaagtttttacaataagttttacgctttgttggccgaaatcatgcctaagtataaggctgaagggaaaaccagcgtgaccattgctattggctgcaccgggggacaacatcgcagcgtagcgtttgcagaacgtattggcaaagccttttccgatgcttatgcggttgacatcacacatcgggacattaagaagcataaggagacggtgaatcgttcatgagtcgtgaaactaaatttattcgggttattcgcggtcggcgtcctaaagtcgtcgtgattggtggaggaactggcttaccggtgattttgcatagtttacatgagcaagatgccgatgtgacagcgattgtgacggttgccgatgatggcggttcgtcagggacgattcgcaattatattaatgtcgtgccgcctggtgatattcgtaacgttttggttgccttatcggaattgccgagtttgtatctggacatttttcaatatcgctttaatacgactgatgctttttttgccggtcacgcgattggaaatttgattattgcggctttgtcagagatgaaaggcggcattttcccggctgttcagcagttaagcgagatgatgcaggttgatgggcatgtctatcccgccagcaatacgccgctgaccttgaatgccgagtttactgacggtacaaagttgtccggcgaggcggaaataaccgcagccgggaagaacattaagcatatttccgtgtccgagactgatccggctaatggtgaacccaaagccgtccaagaagtgattgatgcgatcatggatgcggatgtggtggtgctgggaccaggcagtctgttcaccagtatcttgcccaacttgatgattggtaacctcggggatgcggtgaaaaagaccaaggcagaagtgatctacattgttaatatcatgacgcaaaaaggcgaaacgcaaaactttaccgatgccgatcatgttcgcgtcttaaacgagcaaatgggtgagaactttgttgatacggtgttggtcaatattgagccggtaccggataattatttggatcaccaaaaatataacgaaattttgacgccggtgaagcataattatcagggactacgggatatgggctgtcgcgtcatttcagaagactttttgaaactgcgcgatcgtggcgttttccatgatggtgataaggtggccaaggagattttgaacttagcctttcaagtaagtgccaaaacgcggaggtgagcgcatggcaagctttgccagtattgtgaaaaaagaactgacgcaactggaagttcatcctgagcatgctaaggcggagctgtcggcattgattcgaatgaacggcagtctaacgttgatggcacatcggtttgtgttgaacattcaaacggagaatcccgccattgcgcggcgtatttatagtttgattcgccaagtgtaccatcacgaagcgaacttggtcgttcatcgaaaaatgaagcttaagaagaattaccaatatattgttcgattgacggaaggcgtcaatgatattctgtctgacttggctattttggatccaaccacgatggccatttcaacgactgtgccagccagcgttttaaaggaaccacaacgcatgcgctcgtatttgcgcggcgcctttttggcaagtggctcggtgaacaacccggaaacatcgcgctatcatctggaaatctactcattatatgccgatcataacgcgggtattttaaaaatgatgaatcattttcatctgaatgcgcggaccgttgaacgtcgcagcggctatatcgtttatctaaaagaagcggaaaagattgccgattttttgcaggtcattggcgctaccaatgcgatgcttaaatttgaagatattcgcatcgtgcgcgatatgcggaattccgttaatcggctggtgaattgcgaaacggctaatatgaacaaaaccattgatgctgctcaaaaacagatcgagaacattaattatcttaaagatcatgtcggtttagataatttgccaactaaattacgcgaaattgcagtgttgcggttggcgcatcctgatgtatccttacaagaattaggggcaatggttcctgggggtacgatttcgaagtcgggagtcaatcatcggttgcgcaagttgaaccaaattgctgagggatatcaacaaccagaagatgcttagaccaaatcgatcatataaaatcgttaataccttattgaccagtaaaataatacctttgtttcctcaagataatcgtgtacaatgtaaccgacaccaagcgttatggtgtgtgtttttgtaggcaaaatatgtgccggtttagtttaaattcacggacataacgccacacattttgtcaaagcaactttactcacgcgtggcagcgattgccgattattttcgacgatatccggaatgttggatgcgacaaagtttgatagtttttgcttcaatttttaggaggaaacatcatggtcaaaccgattacattagatgaacaactgtgttttgcgatttacaaggcacaaaaacaatataaccatttttacgcgcaggcattggcaccgtttaagctgacttatccgcaatatatcaccctgttgtctttatatgaacacggtacgatgtcggttaaacaagtcggacaaacgcttgaactggacagtggtaccttaacgccattgatgaaacggctggatcaatcgcaaacgctcaactgaagacgagcgtcgcgttgatgtgagcctgacgaaaaaggctttggatgcccgcgatcagatttttgaacatgttggctcgtgcatgaaactgatgaatctgccgcagtctgaatatgatcatattaaatccgaagtagcgcgggtggacgaacatttgagtgctatcgctgataatgcttatcccgaagcataaatcttcccaataaggtcaaagattgtgatgaaaatctttgaccttatttgactttagcagtatacttagcactgtactttaaagagtgctaaaaaacgattttttcaggaggttaggacatgctagtacctaccgtcgttgaacaaactagtcgtggcgaacgcgcttacgacatttactcacgtctattaaaagaccggattatcatgttgtccggtgaagtgaacgatcaaatggccaactctgtcattgcgcagctgctttttctggatgctcaggattctgaaaaggatatctacctatacatcaatagtcctggtggcgtgatcaccagcggtctggcaatgctagatacgatgaacttcatcaagtccgatgtgcagaccattgcaattgggatggcggcatccatggcctccgtcttattggctggtggcactaaaggcaagcggtttgcattaccgaactcgaccattctgattcatcagccttcaggtggtgcgcaaggtcagcaaaccgaaattgaaattgcggccgaagaaattttgaagactcgcaagaagatgaaccagattttggccgatgcaactggtcaaacggttgagcaaatcaagaaggacaccgaacgtgatcactatatgagcgcgcaggaagccaaagattatggcttgattgatgatattttggtcaataagaacaaccaaaagtaagtttaaagcgtttaaacccaccgaccttcattaggcggtgggttttttgtttggcataaaagcgtttgtaggtttgacagcaggggcctttttggacgttgagcacgtacattaacggtgtaagattgagatgttgggtttctatgtataattgtgacatgttcaaaattgctttcaggccaactcctttgtttataggcagcaacctatgtaaaggtatgaatgctaatggcctaagtcttggcatcgcctccaaagtcgttcattccaaaaaagacttgcaaagttctgattgattgagtaatataattaggtacttgcgcggttagtgtaatggatcgcacgtgagattccggttctcgaaatccgggttcgactcccgggctgcgcagaaacccagtcaaatgggaaaagctaggaacagtaaaagcccgctacggtgggctttttgtttgccggaaaagtggggaaaacgaatttatgtgcaattttatgtgcaatggacctaaaaaaacgtctaaaaaattggttattgcacacgattgcacacacatagctgaatcgactaaggtacaggcaatacggcggacacagtgatttaaaaacctaaatggtagcgtatgggttgcggctgacacaataattcgagctggaattaaacatggggtgggaagactggaagacttcttaatttagtgaaatatctagtagcacccgttatgcgattacaaacaggcttagcgggctttgtcagtaacaagatagtcttcatgaaagcctgccaacaaataattaatttacaagtgaaaattgctcaaaacagaacatgtctcggtgaaagaagcgcgtgttaggtatattcgggagcctgaaacagtcacacagaaacttcatgaaaatttcattagaacccacccgaaacctgcgttatcaaaaggccgattcagggtcatcgggaaagctaaaaaccgaacacttgaagaattttcgaattagatgttcaaacttagcgggttttgtgattactttaagtcgatttaggcatcagacttgcgataaagcggaacccctgctacaattggttctgttggtaagggaaaacagcaaatgttggattcctaatttttttcagcttgctgggtcggaaaacgactcggagggacgtggaatgacccattaaagaaggacgtgccttatgcatactgaacttgcgtggctcaaagcgatcgcgcctgatctgatgggcgttgtcactaaacgctatcaggtccttcaatttattaactggatggcaccagttggtcgacgaactttagccgaacagatgaagatttcggaacgtgctttgcgtacggaaacggattttctacgcggacaggggcttttggaaagctctaagtccgggatggtgttaacagctaaggggttggaaacttttcatggtctcgatcatctgatgaaccaactactgggcatcaaggatgatgaaaaacgactcgcaactcatttggagattgaccattgtctggtcgtttccggagatgcggatcaaagcagccgagttttagacgaacttggtaaaacgctgaattcaaccttacaattgctgttgccgcccggtcacctgacaattgcggtgatgggcggtacaacgatggctcatttggcttcgcagttgacctttcaattatctgccggccgtgaactatcatttgttcccgcacgtggtggtctcggtgaggctgtcacgattcaagccaactcgattgcggctgcaatggcagaagcaaccgatagcaaataccgagcgttatatgttcctgaaaacctcagctcggaatcctacgagtcattaattaaagagccatcggtaaaagaagttttgacacttatcgataaagctcaagtcgtgattcatagcgtaggtgatgcacttgttatggcgaaacgccgtggcatgtcacctgatacgatccgcatgttgaaagccaaacatgccgttgccgaagcatttggtgttttctatgatgcagagggcaaggtcgtttacaagataccgcaaatcggattacaacttgcggatcttgatcatattccgtatgtcttcgcagttgcggctggcaaaagtaaagccaaggcaattgcggcgtacatgcaacatgcaccgagtcggacgtggctgttaacagacgtcggtgccacaaactcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagctgctgctaacacgattcctcacagcactggtgctgctaaggctatcggtttggttatcccagaattgaacggcaagttacagggtcatgcacagcgtgtttctgttgttgacggttccttgaccgaattggtttccattttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgatggtaagcttaattgaagcatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcggcaaggcaattctgctgtctcaccttggccgggttaagaccgaagaagataaggcaaagctgaccttgaagcctgttgcagaacgccttagtgaattgctgaagaagccagttacatttgtaccggctacccgtggtaaagaattggaagacgcgatcgcgaagttaaatgacggcgacgtacttttgatggaaaatacgcggtttgaagatcttgacggtaaaaaagaatccggcaacgatcctgaactcggcaagtactgggcaagcttaggcgacttgtttgtcaatgatgcctttggtaccgctcaccgtaagcatgcttctaacgttggtattgcctccaacatgaaacaaactgctgccggcttcttgatggaaaaagaaatcaagttcttgggtgacgctgtggacaatccaaagcatccattcatcgcaattttgggtggtgctaaggtttccgataagatcggtgtgattgaaaacctggttcctaaagctgacaagattctcatcggcggcggcatgacttataccttctatgctgccaagggtatgagcatcggtaactcactggttgaaaaggacaagatcgacttagctaagaagatcatggaccaagctggtgacaagctgcttttgcctgttgattctgtggttgccccagaattttctaacgatgcaccgcataaggttgttgaaggcgacattccggatggctacatggcgttggatatcggccctaagacgattcaggaattcaaggatgcacttaagggtgccaagacagttgtctggaacggcccaatgggtgtctttgaaatgagtaactatgctgaaggcacacttgaagttggtcgtgctcttggtgatttgaaggatgcaactacgatcatcggtggcggcgactcaacagctgcagctaagcaacttggcattgcacctaagattacccacatctccactggtggcggtgctagccttgaataccttgaaggcaagaccttaccaggtattgcagccatttctgacaagtaattgttagtgatgctgatctaacagtcattatcgacatgcttgatgcatgtcggtacataatgaaaggaagctatgtcatgcggacaccattcattgctggtaactggaaaatgaacaagaaccctaaggagacgcaagccttcttagatgctgttaaaggtaagttacctgatgcaagcaaagttgaaacagtcattggcgcacctgccattgatctaacgacgctggttgccggtgcagaaggcactcctttgaagacagcggcggaaaactgctactttgaagacgaaggtgcttttaccggcgaaaccagcccgaaagccttaaaagaaatgggcgttgattacgtcattatcggtcacagtgaacgtcgtggttatttccacgaaaccgacgaagatatcaacaagaaggctaaggccatctttaagaacaatcttttgccgattatctgctgtggtgaaagtttggctcagcgtgaagccggtcaaaccgaagattgggttgcttctcaaatcgaagcagctttggcaggcttaagtgccgaccaagttaaggtttcggttttggcttacgaaccaatctgggctatcggcactggtaaaacagcaactgcagatcaagcacaagaagttgttgctcacatccgtgcaaccgttgagaagttgtataataaagatacggcagatgctgttcggattctttacggcggctctgttaaaccagcgaacgtcaaggaattaatggctaagcctgatattgatggtggcttagttggtggcgcttcgatggatcctgacagtttcatcgccttggctaactaccaagattaatctggtttcaatattaaacagccttctggcaaaaaggagaagaatatatgtctatcattactgatgtattggcacgcgaagttttagactcacgtggcaaccctactgttgaagttgaattgtataccgaagatggcggtttcggccgcgcattagttccatcaggtgcttcaaccggtgaacatgaagccgttgaattgcgtgatggcgataaggatcgttttggcggcaagggtgttttgaaggccgttgaccacgtaaacaatgaaattgctaaggctgtgattggccttgacgtcaccgaacaacgcttgattgaccaaaccatgatcgatcttgatggcacgcctaataaaggcaagctcggtgccaatgcgatcttgggtgtttccttggctgctgcccgtgctgcggctgatgaagttggtctgccattgtatcaatatcttggcggcccgaatgctcatgttttgccaacgccaatgatgaacgttcttaatggtggtgcacattcaactaacaccgttgacttccaggaattcatgatcatgcctgttggtgccaagagtgttcgcgaagccgttcggatgggttcagaaaccttccacgcattgcaggcactgctcaagagcaagggtgacatcactgctgttggtgatgaaggcggctttgcacctaacttgaaggataacgaagaagctttcgaattgcttgttgaagcgatcaagaaagctggctacaagccgggtgatgacattgctttagccttcgacgttgctgcttcagaaatgtacgatgctgataccaagacgtacacaaccaagtggtccaaccctgacaagaagtacacaaccgaagaatggaccaacatgattgacggctacattaacaagtatccgatcgtttctgttgaagatccaatcgatgaaaacgactgggaaggctggcagacattcaccgagaagatgggcgacaaagtccaaatcgttggtgatgacctgtttgttaccaacaccgattacctgaagaagggtattgacatgggtgttgctaactccatcctgatcaagttgaaccaaatcggtacattgacagaaaccttcgaagcaatcgaaatggccaaagaagctggttacacggctgttgtttcacatcgttcaggtgaaaccgaagataccacgattgctgacttggttgttgcaaccaacgccggtgaaatcaagactggttcaatgagccggactgaccggattgccaagtacaatcagttgatgcgcatcgaagatcaattaggtgctcaatcacaatacaagggtcgcaagtccttctacaacgttaaagcaattgactaattaacgcttgacgttaacatgaaaagcacgtcacttcaaatggtggcgtgttttttctattcttagcttaagcaaaagatgaacttgctcacgctttgtgactgaggactgtctggtgccggtgcaagcacctatgtctgagcattaataaaacgaatggaggcaatgatgagaaagttttttgcaatttttgcctggcttgagattattttgggcctagccatgctgtggatgacctttgatgttggattgcgagctacaggaccttttttcggcgccttaatcgtcttaattggcatcgtattgctatatggcttattgatctatgcgcttgtcgggtggtttattgatcggcaacattggccgtggtatgtggtaacactagtcgttaccttgatctataacgtgttagcgtggtctttccctaaaatcatggtgcaacgctgggctacgtatccttttccgatgttgacgctgatactcggttgtttgatggcgtggattgcttggcgtgagcagagcgtaacgcacaagtcggtgtagaaaccgggctggttcacgctttccaaaacgcgttcaccagcgcagggatctgcgtgtaaggaccttggtcataatggccaaagcccggccatcacgcccaaggccgcttacactccgatccctaggcgcgctggttcacgctctccaaaacgcgttcgcagtcgcagcaatctacgtgtaaggacctcaagcctcaatggccaaagcccagccattgagggttgaggccacttacactccgattgctaagcgctcctgctcacgctctaaaaatgatgtttttcacgtttccctcaaagggttatactaaataaatgttggcatggagggaagcattttggcacgaacggtaaaagaaaaagaaaaatttgatatcacccggctgcggtttgtcttgctaggactgcttgtaggtttaatgaccggaacagttgtcagtgcgtttcgttactgtattgaagttggcttacgcgccagtcgtcaggtgtacggttatttgcgcgtaacaccgtttgtttggtggcattgggcgttgttaatcggctttaacctagtgcttgctggtattgttgcgtggctgcttaaaaaggaaccgtatatttccggctcagggattccacaggtagaaggacaacttgccggtgagttggaaatgaattggtggtcgattctttggcgcaagtttgtcggcggggttttggcgcttgctcccggtttgtttcttggacgtgaagggccttcgattcagttaggtgcatcagtcgggcaaggcttggcaggcgggtttaaactgcgcggcactgatcgacggttgctgattgcatctggatcggctgctggtttggcggcggcgtttaatgcaccgattgccggtaccttgtttgtgctagaagaggtttatcataacttctcgccactggtttggctgactgccttggctggggcgattggttcggactttatttcgttaaatgtgtttggactagtgccggtcttgcatttgagttattcgcgcagtttaccggttacgagttactggcatttgattttattagggattttgttaggtttgctgggttatttgtatcagcgaatgttactagccatgccccgttggtatcagcgattgacacacttgccgcgtgcaatccaaggtgttgtcccatttatgctcttaatggcggtcggttacttcacaccgaatcttcttggtggtgggaatagtttgattgttggttttggccaatatgtgccatcacttctggtgttattgggtatttttgtgattcgctttatcttttccatgatttcttacggttcggggttacccggcggcatttttctacctattttgtcgctgggggcagtgattggtgcggtttatggcgtggtgatgaatcagctagggttattgccgcatgtttatatcatgaatttgattattttctcgatggccgggtactttgccggtatcgggaaggcgccgtttacggcaatcttgttagtaaccgagatggtgggcaacttaacgcatctcatgccccttgctgttttgtcactgactgcgtatctggtggttgatttgcttggtggggcaccgatttatgaagccttgctggaacagatgacgattcctaaaaccgtcgctcaactgcaccggcctgatcgtttggaaattccggtattcgttggtagttcgttaaatggcaaactggttcgtgacatgccttggccaaaagaagccttgctcatcggcattcggcgtggcgagcgtgaagttattcctcatggggacacgttgattcgtgaaggcgatacattggtattgttgacggatgaagcacaacgagcacgagtgaaacgccgaatagatgctttttcagcagccttggcaaccgcgcataagtctgaaccatagtcgattagggcgaagctttttcaagttggtttagtcaattcaggcgtatacttgtacctagcaaagacgtaccgacttgcaatagaaaggttttgattagtatgaaaaaacttcgcattgtatatgcaattgtcagtattttcttaggcctgttttattcaatcggcggagaactgggtttgcttacgtcatctggtagtggcgttgcgagttttttggtgccatttttgttgggctttgttgctaattggggcatgattgcgttggtcattgcaggattaatcgttgataagcagatgcgctggtggtatctggggtatccggctttgatgggaattaacattggcctgaacctgatattaccgttgcagcttgctgatcaggcgagttatttggctccttttcttgttgcgattattggcggatatatgttgtatcgaacggttaagcaacgtcctgatgccgcttaaatctttcgtcagtgtacatgattttgtcaggtttgaagtgtaaatggcggctaaaatatccggctgacggctataagaacaaaatcgggtaaaattcgcctttgccttgcttttatgctaaactactaaagtgagatttttcgcaagggaggcagcaacttgcaaagtttattgaccacattattagtgatcgattcggttttgatcgtgatcgcaactttaatgcaaccaagcaaacaacaggacgcgttaagcgcattgtccggtggagcaacagatctttttgggaagacgaaatcgcgcggttttgaagcgtttatggagaaagtcaccgtcgtactgggtgtcattttctttgggcttgccatcgcgctggtttatctggaagcccactaaaacaaagtctcctggaacattcaggagactttttttgcagagtacataaaatctgcagtatgctgacataaccatttaatttaagctctttatgtcaggcagggcaacaggcagttatcggttggcggtcttttaggattgcttgctaatcgattgtcacgaaggatgattgatcatgattttccgcaaaccacaaccattcgaatatgaaggtaccgatactggcgtggtattgttacatgcatacacgggtagccccaatgatatgaattttatggcgcgggccttgcagcgagccggttatggggtttatgttccgcttttttccgggcatgggacagtggagccgttagacattttgacaaaaggcaacccggatatttggtgggcagaaagtagtgccgcggttgcgcatatgacggcaaaatacgccaaggtgtttgtttttggcttatcactgggaggtattttcgcgatgaaggcgctagaaaccttgccagggattacagcaggcggtgttttttcatccccgattttgccgggcaaacatcacttagtaccgggttttttaaagtatgccgagtatatgaatcggttagcaggcaaatcagatgaaagcacacagattctggcatatttgccgggacagttggccgcaatcgatcagtttgccacgacggttgctgctgatttaaatttagtcaaacagccgacttttattggacaagccggtcaggatgaattagttgatggtcgattagcgtatcaattacgcgatgccttaatcaatgctgcacgcgttgattttcattggtatgatgatgccaagcatgtcattaccgttaactcggcccatcacgcattagaagaagacgtaatcgcatttatgcaacaagaaaacgagggatagcatgaccacagttggccatattcgtaatgaactattagcaacatttcgtaagaatccgaacattgattattcggttcaaacactcagtcgcgcacttaagttaagtgaaggcggcgattttaaagtactcgtccaggcgttaaacggtatggaaaatgataacctgattcacgccaatcacgaaggacgttatgcattgggcggcgcgcctaaagtcttgaccggcactttccgcggcaacgaaaaaggctttggcttcgtggcagttgagggcttggacaatgatgtttatgtaccggcgatgaacaccgattttgcgcttgatggcgataccgttgaagtgcggatcgttcgtgaagcccgtcccaatgatagtcgcggacctgaaggcgaaatcactaagattgtgcagcgcagtttaaccacactggttggtgaattcaaaccattttccgataaagatcgggctaagtctggatttatcggaatggtggttagtcatgaaaagaaactgaagaattttccggtttatgttaaagataccggtaatattccgcaactcggcgatatgaccgtgacggagattactgaatttccaaccgaatatcatcccaagttgatgtatgggatcgttgtcgagacgttaggcaacaagaatgatcctggcgttgatattatgtcgctggtcatgcaaaaccatatcaaaacggaatttccggatgaagtgatggatcagaccaatgccattcccgatcacgttacgccagaagaacgagttggtcgcaaagatattaccgatcaggctgttgtcacgattgacggggatgacagtaaagactttgacgatgccgtggtggtttggaaattaccaaatggaaacttccatcttggggttcacattgccgatgtttcgcattatgtgacggaaggctctgcgttggatcaagaagcatttgatcgtggtaccagtacgtacttggttgatcgcgtcattccaatgctgccatttcgactatccaatggcatttgttcgttaaatccaggtgtagatcgattggcaatgtcatgtgatatggaaatcgatcatgatggtcatgtcgtaaaccacgagatttatcaaagtgtgatcaagagtcatgcccggatgacctacaacaatgtgaataaaatcgtgaccgatcacgacccggaagtcatggccgaatatcaagaactggtacccatgtttgaagacatggttgaattgcatcagatcttgtataaaatgcgtcatgctcgcggtgccattgattttgaagaaaacgaagccaaaatcattgtggatgatatgggtcatccaactgacattgtgctgcgcgaacgcggcgtctcagagcgcatgattgaatccttcatgctggcagcaaatgaaaccgtggctgagcactacaacaagcagcatttaccattcctctatcgggtacatgaaaccccggatgcagatcgcgtcaaggaattcatggagttcattgccagtttcgggatcacggtaccgatgaaaaaaggcaaggagatcactcctaaacaactgcaagatgttgtaaccgatgtaactggcacgccagaagaagccatggtcaatgttaaattattgcggagcttgaaacaggcacggtactcaccagatccgctggggcattttggcttagcggcaaaatactattgtcacttcacaagcccgatccggcgttatcctgacttggttgtgcaccgcttgattcgggattacgctctggaaggcaccaccgatgacgtgaagacgtcttggaataagaagctgcctgatattgcgacccaagcatcgatggccgaacgtcgcagcattgatgccgagcgtgccgttgatgacctgaagaaagctgaatacatggctgataaggttggcgaagaatttgacgccgttgtcagcggtgtcacgagcttcgggatgtttgtggcactgccaaacaccgttgaaggcttggttcacatcacacgaatgagcgatgattactattcgtttgtcgaaagtcaaatggccttagtcggtgaacgcaccaagcggacttatcgaatcgggcaatcgttgcgcgtgaagttagacaatgtggacatcgatcagcggcaagttgacttttcattgattccagacgaaaaaacgccaaccagcgatttaggcaagttggttaaaaaagatgatcgccgtgatcgacgctcaaatggcagtcgcccgagcttcgggaacaatgggcgtggtggtaatcgtaatcagcccaataatcaacgaccacataagccagcaggtgcgcctcatcaaggtaaacattataacgccaagcgcgggactaaataacgctggcaacttttaaatatacgaggggatggttcaatggcgaagaaacatcgacaaaaacctgacaacctgctcgcccagaataaaaaggccggtcatgattacaacattcttgatacctatgaggccgggattgctttgacaggtaccgagattaaatctgtgcgcgatggcaagctcaatttgcgtgatggctttgcccgtattcgcaacaacgaggcttggcttgaaaatgtgcatatcagtccttacaaagaaggcaatttgtttaacgttgatccgatgcgtaaccgtaaactgttgctgcataaaaaagaaattcgcaagctcggtcaaatgacggcgcgccaaggagttactttggttccgttgcggatgtatcttaaacatggttatgccaaagtgttgatcggcgttgcggaaggtaagcacaactatgataagcgcgaaaccttaaagcgtaaggatcaagagcgtgaggttcagcgggcattaaaagcgcggtattaataaaatttacgctagcatgaaggctttttggcagatgagtgttggtgtaacacaaataggcattagcggtcagagatgacgctgatgcctatttattttgtcctgagtgtggcagccccattcaatgaaaggtcatcgggctctgacgcatcgggccctgacgccttgtatgatgccctaatgatgaaccgccaatagactgttatgattgtagcctaaatgacattaaacgatgatcagttaagcggagggcaaacacgctgatgcgaattgtttgagcgcctgatatgaaggcggtatgatcgctgtatagataccgttttttggcaggattttgttacttatgaagaaagaagggcggattatgaacttagctgctttgttgcatcgcccggaaagtgaagattgtttcttatatacggatgaggcaatgcgtgtgcgatttcacacggcacgtgccgatgttgcgaaggtgacggttctgtatggcgatccttattggcaactgcctgatgcagatggcactaataagttgatttatcagcgccggtcgatgcatttgataggtcacgggcaaactagggatcactgggaggtgacactcgaagctccttatcgccgcctgcaatatttatttgaagttaccggccaagatggcgctgtgtggttgtatggtgatcgcggcgtccgagaaaatcacgcggcagcacgacataaggcggaaaactattttcggatgccgtattttcatgcgattgatcgggttaaaacgcctgattgggttaaacagacagtttggtaccagatttttccagaacgctttgccaacggggatcccgataacgatccgattggaaccaagccgtggcggccaacggatcatcccgggcgcgaggattattacggcggtgatttacaaggggtactggaccaccttgacgatttacaagcgcttggtatcaatgggctgtatttttgcccgattttcacggctgcttccaatcacaagtacgatacgattgattatttgaacgtggaccccgcgtttggcgataaagttttgttcgcgaaattgattcaggcggctcaccaacgcgggatgcgagtcatgcttgacgcggtgttcaatcatatgggctttggcagtatgcagtggcaagatgttttacgcaacggagaagcatcgcggtttgcgtcttggtttcacatctatcaaacaccagtcacaccgtttcacaatcctctcaagaatgccggccaaccgcagtatgatacctttgcatttgaagaaaagatgcctaaattgaacactgccaatcctgaagttcaagaatatttattaacagttgccacttactggatcaagacatttgatattgatgcgtggcggttagatgttgccaatgaagtcgatcatcatttctggaaaaggttttacgccacggtaaccgcgattaagccggacttttatgtgttaggtgaagtctggcatcgcgcgcagccatggttaaacggggatgaattttccggggtcatgaactatcccttcacgcagcagattgaggatcactttttcaagcgaacattgaccgctgaagaaatggtggcgctgttaaccgatcaactcatgtactatcgcgatcaaaccaatcaggttatgttgaacatgctggattcgcatgatacgccgcgcatcctgacgctggcgcatggtgatgaagttctggcattgcaggcgttgacgtttacctttatgcagactggtgcgccatgcttgtattatggtaccgagatggggatgtcgggtggcgatgatccggatgaccgcaagccgatggactggagcaaacttggcagcccgatttggaaaaaggtggcggagctggtacactttcgccggaaacacgcacagacattaggccaaggcagcactaggatgtcggtgactgcggccggtctgataaaagtgacccgccatggtgatgaaacgttgacggcttactttaatacgcaggatcatgaagcagccgttggtggcagtgctgttttgacgcaaggttttacgaatggcaagttggcgccaaaaggatttatggtacaagtgggtaaccggtaaggagtatcagggtttgcgtatggaacgagacctacctgtgcaaaggagtacgtgccataacgcgcttaccggtacaggtttctacccgcgccagtaagcgtttattttcttttagtggggggattaaaagtgaagcgattattcgaagtcgatccttggttagtggcaacacatcgtttagagaagacagatcgtcggctgcaagagagtatcacggcggtaggcaatggttatatgggcctgcgcgggaattttgaggaaggttacagcggcgatggtttgcaagggacgtatttaggcggcgtctggtttccggataaaacgcgtgttggttggtggaagaacggttatccggagtattttggcaaagtgattaatgcgcccagttttctggggattgggataacggttaatggtcaacaggtggacttagccaaaagccattaccgcgacttttatctggcgttggatctgcatcaagggttgttgacacggcggtttgtttatatcggtgctgacgtggaagttcagtttgagtttgcccgctttttgagtcagacaataccagaggcagctttgatcaccgttaatgcgagcgtgttaaaaggaaccgccacgatcacttttgacgctaccttggatgggcgggtgacaaatgaagatagtaactatgatgagcggttttggatagcgcagcatgaggatgcaacggctaaaagtattcaactgcaaacaaaaccgaatccctacgccgtcccgcaattcaccgtattacttaagcaacaattacgcgtgaatgggcaggcaattgtcggcaaagtcacaactgctagtgggtggcttcaggagcaggtcacagtgcatttaacaacaggcgagcactatcagctggaaaaagatgtggtggttgtgacaagtcgtgatattgcccctgacgatcaagccgcaaaagctacccagctgatgaaccgagtcgtcaaggatgatttcaagacccatttagcagctcacacgcaacgttgggctcagcgctgggctaaaagtgatgtcgtcattgatggtgatccggccgcgcagcaagggattcggtttaatatcgcgcaattatttatgacttactatggtgaagataaacgtctcaatatcgggccaaagggatttaccggtgaaaaatatggcggagcgacttattgggacaccgaagcttttatcgtgccgatgtatttagccgtgaccccgccggaagtgacccgcgcgctgctgcagtatcggcatgatcagttaccgggtgcctatcacaatgcgcgtcagcaaggcttggccggcgcgttatatcctatggtgacgtttaacgggattgaatgtcacaacgaatgggagattacttttgaagaaattcatcgaaatgcggcgattgcctttgcgatttatcaatatacggtttataccggcgacgaaagctatgtgaaccacgatgggctcgaagtattggtcggcattgcccgcttttgggctgatcgggtgcactttagccagcatgcccaaaagtatatgattcacggggtcactggccctaatgagtacgaaaataacgtcaataacaattggtataccaataccatggctgtgtgggagttgcagtatacgctggcacggttacctaaaggcgatcctgatattgtggcggcattggcagtaacagatcaggaaaagcggcattggcaggcgattattgaccagatgtattatcccactgacaagaaattggaaatttttgtgcaacaagacggctttttagataaggatatacggccggtaagtacgattccggatgcgcaacgcccaattaatcagcattggtcatgggatcgaattctgcgttcaccgtttattaagcaggccgatgttttacaaggattgtattttttaaacgaccggttttcgcacgcggaaaaagaacggaattttgatttctatgagcccttaactgttcatgaaagctcacttagtccgtccattcacgctattttggcggcagaacttggcaaaatggatacggccgttgccttgtatgcgcgcacggctcggttggatctggatgattataatcacgatactcaagacgggttgcatattacatccatgagcgggagttggcttgcgattgttcaaggatttgccggcatgcgctatgaccatgaccgtttgcgctttcggccacaattaccgaaaaattggcggcggtatcaatttaagctgacttatcgtggccgtctgttagcagttgacgttggccaaaaggtaacggttacgctacttgctggcccaccgatcgatctcgacatcaatggtgaaacgcagcacttggaggtggaggatgaccatgcttaaagggtttatttttgatttggatggggttttaaccgacacagccacttatcatctggctgcttggcatgaactggcgcagcgtctcgccattcacttgccagctgcggccgatacggcgttgcgtggccgctcgcgaatggactcgctgaatctgatcctgcgttatggtcatcaagaaaatgactacgatgaggcacaaaaagccgccttagccgcagaaaagaatcagcgctaccaaacgttcattcaatcactgacgtctgcggatattttaccgggaataccagcactgttgaaaaatgccaagcaggcggggttaaaattggcgattgcctcggcgtccaaaaatgctccgttgattttacagcggttgggattattcgcgcaattcgatgcgattgtcgatccgcaaagtctacaccatggcaaaccggatccggaaatttatcgcgcggcgcaggaattgctgaagttgcaagccgatgaggtcattagctttgaagacgcaccggttggcatcgcggcgattaaagcagccggccagtttgcagtcggcatcggggaggcttcggcattggcggcggccgattatttggttagcaatacagcccagcttgattataatcaaattgtcgcggcgtttgagcggtatcatgcgcggtaatcagcgacgtcacgctaagttgatacggatattgataggtcaaaaatcatgtgctgaaaagtaaaaacattttgacatttctttcgctggcgttatactaatcatgtcaaaagaatttgacatttaaggggtgagagccatgaagaaaatggatgaaatggagcggaattttgccgatcactcgataagaattgcttacatgatgatgtttctaatgttatggtcaagtgcggtttttcagcatattcgtacaggagcgtggaatttcgatttctttgtggttaacgtggtgacagttgttcaaattgccagctatgagtggttcaaacaccgagctgattcaactgacaaggagccgggacgagttttgtacatgaccatcgcaggggtggcgattgttcttgctgttggcgtgctcgccttgatgcgtcatggaaaataagattcggagcctcaaaactcagcggcatttgacgcaacaagaattaaaggagtgagagccatgcggaaaatggacgaaatggagcttaaactttcagatcaatcggtcaaatatgcctatgtttttgcgatgacatcattggtcttttataatctttttcagttggctcatggtgaaaaaggcgattttacatcgtttgtgataggcgctgcgattgtcattcaacttggaagctttgaatggcttaaacatcgggcggataaaactgatcgcgaacctagccgtattttagttggtacgattattttagtggccgctcttttaaccttgggcttgctgatgctgatgcgtcatggaaaataaaattcgcacccttagaacccagcagcacctgacgcaacaggaattagcagatgcagtcaatgttacgcggcaaacgatcaatgccatcgaaaacaataagtatgatcccacgttgtccttagcattcgcgttagccaggcagttacagacaaccgttgatcatctctttcaaagttaaaagcaggctgtccacgtcaacaacgtgaatagcctgctttttagatagatcaatcatcatcttctccgagcgcatcgaagtcataataaagatcacgttcgggtaagacaacatctgcatttgtttccgcgtcaatcgcctcagcttcacgttccgggtgaaagctatgccacggcacgatcacccgggggttcacttctttagccaacgtgattaagtcctcgcgagttgcatggccggaagcattcataaactgcaaaggaatttgatggtccgccaaccaatccttcagctgagcaaaccgcggatcgtaatcccccaaaggttcaccgttactgtgtacataagcgctgattggtaagtctgccaaccgttcaaggtgcgcgtaactattttgcagaacatattgttgaggcgcctgtgcaaggtcagttaactggattgttttgccaagaatcgcatcaggctgctggttggtcattgcagttaaaattgccgcttcgttaggctcccacaccacctgacgcccgcttgcatgcgctgaaacttggaaggctgccatccgctcataattgcgattgtaagggttaatgacaaccagttgcgagctgtcagtcagcaattggcgaaatttagtttgcaggctcatttcggtcagtggcacacttggatgatcctgatcttcaactggtgtcggtgtatcaaacgaaaagctagtgccttcaagcaagaagagactgatcttttcagcattgaaacggctagcccaggcgtgcacgcgatcggcatgcgggccattgaggcgaacgtccccggaatgggcaaagcggcgcgcaccatcatcaatcaacagcgccatcactccgggttcatcgtgatcgctgtgaaacccggttactgtcaaatcgccaattgccagtggcgattcaaaggctaagggatggagattggcaaccggtttttcgatgcctaagcgaatgagcacctgatagaggcgataggatggttcggaaagataaatcggaatgtttttctgcaaatattgtaaggcgcccatgtgatcaatatgcaggtgcgagatgaagatggcttcattggcaaacgaatccggttgatcgaaaaaaagttccgggacatgcggtaatttgccgttatcaatggccgaggcaaccgtttcatggcttaaatcagctgcaaccccaaaatccatgatgacccggctagttttggtagcaaattcaacaatgttgccgccaatggtattgagaccgtttaaaaagcgaatcgtcgtcacaataatttcctccaatgtctctcgttggcattcgcgagaacattaaatcgtaccccgtctatgcgtgaaaagcaactattaaagtgaacccggaaattaaaatcagcctcagagacagtttcgtctctggggctgattcggtgtcgtgctggtatgacaagtcataatttagcataccaacctagtagtttttggttatttgtttgtcttgataattgtttctgcctgactttgcagcgtcttcaaagcttggtctggtttttcgtgtttcgtcagcatagcatcaaccgcgttcagaagatcgttgcgatattccgagaagccgatgaaggcagtagattggaaaccgaagccgagtgaatcaacagctgctttgctggttggattatcactgagatatttcttgaagtcagctgattgaaccgcggatttacgcagcggaacataaccggttaattgtgcccacttggaagtttccttttcagatagcaggaacttcatgaatgcccaagcacctttttgctgatcagtagaagcggatttgaagaggacaatatcgttgcctgccagttcggttgctttcttgcccttgtaacttggtagtggcatggtgccccacttaaagtctttgggcgcattttgcttcatgttggtgataccggcactggagcccgcgtagaagagcgttttgccggaagtgaagttcttatcgccataaatatcttcgccagcggttttagcctcgccgttgttcaccatatccatgatgaagttggctgcggttaaagtcttcttgctgtccaggtttgccttcagcgggttagcagaaacaagcggattgcctgcttggcgtgcaagtccttcgaattccatatcgaaactcttgtcaaagccaattgccgcaacgccgtcagccttgagtttctcggcatccttcttaatgtcttcccagctctttggcttatcaatgttatacttcttcatcagtgcttcattataaaagagaatccgcgttgacttggagaatggcacgctatagtacttgccttggtacttggagctagacaagaaggctgggtaaatatccttcaagtcgctactgctcattttgtcatcacctttgagcatgtattgatcaagcggggtgatgaaaccatttttcacataatcaggaacggtggtgtaggttgtctgcgcaattgtcgggagattacgcgactttgcggcagccataatcttttgctgcaacgcggtgtaattgccttgcgcggtgccgacaactttatactgcttttggctcttgttgaagtccgtgatgatctgattaagcgccttttgataaggaccgttcatcccatgccaaaaggtgatcgtcacacgtttacccgaatcgctcttagtcgtggaactggatttgctgctactgttgctgccgcatgcggttaagatggcaaccaacatgaccgtaaacattgcaagtaatgcttttacccaagtttgctttttcattttgatagattatcctttcaatccagctttagaaatcccagcaataatgtacttctgcaagaagatatacaaaataaccattggaatgatgacgaatgtggaagccgccatcaaaagttgatattgtgtgccggcatcagttgtgaaggcctgtaagccgactggcaaggtgcgcatcttatcagagttcgtgacgatcaaaggccacatgaatgcgttccatgacccgatcacctgaaggacggtaaccgctgtgatcgtggacttgctcattggaacgagcacctgccatagatacttccaatccgacgccccgtcaattttggcggcataataaatctgatccggcgtcgattggaaagtttgacgcaacgtgaagacggtaaagaagctggccagccacgggagaatcagcgctccgtagtggtcgatttgtcctaagtgcgacaaggtgacgaaattggggatgatcagcatttcaccaggaatcatcatggttcccaagaaaatgataaacagaatattcttgccatagaacttcaaccgtgaaaaagcgaaggcagcaagaatactggtgaaaagctgtccaaccgtggtcaccaccgttacgatgatactgttgatgaaatactgaccaaatggcgcttcattccatgccttaacatagttgctccactgcaaggcctttggaatccaaattggtggaacggcgattgtttccggtgcggttttcagcgatgtcgaaatcatccatagaaaggggatcagcatggtgatggcccctaaaatgacgatcagataaagtaagactttactgagcttttttgccatagtttgcttttcccccttaataatgaacgtgcttgcgcgaataccacagctgcacgagcgtcacgagcaagatgaggaagaaaagcacaacgccggatgcggccgcaatcggatacttatactcggtgtaaaatttctggtacaagtagtacacaatcgttaaatcggccttgcctggtcccggcgtcccttggaataaggcaaagatttcatcaaacactttgaaactgccgataatcccgttaacggaaaccaggaaagtgatcggtgaaagcatcggaatcgtgatgttccagaatcgctgacgagcattggccccatcaatttcagcagcttcgtaataaccgtggtcgatgttgtttaagccaaccaggaaaaggatgatgttgaagcccaaacttttccagatactcatgatgatcagtgccaacaaggcgtagtgcggatcagtcaaccagttaatcggatgaagtccaaaccagctcatgaagtaattgatcaagccgtaattaccatggaacatccaattccagaccatcgcaatcgcaaccgtacttgtgacaaatggtaagaaatacacggttcggaaaaaaccggaaatgatctttacctgattaagcagtaaagcaataattaatgacaaaacaactgttatcgggacaacgccgatcacaaagaccaaggtgttgcgcactgctaaatgaaaatcaggatcattccagagatagacgaagttgtcaaagccccagccgctgaccttatccgtgtaaaagtcatacttggtgtatagactcattaaaaaggaattaatgatcggccagatattgaaggtgatggtaatgacgagcattggcagtaaatagagtgctgctttagccgtcgatttgagcgtggctttttcattcagcatgactttcaccaccaaaaatcaaggcgccagactgatcaaagagaaaaaatcctgatttagtgatgtaaaaatccaactccggtagataggctggaagtggaagtgcagcgatgcatggagcggaccagtactaatcggtcgaggacttaaccaagtaaagcgcaaactggcgtaacgccagcgcgcgtttcgatgaaatacgttaagttccggtaaaaacaacaacaatgatagccagttttgagagcgcaaagttctcataagtgtggtggcgatagcaagaaggatacacctgttcccatgccgaacacagaagttaagcttcttcacgccgagagtagttggtgggagactgcctgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctcatttaacccaccttttgcgggtgtggcggaactggcagacgcgctagatttaggttctagtggtttttgaccgtgggggttcgagtcccttcacccgcattgtatcttacatgatttgctcgggctctaaaggctgctcctcggtcacaattgaatagctttgatatgcggaagtagttcagtggtagaacatcaccttgccatggtgggggtcgcgggttcgaatcccgtcttccgcttttcactttatgccggggtggcggaattggcagacgcacaggacttaaaatcctgcggtcagtgatgaccgtaccggttcgatcccggtcctcggcattttgttgaagcacccatagcgcaattggatagagtgtctgactacgaatcagaaggttgtaggttcgactcctactgggtgcatcattggtcgctatgaagctgtggcgctgatcaaatttcatattcggtatgcggaagtagttcagtggtagaacatcaccttgccatggtgggggtcgcgggttcgaatcccgtcttccgctttaccgggaagtagctcagcttggtagagcactacgttcgggacgtaggggtcgcaagttcgaatcttgtcttcccgattcttggatcacgacaatcgtggtccttttttcgttctccaaaaaacattggtcatggtggctgcctgcgtgtaggtgaccgtaaactcagcgcctataacgtgtacagccactcacattctgaattctaaccggtactgttttcgtttacctcaaagcatatatttgtataaatacattgatgccagtataatgtgtaatagtcaagattggtcaaagtcaaaaaggattgaatggcatgcagcgcgaaaatatttcggatattattgagacatacttaaaaacgatactggcacaggaagcggctgttgagattcggcgagcggaaattgcacggcgctttaattgtgttccttcgcaaattaattatgttatcaagacgcgttttacaccggcacgtgggtacattgttgaaagtaagcgtggcggcggtggctacattcggatcgtgaaggtcaaattgacagatgatcaggatctcattcaaatcatgcgccagcacattcctagtcgcttgcggttacgcgatgcacgggatttgctgcaggaactgtttgataatgggcttatttcccaacagtccggcaatttaatgctagccgtgatcaatcatgagactttgggaattcttgatcaagaaacagaagaacacttacgatcgcgtttgtttcttgcatttttggatcgtttgcggtatgaaagataaaacagtttataattggctttttaaaaaaggagcgtgcttatggacaacttatttacccctagtgctaaaaatgtgttgcttttagcccaggaacaagcgaagtacttccatcatcatgctgttggcacggaacacttgcttatggctttggttatggaaaaggatggtatcgctggtaagacgctgcgtcagttaggggtcacagaaaatgatgtccatgacgagatcgagcgcttcacaggatatggaactgttgatgccgccagtcaagctagcgatagttatttgccatactcaccaaaaggcaaggaaattctggcatttgccggggacgaagcaaaacgcttaggggcgttaaaaatcggcaccgagcatattctgctgggactattgcgagaagacgatattttagctgcgcggattttacaaaacttagggctcagtctctcgaagacgcgtcagatggtcttcaagaaaatgggcattgcggatacggcggcaaagcggcggccaatggcacgtggcggcgctcgccaagacggtcaggggacaccaacgcttgatggcctcgcccgtgatctaacccagatggcgcgcgaaaatcggatggatccggtggttggtcgcgacaaagaagttcggcgcttgattcaaatcttggctcggcgcactaagaacaacccggtcttgattggtgaacccggtgtcggcaaaacggccattgcagaaggcttcgctgaaaaaattgtggctggaaaagtgccggatgatatgctgaacaaacgcttgatgatgcttgacatgggttcgttggttgcaggcactaagtatcgtggtgagtttgaagatcggctgaagaaaattattgatgagatttataaagatggcaatgtcattttattcatcgatgaattgcacacattgatcggtgctggcggtgctgaaggggcaattgacgcttcaaatatcctgaaaccggcattggcacgtggcgagcttcagctaatcggcgccacgactttagatgaatatcaaaagtacattgaaaaagatgcggccttggagcggcggtttgcaacaattcaagttgacgaaccgactgaggaagaagccgaacagattctgaaaggtttgcgtccgcgttacgaagcacaccatggcgttacgattaccgatgaagcgctgcatgaagcggttgtgttgtcgtcacgttacattacaacgcgttttcttccggataaggctattgacttggtcgatgaaagtgcggctaaagttcgccttgataaagctaacgtggagaccaaagctgataaacttcaggatgaattagctaaactggttgccgacaaagaagatgcaattgatcatcaagacttcgaaacggctgctacaatccggactaaagaagcgggcgtcaaggctaaacttgccgatacgcctgaaccggtgaatgaaagtggtgttcgtaccgatatcaaggtcacgggcgcagacgttgccgaagttgtatcgcaatggaccggcgtgccggtcacgcaactgcagaaaaaggaatctgaacggttggttaatctcgagaagattctgcatcagcgagttgttggccaggatgaagccgtttcagcagttgcacgggcaattcggcgtgctcgttccgggttgaaggatccgaccagaccgattggctccttcatgttcttgggaccaaccggcgtcggcaaaaccgaattagctaaagcgttggcagaagcgatgtttggttccgaggacgccatgattcgggtcgatatgtccgagtatatggagaaattcagtacgagccggttaatcggcgcagcgccaggctatgtcggttatgacgaaggcggtcaattgacggaaaaggttcgcaacaagccatattcggtcgttttactcgatgaagttgaaaaggcgcatcctgatgtcttcaacattttgttacaagtcttggatgatggctatttaaccgatgctaagggtcggcgggtcgattttcggaataccattttgattatgaccagcaatatcggagcaactgccattcgcgatgataagacagttggatttggtgcaaaagatccaacagccgacttcaatgccatgaagagtcggatgttggctgaactgaaaaagagcttccgtccagaatttcttaatcgaattgacgaaactgttgtcttccatagcttgaacaaggctgagttgcatgagatcgtcaagattatgaccaaaaccgtgcttagtcgtatcaaagatcaaggaattgacgttaaaattacgccagccgggattgatgcgattgccgcggctgggtttgatcctgaatatggtgcgcgcccgatccgccgtgccttgcaaacggatgttgaagaccaactcagtgagctattgctgacgggtcaggctaaaaccggtgatttgattcaaatcggcgctaaaaaaggcaagctgacgtttacagtcaaggaaaacaaaggtaagcataaagaaaacggcgcttctaaagaacctgtcaaggcatgatcaatagcaggctcaaatatgtcaggttccactaataacgcttaaaaagatcggtcttagaggtgaagcattatctctgggaccgatttattttgccaaaacagtcagtgatggcgggacgcgattttgatgctatctggccttgcattactttgacgatcgacaccttgcattactttgacaagcaggtgcttgacattgttactccgcacgcgtattattaaataaatcgcatttcggtttggacaggctgtcaggacgatctattgtccgttctgactaatgaaaaaagcaaaaacagcaggctggttgaaggtcgatctgtttttggtttttttttgctcaaaatgtctgcgggatggtcaatgtcatgtaaatttaacaatatttacattatttttacaatcatcaagccggaaaatcttacaaggggtgaataatttggcaggacacttagtgaattatggtaagcaccggacacgccggtcttatgcccggatcaaggaagttttggatcttcctaatctgatcgagatccaaacgaattcttaccaatggttcctcgatgaaggtcttaaagaaatgttcgacgatattatgccgatcgatgactttcaggggaaactgtcactggaatttgtcggctatcaactgctggaaccgaaatatactgtcgaggaagcacgccaacacgatgcgaactactccgcaccattgcatgtaaccttacgtttgacgaatcatgaaactggcgaaatcaagagccaggacgtcttttttggtgattttccattaatgacgaaacaaggaacgttcattatcaacggggcagaacgggttatcgtttcccagctggttcgttctcctggcgtttacttccatagtgaaacagataagaattcacgggtgacgtatggcacgactgtcattcctaaccgtggggcatggttggaatatgaaaccgatgcgaaggacattgcgtatgtccggattgatcgcacgcggaagattcctctgaccgaattggttcgcgcattgggctttggctccgatcaagacattattaatatgttcggggataacgattcgttgatgctcacgcttgaaaaagatgtgcataagaatacggatgattcccgtactgatgaagccttgaaggatatttatgaacgtctacgtccaggcgaacctaagactgctgattcatcgcggtcacttttgtatgcccgcttctttgacccgaagcgttatgacttagcctctgttgggcgttacaaggtgaacaagaagctgagcctgaagacccggctattgaatcaggttttagcggaaacactggctgatccggatacaggtgaagtccttgcccaaaaagggaccaaagtggatcgccaagtgatggataagctggcaccgtacttggatcgggatgatttcaagacggtcacttatcaaccttctgatcaaggtgtgatgaccgatccgattgagctgcagagtattaaagtttactcacaggtgaccccggataaagaaattaatttgattggcaatgggcatattggcaagaaagttaagcatattttgccagctgacgttttggcatcgatgaactacttcctgaacttgcaggagggccttggcacggttgatgatattgaccacttgggtaatcgtcgtattcgttccgttggtgaattattgcaaaatcagttccggatcgggctttcgcggatggaacgggttgttcgcgaacggatgtcgattcaggacaccgcaaccgttacaccgcagcaattgatcaatattcggccagttgtcgcttcaattaaggaattctttggtagttcccagttgtcacagttcatggatcagaccaatccgttgggcgaattaacccataaacggcgtctgtctgcccttggacctggtggcttgactcgtgatcgtgcgggttatgaagttcgagatgttcattacacccattatggccggatgtgtccgattgaaacccctgaaggcccgaacatcgggctgattaacagcttggcttcatacgcggtcgttaacccatacggcttcattgaaacgccatatcgacgggtttcatgggatacgcataaggttaccgacaagatcgattacctgacagctgacgaagaagataactacattgttgcgcaggcaaactcgccactaaacgatgatgggtccttcgttgatgacacggttttggcccggcataaagataacaatattgaaatttcaccagacaaagtcgactacatggacgtttcgcctaagcaggttgtcgcagtcgcaaccgcctgcattccattcttggaaaacgacgactctaatcgtgcgttgatgggtgctaacatgcagcgtcaggcggtacctttgatcaacccgcatgccccgcttgtcgggaccgggatggagtacaaagccgcccatgactctggaaccgcggttttggctaacaatgccggtacggttgaatatgtcgatgctaagcaaatccgggtacgtcgtgaagacggtgccttggacacttacaaattgatgaaattcaagcgtagtaacgccggtaagaactacaaccaacgtccgattgttacgatcggtgaccatgtcgatgtcgatgaaatcattgctgatggaccagccatgcaaaatggtgaattggcattggggcaaaacccaatcatcgccttcatgacttggaacatgtacaactacgaagatgcgattgtgctgtctgaacggttggttaaagatgatgtttacacgtcaatccatattgaagaatatgaatcagaagcacgtgacaccaaacttggacctgaagaagtcacgcgtgagattccaaacgttggtgaagaagccctcaaggatctcgatgaattcggggttgtccgtgtcggtgccgaagttcgggatggcgacattctggttggtaaagtaacgcctaagggagtcacggaattatctgccgaagaacgcctgctgcacgcaatttttggtgaaaaagcacgtgaagttcgcgacacatcgctgcgggttccgcatggtggcggcggtattattcaggacgtcaaaatcttcacccgtgaagctggagatgaattatctcctggcgtcaacatgatggtacgggtttacatcacgcagaagcggaaaattcaagttggtgacaagatggccggtcgtcatgggaacaaagggacggtttccgtcgttgtgcctgaagaagacatgccatacttgccagatggtaccccagtcgatatttgcttgtcgccaatgggtgtgccaagtcgtatgaacatcgggcaggtgctggaattgcatctgggcatggctgctcgtaacttaggcattcatgttgcaacgccagtctttgacggtgccaacgataaagacttgtgggcaaccgttaaagaagccggcatgccatctgatgggaagtcagtcttatatgatggccgtaccggagaaccatttgaaaaccgggtatctgtcggtgtcatgtattacatgaagctatctcacatggttgatgataagatccatgcgcgttcaattggaccttacagcttagttacccagcagcctcttggtggtaaagctcagtttggtggccagcggtttggtgaaatggaagtctgggcccttgaagcttatggtgcagcgtataccttacaggaaatcttgacttataagtccgatgacgttgttggccgagttaagacctacgaagccatcgttaaaggcgatccaattccaaagcctggcgtaccggaatcattccgtgtgcttgtcaaggaattgcaagcgctgggacttgatatgaaggttctaggtgctgataagcaggaaatcgaattgcgcgacatggacgatgacgaagacgatgttgtttctgtcgatgcattagcgaagttcgcagctcagcaagaagaaaagaaggcacacgaagccgcaacccaagcaagtgacggtcagtctgccgacaatagtaccgacgataagaaataggaggttagccctttgattgatgtcaataagtttgaaagtatgcaaatcggcttagcctcgccggacaagatccgcagctggtcttatggggaagtcaaaaagcccgaaacgatcaactatcggaccctaaagcctgagcgggacggcttattcgatgaacgtatcttcggaccgaccaaagactgggaatgtgcctgtggtaagtacaagcgaatccgctataagggaatcgtttgtgatcgctgcggcgttgaagtcacccggtccaaggttcggcgcgaacggatgggtcatatcgaattagctgcaccggtgacgcacatctggtacttcaagggaattcctagccggatgggtctggtactcgacatgtcgccacgttcacttgaagaaatcatctattttgcttcctatgttgtgattgatccaggcgatacgccaatggagaaaaagcagctgctaaccgaacgcgaatatcgcgaaaagcgggaagaatatggacagaccttcaatgccaaaatgggtgctgaagccatcaaggaattgttgcaggatgttgatctcgaaaaagaagtcgctgaattaaaagaagacctgaaatcagctcagggtcaaaaacggacccgtgcgattcgccgtctggacattttggatgcgttcaaggagtccggtaatgatccggcatggatggttatggacacgattcctgttattccaccggatttgcggccaatggttcagcttgaaggaggccggtttgcgacctctgatctaaacgacttgtatcgccgggtcatcaaccgtaacaaccgtctgaagcgtctgcttgatctcaatgcaccaagtattatcgtgcaaaacgaaaagcgcatgctgcaggaagccgtcgatgccttgatcgataacggtcggcgcggacgtccggttaccggacctggtaaccgcccgctgaagtccttgtcccacatgttgaaagggaagcaaggccgattccgtcaaaacctgttaggtaagcgtgtcgattactctggccgttcggttattgatgttggcccatggttgaagttttatcagtgtggtgttccgcgtgaaatggccttggaactctttaagccatttgtcatgcgcgaactggttaagcgcgatatggcaagcaatattaaaaatgctcgccggaagattgatcgccaagatgatgatgtctgggatgtcctcgaagatgtgattaaggaacggccagtccttttgaaccgtgcgcctactttgcatcgactgggtattcaggcatttgaacctgtcttggttgatggtaagtccattcgcttgcacccactggtctgcgaagcttataacgctgactttgatggtgaccagatggcgattcacgtaccgctatctgatgaagcaatggcagaagcgcgcatgctgatgctggcagcgcaccacattttggcacctaaagacggcaagccaatcgttaccccttctcaagacgttgtgttaggtaactactacctgaccatggagcagaagggccgcgaaggcgaaggcatgatcttcaaggataccaatgaagtgttgatggcgttgcaaaatggctatgttcatctgcacagtcgtgtcgggattgcggcgaactcctttacggacaaaccgtttactgatgagcagaaacaaaagattatggtgacgagtgtcggcaaggcgatctttaacgagatcatgccaaaagacttcccgtatttgaacgaaccgactcaggacaacatcgtcaatggtgtgccggataaatacttcatagacaaaggtgaagacatccatgcttatcttgaagatgcacctttgatcgatccattcaagaaaggattcctgtctgacatcattgcccaagtcttcaaggtttataaagttcagcggaccagtgacttgctggatgacatgaagacactcggctatactcagtcaacgaattccggtttgacggttgggattgccgacattacgaacttgaaggaaaagccagagattgtggcggcagcccataagaaggttgcaacggtttctaagcagttccgtcgtggtttaattactgacgatgaacggcatgaccgggtcattcagatctggaacgacgctaaagatgaaattcagcaaaaactggttgattcttttgacccgaacaacccaatttccatgatgtccgattccggtgctcgtggtaacatctcaaactttactcagcttgccggtatgcgtggtctgatggctgcgcctaacggagggatgatggaagttcctgttatctcgaacttccgtgaaggtctaaccgttatggaaatgttcatgtcaactcacggtgcacgtaaagggatgaccgatacggcgctgaagacggctgactcaggttacctgacccgtcgtttggttgatgttgcccaagacgtcattgttcgcgaagaagactgcggtactgatcgtgggttggttgttcgtgcaattcgtgaaggtaacgaaatgattgaaccgctgtatgatcgtttggttggccggttcacgatgaaagacgttcttgatccaaagactggcgatgtgctggttaaacgcaatacgcttatggatgaagacatggctcagaagattgtggatgctggtgttgaagccgttaccattcgttcggtctttacctgcaacacgaagcatggtgtttgccagaagtgctatggtcgtaacatggcaaccggcgaacaggttgaagtcggtgaagctgtcgggaccgtggcggcacagtcaatcggtgaaccaggtacccagctgaccatgcgtaacttccataccggtggtgttgctggtggcgaagatatcacgcaagggctgcctcgtgttcaggaaatctttgaagcacggaaccctaaaggtgaagcggttatcactgaagttactggtgaagtaacggcaattgatgaaaacccagccgagcatacgcgtgaaattaccgtcaaaggtgacaccgatacccggacttacagcgtgccatatgcttctagtgtggccgttgcagaaggagatcacattaaccgtggcgaacgcttaactggtggttcaattgatcctaagcaattgatcaaggtgcgcgatgtgatggcaaccgaaaactacctgctttctgaagttcagaaagtttaccgtatgcaaggggttgacatcggtgataagcacgtcgaagtaatggtacggcaaatgttacgtaagatccgcgtcatggatccgggcgacacgaatattctgccaggcaccttgctcgacattgcggacttcaaggaaaagaacacgcaagcaatcatcagtggcgggatcccggcaacgggtcgtccggtcttgctggggattaccaaggcttctctggaaactaacagcttcttatcagctgcttccttccaagaaaccacgcgtgtcttaaccgatgcatccattcgcggcaagaacgatccactggttggtctgaaagaaaatgtcatcatcgggaagatcattccggctggtaccgggatggccacctatcgtcacgaggaacctaagagtgtcggtacagtttccgacagtgtttattcgatttcagacatcgaaaagcagatgaaggaaaaagacaaccagcaaagcgacactgataaacagtaatcgccttgtcggtggtcaaactgaagcatctggccacaaaagaagcggcgtaagtatcttgaaaaagatacttgcgccgcttttttatatgcacgcgagctggaacggtcacgagctgcttacataccaatctctgtgccaaggcatacgttttgacttgtacacaaatgaccacgatcaaaaaatgccaaggcaattagctgccaaactaaagcaaccgtaaccgatcgctatatgactaatcatcggtaacgtctctaaacgggtaatgaaccagtgaccgccagcgctgatacaagcaattaacgtgatgaccaaggcagcttctaattgcagaacgccacctaataatgcaatcagtaaaacatcagcactgcctaaaccgtgcgacatcagtgctaacccgccaaccatggaacctaacatcattaaattaaacaaattgcagggaaaaaccacaatgataccaaaccaccagccacaaaaattgatgagtgaaacgctgcgttcatgccaatcagcaatgctaaacataagcaaaccgatactgaggaaaaaaggtaaccaggtcgtactgcttatccctaaaagaatcgccaaaacacaatgaactgactgattaatgctagttaaacgctttgttacgctgatcacggttagtaaaaataaagttagaatcaaagccaccacctcacttcatagaataaatttcgctaaaaaatggatggcgcttgataacgatgcaatatgatcgatttagcaatatcgacaacgctttcgtaacaaaaagtaagtaaaatgacaaatgtatttctcttaaaacctgcatttttaaaaacttttcaggctaaatcgtgggagaaaaaaggccacggttaaccaaaatattattttgggaaaatatatatttgatgagtatttcatataaacgcttcaatattataaaaagtgttatacaataatggtgagcttaaggttaattaatacatgcataatttataacttaatggcctcatggggaagggccagacaaatcttctaggaggaggaagaggaaaatcatggaggagctaggtgtcaagaaaacatggcacttcatgtttaaggttggggtttattttaccgtgatcctaggcatgatcgtgcaactgctttcaccagcactgacccttgcagccgagaacccgacacaagcagtgactggtgcactcacgattaagaaccaagatgaacaaggctcaccgttaaatggggctaagtatgagattcgcaatgaatcccatcaagttgtggcaactagcagtatcagtcaagacgggcaagcaaccatctcgaacttgccagtcggaaactatctgccacggaaacacagtctgtcgcaggttatacagccattgaacagacgaaaaactttagcgtcgcagcttctgagcaaaccacgttactgtttaagagccgtgcatctgccacgattgccagtaacagtgagcgttcagcttcgtcgtcagcaaaggcggcaactccgggcactcatgcaagcgcagcagcagagacaaacgatgatgttaaattgcccaatattttcactaatgttgttttaaaagacggcaatgggcaaccattaggtacagagattgagcagcagagtacagtcaagctggagatgacatttataataccggaaacaagtacgccgtttccagcaggcgcttcatttacaacgacgctgccaaaaaaccagattgactttgcccaagatggtagcggtgtgtttgatggggacgtagctgaatacagttttgaccacaccactgctcagttgaccatcaaactattgaaggctgttagctttggctcttggaaggtgaacatcaccaccaactttaagcagctcacagccaatgactcactggaccagacactggtatttcacacgaaagatcacgataccaagatcccaatcagcttcaaatcgaatgcggagcctgtggaggtagctgaccctaaggcaacaccgcaaagtttcaacccgactggtattgaaggtagtgctaagtttaatttaaatggcgctgaaactagtaagaccgatccgactaaatgggacagtgatccagctaagcgatctaaaaacgcggacatggaactgaccttgaccgcacaaggcagcggtgaaacctatccgaaatcactgacttttagtgatagcgatttggcgaaaattaaggtttcatctgcacccgtgaatgtgttaggtgactttaccgaagccacaaaatcgctggtagcagggcgagattatcacgcggtcttatccgatgacaaacgtaccgttaagatttatttgacaggcggatttaaaaagtccactggctatcaagtagattacacggcaagtattgatcgttctttggacgataccggtaaaatgggcagcgcgttagttgaagggtatcgttttctgaccggttcgcaaacaaataacgggtatggttacaagagcgccacgatgcgtaattcaggcgtggcgatcaccaaatccggcgatattaccaacaactttcgggcaatgaactggcagattgattgggactttagcatggacacgatgaaggctggagctactttaaccgatcgttttggtaaacaggtgaatggaaccgatgatcatggtcagcccaagattgaaaaagacgataatcagtcgcttgatacccaatctttgaaagtctttcaggttacgttcgaccaaaatgcaaatcccactgtttcgaaagatgatattgcaaaatatttcaaattaacggataaaggtaacggtgagtttactttaacttatctgggtggcggcgacttacctgacaatgcatcatttcgaattcaatatcaaacgaagctaaaaaatacaccggaaaacggcagtgacatatccaatattgtcaatgatcaaagaaatcattacacacatgccacttatcccgttagattgccaagcgcaatccaaaaagttagtggcaagattgatgcatatcttgggcaaatgacatggcggattaatgctaatcgaacgttccgtaatatgcgcgatggaaagatatttgatttattcccggatggggtcgacaaactagatactgatccgactgccgccaatatcaatactatctctggggagtatgtgactaaagatgatgacgatggtgcaaatgacggtattttagtttacgcacaggatccagatgggaatcgaaccttactgaaaccggaaaccgactataccatgagtactaacgatggcgatgttcagactgctgtcaaacaatacaacgataaagacaagatcggtcaaatcgatgctaatggtcaagaaaagggaattcgtggatttgtcgtgacactcaaaggcaagtatgccgaaaccgattctcaaatcgtcatttatacgcatacaaagctggatatgctgaagttggggcaagttggtcacgataacgatgctttagctaaagcgctcaacaatcgcgcctttttcttctttgacctaccaccaggtgatgatgaagtcgcaagtggaggtgggagttcaacaccaacgccacaaaaaggttccttcagcggtgccttgaagaattcctggagtgatgcaccagacacgcagtattggggtgtgttggtcaatcagctaggccttaaatatggtcatttgcatttgactgacattttgccgcgattcgatggggttaattacgagctaattcctgactccatcaagttttatgaagtcacgggaccagatggcgttgatccatcaaataccggtgatccaacgacttccggtgatgtaaaagaaatcaaaaccaatccatactacggcactagtggctgggtatccaccgcattaacagctgatgatgctaaacagcaaagcttattgccgaccaatccacctgatacgtggcttaagaacaataaagatctaacccaacaattggatttcgattttcccaatatcgacaccggtcgtgtttgggttgttttcaagacaaaacgtgctaatcaatggaactataacgatcctaactttacgaaccaagcaaccgtgacagacactaagacgacaacgacgattccaacgtttaatccgtctgcctctaaatcggcgcagagttactggacgccgattaataaaacagttagcgaagatgccaagcagaagaatgtgcttaattggcatgttcaactggagaatattcaagataaataccgaccaatggtgaatccaatcattacggacaccttggaaccctacggaagcggcgcagaaatcaatgccaccagttttaaagtgacgctacaagtcggttcagcagatgaagtcactttagataaaggaaaagattatgaccttgccttggacggtaataacttcacggtcaccttccatcgaacttttggtaatttgacacaaaccgatggcaatccgttaaataactatcgggtcaatgtttattatgcaacgagtagtaagaattcaggaactgttggcaacacaagtgcggttgcgtgggatggaagtcaaacgactaaaaaaccaagtgacggtgtacctgaaaatgccagaattgccactacgaatggtttcctaccttcatgggattccggcatcagtggtgaaaccattacccaactggccaatttagtggtcgaaaagaaagatagcgttagcggcgcaccaatccctggcgttaaattccgcgtcagtgatggtacccacacgtttgaagcgacaactaaattagatgcgaatagccaaaattcaaccgccactttccaaggcttaccacttggtgattacacgctgacagaacttaatacgccagcaggttacaaaccaatggcaccacaaaagattagattgaataccacgtctgacagtggcaccgcgatccagacgcaagaagttgaaaatcaaccttatcaaatcattttgaccaagtatgataaccgtgctgaaggccagtcagaagccaaccgcaaacaatatcagcttgccaatgccacttacgatttgattgatacggacacccagaagaaattactgacagacttgaagactaacgatgatggtcagatcacggtcggcacggcgacaagtttttcaggtaattacacgaatgatgactttaagccagatttgaaggccggccaatatgtgcttgaagggcttaagccggggcattataagttgattgaacgcgaagcaccggaacattatcgcggtgatgcccatgatcaggccaatgtcaccagcggaccggataagcaactttggatcgacagtcttaatgccggcagtgtcacgacagccattagcgatgaaacgccaacagcaacggttgcggcctacgatcaaaagaaaccgggacagttggacctcaagaagcaggcagaaacgattaaggatgatcacttcccagatcgtcagccgatgacaggggcagcgtttaagctttatcgctatggggatgatggcaagcttgactatgataagtcgtggcaagccactgttaccaattccgatggcaccgtttcgtttaacgccaatgatttatatgaaggcaagtatcaattaattgaaaccaaagcaccagctggctatgtcattccaactgatttggctaaaggtgtggacgttgagatcacaggtgaccaaacgctgaagttcccaaccattgaggaaccagttttccgacgcgctgtcactttgaacaagactgatggtgattttggtaatccaattgctgggatcacctatgccctttatcgtgaaaatggaaccgagcttgctaaagacctagtcaccaacgaaaagggccaagtcaacttgccgtttaatttaccggcaggctcgtattactttaaagaaactaagacattgccaccatatcggccaaatactgataagcattcatttaccgtaaaacaaaccgatcaaacacagacggcagcagccttagcgactgagaacaagcaaaagccgatcactgtcgatgtcacaaactatcaggtcaagacgattaatgtcaaaaaggttgatagccagtataaggatcacatgctggccggagcaactttccggttgactaacagtgccggctacagtcgtgacatcacaactggtaaagacggcttggcttcatttggcgacctgctgctgggtcattattcattgactgaagtaaaagcaccagcaggttataaactcgatacaaccgtttatccaatcactttggcttctggtgaaaccccaagcgcaattacggtgaccaaggaaatcgcggatgatccgtatcaggtggctttgaccaagtatgataatcgcgctgataagtctgatgatgcagcaacgcttaagaaatacttgttgccgggtgccacatataaacttgtggacaccgtgaagaacaagactttgaaagctggcatgaagactaacagtgacggccagctgaagtttggcgcggcaagcagttttgacacgccactcaaagctggtgagtatgcggttgagggcttacaatctgatcgtgcttatcgcttagttgaaactgaagcaccaaagcactatcgcggggatgccagcgatcaagcaaacttgacaaccggtgctgaacgtcagcgctgggaagcaagcttacgggctggaagtgtcaatttcacaattaagacggatcagacgcagctaaaggtaacggcgaccaaccagaagaaacctggacagctagccatcaagaagcaggcggaaacgatcaaagatgacaaattccctgatcgacagccgatgaccggtgctgagtttaagctttaccggtacgatgaggatggcactcttgatcgggacaagacttggacgactaccatcaccaataacgatggcaccgtcacttttaacgatgccgatctgtacgaaggcaagtaccagttagttgaaaccaaagcaccaactggctatgtcattcctgatgacttggctaagggtatagatgtgacgatcactggtgaccagacactcacattgccaacgattgaggaaccagttttccggcgctcaatcgccttgaacaagactgacgggaattttggcaatccaattgctgggatcacttatgccctttatcgtgaagacggtactgaattagccaaagacttagtcacaaacgaaaaaggccaagtcaacttgccgttcaacttaccggcaggctcgtattactttaaggaaactaagacgttaccgccatatcggccaaacactgacaaacatccgtttaccattaaacaaacggatctaacgcaaacggctgcggatttggcaacacaaaacaagcagaagccgataacagtcggcgtcacgaactatcagatcaaaacgttgaacgtgcagaaagtcgatcgcacctattcagatcatgtattggcaggagcggtcttccgcctcactaacagcacaggctacagtcgcgatgtcaccaccgatgaaaaagggattgcctcatatggcgacctactgttgggcaattactcactaactgaaattaaagcgccaagtggttatcggttagatccaacagtacatgcgattacgttatcttcagcgattacaccaacgccgatcacggtgaataagcaaattgctgatgatccttatcaggtcaccttgaccaagtacgataaccgcgtcaagaagacggatgatgcagcgacgcttaagaaatacttgttgccgaatgctacgtataaattggtggacactgtaaccaacaagactttgaaggctgacttgaagaccaatgatgacggccagttgaagtttggagcagcaagcagttttgacaccccacttaaggcaggcgaatacaccattgacggcctgaagcctgaccgggcctatcgcctagttgaaaccgaagcgccgaagcattacgaaggcgatgcgactgatcagaaggaacacaccagcggcgctcagaaggatgcttgggaaaagagcctggctgctgggagcgttgactttacgatcaaggctgatgaaacccaagtgaagttaactgcaaccaaccagaagaagccgggtcaactagccattaagaaacaggctgaaacgatcaaggatgacaagttccctgaccgtcagccgatgacaggagctgagtttaagctttatcgttatcaagaagatggcaagcttgatcaaagtcgttcatggcatactgttatcacgaataacgacggaacggttactttcaaggatttggatctgtatgaaggcaagtaccagttagttgaaaccaaagcaccaaccggctatgtcattcccgatgacttggctaaaggcgtggatgttgagattactggcgatcaaacactgaagttcccaacgattgaggaatccgttttccggcgctcaatcgccttgaacaagactgacggtaattttgggaacccaattgctgggatcacttatgccctttatcgtgaagatggaaccgagcttgctaaagacttggttacagacgaaaaaggccaagtcaacttgccgtttaatttaccagcaggctcgtactactttaaggaaaccaagacattacggccatatcgaccaaatacggataagcatccgtttaccgttaagcaaacggatctaacccagacggctaatgccttagcagccgagaacaagcagaagccgattgcggtcagcgtcacgaactatcagatcaagacgttgaacgttcagaaagttgatcgtcagtacaccgaccatacgctggcaggggctattttccgcctcaccaatagcactggctacagtcgcgatatcacaactgatgaaaaaggaattgcctcatttggcgatctattgttgggtagttactcgctaactgaagtcaaagcgccaagtggttatcgactagatccaacggtacatgcaatcacactatcctcagcgatcacgccaacgccaattacggtcaataagcaaatcgttgatgatccgtatcaggtaactttgaccaagtacgataatcgtgtcaagaagacggataatgcagcgacacttaagaagtatctattaccaggtgccacgtataaactagtggacactgtgacgaacaagactttgaaggccgacatgaagactaacgatgacggtcagctgaagtttggagcggcaagcagttttgacaccccactcaaagctggcgaatacaccgttgaaggcctaaaagccgacaacacctatcgtctggttgaaactgaagcgccgaagcattatgaaggtgatgcgactgatcagaccaagcatactagtggcgctcagaaggatgcttgggagaagagtttagctgccggaaatgttgacttcacgatcaaaggtagtcaaacccaagtgaagttaactgcaacgaaccaaaagaaacccggacaactagccatcaagaaacaggcggaaacaatcaaagatgacaaattccctgatcgacagccgatgaccggtgctgagtttaagctttaccggtacgatgaggatggcactcttgatcgggacaagacttggacaactaccatcaccagtaacgatggtaccgtcacttttaacgatgccgatctgtacgaaggcaagtaccagttagttgaaaccaaagcaccaactggctatgtcattcctgatgacttggctaagggtatagatgtgacgatcactggtgaccagacactcacattgccaacgatcacagagccactttatcggcgtactgcccaactagctaaaacggatggtgactttggcaatccaattgcgggaatcacgtatgcactttacaaggatgacggtaccgagcttgccaaggatctagtgacaaataaggatggccaagttacgttaccatttgatctgccagccggacagtattacttccaagagactggaaccttgccgccatatcggccaaacactgacaaacatccgtttaccgttaaacaaacggatctaacgcaaacagcagctgatttggcagcacaaaataagcagaagccgataacggtcggcgtcacaaactatcagatcaaaacattgaacgttcagaaagttgaccgtcagtacacgaatcatacgctggcaggagctactttccgcctcactaacagcacaggctacagtcgcgacgtcaccaccgatgaaaaagggattgcctcatttggcgatctactgttgggcacttactcgctaactgaagtcaaagcgccaagtggctatcgactagatccaacggtacatgcaattacgctgtcttcagcgatcacgccaacaccgattacggtcaataagcaaatcgctgacgatccttatcaggttaccttgacgaagtacgacaaccgcgtcaagaagacggatgacgcagcaacactcaagaagtatctgttgccaggtgccacgtataaactagtggacactgtaaccaacaagaccttgaaggctgacatgaagaccaatgatgacggccagttgaagtttggaacagcaagcagctttgaaaccccactcaaggcaggcgaatacaccattgaagacctgaagtctgaccgggcttatcgtctagttgaaactgaagcgccgaagcattacgaaggcgatgcgactgatcagaaggaacacaccagtggcgctcggaaagaagcttgggaaaagagcttggctgctgggaacgttgactttacgatcaaggctgacgaagcccaagtgaagttaaccgcaacgaaccaggagaaggcaggtcaggttgtcatcacgaagaaagcggacactactggtgatcaacgcttccctggtaagatgacaatgatcggtgctaagtttacgctgtatcgttatcgtgaagatggtacggtcgatcatagtaagtcttggcatgcaacgattaccaaccaaaacggaatcgtaacgctcagtgatcatgatctatatgaaggtaagtaccaactgcttgaaacccaagctccacgcggttatgtcattccagacaacttggccaaaggaatcgatgtgaacgtcaagggcgatcaaaagattagccttgacccaatcattgaacctgaattcactcgatccgttcagttgcaaaagacggatggtaattttgacaagcaacttggcggggttacctttaatctctatggcagtgacgatcgggtcctggctaaggatttggtaacggatcgcaatggccaaatcaagttgccatttaatttaccgattggaacgtactactttgaagaaacgaagaccttaccgaaatatgaactcaacaccgataagatcacctttaaagtcgaacaaactgatttgacacaaacggccgctgcattggccaaactcaatcaacaacagccgatcaaggtccaggtggcaaattatcaagtcaatacattggtcgtcaaaaaggtagatgcggcgaataccgatcatgcattagccggtgcggttttccggttgaccaatgatcagggttatcgtcaggaaatcacgaccgatgctaacggtttggcgtccttcaaccatctgaaactgggaaggtactggttaactgaaatcaaggcgcctgctgggtacagcattaaccctgattatgcgcaaccagttgctgtagaagtcaaagcaggcgacacgatgcaattagtcattgcggataaacggcacacgttgccaagcactgacggaactggtggagctggaactggatcgggatctgaagccggatctgaagctgccggttctggaagccatggtaataacgttcgtcatgaacagccatcacgccgattgctctttggcagctttggcgatcgtgatactgtcaccttagttctattaggtattttgattctgaccattgccggcagcaccgtgattttacgtcggcgcaaacgtttataatcattaagttggtcgttacgtttggttagagattcgaaaaagttctgtgaagctgcctttcggggttgctttacagaacttttttgctatggttgaagttagtcggttatttagaaatataaccgtgaaaaggttgtcgttcatacgcttttgttaaaagttcaccatttcaaatgtcaagtgaatgttctattgttttccttgacaccagcgcgcataggatagtacactatcaaaggtgcttttttccagtttattcgggttgtccggacgtgctgactgggttaagagccgtcgccgttcggttggccgtttttttatcacaaaaaatgaaccgcctggatgtgtggacttaaaaaagatgcaatataaggaaggagaagcttaatgcctactattaatcaattagttcgccaaggtcgtaaatccaaatcaaccaagtcagactctcctgcgttgaacttcggttacaacagcaagaagaagagccttaccagtaatccagcaccgcaaaaacgtggggttgctactcgtgtcggtaccatgacacctaagaaacctaactcagctttgcggaaatatgctcgtgttcgtctgtccaacttgatcgaagtgacagcttatattccgggtattggccataacttgcaagaacatagtgttgtcttgatccgtggcggccgtgttaaggacttgccaggggttcgttatcacatcgttcgtggtgcgcttgataccgctggtgttgacggccggatgcaaggtcgctcgaagtacggtgcaaaacgtcctaagaagaagtaagcaaaatcagtgcggattagccgcatgatgatgacaacaaatttttagatccgctttgtgcggtatagacagaatatgcgtcagcctaaaagaaactcaggaatcgctttgggttgctagccgagccggtttgtgagcagcttgggcagacgaatacttttaagaggaggcaaaatgcatgccacgtaaaggcagtgtcgcaaaacgtgatgttttacctgatccagtttacaattcaaagctggttacccgtttaatcaaccacttgatgattgatggtaagcgcgggaaggcatccactattttatatgatgcatttgatatgattaagaaacaaaccgggaacgaaccgttagacgtttttgaagaagcaatgaagaacgttatgccggtcttggaagttaaagctcgccgtatcggtggttctaactaccaggtgccgattgaagttcgtccggatcgccggaccaccttgggcttgcgttggattgttcagtattcgcgtcaacgcggtgaacacacaatggacgaacgcttggctaaggaaatcatggacgccgctaacaacaccggcgccgcagtgaagaagcgtgaagatacccacaagatggctgatgctaaccgggcatttgcacattatcgttggtaagatggtttggctattatatccgcggtttggtatatagtagccattctttgtataaagccagttgaatcaagagaggagcaatacgccacatggccaacaaacgtgaatttccgttagaccgtacccgtaatatcgggatcatggctcacatcgatgccggtaaaacgaccacgactgaacggattttgtattataccggtaaaattcataaaatcggtgaaactcatgaaggagcttcacagatggactggatgccacaggaacaggaacgtgggatcaccatcaccagtgctgctaccacggctttctggaaggatcaccgggtcaacatcattgacacccccggacacgttgacttcacgattgaagttgaacgttccttgcgtgtgttagatggtgcgatcaccgttttggatgcccaatccggtgttgagccgcagactgaaaacgtttggcgtcaagcgacaacatacggggttccgcggttagttttcgttaacaagatggataagattggtgcggattttgactattcattgtcaactttgcatgatcggttgcaggcaaatgcccatgccgttcagttgccaatcggtgccgaagataagttcgaaggggtcattgacctgatcgaaatgaaggccgacttgtacgatgaagatgaactcgggacgaagtgggatacggttgacattcctgatgaatataaggaagctgccgaaaaagcccacaacgaacttgtcgaagccgttgctgacgttgacgatggcatcatggacaagtatcttgaaggcgaagagatttccaatgctgaattaaaggctgctattcgtaaagcaaccattaacttggaattctatccggttttggctggttcagctttcaagaacaagggtgttcagatgctgttggacgcggttattgattacctgccgtcaccattggatgttcgtccgtatcatgcaaccgatcctgatacaggcgatgccgttgagctgaccgctggtgatgacaagccgtttgctgctttggccttcaaagttgcgactgatccatttgttggccgtttgacctacattcgggtatacagcggcacactggaagctggttcctatgtgttgaacgcaacaaaagacaaccgtgaacgtgtcggccgtctgttgcagatgcatagtaatcaccgtgaagaaattccggaagtcttttccggcgatatcgctgctgctatcggtttgaagaataccaccacaggggattctttgacggatgttaaccacccattgattcttgaatcattggatgttccggatccggttatccaggtttccatcgagcctgactctaaagaagaccaagacaagctggatatcggtttgcagaagctctctgaagaagatccgacattcaaggctgagaccaaccctgaaactggtgaaacactaattgccggcatgggtgaattgcatttggatatcatggttgatcgtctgaagcgtgaattcaaagtggctgctaaagttggtgaaccacaagttgcctatcgtgagacctttactaaagaagcgtctgcacaaggtaagtttgttcgtcagtccggtggtaaaggtcaatatggtgatgtttggatcgagttcacaccaaacgaagaaggcaagggctttgaatttgaaaatgccattgtcggtggggttgttccgcgtgaatatatcccagctgttgaacaaggtctgaaagaagccatggcaaacggtgtcttggctggctatccattaattgatgtgaaggccaaactatatgatggttcttaccatgaagtcgattcttctgaagctgcctttaaagtggctgcttccatggcgttacgtaatgcctcgaagaatgctggcgccgtgatccttgaaccgatcatgcacgttgaagtcgttgcgcctgaagaataccttggcgatgttatgggccagatcacggcacgtcgcggtcgcgttgaaggtatggaagcgcgcggtaatgcgcaattggttaactcaatggttccgctggccgaaatgtttggctatgcaaccaccttgcgtagtgcaacccaaggccgtggtactttcaccatgacctttgaccactacgaagctgtaccaaagagtatccaagaagaaattatcaagaaaaatggcggcggtgttgctacgaaagactagtctttcgtgatcaccgacgacaaaaacggtgttgcctgttcaaggcagcaccgttttttattgagcgtgagcgtgaaccggcgcgcttagggatcggagtgtaagtggccttgggcgtgatggtcggtctttgaccattgcgcccaaggtccttacacgcagatccctgcgccggcgaacgcgttatgggcatgagctagaacataagcggccttaaccgtgatggtcggtatttgaccattgcgcccaagatccttatacgcagatccctgcgccggcgaacgcgttatagaaagtgagtgtgatttcgcccgatctctaggctggtcagtacattatgagcgtggaagacttcttgagatgattgacggcacgttttttgaacgcgtatgatactgttattattaggtgacgttaggaagtggcgcaacgtgtcaagccaggaacgaattgtaacgattatgctgcgactcatgcgaggagaggtattaaacaaacaaaccttaatgcacgagtttaataaagatgagtcttccattcggcgtgatattagtgtcattaaacggatgttcgatgacgtgatggatgagccggatgtatttgtcgcaagtaccacgggtgattatcgcttcaagtcaactgtactatcaactggccacagtcccttaaatgacgggcagttattagcaatgacgctgattttgaccgcaagtcggggcttggcaacttccgagatgaaaacgctacttcaccagttgctgcctgaagggccggagcatcgaagcctaagcgatgtggtacgaaatccgatcttcgagtataaaggggtaccaaaagtagcactcacagcacggttggcacgtttgagtcaggcgattttgaagcatgagaccattagcttcgatcatacttatcatggcgtaacccgtcattttgatcggcgcctaccaactggattatattttggcgacttatttttttatctcattattgatggtagtgacgagcagcctgatgatccggacaatggtcagtttgtgcgctttcggcttgatgatatgagccatattacttaccatggacgtcaaccgcaacatgcctatgaagcacgttttcgcggcggccggttacaaaaacacacatggtatccatacttaggcaagccaattaatctggaaatcctgtatggctatgacccgcgttttgtccttgatcgttttccggatgccatcgttcatgatgaaaaagtcgatgagcagccaacgtccaagaatccttacgcgcaaaagttctaccacatcaccattccggttaatgatggctttggcattcgtatgtggttgctaggacaggcagggttagtcaaagtgcttgcgccaaagtatattcgtgattatgtcattcgcggtttagaagaaggtttggcacattatcggcatgaagaaaggaatcgtttgcgctaggaagttcacataacgccttaagagcatacttttaaacacactgtctattgaaacagatggtgtttttttaatcggcggtttggaaagaaggcaagctaaccagcaacatttttgatttatgtgggtaactgtcacaggtaattcgtggcaatttaggcttgaaaatgcgggcatgaaaaggtaccgttaagttgtaaataataatcattctaaaaatggagggaatattatgagctttattggacagcatttaccggacttttcattgaccgcctatcaaaatggggattttcacacggtgacaaataaggatttgcaaggtaagtgggcagtaatctgtttctacccagctgacttttcatttgtttgtcccacagaactaggcgatttgcaggatcactacgatcgttttaaagctgcaggagccgaaatctattccgcttctgaggataccgaatttgtgcatatggcatgggcagagacgagtccgacgatcaagaaaattcagtatccgatgcttgccgatccggctggtaaactggcaacggcgctggatgttcgggatgaagcgagtggtcaagcgttccgcggcaccttcattattgacccggatggcgtgattcaagcttatgtcgttaacaacttcggcatcggtcgtaacgctgacgaaattttgcggacgcttcaggcagcacaatttgttgccgctcacggtgatcaggtttgcccagcgaactggcagcctggcgagaaaaccttgaagccgggtgctgacttggttggcaaactttaattaaagggaattatctaattgtgaatgctccggtcaggatatattcacgcaaaaaggaatcgcaacggtcagctgcgattcctttttgcgtgaagtcatataacccgagctaaagaacaagaatacatcagagcctggatcagtagctaaggcaaaacaagatcgccacagtcaaaagtgctgatcgatatcaatatcctgttctccgcgcgagtgtttgaaatcgccactaacaaaggagaagaccgtcaaaacgcctgctaaaacgagaattgccaatgtcaaaagcaaggtttcggtaccacgatcgtgtaagaccaacagctgccgtaaaatggccgtcatcgaaatgagaatgagataacgaatcggaatatggtgcccctcttcaatgtagcgaatcagcataatgacaaattcaaacagcataaagaaactcgtgacttcctgaatgaccttgccgaataggtcagccgataacggtcgaaggattaaactcccaatgtcgataatgtagcgtaacatgaagatgacgacaacaatagcgagcagaccgagcaaaagatccaaggctacgttgataaactttttatagtgatcgaatttcatggcatgctccttaatcaaatcgaatactggatttaatttgaatgtagcacatacagctgatcagtaaaacaagtttgcttttctcagcatcaagcgcacaaacttttttgtgcaaatcgaaagaaaaccttgtaatggcgggggagtttttgtatactatcaagagtgctgtttctcaaaggggataactatgcacttggttccagagatgaaccagagtagcgtggatgtgagaggttgcgacacgcccggccgctttgccacggtggcgagttggtaattttcacggagctagtctactaactgataatagacgaaggaggtcacacaatggcaaaacaaaagattcggatccggcttaaggcttatgaacaccggattctcgatcaatccgcagacaagatcgttgacactgcaaagcgtacaggcgcaacaatttcaggtccgatccctctgccaacggaacgtacaatttacacggttttacgttccccacataagtacaaggattcacgtgaacaattcgaaatgcggacgcacaaacgtctgattgatattgttaacccaacaccgaagacagttgatgctttaatgaagctcgatttgccaagcggcgtcgatatcgaaattaaattataattcttagaaaataggaggtgtacccatggcacgtaaaggaatcttaggcaaaaaagttggcatgacgcaggtcttcaccgataacggcgaacttgttcccgttactgtaattgacgtaacacccaacgttgtaatgcaagtcaagaccgttgaatctgatggttacgaagcagttcagttgggctacggcgatatgcgtgaagtcttgacgaataagccaagcgtcggtcacgccaaaaaggctgacacgacccctaagcgcttcgttcgcgaaatccgcgatgtagcgcttagtgattatgaagtcggcagcgaagttaaagctgacgaattcgcagcaggcgacattgtggacgtcaccggtacttccaaaggtcatggttatcaaggtaatatcaagaaagatggtcagtcccgcggccctatggcacacggttctcgctaccatcgtcgtccaggttcacttggagctatcatcaacaaagtcttcaagggtaagaaacttcctggccggatgggtaaccatacccgcaccatgcaaaacctgcaagtcgttgccgccgatacagaacacaatgtcctgttgatcaaaggcaatgtcccaggtgctaacaagtcctttgttacaatccgttctgctgttaaagcagctaaataatacgaagggaggacaataactaatggctaacgttactttatataagcaagacggctcagaaaacggcacggttgaactcaacgatgcaatctgggcagtcgaaccaaatgaaaacgtcgtgtttgacgcagttgtgatgcaacgcgcttcccttcgtcagggtactcacgccgttaaaaaccgttccgctgtttcaggcggcggtcgtaagccttggcgccaaaagggtaccggtcgtgcccgccaaggttcaatccgcagtccacaatggcgcggcggtgggatcgtctttggcccgacaccacgcagctatgcttacaagctgcctaagaaggttcggcgcttggcgattaaatccgtactttcacaaaaagttctcgatggcgatctggtcgttgttgatggcttgagctttgatgctccaaagaccaaggcatttttaaatgtcttggacggactcaaagtcaacgataaggcactggttgtgcttgaagatggcaatgatgttgctgccaaagctgcacgtaacctgccgaatgtgaaagttgttcctgcagagggtatcaacgtcttggacgctgttaactacaagaaattgatcttaacccaatctgcgctccaaaagattgaggaggtgcttgcataatggaagcacgcgatatcattttacgtccgatcgtcaccgagcaatcgatggctgaaatggacaaccgtaaatacacattcgaagttgcaattcatgcaacaaagccccaagttcgcaaagcagttgaagaaatcttcggcgtgaaggttgttaatgtcaacattgcaaacgttcgcggcaagaagaagcgccaaggtcgttacgaaggcatgacgcgtcgtcgtcgtaaggccttggttgccttgagcgccgattcaaaagaaatcaagatcttcgctgatgaagataacgataacaagtaacaaaaatttgttataggaggttaaacacgtggcgattattaagtacaaaccaacaagcaatggccggcgcaacatgtccggctcagactttgctgaaatcaccaagacaaagcctgaaaagactttgctggtcagccaaagccatacagcagggcgcaatgctcacggacacatcacagtgcgtcatcgtggcggtggtcacaaacagttttatcgtgtgatcgacttcaagcgcaataaagacaatatggccgcaacggttaaagcaatcgaatacgatccaaatcggaccgctaacattgcattattgcattatgaagatggggttaagtcctacatcttggcaccaaagggacttaaggttggcgataaggtttactccggtgacgatgttgacatcaaagtcggcaacacattgaagttaaagaatatcccagctggtaccaccatccataacattgaacttaaacctggcaaaggcgcacaactagcacgttctgccggcgtttccgctcagttactgggtaaggataatgataagtacgttaccatcaaacttgcttccggcgaagttcgcttggtattagccgagaaccgtgcgactatcggtgcggttggtaacgaacaacacgaattgattagcattggtaaagctggccgtaagcgctggttgggcttccgtccgactgttcgtgggtcagttatgaaccctaacgatcacccgcatggtggtggtgaaggtaaagcaccaatcggtcgtccgtcaccattatcaccttggggcaagaagaccttgggtaagaagacccgggatcacaaggctaaatccgagaaattcatcgttcgtcaccgcaagacgaagtaaacacattgaagtgttacatcgattaaaggaggtcacacaatgggtcgcagtcttaaaaaaggaccttttgccgacgctcatctcctgaagaagattgaagcgcaggcagataacgacaagaagaccgttattcgtacatggtcgcgtcgttctactatttttccaagtttcattggctacaccatcgccgtttacgatggtcgcaagcatgtcccggttttcgtgagtgaagacatggttggtcacaagttaggcgaatttgttcctacgcgtaccttccgcggtcacaacaccgatgacaagaagacaacagcacgctagaaaggagcacaacattcatggctgatcaaattacgtctgcaacggcaacggccaagacggttcggattgctgctcgcaaagcgcgcttggtaatcgacttgattcgtggtcgcgatgttgctgaagcactggcgattcttgagttcacacctcgttccggttctccgatcatcgaaaaggtactcaagtctgctattgctaatgcagaacataactatgacttagatgcacaaaacctttatgtaagcaaagcttatgtcaacgaaggcccgaccctcaaacggttccgtcctcgtgctaaggggagcgcatcaccgatcaataaacggacaagccacgttaccgtggttgtatccgaaaaagaagcataaggagggataacgcgtgggtcaaaagattaatccaaccggtttccgtgtcggtgtcatccgtgactgggatgccaagtggtatgcagacaaagactttgctgactacttgcatgaagacattgaaatccgaaacttcatcaataagaagctgcaagatgcttcagtatcacgtattgaaattgaacgtgctgcaaagcgcgtcaacatttccgttcatactgctaaaccgggtatggttatcggtaaaggcggttctgaagttgaaaacttgcgcaagcagctcaataagctgactggtcgccaagttcacatcaatattgtagaaatcaaaaaacctgatttggatgccaagcttgtcggcgaaaacatcgcgcgtcagcttgaacaacggatcgcattccgtcgtgcaatgcgtcaagcaatgcaacgtaccatgcgtgccggtgctaagggaatcaaaacccaagcttccggtcgtttaaacggtgctgacattgcacgtcgtgaacattacaatgaaggtttagttccgctgcataccttgcgtgccgatatcgactatgcatgggaagaagcagcaacgacttatggccggatcgggatcaaaacctggatcaatcgtggtgaaattttacctgaaaagccacagcaaaataatgcgaaaggagggaaataatcaatgttagtacctaagcgtgtcaagcatcgtcgtgaattccgtgggaagatgcgcggtgcagccaagggcggcaagaacgttgacttcggcgaatatggtttggaagcattggaatcccattggatcaccaaccgccagatcgaagcagcgcgtgttgcaatgacccgttatatgaagcgtggtgggaaagtatggatccgcattttccctcacaagtcctacaccagtaaaggtgtcggcgtccggatgggtaatggtaaaggtgcaccaactggatgggttgcagtcgttaaacgtgaaaagatcatgtttgaagtcggcggcgtgtccgaggcagtcgcaaaggaagctttgcgtttagcatccaacaaactcccaatccgcaccaagatcgtttcacgcgaggaagtaggtgggcaatcaaatgaaggctaaagaaattactgcattaaccactgctgagatgctcgacaaagagaagcaatataaagaagaactgttcaacttgcgcttccaacaggcgactggccaattggaaaacaccgctcgcttgaagcaagttcggaaaaacattgcacggatcaaaacggtccttcggcaacaggaactcaataaataatcggaaaggagacatttaccttggcagaacgtaattctcgtaaagtttatcaaggccgcgtggtctcggataaaatggacaagaccatcaccgtggaagtcagcacatataaaacacaccctgtttatggcaaacgggttaagtattccaagaagttttatgcgcatgacgaagacaatagcgctaaagttggcgatattgtccaaatcgcggaaactcgtcctttatcacgcaataagcgtttccgtttattgaatattgtcgaaaaggcagttatcatctaatcatttttagagtgaaaggaggaccaaatccgtgattcagcaagaaagtcgtcttaaagtagcagataactcaggcgcgcgcgaaatccttgtcattaaggtacttggtggttcataccgcaagaccggtaatatcggggacgttgttgtcgcaactgtaaaacaagcaacaccaggtggcgttgtcaagaaggctgatgttgttaaagctgtgattgttcgtaccaagtcaggcgctcgccgtgctgacggttcctacatcaagttcgatgagaacgcagctgtcatcatcaatgctgacaagagcccacgtgggactcgtatctttggacctgtggcacgtgaattgcgtgacggcgatttcatgaagatcgtctccttagcgcccgaagtgctttaatcattctgaccaaataggaggtgcgatacatgaagttcaaaactggtgacaaagtgcgggtcatgcgcggcaaagatgccggcaaagaaggccagatcacgaaagtcctcaagagcgctgacaaagtcgttgttgaaggcatcaacatgatcaagaagcaccagaagccgaacaatacgaatccgcaaggcggtatcatcgacaaagaagcacctattcacgtttcaaacgtgatgcttctggatcctgaaaccaacaagccgactcgcatcggttctgaagttaaagatggcaataaagtgcggattgctaagaagtctggcaccgcaatcgataaataatagggaaggaggacaaactttttcatggagaatcgtcttgaagaacgttatagcaaagaaatcgcccctgcattggtaagcaagttcaactataagagcaccatgcaggcacctaagattgaaaagatcgttttgaacatgggtgttggtgatgcaactcagaatgctaagttattggatgaagcggtagaagaattgacgctaatctctggccagcatccgctgatcaccaaggccaagaagagtattgccggtttccgcttacgtgaaggtatgccaatcggcgccaaggtaacattgcgcggcgaacgcatgtatgatttcttagataagctgatcaatgtttccctgccgcgtgttcgtgacttccacggtatttccccaaagtccttcgatggccgcgggaactatacattgggtgttagagaacaactgatcttcccagaaatcgattacgataaggttaatcgggttcgtgggttggatgttgtgattgttacaacggcaaatactgatgaagaggcactcgagttgctcacgcaagtcgggatgccattcgccaaataagggaggtccgctacttggctaagaagtcaatgatcgctaaaaacaaacggcctgcaaaatttgcagtccaggaatatacgcggtgccaacggtgtggccgtccgcattccgtatatcgtaaattcaaactctgccggatttgccttcgtgagttagcacatgccggccaaattccaggcatgcgcaaagctagctggtaatcactagacaaaggaggttaaatcaatggtcttgaccgatccaatcgcagattacttgacccggatccgtaacgctaatatggtgcgtcacgaatccttggtcgtacctgcatcaaagatgaagaaagacatttctgagattcttaaacgtgaagggttcatccgtgactacgaagttatcgatgatgacaagcaaggcgtgatccgcattttcttgaagtatggtaagaacaatgaacgggttatttccggcttgaagcggatttccaaaccgggtttgcgctcatacgttaagagtgatgctgttcctaaggttttaaacggtttagggattgcaattatctcaacttccgaaggtgttatcaccgataaggaagctcgtgccaaaaacgttggcggcgaagtactcgcttacgtttggtaattcataacatcaaaaaggaggtgccgataagtgagtcgtattggttataaagtcatcaaagtcccagccggtgttactgttaccaaagatggtgacaatattacggttaagggccctaaaggcgaattgacccgtcattttgccccggaaatcgaattacatcaggaaggcgacgaaattaatttcacccgtcccgatgattcctacaaggccatccatggtacgatgcgtgccaacttaaacaacatggtcgttggggttaccgaaggctataagaaagaaatgaagctggttggtgttggataccgtgcgcagaagcaaggcgaaaaacttgttttgaacgtcggttactcacatccagttgaaatgaccgcgccaaaaggtgttactgttgaagtcccaagcaccactcagatcatcatcagtgggatctcaaaacaggttgttggtcaattcgcagccgttgttcgttccgtccgtgcacctgaaccttataagggtaaaggtattcgttatgttgacgaacatgtccgtcgtaaggaaggtaagactggtaagtagtcgtaaccttcaacaaatttaacaagaggtgaacattgtgatttcaaagccagataagaataagactcggcaacggcgtcacgcccgcgtacgaggcaagatttctggtacgagcgagcgcccacgcttgaacgttttccgttccaataaaaacatctacgcgcaattaattgatgacgtagcgggtgtgacgctagcaagtgcctccactcttgataaggacattaaagatcctgaaaacaagactgacgcggctgctcaggttggtgcattaatcgccaagcgtgcagttgcagatggtcataaagttgtggtctttgaccgtggtggttatctgtaccatggtcgcgttgccgctttagctgaagcagcacgtgaaaatggcctcgaattctagaaaaaaggaggataaccaacacatggcatcatttatcgatccaaaccaattggacttagaagaccaggtcgttgccatcaaccgggttacaaaggttgttaaaggtggtcgccgtctacggtttgcagcaattgcaatcgttggcgataagaacggtcacgtcggcttcgcaaccggcaaagcccaagaagtacctgaagcaatccgtaaagctgttgacgcagctaagaagagcctcattgaagtgccaattgtcggcaccacgattcctcatgaagtaatcggccacttcggcgctggtgaagttttactgaagcctgctgaagaaggttctggggttgctgctggtggcgctatccgttccgttatggaacttgccggaattgctgatatcaccagcaaatcccttggccgtaacacgccaatcaatatgattcgggcaacaatggatggacttacacagttgcgcacccgcgaacaagttgctgaattacgcggcgtttctgcgtcatcgcttgaagactaggaggtaaacacatggctcaattgaagattactttgacccgtagtgctgcccaccgtcttcctaagcaacgtaaaattgtgaaggaattaggcttaaatcgggtgaacagctcggtgattaaaccagacaacgcagccactcgtggtgcgattttccagatttcacacttggtttcggttgaagaaatcaaagattaatacattatttcgacaaggaggtgcccaagagtatgcaattgcacgaattaaagccgagtgtcggctcccgtcatgcccgcaagcgtctgggccgtggtacttctagcggtcaaggtaagacagctggtaaagggacaaaaggtcaattggcacgacaaggcggcaagacgcgtcttggcttcgaaggtggccagatgccattattccgccggatgccaaagcgcggtttcaacaacattaaccgcaaagaatatgcaatcgttaacctttccgatcttaatcgcttcgatgacggcgctgaagttacaccagcagccttgatcgatgccggtattgttaagaacgaaaagaacggtgttaagttgctggcagacggtaaacttgagaaaaaattgaccattaaggttgcaaaagcttcaaccgcagcaaaagctgccgttgaagcagctggcggttcgattgaggtgatctaatgctgaggaccctaaaaaacgcgctcaaggtcaaagacatccgtaacaagatcctcttcactttagcggttttattggtctatcgattaggtacactgattgcggttcccggtgttaatgccaaggcgctgcagtcaatcggctcgacaggcttgatctcactgctggatactgtcagtggtggcggattggcacaatactccatcttttcgatgggggtttcgccgtatattacggcacaaattgtggttcagctgctgcagatggatatcgttccgaaatttgtcgagtggagcaagcaaggggaagtcggtcggcgtaagctgaatcaagttactcgttatctgaccatcgcttttgggttctttcaggcaattgggattacggccggctttcaaacgttaagttcgatgggcttggttaaaaatccgtccgttagtacctatatcacaatcggtatcatccttaccggcggcacaatgttgctaacgtggatgggtgaacagattactgataaaggccttggtaacggggtttcgctgttgatcttctccgggattgtggcacgcctgccttcaggtctccaagagttatatcgagataacgttcaggtatactctggttctgaaatctggaaaggaattgcatttttagcagctttggcagtcatcgtgatcctggttatcacgtttgtcacctgggtgcagcaagctaattataaaattccaattcagtacactcggcgcgttaccagcgcgggcagcaacagttacctaccgcttaaagttaacgttgccggtgttatcccggttatttttgcgagttcctttattgtgacgccgcaaacaattttaatggcttttcagaagaatcatgggactgacggatggtatcaagtcatgactaatatcttcaatatgcaaaagccagccggaactgcgatctatacgcttttgattattctgttcacgttcttctatgcgttcgttcaggttaatcccgagaaggtcgcagaaaacttaaccaaacaaggcagctatattcccggtgtttggccgggtaaggaaaccgagaattatatctcacggctactcatgcgcttatcaacagtgggtgctttgttccttggtttggttgccttactgccacaactggctgccaacatttgggggctgccgcaatcaatcggacttggtggtacgagcctgttgattgttgtcatgaccgctattgaattggttcgccaattggacggcttactcatgaagcgtgagtacgtcggatttattcgcggcgatttggttaagaacgataagaagtaaacgatatcagaagtcagccattttcaaaggttgacgcgttaaaagcagcgtacaaactggcaagtagtttcagcgttaaattgtttagaagctgttcacagcagttttaaatacatgccagcgcgtacaattagaggaggatgcaacgtgaatctcattttaatgggacttcccggtgcagggaaaggcacgcaggcagaacggattgaggatacttatccgatagcacatatttccaccggagatatgttccgagccgcgatggctgctggcacagcattaggtaaggaagcaaaaggctttattgataaaggtcaactggtacccgactcggttaccaatggcattgtcaaggaacgccttgctgagtccgataccgatgcgggctacatgcttgacggctttccgcgcaccatccaacaagcagaggcactcgaaacgatcacagctgatcttaagaagccgttagatgctgttatcaatattgatgttgcgcctgcaaagttagttgaccgcttgtctggtcggtttatctgtaagacatgtggtgcaacttatcacaaaatctacaacccgccaaaggttgccggcacatgtgatcgctgtggcggccacgaattcttccaacgcgaagatgataagccggaaaccgttaaaaaccgtcttaaagtaaacatcgagatgaatacgccattattagacttctaccaaaagaaggggttgctccacactgttaatggtgatcaagacatcgataaggtgtttgcagatattaagacgattttggctgctgtggcaaagtaagtgcttggacgattgcacgcccctcatgactgttttcaaagtcgaagaattatggtacaatatcgcggtatgcggtgagtgccaatcggcctcacccttttcgcgcgttaatagaaccaataatttttaggaggaaacacttcgtggcaaaagacgatgtaattgagatccaaggcaccgtgacggataccctacccaacgcgatgttcaaagtcaagcttgaaaatggtgccgagatcctcgcccatgtttccggtaaaattcggatgcactacattcgcattttaccaggtgacaaggtgacggttgaactttcaccttatgatttgaccaagggccggatcacataccgtttcaagtagttgccaactcaaggaggctaaattctcatgaaagtacgtccatctgttaaaaagatgtgcgagcactgcaaagtggtccgtcgtaagggtcgggtcatgattatctgctctgcaaacccaaagcataagcaacgccagggataatataaattaaaaaataggaggtgtcattgtacatggctcgtatcgcaggtgtcgacttaccacgtggtaagcaaattgtcattgccttaacttatatctatggtgtcggcaagacaaccgctcaaaaggttctcaagactgccggtgttccggaagatgttcgtcaagatgacctgaccccagaacaagaagacaagattcgtgcagctttggactcatacaaagttgaaggcgatctccgtcgtgaagtgaacttgaacatcaagcgattgatggaaatcggttcatatcgcggcatccgtcatcgtcgtggcttgccggttcgtggacaaaataccaagaacaatgctcgtacccgtaaagggaaaaaagcaacgatggcaggtaagaaaaaataattaaaggaggtcattgatcgatggcaggtagaaaaactacgcggaagcgccgtgtccgcaaaaacgttgaatctggcgtggctcatatccactcaaccttcaacaacaccttagtaatgatcacggaccctcgcggcaatgcgatcgcttggtcctctgctggtgcactcgggtttaaaggtagtcgtaagtcaacaccgtttgctgcgcagatggctgctgaagctgcggcgaaggaatcaatggaacatggcatgaagtcggttgaagttgcggttaagggcccaggctctggtcgtgaagctgcaatccgttcacttcaggcaacaggtcttgaagttactgcgatccgtgatgttacaccggttccgcataacggttctcgtcctccaaagcgtcgtcgtgtttaattgttacccttcgaccgttatggcggtcaggcagacaaatcttcacttctcgttttgaaaggggtacaaactagatgatcgaattcgaaaagccgaacattaccaaagttgacgaaagcaccaactatggcaagtttgtggttgaaccgttggaacgcggctacggtactacgttaggtaactcgttgcggcggatccttctttcttcattaccgggcgcagctgtcagcagcattcaaattgatggggtacttcatgagttctccacaattgatggtgtattggaagatgtgactcagatcattttgaatatcaagaaattggcactcaagatgaacactgatgaagataagaacatcgaaattgatgtcaacggtccggctaaggtaactgctgctgatatcgtcgctgatcctgatgttgaggtcttaaatcctgaacagtatatctgtactgttgcagacggcgggcacttccatgtacgtatgaccgttaaaaagggtcgcgggtatgtggcagctgaccagaataagtctgatgacatgccaatcggtgttttgccgatcgactcgattttcaccccgatcagccgggttaactatcaagttgaaagcacccgtgttggccgtcggaatgatttcgacaagttaacgctggatgtttggactaatggctcaatctcgccacgtgaggccatcagcttagcagcgaagatcctgactgaacacctggatattttcgtcaatttgacggatgaagctaagaacgctgaaatcatggttgaaaaagaagaaacgcacaaggaaaaaatgcttgagatgaccatcgaagagcttgacttgtcggttcgttcctacaactgcttgaagcgtgccgggattaatacggtccaggagttaaccaacaaaacagaagccgatatgatgaaagttcgtaacttaggccgcaagtcacttgaagaagttaaaaacaagttggcagatcttggcttaggattgcgtaaagaagactaatttcgaaaaggaggccaatccatgagttaccgtaaattagggcggaccagctcacagcgtaaggcaatgctacgcgatttgacaacggatctgctgatcaacgaacgaatcgttacaaccgaagcccgcgctaaggaagttcgttcaactgctgaaaaaatgatcaccttgggcaagcgtggcgatttacatgcacgccgccaagcagcagcttatgtgcgcaacgaaattgcgagtgtcgaagaacaagaagacagtgtgattgtgaagtccgctttacaaaaactgttcagtgacttggcaccaaaatacgcagatcgcaaaggcggctatacccgcattttgaagactgcgccacgtcgcggtgacggtgcaccaatggttatcattgagctcgtctaaattcagttaaaagggctggccctcgaggtcaaccaactttgatcatttgatcgatggagcgttacgatgatggcaggtataatcctgcttagtctagcttgagagcaccgggcaaccggtgtctccatcattaaatgatttttttgtgcaatcgcaaactattgcgatcagcagtcggcatgtaagcgaccatggacgtgatacccgttttgaccatggtgttcatggctcttacatgtggattgctgggctggtgagcgcgttatgatgaagtatgaaccagcgcctcgaaagcaagcgtaaccaagcttgttgccgtaattaaatctatcaactaaaaagaattctcttcgccgacacgcggaagagaattctttttaaatactggggtcgagttaaaaaagcattagccttaaaacaaagccagccatgacgcgcggtaaattggtcctcaattcgccaaactttctagctccatcgcactactaatccgatttttcctgtatactgcgacataatggaggtcatgctaatatgcgtacttggtttcattatcgaacgccgctgcaacttggcttattgttggttagcggctggacaatcctttcaatcctctttgtcgttttgatactcgcatttacgcctgcaagtacgagtataggtgggctgtttattcccactgtttatcggttggacaatggggcggtggccattgactggtcttcgtatctgtggctttttgcggctttatgtggctacttaatgggggcacgctttagacgaagcaagacaccattttctttaatgaaggcctatacaccgcttattgttttatggttcctcgtggtggttttggcgcagtggtacccgcttgccaatctgatgtatccccactcattggatgggtttttgttacaggtgattcttaactttagctgggtgatgcctgccggtagtatttcgctacttgtgggtttatcggcaaaaggtggacgcgtagccctcatgttttggctcattttccttatccaaagtcaattctatcggcaattggttgtcaatggccagagtcggtttgggattgtgatgtctcatgttggaatggtgcaagtacaggcatggcttctagggctgattgcgttgatttttacggtctttttcgggtttctttgtaccgatccggatattacgaaaagatgattgaattggctaattagtcccggcggtcactgaaacgactagcggtacatctcgtatttgaagtagggatcgtccaacaattcggtaaaatatggtatcattgttcggtatacaaagcgtaggaagaaggggcattgtgggcaacgtcattcatgttcaacacttgaattacacttatccggaagcaaaacgtcaagcactgacagatgtgtcgtttgatgtggctaaaggtgagtggctggcaattatcggccataatggtagcggtaagagtacgctggcgaaaaatttaaatggactgctggcgccagaatcgggcacggttgaagttgccgggatgacgcttagcgaagaaaccgtgtgggatattcgcgccaaggttgggattgttttccagaatccggacaatcagtttgtgggtgcgacggttgccgatgatgtggcattcggactggaaaatcgcggtgtcccacgagatgacatgattcgccgggtggatgaagccctcaaacgcgttggcatgacggcttttgctgaccgggagccggcgcggttgtctggcggccagaagcaacgggtggcgattgccggcattattgcccagcgcccggagattattattctggatgaatcaacatcaatgctagatccggccggtcgccaggaagtgttgggtgtgattcgtgaactcaaagatgaattggggctcaccgttttgtcaattacccatgatattgatgaagcggcatctgcgcatcggattattttacttaatgacgggaagattaacgaaatcggaacgcctagcgagatctttgcacatgggacagacctattgcgcttagggcttgatgtgccgtattccgagcggttaaaagacgccttgattcagcgcggtgtcacaatgccagaagcatatttggacaatgaaaggttggtagactacctgtggacattacattcgaccatgtgagctttacgtatcaggcaggtacgcctttcgctggtgacgggatcaaagatgtttccggaaccatccatgatggcagttatacggcgattatcggccacaccggttcgggtaagtcgaccattttgcaacacttgaatgcattactaaagccgacttccggaactgtcacgattggcgataaggtcatcactaatgaaacgagtaataagaatctgaaaccgttgcggcaaaaagttggtatggtttttcagtttgccgagaatcaactgtttgaacaaaccgtggctaaggacattgcttttggaccgcaaaactttggtgtgagcgagcaggatgctttagcgttggcggataaaatgattacgatggtcggtctgccgcatgatgtattagaaaagtcgccatttgatctgtctggcgggcaaatgcgaagagtggccattgccggtgtgttggccatgcaaccggaagttttggtgctggatgagccgacagccggtctggatccggctgggcggcacgaaatgatgcaaatgtttgaacgcctgcatcgtgaagaagggcagacaattgtgctcgtgacccaccagatggacgatgtggcggattatgccgacacggtttgggtgatggcaaagggacatttgatcaaaaccggaacgccgcgggagatctttgccgactcggcttggttgaaggcgaatcagctagggttacctaaaaccgctcaaatggcacaacaattgactgcaaaagggtttcactttgatccgcagccgttaaccgaagccgagttggcggatcaattgctgccacagatcggaggtggccagcgtggataaactattacttggacgctatattcccggccattcatggattcacgagcttgaccctcgcaccaagttgatggcgagtttctattatatcgggattgtttttctagccaacaactggcaaacgtatttaatgatgtttgtggcgactttgttcatgatttggctgtccggtattaaacttggcttcttcttgcgaggcgtccggccgttaatctggctgatcttgtttaccgtcgctttgcaggtattgtttgttcgtggcggtacggtttattggcattggggttggttatggatcacgaagctagggctgattaatggggcctttattttcgttcgttttgtgctcatcatctttatgtcaaccttgctgacgctaacaacccagccgctttcactggctgatgcggtcgagagtctgttaaaaccgttacgggttattcacgtgccggtgaccgagctggccttggttttgcaaattgccttgcgattcgtgccgacattgatggatcaaaccactaaaattatgaatgcccaacgagcgcgtggcgttgactttggtgaaggtaatatttttcagcaaatgaaagctgttgttccgctactgatcccgttgtttgtttctagcttcaccaccgctgacgagttagcaacagcgatggaagcccgtgggtatcaaggcggcgacaatcgaaccaagtatcggatcttacgttatcatcagcgtgactggattgctgcgggcggtatgcttgttttaaccggacttttgctgttactgcgcgcgtattagaaaggaaccactgtattgacgcattataaagtgacactggcttacgatggcaccaactttgccggctatcaagttcagcccaagcagcgaacggttcaaggtgttctgcaaaaagctctgacgaaaatggcaaaagggcaaccggtgcatgttgatggctcaggccggacagattcaggcgtgcacgcgctaggacaggtcattagttttgattacccgggaaatattccggctgagtcgatgttgcgggcaatgaattcactgatgccactggatattgaaatcctaaaagctgaaattgtcgcggcggattttcatgcgcgctattcagcgaagggaaagcgatatcggtatcgggtggcgcgtggctattatacgaatccgtttaatcgcctttacacaggacactatccttataagttggatgtcaagcggattgaggttgcgttgaaagatctagttggtacgcatgacttcacgagttttgcagctagtggcggtgtgattaaagataaggtccggacgatttatgaggcaacggttgaagaagatccggctaccaatgaattgatttttgagttttatggtaatggctttttgtacaacatggtgcggattttggtggcgacggctttggagattggcaacggccggcgcgatgttcatgattttcaacggctttttgaagttaaggataggcagcaggcaagaggcacggcccctgcttcgggattgtacttgaaggaagtttattattgaccctcacacacaaacttttttattggctttgtggtatttccctgatcttttgcattttgaagtaccgagttgacaaactatgcaaccaaaagaggctctaaggactggtaggtcagtctttagagcctctttgcaaatgaattcatcctgctgaaattgacagctggttagtcacgccaaaatgcttaaacagcgcacacgaaatgaaatcttggtgcgttaacgcgtgtaatggcgaatgatggcgttcaaagttttggaagcaccttttttacctgtgccgtcttcatagtacttggtgaaacgcggatcggagacgtacatggctgccagaccgcggtgagctttttcggaatattgttcagatggccaggtgagttggagaaactgtttgtgcagtttgaaaagatgcttggcggcggcggtgttgtaatcggtcgtaccaacgagtggctttagttcctcaagaatcttctgttgcagtgcggtcagttgtgcgacttgtgcttgggacattttgcgaaacttctcattgctggcttcgacgacatcttctccgtattggtcgcggacttctttaccaaaatgttcttcattgtgctgaatggcttgttgcttaaaagcagcaaatttttcgttgtctgtcatggtgttaacccctttttctaaagtttgatccaaggtttgaagtagtaagctaagttggtcgcgtttggcggtgatgcgttgccgttgccggatgagcgtggcggttaattggtcggttggaccgtcaagcagttgtttgatttggctgagtggcatttcgaaaagttgtaagaagcggatgacctgcaggcgattgacctcagcttgcgtgtattggcggtagtcgttgttgggattgcgggttggctttagtaagccgattttgtcgtagtagcgtagtgtgcggatggtcacaccagctaagtcagcgagttgcttggttgagtatgtcattgactggcctcccttggatcaattataactttaaacggtgacgtggggttagggtcaaggggggaaggtggatagtgagtttgaggttttgtggttttgaggttggtgggttgcggaggacatgctattaggggcaattagcatgtcttgccgtactttctataacgcgctcgcagtcgcagaagtctgcgtgtaaggaccttaagcgcaatggccaagtgcgggccatcacgcttaaggccgcttacactccgacttctaagcgctcctgctcgcgctcacccaaaaagaaccgcgtccctttttgtgggggcgcggttcatgatgtttagttttgtgatcttacttcttgagaaccttttctgctagggctttgacctcatcgtcggacatgtctaggactggtttcatttcttcttcagtcttgatggtatcacggctgttcttttccatgtaataatcccacagcgcatcacggacaggtgcttcgctgttgctccagtcaaataccttgttcattggttcatcgagaaacaatgtcttttcaggatctactgttgccataatgattacctccatgatataaactcatttttgatacaaattcattataagccttttgctgggcgatgatgcaaatttttagcactgtttttaaaagagtgctaattcggcctatctgatagcgcttagatgctgctgctatgcggaatagcggcaagcttaaaatattaaaaaaagattaaatctacgctggattcggtgtgacttttttggccgctctgtctctgagttgcttgagctgaccatcgcgcatttcatatagcgtatccacgtcatccagcaaacgcgtgtcgtgggtgatcatgatgacaccgcgcttggttttgtgggcaatatcagccagaagtgccacgacttgcagtgcccgtttggtgtcgaggctggcggtcggttcatcggctaagataatcttcgggtcgttgtataacgcacgggcaattgcaacccgctgtttttcgccaccggataaagcggacggataattggtggtcaggtcgctgataccgagtaggttaaagagctcggtcatggagcgtttgtgttggcgatgatgattgaaacggtctactaaggctagctgatctttaacggtcaaaaaaggaattaggttgctggcttgtaagataaagccaaacgtattaaaccgcagatcggtccgctgacgttcattaaaatgcgtggtgtcctgactgttaatcacaatctgaccgtcgctgggttgctggagattgccgataatcgttaacaaagttgttttacctgaaccggatggcccgatgacggcggcaaattcaccggcatgcagcgtaaagtcggtggggtgcaaggcgactaccgccgtatggccactgccgtaaactttgctgacttgcttgagttgaactagtgtggtcatgttactcgcctccaatcgcagctaaaggatcaatgtgcaaaatccggcgtagtgagaataacccgccaaccagggacattaaaattaaggcggcagcgatcgcgataaaaagcggcggattagcataaaatggcatggcttttggtaaaataaattgcgttaatcccaacagtccggcaccgatagcaacgccggtgaccgcaagcatcaggatttgccagaacaaagcagcaataattgcccgcgtgcgaatgccttgtgcccgcatgaccccgtacatggcaattttttgaatggttaaaatgtacatgaagatgccaatgattaagagcataatgccaatcattgctccgatcattaaggcaaaagtcgaagtttcagctgtatagccggggatgttttcgactaaggttgctttggaaatggattgggtcttggtcgggacatttttaaacggctttgtactgatcaccgcggaggcctgtttaacttggcgctgtccgaactttagctgccgaaaagtgcctaaagttgtgtaaaatacaggtaccgtgtaaaagcgccggtcatgcgtcaacccgacaatccgatacgtttgactgctgccgtttaaagtgatgcgatcaccttggtgcaaaccataaatggtcacactgtcatccgcgagcacctcgttgtgatggattggcaggcgtccgcttgtgacagtcggcttcagcttgccgttgaggttgatgccaaagacgttactattgactttcttattattcgcggtactttccgctacaaccgcaacttgaccgaggacggcggtgtgcttggtgctgactttggtgatttgatccgcgctcaatgtcgaactcaggagattcttgttggcatattttgacaggagaacgtaattacccggcaatgcgtcaatggcggtgcgattgttacgcgctaaacctgtagccaaaccggttagaaaaaagaccagataggcaattaaaacaaaggtcgccatgacgagcagatagcgggctttgttgtgaataatctctttatacgcaaggaacatcacgatcacctccatatttgattttgcacaatcagtatatcacttgtttatcagttgataaatgaaaagggcttggaaaaatgacacaacgaaatgaccagaagaaagcgaccgtgcagcggatcttaaccgccgctcaggtattatttatgaatcacggttacacagcggtgaccacccgaatgatcgctgaagcggctgacgttcgccaaccgctgctgtatcactattttaaaaccaaagaggccttgtatcttgctgttgtcatggcggtaagtgaagacatggcaagtaaaattgcccatgaacaaatagatgcccaaaattttggcaaaaaagtcaagcgcctcggacatttactcaccgatgacaacatgatgaacttgcaactcgtcttacatgatgtcgggaatttaagttctaaggcgcaggcggatgtttttcaggcatggcaagtcggcttgttgtcgccgttagatcggttttttagcacctttgacgaacagctggcgccgacatatcgcgttcgtgacgtgaccctctattttttaaccgttttagccgcttatctgcaaccaactgtaggtaccggtcgcgggaacacttttcaaaatcaattgtcgcttgatcgcgctttgcagatgttttgtaccggtgttttgcggcccgaagccaatggggaaggatacgaggattgaagcatcgagtgggctgttgcagacacggtactaatggaagcagtaaaattaaagcaccgtttttaagaagtatttgatgtacgcaagcgcatttgggacaagcaacatcttgaagttaaaagaacgcgaactgcgagtgcaactttatagtaggatactgaattttacattgacttgagcgctaatcgttggtattctagtagctggtattgtttgccccacgataagccccggaaacttaacgtgttcaaacaagcacagaattatggaggaaacaaatcgtgcgtacaacatttttggctaagccaggtgaaatcgaacgtaaatggtatgtgatcgacgcaacggatatcgcgttgggccgtttatcatctgtcgttgcttcgatcttgcgtggtaagaacaagccgcaattcaccccaaacgttgatacaggtgacaatgtgatcgttatcaacgcttctaagttaaagttgactggcaaaaaagcctcagacaagatttactatcgtcacagtcagcatccaggtggtttgaaacatgaaatcgctggggatctcttgcgggacaacccggctcgtctggttgaatactctgttaagaagatgctcccgaccaagaacactcttggtcatcagcaattcttgaagcttcatgtctatgctggggaggaacacccacatttggcacagaagccagaagtactcgacatttcaaacttaatctaaggaggcaattactgtggcacaagtacaatacgcaggtacaggtcgtcgcaagaactccgttgcccgggtccgtttggttcctggtaccggcaagatcacgatgaacggtaaagacgttcgcgactaccttccatatgaaaacctgatcaccgatttaagccaaccatttggcatcactgaaactacaggcagctatgacgtgcttgttaacgttaatggcggcggtttctctggccaagctggcgcaactcgtcacggcattgcccgtgccttgttgaccgttgatcctgacttccgcggcccgcttaagaaggccggcatgctgacccgtgaccctcgtatgaaggaacggaagaagtatggcttgaagaaagctcgtaaggctagtcagttctccaagcgttaattcgccgagagcgaccggcaaaacggtgcatgttatatgcatcaactttggaaccacctggacagttatctgttcgggtggtttttttgctgtccaaaatacgtttcatttttaggagatttggaaactttcgcggtttacttgcaaatttatcattttgatccagcgcctagcaattgaagagcaaaattaacgattgataaattttagcttaacccttatgatgaaaagcatgtgtttgttcaaagaaatttcacggtgtccttttagtgataggcgtctgaagtcagcgtgattgatcgcgaacaatgacgacaattcaatctggcgaggtcattaaaatgataagtgcattacatacaaataccatcgaatattcggacagcgaggaattgcattatgattaagcgaatgcaaaacgcgctccctttgcttcttggatacggcttttccttactgggcgacatggtctatatctacgggatgaactggttcttagttgagcaaacgcatcaaacagaacttttgggattgattaacggtatcagcggcatggtccttatcgctgccaatgtttttgctggcccgattgttgactcgtttaaccgcaaacatatgatgatttttgctgatctgttaagcggcctgacctgtttcatgtgcgcctttttgcttcgcgatgttgtggcaggcaaactgctattgattctgacgagttcggtgcttaacgtttcgttggcatttaattcgccgtcagcaaaagccgttgtgcctaatgtcattcatgaaagccaaatcgagccttttaattcggttcaaaatacgttgtcaagtacgatcaaagtggttggcccgttggttggcgcattgttattgaagcttcacagtaacattaatggctttattttaatcaatggggtttcgtttgttttgtccgctttattaatctcaaccatccggtataccgaaaaaaacaatcataaagaaaaattgcagatcttgcccaaattaaagtctggcatggcgtatgtacgaaagaaagaaacgatcttggggttgctgatattaattgccacgattaattttttcgctgaagcttacacgctttcactaccatatttggtcaaggtttcgttagatttaaatggtgattggtatagcgcagtgatcagtatcgaggcgattggcggcattgccggaggcttgttgttggcactgtttaaccaaaaaagtgggaagaatggttactacatagatgtacttttgcttgcgttgtccattctcattcccgggatctttagagtttatcctgcgttactttttgccgcgtttatcaatggcttctttggtacgagattcaatgccaaggtattcaccgcgctacagataatcaccgagaatgattatctgggtcgcgttttttcaatcttgtttatttttagtgcgcttttgatcccaccagctgactttttatttggccgtgtgattccaatcttggggtggaatgccttgatccttagtgcgattgggctggcgttgtcgtcattgcttatttggatgcgatttattcgaaagctagactagtgatgtcgagactgtttttggtacaaaaggacgacatgctttacggcggtgttattttgggtgtaaattatgatttaatcatttatcgaatggtatatgtatgtgaaaatttgctccaaaacttgtacaaagcaatcctgttgttggcgcttatttttactgcgaatggtgacttttgcttttaacaaacgtgaaccttgggtgatatcagggggtggccgttatgggacaagccggcaactggcgctatgtacttgctaaatttattggcaaatatcgcttcaagttcggagccttattgggcgggctgtgtttggtcgaaatcgtttatgtggtcggtatttcattgctgccgccgctcgcagtcattttgttacaaaccaagcagttgaatgtcgggttgacgatattagttatctttatttctggtgttattgtctatggtatcagaattttggatctattcttgcagcagcgcctgtcaatattgacgtttgatttccgttttgattatgtaccggtgttttcggagcatattttcggctgggatcagcgcttgattgattcggtggcgggaaaaacggtcatcgatcaggcgtatgaagctatctataatggggctaatgttggtatcggggcggttgtcgatcagactattattttggtgcgcacgggttgtcagattgcggtgttactggtgatgatggggacactgagtttttggccggctgcagtggtttttggacttaatgtcttgcagtacctgtttcagcggttgagtaatcagtggtatttcaagcataaagaaagccagaatcgtatcactagttatcaaaattattttgttcgaacgttgatgaagcgttcgaccggcaaagatattcgcttgtttgcgatgcttggggttttccaccagcactttagcgatttaattcagcgcttagtggcatggcagcgacattatgccaatatcacgttaatggtgaatctcggtcagcgtatcgtgaatgtcggcggcctagcgctgtcattactgattttgctggcaacccgtaatatttctgttgccagtctgctgtttttcatcacggcgattcaaacgcttaattctaactttggtcaactcagagatgcgtatgcggcggtagggaaaaatctggtatttgtcgataactttcgaaaatttatggcatttccctatcgccaccaccaacgaaaaaataccgatcattttagcggctctggcgcaatcaacgtgacgcatgtggattatcaagtcaacaagacgcctattttgcacgatgccaatctttccattgccccaggtgagttaatcgcaatcgtaggggaaaatggtgccggcaagtcgacactcatcaaattgctttgcggactttacgtgccaacagccggatcggttgtcatggatggccaagcaatttcggactggacgcctgccgctattcagcgtcgggtggccgttgagtttcaagatgacgtgatacttcacttcaccattgcagaaaacgttgcttgcaccacacctgaaaagatcgacttgggtcgggttaaaacggtgcttgatgaagtggggttaggtacttttgtcgctgggcttcctcaaggcgtgcagacttttatcggtaacgaattggcggatgatgggattcaattgtcaggcgggcaaaaagagaaactgttatttgcccgtgtactgtatcgtcaagccgacttcaatattcttgatgaaccgacagccgcgcttgatcctttgagtgagaaacaattttacgatttaatcgatgaaaaactcgtcaataaaaccacgattattgtcgctcatcggcttggtgcgcttgcggttcggaatgtcaaaatctttgtgatgaaagacggaaccgtggtggcagcgggaacgcatcattggcttctggaaaattctgctgattatcgcgctttatgggaagcacagcgttcaatgtacgttggaggtggcgatcatgaaacagcttaaagaccagctccaagaagccttggcaacaggacgcttgattgctcggtttgggaaaagcctttttgtgctggcagtattcacgagcacactgaacgccattgcgccgcttctgattattctgggtaatacccaaatcattaatgctattttggcaggtcatctagaaacggtaccgacacttattggctatttttatgggatggcgggcggggcttacctgatggctgtatgcattcagcgctatttggaagtcaaaacgcttcaggccaatgagcagctaaaactggcaatgtatgaagcttgggagcaggttgattttcaaacacttgagactcagcgctattttgccaagatgatgaaaagtgaggcgtcatttcgttactcaggcgggattccggttttctttagccaattacaaaacctgattcaaggggttgtgaccgtgattgtcggtttaggcttgattagttggctggtggttgccgggacgacacgcagtcaagagattaccgcggtagttttagtgacggttcttacattatttttgggcgaagcattgctcattcacgtctatcaatctctgacgcgcacaagttttaagttgttcaaggatttgatgggcttggaaagaaaaatgaactattttctgatgaatgtcgtcaacgcctatgaaggacttaagtctattaagatgtgggggttaggtacgccgattcaacaacgctatcgagcaacgtggactgaggaaaagactgccaatcataagctggtagttaacgacagtggttcgcaaatgatcactgctttaatggcggcgtttgcgacgatggctttgtttctattaattgtgtttaaaatttatcgcggcttgttgccggtggggcagcttaataccttatttggcagcgtggttcaaatgaccagtgctgctagtttgatcgtagcgacttggcaacgattcctgcgctttgagaatcagatggggtacgtcaatgagatcttgaccactaacggccaaacaacaacgccaacaagtgagaccccgccagttcagcgtcaaaataccattgtttttgatcatgtttcgtttgcctacccggatggcgaggaggtcttgcatgatatctcctttaccctcgacttaaccggtgtgactgcgttgattggtgtaaatggcagtggcaagaccaccttagtcaaattgttgctgggactttatcaaccgactgccgggaaaatcttatttaacggtcatgatattgctgaaatatcagcggctgcttacttaggactattcaaagtagtattccaagactatgccatttttgattttacaattgctgaaaatattactgccagcactcaaccagatacggatcggctcgcacaggtgatggcagccaatgggattgacagtttggtggcgcacttgccaaaacaagccgccactgaaatcggaagttatcagcaagacaactttcaacccagcggcgggcaacgccaacagcttgcagtggctagagcacagtacaagcgaggcatttatcaaatccttgatgaaccttccgcggcgatggacccgttaaaagagttggctttatttacaaaaatcaaacggctgtctaaggaaaccccgtcactattcattacgcatcgtatcggcgcggtgacattagccaatcaaattattttattaaaagctggacgaattgacgatatcggaacgcgagaagagcttcttcaacgttcggcctatttccgcgaattatggcagagccaagctgaattgtatggtgatgtgcatgtgctgcgagatagataaggcgctaacatttgacgttgattaatggcttttctttccgctttgtgatacgtgtaatacatggtatacctcaaggggcagaaggaggcgattatgatggatgtgaaagttgtaaaacgtggaaactcgttagctttatcacttccgagcagtgcgggtttcaaacgaggcgaggcgtttttgctgatttcagatgaaaaaggtggttatctgttgatcccaaaggtaaaaaatccctataccaaagcaaaaccattatcattccatcaagaagaagcttggccggattttgactatgaggatattgaataatgacatataaggctaagcaaggtgatgtggtgtggcttgattttgatccgtccgagggtcatgaaattagaaaaagatgcccagctgttgttttaagcagtaacgcatacaatcgtgcaaccggatttgtgattgtcgcaccaattacctcaacaattcggacactacctggttatgttgatattgtatccaataaaattcgtggtcaggttgtcacttcgcaggtttattctctggatgtcactgaacaaggcaaccgaaaaatcgattttattgaaagaatgaacattgaagatttttatacagtcgctcaattcaccaaaatgaattttgattttaaattttagttttcgttacagtgactgtgaccgtacaaagtccatcaacatcaaatatgtttgaattgtcagtaaatggctatcaggtgaatggattgacttttcctaatactcgaattagcatagggttaattcaaaatcgttaaagacgcaaggaagagtaacagtgatttcggtccgcagagaatccggctggtggaaaaggatgactgcaaacactgtgaagatgagctttgccatgtcactagcttgttaacgcagactagtcggtcggagccgttaactttccggacctcgaaagatcatgaatttcggcgtcgttgaggcattgcttgtgaaggtaatgtaaatttgggtggtaccgcgctgcagcattcgtcccttggcaaaacagggatggatgctgttttttgagtgagcgcgagccagcccggttagaaaccggagtgtaagcggcctcagttgcaatggccggtctttggccattgcgactgaggtccttacacgcaggtttctgggctggcgagcgcgttaatgtgagcgcgagccggcgcgtttagaagtcggagtgtaagtggcctcaggcgtgatggccggtctttggccattgcgactgaggtccttacacgcaggtttctgggctggcgagcgcgttatgggagtaagccggaacataagcggcctcagtcacaatggccgagctttagccattgcaactaaggcccttacacgcaaatttctgcaccaggaatcgcgttatagaacgcaaagtcgcccccaaaaccaaccgaaaaacagaactccctcccgcctaaaaaagcagccagcacacccccagaaagtgaggaatagccatgaacttcatcatcgatcccaaagtactagcactaggcgtcaaaatccgcggcgttgagctaaccggcatcgacaatcaccactacccgcaagctctaaaacaagccatttccacagagattgcaacggttttggaaacattgaatcgcgatcagattaagcaggatccgattattcagggcttttgggacttgcatcgcgctgttcatctgcctaagcgcaacaacaccccggcgccagcaacattattgaagctaattttgaaacgcggggagcttgtacccattaatccagtggttgacttatacaacctcatttcgattcaaagtcaccttgcacttggcgcccacgatattgaacacattgatggcaatgtcaatttacggctgactgatggcaccgagcgcttcgttcccatcggtgcagacgaccagccggaaccggttaaagcaggcgagtatgcttatgttgatgacagcaacgaaatcatttgccacttagaaacccggcaagtggaaaaaacgaaagtgacgcctgaaaccacccatctttattacatcgcccaaggaaatgaaaacacaagccaagcgttggttgaccaaacggcccaacgcgtgattgacttaacaaccaaatatttaggtggtcaaggcaaactgcttaattgatcttgctgaggaaatttgcttcaccggcttctttttaaatgacgccaattgttatcaatggcccatttttctttttaaaaatacatctgatccacgggaatgctcgcttttaactgttattgacagtgaagcgggcgttttttcatgccgttttcgtcacgaactcttcaaacttgcttaagtcagctttaagttaccgctactagtatgaacatcatcaacttaagggagatggcgctgatgcaagaagtcacgacactgacgcaggagccgaaaaaacgggttaaaccgtctgtgaattggttaaagatcctgccttggctggtaccgctcgcgttcctgatgagctggcaggcggcggtcagttttaactgggtgacgagttccttgattcccgcaccgtcaacggtcattcaagacggaatctcgctgtggcaaagcggtgaattgccaaagaatattgccattagtctttatcgagccacggctgggtttgcgattggcggtagtgtcggcttcgcactcggcctgatcaacgggttagtcaaaccgattcgtgctttgcttgatagtccgattcaaatgttgcggaatatcccgcacctttccttaattccgctcatgattatcttaatgggcattggcgaaccggccaagattgcgttggttgccatcggggttatgttcccgatgtatatcaacacgtatcaaggcattgtcggcgcagatccggagttattggaaatgggccgtgcttatggcttatcccgacgcgcattgttcacccgcgttgttttcccgggtgccttagccaatattcttatgggcgtgcggtatgcgctaggggtgatgtggacaaccttgattgttgccgaaacgatctccgccacatccggcttaggctacatggccaccaatgcacaggaacttatgcggatggataccgtgttactttgcattttgatttacgccttactgggcaagctctccgatatgatcgcaaaaagcttggagcgcctattcctcggttggcggcaaggagggactgaaaatgactaacccaatcgtcaaacttcaacatattgaaaaagtctatggtgataaaaccgttcttcatgacattcaactcaatctttatcccggcgaatttttagcactagtcgggatgagtggcggcggtaaaagtacgattctgcgcttaatcgccggacttgaagccccgactgctggcaaactgacgcgcgcaaacgacttggtaatgcgcgtgatgttccaaaatgatcggcttttaccatggttaaccaatctcgataatgtttcgttcaaaaatcatgatccggcagtggttaaggaggctaagtcactgttaaaagcagtcggtttggccgataaaagtgatggctatccggcacaactgtctggtggtcaaaaacaacgcttggcattagcacgagcattgttggccaagccccaactgctcttgcttgatgaaccgctgggcgccttggatgcattgacccgtcaacggatgcaagatctcatcttacacattttcactacccaaaagctgagtacgatgttgatcacgcatgatgttaatgaagcggcgcggatggcagatcggattatcgtggttaaagatggtcagttggtcgctgaaacagcgggtgctcgtggtgagtcaccagaagttattgcccaaacggcagcgcgggtattgaaggccattttagcagagccggtgaccgtatgaaacaggtacaggcaacagcgaatgctacgacggcaaagccaactaagcatcgctacctttatgagattgacttaatgcgattgatcttcattgccggcgttttgttgaaccacaccaccacggcatttcaacatcaaatgtcttctggttttgccagcacggctttgctcgccacccacctcatgattcacttcacacgcatgggcttcatgttcatgacggggctggtgctgacgatggtctactactcccggcaacgtaactggccgcggttcttcaaaaaacgcttcacaacagttggcgttccctatgtcttgtggaacacaatcttaatgatcagcgccgtgctactgggtattggcgggttcaccgttgccaacttctggccggattatctcagtgccttattgcatggtgatcaattttatctgtattacgtcttggtaaccttacaactgtatctgttatttccggcgatgctttggctattcaaaagaacggagaagcatcacggcgccttgttgctagctagttttactttgcagttactcatcgtcgcaggtatcaagtacggcctgccgcatgtcgacacgagccactggttatggtggtttagagcatatggcgtcaatgttgtgacctaccaattcttcttcattgccggtggtttattcagcctacacgcccaagcggttaaaacctggttaatgtcccatcagcgcctgatcggctggagcaccttgtttctcagcttaggaacagttggtctttatggcttcaacaaacagattcttggactgactcacagtgctgcggtttcacctcatcagccgtatatgttggtatatgacgtggtgatgattgcctttgttgccatccttggtcaaaagtatgccagctggcacgccaaacagccaacgcactggattgctcgtttggttggtcatggcgcacaagtttcgtttggtgtctatctttgccaaaccattgccatcacgctattaggtggtgtcttgggactggttcatcttagtaatctcatgttaatgctgctgttgccgctgggttatctcagcattctcggcatttcctttgccatcgcttggttttgttacaaagtttccccgtttggatggctcattggtcgtccgcagtcattgttgttagctacgaaaggagtcctgaatcatgagcaaactcaccgatcagttatctcagaatctcatcaatcatcgtgattacccgttagtcaaatccgttgaggccaatacttggtacaccggacgcgatttggaagaagatgttgccgcgttacgtgatcagtttgctgagcagaaaattggcgcaggtgaccaagtcttaattgctttaccgaattcgccggtctttttaccgcttaatcaggcgctctgggaaattggggctgttgctcatccgattgctgccaaaaccccgctaccggaattgttggcagaatgggaaacctaccactatcaagccgtcatcacattgccagcagtgggtaaatccttagaagccccgttagttccatgggagaaagtgcaactgcataccatttccgagttggcaatcctgaccgatgcgagtcagttggcttatcggattaatgcccctcaagcacgaccacaagaggacgacttggcattaatcctcaacacttccgggaccacgggcaaacctaaacgagtcggcttgacgcaccggatgttattaaatgctgcgcttcatgatgccaagagtcacgaactatcgccggatgataccgcgatggtggtcatgccgatgtttcatattaatgcccaggtcatctcggtacttgctactaggttgtcaggcggtaagctggtgattgcgccgaagttttccgcctcgggattctggccgacgattgaaaccaatcatgtcacgtgggtctcggtggttccgacgatcatttcaatcttgctgatgaatcaacaggcgttagcggcttatcacagcaacattcatttacgctttgtccgcagctcgtcctttgcattaccagaagataaactggtcgcctttcagtcgcattttcacactcaggttctggaaggctacggcatgactgagacggctagtcaaagtacgcttaatccgattcatgccccgaaaatcggttcagccggtaagccggtggggactgagttgcgaatcaaattagcggatggcacctttaccaaaaagccatttgttgaaggcgaaatcgttctgcgtggcgatcacgttattcatgattatcttgagccacacccggaatcttttgaaaatggctggtttctaaccggcgacctcggatatctggatcaggatgggtatctgtttgtcaaaggccgacgcaaagaaatgattaaccgcggtggtgaaaaagtggccccagccaaagtcgaaaatgttctaaacgaactggactgggttgcccaagtggcggttatcggcttaccggataatttatatggtgaagcggtcacagccgttgtcattcgccaagatgccacggaagacccgcaaaaggccaagcttgatttactcaattttgcccgtcgacatttagccgcttatgaatgcccaaccgaagtcgtttttgtcaaagcttttccggtgaatgctactggtaaggtgctgcggccgaaactccgcaaacaattaatgcaaggcgggaagctatatgaagcgtaagttacgactggttttattgttagtgggcttagttgcttggctgagcgtggcggtttacggttatactcaaaccaccacggcatcgagcaaccttgagaccgtcacgattggctatcaaaaagccgatcctgtcgacattgcccggcagcgcggcgaattagccaaaaagttgaaagctaaaggctatcaggttgagttcaaggagttctctgacggggcagccttgatgacggcacttaaaagcggtgccatcgactatgcgcgggtcggggatacgccgcctgtaactgccaaagcaactggcacggacattgcactaattgccgctggggccaccaaagaatatggtagtggtattttggttggtaaaaatagcggcatcaccagtcttgagcaattaaagggcaagaccattgcgtatcaaaaaggcactgccgcccagtaccttatcatccaggcgctcaagaaagccggactcagcaccagtgatgtgaaactggtgaacatggatcaaagttcggcctcggttgcatttgctaaaggtagcgtcgatgcatgggttacctgggatccatatacgtcaacggcccaagtcaatcaaggtgctaagctgttgaccaacggcaccggcttgaccaagaaccgtgatttcctgatttcaacccagagctatgccaagacccatacatcattaagtaagttactgacgactgaactaaatgacgatatgacttgggccaatagccatcatacgcaactcattgcgatgctcagtaaaaccctgaatctctccgatgaagtgattaaaaagatggtagaacggcgcacctattccatgacgctgattagtgccaacagtagcattgtggcagaagaaaacgccattgccgatgtgttttatcaggatggggttatcacgacgaaggttgatatgaagacaactttggtcagcgattccaattaaaaccagctagatgattcagtcggcaacaaccataacgcgttcaccagctcagggatctgcgtgtaaggacgcttacactccgacttctaatcgcgccggctcgctctcaccacacaaaaaaccagctcgacagtcaattgctgcctagctggtttttgtttaatgtaaaattgacaaaagtcgtgaaaacttaagattggtagacactaagcttgatattgaatctgatagcgacccatggggatggttaaggtgtcgtggtcatgttcgatcgaagcggtccagtcttttccgtactggtcgtgaacgacaatggcctgggcatcatcaggtaattcaacttgtgcggtggtattcattggcacggttacgtcaagcatctggtgtgttggctcgtgacgataatgcagggtgataagtcccttgactgatggcgtcgtgagatctaagtgcttcaaattgccagggcgaactttgactctgaaggttgtaaatccaggcgcgagcggcacgatgccaaagaccccttgaacaatcgttaagccgggagtggcgccccacggatgggataaggtgagatttggcttgtacgcattactccaagcttccggggcaatggttgcttttaagctgtctaaaatcgccgcaaatgacttatgatccttgtggttgtcagggtcggtcaacagcgtgatggcgtcggctgcgtgaccggcttcaaagagtcctttgagcatgaagtagataaagtagatactaccgacaaaatgaccattattggcgacaaaatgacttaaccgatcggccatattctgatcagtataaacgccatagcaaagcgcgtaagcagacgcgtgatgtgatgtatggcgattgacagatagatccgcggttaacgaatcgaagaaccggcctgtttgcgggtcatataatttatcaatcagattcgtcttaatgatttccgctcgtttttggtaacggtcagcgtcatcaggatgatgaaggacgcgcgcaattttggccatcgtcgcgtaagcaccatggaaaatcgcgttaaatggcgtattgtaagtaccttccacaaagccgtcacgttcggaaatcggccagtccaccagcccatcgttggtgaccaagccgactgcagcgtcaaaattgtcgacaccttggctgttcttcagcgaaccagtgaaactttgcgaagcgccgtcaaaactttctgcggacttaccgcgatttagcttgtactgcaagtcagtgtaacgagtctgcagtaaatcatcatcaccggtatagagataatcaagccaagccatttcaattgcgaacagtttgtaatcttcgggccaggttggattgtcaattaaataatccagagaatgcctagccagtgagtagtttgaggagacactataactcgtattggcattgacaaggagatcgccttcatacggccggcgttcgcgtgcttgtgagtcgacaaaaacatcctgattcgtcgccttgatcgtatacttcgacaactcgtactcacgatttaacaactcactgtcactatcaaactggctctcattatccggaaatgcttgttgcagggcccaaccattaatggcatcaagcggcaaatcaccttcaaatcctaacagttcaacatagcggaagtttttcatttgtaaagtggtgaattgattctgtccttttacaagcgtccagttttcgatgtaatcaggtccgcacgccatctcatgccggacgtggccgtcttcatttagttgttcacccatcatcacggtgacacgctgatcgaaggcactgaacagattgacctttagcccgccaatgatctcttttcccaagtccaacagatagttttgatcggaaaaagtgagcacccgtttattgcgatcatgcacttccacgcgttcggtattttcgcttcgaaatggcaccagcacttcattgtcggcaatcatttggtgaggattctgccatgcaagcggccaattatgatcgtcaaatgcgctgctggtccagttctgaggatagtaacgcatgtcgatattttcactgaccataccgaaatattgggttctgatcttaacgccataatcgccaaaggcactgctgccatctaatgcgcgccaggtgttgtcagtggtcgtggcaacttctttcgttccgtcatgtttatacaggatcagctggcaccagaatgcctgcctatctgaacttgcagtggccaaggctgcaacggtattcgccccgtcttgcaaaaaatcggtagcttcataaacgttatagtaaatagctgttttttctgttccatgatcgtgttcctgttggcgagccgagccaacccccagacaatgaccattgagataaagatcgaaactttgagcaaaaaccggttcattaccccgggccaccgcaacaatgacggcagtatcaacctcgctcagattgattttgagttgagggctgcgcaaaaagacaacctgaccgatgtgtgccagctcttgggccgttttgggttgaggttggcgccagatgccatgcttaaccggtagcgacggatcggcacagatcagtttggcaggctgggagaagtcactgatatttccggcgttgtctttgatgcgcacttgccaataatacaattgaccagcaacgagttgatcggataactttgcagccgtcaccgcggtattattcgaactcgttacccaaccactatcgtacaaatatttatgatcctgacgatcctgaaggcgctgaaagaccgtaagctgatacgcgctttgcgatgctccggtgcgattgctgtggttccaccagctgaaatgcggttgcgtttggacgttataagcaaaatgttgcaagttaacgcgcagatgatccggcgcgagtaacgatggtgttatatttggcatgtctaattagctcctttttaagtaaaacgctcttttttttagcgtactttttaaaaattgaaaatgcaatatggtatttaagcgtttactaaaagtcgcttttaatatgaagttatgaaatgcgtgatatcagttattgcttaaaatcttgccttttcatagatggagatttgtcccaaacttgctagattgatgtccctaaaaatcattttgctaataaagatgcgttaaaagtactactgaatcgatcagatggacgtcacgaaatcctgaatatacaaagaaaaagcgtcatcgtttgcaaaactggtctagatattatttttcatttgctgtaaatttcacaaaaatctacaacagcatatacaacgatcaagaacacaaataggtgattccgatttgtataatggtattgataagcgacgagaacatgaagagggttaaaaggccaaaactaattctgattctgtagatatgtccttattttgggacatatcattagcaatcgcgctgattttactaaaatagtcaaatttagatagcgattttacgaaagtggtgttaacctcatttttgtaaacgtttacgaaaagaaccgaatcactatttgttgctaattaaatgggaggttttcatcgtgaagagaaaagtcaggtggcgtaatgttattggttacggtgccgcagatttatttggtaatggggccctaaccgttgcctccacatggatgttgtttttctacacatcctttggcggattatctccagtgcttggaggtacgatccttgcgattgcacgtgtggctgattcctttattagtcctttgatgggttacttaacggatcacttcggtgcaactaaattaggacggaagtttggtcgcagaagattcttcctgctaatttccattccgctgatgtttatctatgtcattatctggatttcacatatgggcttctggttttatcttttcacatacctgctcatggaagctttcacagcgttggttatgattccatacgagacgctggccgctgaaatgacagatgattatgatatgaagtcacgtttatccagttcgcggatgctttggtcagctttagcaaccttccttgcttcatggctgccaggtcgcgtctttgccattatgggtaaaaataatccaaacgcattcttaaccatcgggatcattcttgctatcgtcttcattcttgccattggcttgacgtacttctcaacctttgaacgtgagacagatggaacgccggaagaacgtaaagctattattgaagaaagcagtcataaaggcgaaaatcctttagtatcgctttggaacatgattaaggatatgggttcggtcttccggattaaatcctttgcacttcacttagttatttatctgagttcatttacagcacgtgatattgtcggggcaacctatgtgttttacattgtctatgccatgcagagcaatccgactgaagcttccaatattttgacgtttggttccattatcgggatcccatgtaacttggtatggccaaagatcatgagcaaacttggaccttccaagttattgcggattatgtatgcaatgatgttcttcacggttgcttgctacgccggtttgtactatggccaagcagctgcgactagctggggcatcatgaccttatatgcacttcaggtaacttggggcatttcaaactccggtaccggctatgtgccatggactgtttacacgttcattcctgatgtggacgaaatggtcaccaagcaacggcgcgaaggtatctttgccggtattatgacctttgctcggaagacaacttccgcgctggcaccatttttaaccgggattgttttatcagcatttggattcaatgaaggcgccaagacgcaaagtgccgctgcgataaacggtttaatcatctggatgttagttggtacaacgttaatgctgttactcgcgtttgttacttcctacttctttaagttggatcgtgaaaatcacaagatccttcgtgatgaaatcgatcgcttgaaggcaggcggcaagatggcggatgttgatcccgccgtcaaagcaaaagttgaagatctgactggctttggttacgaccaactctgggggcacaataatattgtgtgaccaagcgatcgctcgacttggtagactaaccatggtgacaacatcaaataatgctgctaacgtcatttctccaaaatagcgtttttaagtcatgtcgatagtgacaacactcccatgttttcttagtttcgactgaatgactttcccgtgataagcgggtaccattttaaagccgaaagtcagtgcgcgttcactgacttcgactgaaattaaaaagtccggactgtttgttgcagcgcgggctttttactgtggcaagtattttgggttggcagtcggtcagctgggtataagctaatctgcgtcatgtttgtctacagtggaaaatcaatcactttccggcgctgttttcccatgcaattatttgatataatttcaatgaattaaatggcgatggtgttcgcctatacgtaagttgatgacacctaccttgtaattaacggggtaggtgtctttttttggacacatgtacggcaacgcgcggatgaagaaaggagcaatctatgcaacaacgggaacaagtaaggcttagttgggtgctggcagtatttgtcggtggttttttcggcggggtcatgcgatatggccttagttcagtcacgatggacggtcaaaccatggtgggtacgacaattgtgaacttattgggcagttttctgctggcgtttacgacttatgggctagacatgagatttgacttgccagagtggctgttgttaggcattggaacaggggtaatcggtgggtttacgaccttttcgacgcttatgctggactttgttaatttggtggcaacgcatgcggtctatgcgttcgtgttgctaagcttaaatcttatcggcggactgctggcagcagctggcggattctttgttgcaaaatggctaccacgaaaggataaaagctcatggtaattttggtcggaattggtgctggtgtgggagctgtttgtcggtatttgctgacggtgttagggcggatgctgtggcccggaaaaccggttgccacaatgatgattaatgtgcttggggcatttttggcgggatttttagctggcttgcccgcgttttctgcttttcgggtgttgttgctgactggattttgcggtggctttacaactttttcaacgtttatggcagacgcgtttattttgattcgtaatcggcagtggcgcgtgtttgttgggtattttttggggagtgtgttgctgggggtggtggcgatggtagcggggttaagggtttcattacttatatgaaactatcaaaaaggttgtaaaatactttgcttgacgagtcatctcaagaagcgccgtattgcataggcataatactcctaattcaaaaatataataagttttgtaccaagctttagcagatacaatattgatgctattggaggagtaaatatgtttatataaccgcttcaaagaacatgtcgtcaatgacaagaagaaaatgtacaagcgcggtagtcaatgggttgttgcttcagcgtttgtcgtactttttggcaggacaactttaggcgttgccaatgtaacgctttctaaaaatggaaatgcaagtcaaaaggcacctgtagccctgcaaagtcagcaaaatgaatcgcgggcatcaaaagtagcaactcctcagtcagtgcaggggcaaccgcaacaggaagagctgataatacggtagctagctcggcagcagtgcagaatacggccaaagcgggttcaagttcagcggctgctacataagctgctgcaagtgcgggcagctcagcatcttccagcgcttcgagttcgtcagcctcaagtataggcagttctgcttcctcaagcgcgtccagctcatcggcctcaagtacaggcagttcagcatcttctagtgcctcaagttcatcagcctcaagtgcaggtgccacagcatcatcaagcacttccggctcctcaacttcaagtgctgccgtggcaccactaggaaccactcagtcaaccaatccacaacctatgagtcggatggtccagaagaatggcaagcacgcttatccagctacaggtgaagggcaaacgggtcttcttttagccgaagccggtgccgctatcatcgctgctcttgggttcgctggcgttcgtaaagcgcgtcatgcaaagtaattgatattagcctgctaaacatgtgggatgattagcaggcgagacaattatgatgaaaaaatggcttttatactctcgcttgtgagagtgctattgcaaggttttggtagttagagataagggtagacacatcggagaaatcggcgcagcatgagcagaccgaaagccgatattatttcaggtttatggtcttcaaaaaggtgctggattctttcatataggtcagtcgtaaggaaaccaggaatcaacggatcgtgggggtctcgttattcctttcatccaaatgtgaggcagactggcgatgaaaaaacacctagacagagggttcaatcgctgtgggagtggttgctcagcgtctagtcgccatttaaaatataaaaaaggtcacagcactaagtttatcgatggccttaagtagtcagtttgcatttttattagcgagctggctattttttggaaaaataacgtcaagaatgatggaaggctcgcccaaatttatagtgaagaagaaaggtcagaaaaattgctgggtactttgcagtatgatgatcggattatcttagggaagacagttggtttctggacacataaaaagccgcctcacctgcagatgagacggcttttggtatagtaaccatcaatcaaaatcttgcatttgtttttggttggaggctactgaggtttgtatagaacaagtcctcctgcaagcgtgcttgttcttcttcgtggggatcgcgtggtgcggcgatcaagtgctcaacgcgtttaaaagtatgtttgaacaatgacatttaaaacatctcccctttggttgctcctgtttacaactctattgtagttcaaccggtcaaaaattcaattggtataaggggtatgaaaacgaattcatttcaaaaagtttacgaaaatgtttcatatgtcacatggcttcacaaactatcatgttttaaacgcatgctactcgtaggttttgcggtcaagaaggttacttagtgtccgtctgattttggattttttccagttgtcgatattgatcagtcatccaagtgcggtagttttttcctttaggcagtgtctcggtgacgttcagaacaggtaccttgttttccttggctagcttaatgaaactatcgatggtttttgaactggcttggctattgttgacgaagaaggcgattttcttttctttgatgtcggtttcaatcgcatggatatctttggcgctgtaatcagtaccttcttcagttgcctgggcaaaatgacggttgttgactttgtagcccagataattgagggcatagccgaagacgggttcggacacatcgactttttgaccatgagcattttgcttgagcttggtaattaaggcattgagggagttaagcgaggcgatgtatttcttggcattggctttaaaaatcgccttttttgccggcttttctttggcaaatttgctggctaacgcattggcaagtttaggcatggtgcgtggatcataccagatgtgttcattatcgccttcatgtttagccatcagatcatcagcaacgcgtaaatactgtttggatttgttttccgacttgatcagcttatccatccagccatcataaccgatgccgttagcgatgattaaatcagctgtggccacttgtttgccgacttgggtggttggttcatagtcatgcggatcaatggcaggattgtcgataatggacgtgacttgtacttgcttgccgccaaccgctttggcaacttcgccataaaaatcaacggttgcgacgacttggatcttttcatgatttcctgatgatttggtattcgtattgcatgcggtaacaactgttgttagtagtagcagactgatgactgttaataaccgttttaacataactgaatctcctcgtttaaccgtaatgatgacgcgtttaagcgtagcgtactggcgatattgacgcaagctaaaagatgccatattgatgactaatcgtaggaaacgctaatctggcataatatatccatttgtataagattgaaaaatattgaaaacatgatgccggtagttctgggactatttttgatggtcatgaagtcatggtgaactttttatccaaaagcatctgcaatcatatttgtcatttgcggtgacttgtttgacgctgtatcacgcctgtggttgaatgaacttaatgaagaatggttgtgaacagtttgatcgagggggaattgtgttgcgaaaatggctattgatcaccgtaatctgtttgacaatggtcggggccaccggttgtcagtccaaggcgtctaaatcgtcacaggatgcggggtcaacgatgattaaaacaaatcactataccaaaaacgacctgcaaaagcggtacacgcgcatttctgatattgtcatgaaaacgatgacaaaagtatcgttgcaaagtgatagtaaggaaattagcaagacagccaaaaaagggcttgggcaattggatgatattcgcctcgaattagcaaacaataaaacagaggacggtttaaccaaagccttgactgattacaataagcttggcagcgagctcttaaccagcgcaataaataatgatgcgaaaacttatcaggctaacggtcaaggcttcttcaaacaggccgtgagtgtcggtgaaaagtattttggcgatcaaattccccaatcaattcgcaattttgccaacaatcaacaagctgtcacaactgaaagtagtaaatagcgtcgaactgccaaaacggtttgactagtaaaaaaatttcatcctcatgtgccggtgatgctttttgtagagcggtcacgctaatgaagatgaaatttttttgtggtggaaaaacttcacgctaagattaatagaaggaaggtttatcgccttgcgtatgcggctggtcaacgccaagcgattcaccgatgtgttgatgcggatgattgattaagttaacaaccagatcagcaatactacttcgggagacttctgtgcctttgaagggttcccctttttgcgtgagttcataacttacaatggctttattggatagccaagcagggcgaataatggtgtaggctaagtcggaattttcgatgactttagccgctgcagcataggtttcaaggtaaccgccgtctaacatcttatggttccagcgaccaaatgcacctggcacttcatcgtaaataccaagtgttgaaatccaaattaagcgtttgatgtgattggcatccatcgctttgacgaccgacttggcttgatcctcaatccctgagttccctaagttggcgtaaacaagatcactaccgctcattgcttttgtcagtttgtccgtatcagtgacatcaccgtcgtaaaccgtttctcgttggcggtcaacatcagtgatgcgcttggcatggcgtaaaaacaagttgagatgatgctgagtttcttttagcaagcggtggcgcaccaaggtcgcaatttggccgtgtgctcctagaatcatcacatttgccatactcatcttcctttcttgtgccggctctagtgtaacacttccgatttaaaacgcctggggccacttacactccggtctctaaccgcgccgggtcgcgctcactaaaaaaagtccgcaatttgcggacttttcctgaccagactgttcgatgcttttgactcgaacttatggtttgttgggtcatcaatgctaaaccattgatggattttttcggtacagggtgagtgataccgaagtaaagggaagtgtaacaaacccttgtggtcagacgagtttgattacttactgcttgttgttgcttgattttggatcttttcgagttgttggtattggctcatcatccatgtgcgatagtttttgcctttaggaagtgtttcggtgacattcaaaactggcacgttattttgcttggcaagtttaacaaggcgtgaaactgttttagatgtcgcttgaatgttgttaacgaaaaaggcgattttcttttccttgatgtcggtttcaataccatgaatatccttggcgctgtaatcggtaccttcttcggttgagttagaaaagtgggcgtcgttgatcttgtagcctaggtaatctaaggcataaccgaagactggttccgagacgtcaacaagttgaccgtttgcgtttgatttgagtttattaacaagtgcattgaggtcatctaatgaagcgatgtatttctttgcgttggctttgaacttggctttattggccgggtcttttttggcaaatttatccgccagcgcatttgccagttttggcattgtccgcggatcataccagatatgttcgttgtcgccttcctttttgttcatcagatcatcggcaactcttaagtagcttttcgatttgttttccgatttaacgactttgtccatccagccgtcatagccgatgccactggcaatgacgaaatcggatgttgcaactgctttgccgactttggtggttggctcataatcatgcggatcaacagccggattgttaatcaccgactgcaccgcgaccttatcaccgccaactgctttggcaacctcaccataaaaatcgacgctagccactacctgaattttatcgttgctagcgctggattgctttgcggcaccattattgccacacgcgactgcaaaaactgctaagagtgcgacactgatacctgcaagtaatcgcttcatcataaatacccgcttccttccaaaacgtaatcattacgatttaaactctaaagcaaaaaaaccggcttgacaagtctttttttgaattgggtcaaagaagcgttcgtcctgaaaaagttattgacagtcaaaacagctgcatgatacggttaaattcgtcattaagcgtaatgattacgatttaaagggagagggaaattttggaaaaaacggatttagcaagtgcgcggcgccggatgaagagtcccaacattaaaacgcgcaaacgagcattaaaaattctacacgatacgaagcgcaagcagcaaaaatccagataagcgttcgtatacgcctattgtcggtgtcggaaaataggttggttaatgagatggctcgtcacattttatagaaagaggaagcttatggccaaaaagtcaaaaattgccaaggcaaaacggcaagagaagttagttcaacaatatgcagcaaaacgcgcagaactgaaagcaaaaggcgattatatcggactcagcaagttgccacgtgactccagcccagtacgattacatcatcgcgacgctttagatggtcgtccgcacgcgtatatgcgtaaatttggcatctcgcgacttaattttcgcgagttggcacacaaaggccagattcccggtgttcgtaaagccagttggtaatacgtacgcagaaaaaataacaaccggccttttaaaaagttgcgactgatttgtaacttaaataacgggaagataaacaaaggcctatgagtaattaatgaaattactcataggtctttttatagtctcaaataagttccaataactgcatgcgattacatttttgatttatcgggatttataactatgacttgagacggacacgataaagcgttggtggccaaaatgtaccgcgtataaaaattttaagtatgccttaaaaaacacttgccagtctctcttcttttctgtaagcttagggtgaaagcgaattaggtcaccctaaaattggaggttcttatgttaacagtcaagaacctgaccgttgcctacgctgacacaccggtgtttgctgatgttgccgttcattttaacgcaggtaagatcaccgggatcattgggcctaacggagcaggtaaatcgaccttgatcaaagctattctaggtttgatcaaggttcaatcagggaaggtcgacttttccggccacaccctcaaggaagtgcaacaagcgattgcttatgtcgagcagcgcaaggatttggatctgacttttccaattaacgtgttagatcttgtgctgactggcacctatggacgtctggggttgttgaagagccccggtaaaaaagagcgtcaggcggcacttgaagcgctggaacaagtcgggttggcggatttcaccaaacgccagatcagtcagctatcaggcggccagctacagcgcgtgtttgtggcgcgtgccattgtgcagcaggctgacatcatgatcctggacgagccatttgtcggtattgacatgaagagcgagcaggaaatcatggccattttgaatcagtggcgcgatgccggaaaaacactgattgtcgttcatcacgatttaaataaagtttcaaattattttgatgaacttgtggtgatgaaccacggcattattgctgaaggaccggtcgaagaagtgtatacggctcaaaatatcgaacgggcattttcggccgatctttccaacgtgctgtttgcaaccaaggaaggggcgagcgtatgagttcattagctgaatttttcaccgcgttaggaaaatatgatttcctccaaagtgcgttaattactgccatcatggtagggatcatgtccggtttgattggtagcttcattattttgcgcggcatgtcgttgatgggggatgcaatttcccatgcggtgcttccgggcgttgccgttgcttatatgctgggtgtcaacgtcatgattggggcttcggtgtttggcattatcgccgcgctgttgatcggttttgttgcggcaaatagtaagatcaaaaccgatacctccatcggcgtggtgttcagtgcgttttatgcgctcggattcattttgatttcgatggcagaaagcgctacgaacttgcatcatattctgtttggtaatattttggcggtcagcgatagtgatattatgaccaccgcggttgtgttagggattgtcattttattcgtggtgttgttctataaggaattgttgatcacatcgtttgataatacctttgctaaaacttatgggttgaataccactgcgattcattacgcgttgatgctggttttaaccttggtaactgtttcggccttgcagacggtggggatcattttggtcgttgctatgctgatcacgcctgctgccactgctttcttatggacggatcggcttgaaaccatgctcgtgatggcagcaagcgtcggggtcatttcgtctatcaccgggttgtatttcagcttcacctttaactgggcatccggtccggcaattgtgctcgtagcggcggtattgttcgccatctcgttcgtcttttcaccaaaacaggcattctttagtttcagtaagcgtcagcggaccaaaacagccgcgacgactcaaaccgcggaggaagttattcgatgaagaagattttaattacggtgggcgccttaattgtgatgattggcggtgtcttttggttcatcaacagtcggagcacggctcaaaaagattcagcaagcacgaatcaaacgttgcgggtggtcacaaccaattcgattttggaggatatggttcaaaatgtcggcggcgagcggatcaagctgtacagtattgttaaacgcggcacggatccgcatgagtatgaaccgcgcccaaccgatgtggcggcaaccagtgaagccgatgttgtgtttcataatggtttgaaccttgaaaccggtgggaatggctggtttaagaagttggttaagacgtcgcacaaggaatttgataaggatgttttcgctgcaagtaaaggcgtgaccgcccaacacttaacaacgaacaccaaggaacaggatccgcatgcttggctagacttagctaacggcatccagtatgttaagacgattaccaaggtgcttaaacaaaaagatgccaaaaacgctgcttattaccagaagaatagcgatcgttacgttgccaagttgcaaaaactacatgaaaccgcgctgtcacgcttcctcgatattccggaaaagcaacgcgtgttagtgacgtcagaaggggcctttaagtacttttccaaggcttatcatgtgaccccggcatacatttgggaaatcaacaccgaatctcaaggaacaccagaacaaatgcagacggttctagctaagattcgtgcatccgaagtgaaacatctattcgtggaaacctcggtctcaccgaagtccatgaataaagtggccaaagagaccgggttgtcgatttactcgaagattttcacggactcgctggcggctaagggtactcaaggcgatacgtattatacgatgatgaaatggaaccttgataagattcacgatggattggcaggttagctttaaggatcagtatgaaaaagaaacaaggtatatcctgatacacattgaagtgtaaaggaatataccttgtttttttctcgaaaatgagtcattgaccgtgttgcttacctcgggcgacatgatctgcgtgggcgagcatggcatcaatgaccgcaataatgtgggggtcatcgagttgataataattagctttgccgacacgttttgcactaacgagttggtgcttgcgtaagagcgctaactggtgggagacaacggattgctcaacgcccaataattcactaagcttgctgacgttgagcacttgttgttcgagtaatttcagcatctgcaatcgagtcggattactgagcagtttgaaaatacgctcagcttcggcaagcttggccgattcaaccaaccttagcgtcgtagcagtcattaacgggttcctcttttccattgatgaacgaataacaatcaaagtgatacaaatgaccttaaagcaagacgtcttttcattcaaggcgctttgctctaaggtcatttttccggaaagatttattcctcgttttcgctgtggctcaagccggtttgcagtgcttcccagccttcactggcaacaaaataaactaaaatcaacgctgcaaccgaatcggcccaccaccaattaaatagccaagttaacaagctaccgatcaaaacagtagccgccatgtaggcacaggtgatattgcacatgccgtcttcgataagtgctggagaattaagcttgtgaccaagatgacgttttctaagtgtcaaaaatggcatcacaataatagacgcgatggcaatgccgataccgctcatactactttcagcggctgcgtgcgtcacaagattgaaacctgaaaccccgatgacgtataagctcagcagcaacagcacacagccgaccacaagacttgagcgttgttctgcacgggcgaccgccgaagcacttgcaccgttactttcttttttcagtcgccagattaaagtggcaccggaaataatttccagaaaactatccagcccaaacgcaattaacagaattgaccctgcttgaaatcctgaccagaagccgatcaaaaattcaaacgccatccagccagtagaaaaatattcaactcgaatggcggttgtcatatcagcgtttttggcgatgacaaatggtttcatcttgctgcctcactctttatttatttgctaacatatgatattgcaaacatatgttaatgtcaacataaaataaaggtgaggtagccagacaatcagcatcaagtctgcttaaagatcaatgctgcgtggcatggtgatgcgtttcatggtcagcttgatacgcatttaccaatcccgagattgcatcaagtgacatgataatgcccatcagccacatggcagccatgttatgcatggtggcaattaataccagtaacacaacattcagtgccaacatcaaccagcccatggattttgacatcattttcatcttcctcccttctttttacgaagcacctactttagattaattccaaattacgtttatggcaaccctaaaaagtgctagaatttgaagcgaggggggaacgatgatgaaaacctataccgactatttctttgatgagccggcgtttgacttgcatgatggcggttatgtgccacttgaagtaagcgatgcgccagccaaacccttaaatgtgccgccgttgctaaaacctgataaagaaacggcaaccgatgtgtattacaccgtcacggcacaagcaggggagacacagttgcttcccggcgcaaagacaaaaacatggggttataatgctagcttgcttgggcaaacgattgtctatcgccgcggccagcatgttcatgtgacactgaaaaacaccttgcctgaactgacaactttccattggcatggcgctaatgtaagtggcccttatgtggatggtgggtgccatgcgccggtttatccgggcgaaagtaagcaaattgatttcaccttggatcaaccggcggcaacattgtggctgcatgcccacccgtgtccttcaactgccgaacaggtctggcatggcttggcggcaatggtcattgttaaggatcagcatgaagaaagcttgccattaccacgcaattacggagttgacgacattccggtgattttgcaggatcgccggtttcatgagcagaatcagtggaattatcgggctgattatgatccggatggcgttgctggtccgaccgcgatgattaatggcaccattaatccttatttcgatgtgaccacccagaaagttcggttacggtttttagatggcgctaatcgccgggagtggcggctgcatttttccgatgatttgccgtttacccaaatcggcggtgatggttcgttgttgccggaaccggtggccttgacgcatttgatgctgacgtgtgctgaacgggcagaagtcattgtcgattttggtcagtatcatgaaggcgatgtggtcacgctttacaccgataatgtgcctttgttgaagtttcggattcatactttcaagccggatcacacgcaattgccggacaagctctttacggtgaaagcacctgcagttgatcctgctttgccagttcgccatgtggtgatgcaaggaatggatgaaagtgtcgcgattgacggtaaaaagtttgccatgcagcgaattgatgcgactcaaccgattggcaaagctcagtattgggatgttaccaacagtaatgctgcgcccgggatggttcatccgtttcatgtgcacggcacgcaatttttgattttgtcccgtaacgggcatgcgccatatccaaacgagcacggatttaaggatacggttggtgttaatccgggtgaaacagttcggttgttagtgcgctttgatttgccaggggtttacatgtatcactgtcatattattgaacatgaagacggtggtatgatggcgcaaatcgaaacgtttgatccgacaaaacctaaacaggaatacaaattgatggacatggatacattgatgacagccttagcgaaggaacgtggggtcaaaccatctgaattatggatgggcggtatgcagtcgtatgaaaaaatgggtatgaaaatgtgaggcaccaaaaatcaaatagaaatcgatgatgttatgaatggtacaacgattaaacatcgcggcgcttttgtcgcaactttgctgacaggaacgttttcgatgtcaatttcgcaatcttctttgagtacggcctatccggcttttatgaaggcatttggtttgggcgcggatacggtcgcgtggctgacgacgggatttatgctggtcatgacgctgatgattccggtgagtccgtggctgttgcataatgtcccgtttcagcggctttttcaggcaattgagctgatttttgcagttgggacggctttatgtatctgggcgccaagctttgcggttttgatgattggtcggttacttgaggcggttgccgtcgggattattttccctagtttccagacagtgctgctgacgattacgccgcacagtgaacgcggtaaagtgatgggaacagccggcttggtaatgggatcggcgctggcggtgggcccgattatttcaggggtcttgttgacgtggtttccatggcaagcgttattcctattcttcctaattgtttcagtgcttgtactggcagtttcgactgtcacgattgcctcggtgatgccgctggaacagacccggttagactgggtttcgtttatcttgtcggcgagctttccgattttgctatatgccttaagtgcgtggtcaaaacaaggcctgcgcgttggggtgattagtttgttgatcgtcggagtcttggcaggcggtatctttgtgattcggcagttgaatcgccaaccaccgatgctgcaaatgcgggtttttgcaactggcatgtttaccaaggcagtcttcttaaccggtatttcttacatcggcttgattgttacgacgattctgatgccgttgtattttcaaaccttgctaggactttcgccgttagtttccggcctgtcacttgtgccagcagccgtcttactgagtttacttaatccggttagtggacgcttgcttgatcgctttggtccgcggctggtcgcgatgatcgggatggttctgatcacaggcggttttggtttactggcgatttttgctcgtcatctgccgttgctaggtgcgattgtgttagcgatggcaacagaagcagggaatgcctttgtgatgatgccttctgtgacggctggcgcgaatgccttgccaaatgaactggtggccgatggaaccgcggttaccacaacggcccgacagttatttggctcagccggcgtgatgtttgcgacagtattgttggacaacatgcaggtgacgttaaatagccacgctggcggctttgcagttacctttgctgtctttgccggcgtgggcttagttgggctattgctggccttgacattgccaaaagcggttgaacaaaagcattaaaagaacgggtcattgggtgaaaacgtcacaacaatggctcgcttttttatgtattttgcaagtaattctcatagaagaaccgaaaagaattgcaggctgtcgtttgatcagattattcatcattacccaaaaataaatagtgtcaacagtgtaacggcaggggttttagtaattccagcgacaccaaaacgccgcctatcttttcttcggataggcggcgttttgctgcaactaagctgcttgactggatgacttagccgcaactgatcgggagaggagcagcatcgcgactaggaaaggaggtaacgcggttgctcagtcaacgaaaatcagttcaatttcggaatcagccggtttgacattgactgacaaatgacggttgaggtcggcaaccagtttgcgtgcaaaagccattttctcatcgaaatcagtcatatgtgaggtgaaaggaacactttgataatcgtaattttcaccgatgaatccggggtcggtgacataacgcaaattattttggtcatgacgactgcccggttttaagacggcatccaagtactgatacaagattgccggctcgtagttcagcggtttctcaagggtggtggtaatcttatagccatttgcttcgccggcaaattcttcattaatttggacttgtgtgagaccttgatacaatttcaaaacgatcagctcctcttcttttcacttccagtataccagttgtcggcttatttaaaagagaaattttaggattgcctgaaatattttaaggcgaaagaatcggcacagcatcacggaacattaattcagagatcgccttcgaaagcccaaaaagcccgataaactggtggatgatgaaccagtttatcggactttttgtatacgcataaggtttgttagggaaaccttacttatagtcttaccattgttaatgccaaaagaaaagaaaaagtttaggctgtccaaacattatttactgatttttgtggtggattgaaacgcatcgtggccgtgaagccgttgccagcgcaggcggatgattttgtcgatttcagtcacgatcaaaatcacagaaccggctagaacagcaatgccccattcacgccacgacatcgaagcagtttggaagatttcctgcataaaaggtacataggtcaggaaacattgcagtgcaagcatgatgccgataatcgcaaacgccatgggattactaaagagattttttgaaagtgccagtgtgtttgtacggatgttaaagagatagaagatttttcctaagacaatcatgttcaccatcatggtgcttgcggtgacgcggtctgttaagtggttggctgtcaaccaatcgaacgcccacaacccgataccggcgatcatcatggctacataagcaatttgaaagacatcatgtttgtgcatcattgacgcatttttcttacgtggtgggcgctccatcgtgccggcttcggcaggttcgaagatgaaggcgaattgaatggtgatggcgctgaccatgttaatccacaacagctgactggcacgtaatggcatcgcttgttgggtcaggatggtgaatacgatcaccagtccttcggcaaaagaggtcggtaataggaacaaaatgctttttttgatgttttggtaaatgcggcgtccttgagcgatggccgtttccatgcgggcaaagcggtcatcggtcagcaccatgtcggctgcatctttggcaacatcggtcccggattgacccatggcaactccgacgtcggactttttaagtgctggtgcatcattgacgccatcgccgaccatggcggtgacgttgccggcatcttgtaagacagagacaatcgtcagtttgtcttttggtgtggtccgggcaaagacgtcggcattgaggatcatctggcgttgcttttcttccggcagtgctgctagttgcgtgccggtgacggctgtaggcgaatcggccatgcctagctttttggcgatggcaagagccgtctcggggtgatcgccggtgatcattttgactttgacaccggcgcgccgcatttgcttgatcgccgaaatcactgactcgcgtggcggatcaataatcgcggtgagtcctagaaaatcgagcccttgctttaataatgctggcgtgatttcgctagtgtcatccggaacgattttctgggcaacggcaatgacgcgttgcccttccgtactgaactgactcgttaacattaaatagtgggactgatcaaagtcgggatgagccgccgcaacaagcggtaacaacttatccggagaaccttttacaaacagacaggtgtggccatccgcgcattttgctaatttggccatgtaacgattgttggaatcaaatggcatcaagtcgcgttcggtgttagcgggttcgtccttgaaggctttgtagtaggcagtgaggaaagcaccatcagtaggttcaccgttgatgacatagcggccgtcttcttggtgcaattcagtgtcattggcttcaaatccagcggttagcaaagcggttaaatccggatggttagccggttcgatggtttttccggcaagggtgaactgccctttaggggtgtagcctgagccgcttacctgataagtggcctgaggggtgatgacggtggtaatggtcatctcgtttttggttagcgtaccggttttgtcggtacagataacatcgactgagcctaaagtttccgcagctggcaaggttttgacaatgacgtgttgtttctttgccatattggaaacacccattgccaagataacggatgtggtggctggcagaccttctggcattgagccaacgaccatggtgacgatggcaagggctaagacaggcagactgtatttaccgatgatcatgccgaagataaatagtaagaccgctgctgcgataatggcgtacgaaattcctttaccgataccgtcaatttcgcgcatcatcggcgagcggcctttacgtacgtccgaaaccgcctgggaaatcttaccgaactcagtatcgtggccggttgcaaccacgatgccaataccacttccgcctgcaaccgctgtcgaggcaaacgccatattgctttgatcggcaagtggtgtgtctgctggcaggatatcagtcgttttgatgaccgaatttgcttccccggtcaggacagcttcttgaatcgttaagttgtcaatatcaacgaggcgtaaatcggagggaacattatcgccggcctccagaaaaacaacatcgccgacaaccaaatcggcactgggaatatcaagacgctcaccgtcacgataaacagttgcttcaggggccagcatttttttgattttttcaagtgaatcgctggcgttgctttcctgatagtatccaataatcgcattgacgataatcactaaaacaataaccgaggtatcagtgacatcgccaatgacggtggttaggattgcggcaatgatcaggatataaatgattaaattgttgaactgccgcagaaagatcagccactttggcgttggatgcgattcgatggcattcgggccattggcttctaagcgtttagcggcctctgttttagagagaccgtggtcaagggacgggacctgcaacatttgctgcagatccttgatactgtgcgctgttgctggcggttgcgagtcgggaacttcttccataagtgattcctcatttcgtgatataaattttttggtactatctttatcatatggtatgcctaaaccggttgcaatcaatttgcgatttcaatttaatgcgagctaaaaaagcgtttatcttttatatcgggattatgatgacctaatgctttgaaacggttttctgaaagcaatcggctgtaagcgtgattagctattgccgtgaatcgggcactgcttaggcattttgaaacaatggacactttacaaattagtcactgaaaatacaattaattttcataaaatagttgacgatatcagcttcaaggcatatcctaagaaaggattaagttagggagacctaaaaggccttgttccccagggacttaacttttttcaagatgaaaggggagacatattgtgagtgatgatcacaagaagaaacattccatgaagctcattcaatacgcgaacgggccgtcattggaagaaattaacggtacagttgaggtgccacacgggaaaggcttttggcgaacgctatttgcttattccggaccaggagcattggttgccgttggttacatggatccagggaattggtccacgtccatcaccggtggtcaaaacttccagtacttactgatttccgttattctaatgtcaagtttgattgcgatgctgttgcagtacatggcagctaaacttggcattgtgagtcaaatggatcttgcccaagcgattcgtgcaagaacgtcgaagaagcttgggattgtcttgtggattttgactgagttagcgattatggcgactgatattgccgaagttatcggtgccgctattgcgctttatcttctgttccatattccacttgttattgcggtgctggtcacggtcctcgatgttctggtattactgttgttgaccaagattgggttccgaaaaatcgaagctattgttgttgctcttattcttgtcattttactggtcttcgtttatcaagttgctttgtcggatcctaatatgggggctttgcttaaaggcttcattccaactggcgaaacatttgcaagttcaccgtcagtcaacggtatgagtccaattcaaggggctttgggaatcatcggggcgacggttatgccacataacctgtatctgcatagtgcgatttctcaaactcgtaaaattgatcataaagatccggaagatgttgctcaagccgttaagttttcagcatgggactccaacattcagttgacttttgcctttgttgttaactgcttgctactcgttatgggggttgcggtcttcaagagcggtgcagttaaagatccttccttcttcggtttgttccaggcattgtctgattcttccacactgagtaacggtgttttgattgcggttgccaagtccggtattttatccatcctatttgcggttgcgttgttggcatcaggtcaaaactcaaccattacaggtacgttaacagggcaggttatcatggaaggcttcattcatatgaagatgccgctgtgggcgcggcgcttggttactcgtgttatctccgttatcccggttatcgtctgcgttatgttgactgctcgggaaacgccgattcagcaacatgaggcgctcaatacattaatgaacaactcacaggtcttcttggccttcgcgttgccattctcaatgttaccgctgctaatgtttacgaatagtaaggttgaaatgggcgatcggttcaagaacactggctgggttaaagtgctcggttgggtttccgttatcggtttaacttatctgaacctgaaaggtctgccagattcaatcgccggattcttcggtgataatccaacggccgcacaaaccaacattgctaatatgatcgcttacgttctgattgcagctgttttggccctcttggcatggacaatttgggatctgtataaaggtaataagcgttatgaagctcatcttgaagctgtagccgatgaagaagaggcgaaagcaaatgatgacgtacaatagtcttgtcgcgtctttggtgatgagttgcgatgggatcgaggagtcagaaggctacgatccgtggttattcgcaattcttggattggaaaatgagcaatctaaggtacgccaaaacaagtaagataattgttggccattgttgtatatgttaaaaaagccgctttgatcagctcaacatgatcaaggcgacttttttgtaagcgcgagccggcgcggttagggatcggagtgtaagtggccttgggcgtgatggccggtctttggccattgcgcttaaggtccttacacgcagacttctgcgccggggagcgcgttatgggcgtaagccagaacataagcggccttaagcgtgatggcccaggtttggccattgcgcctgaggtccttacacgcagatccctgcgccggggagcgcgttatgggcataagccagaacataagtggccttaagcgtgatggcccgcacttggccattgcgcttaaggtccttacacgcagacttctgcgccggggagtgcgttatgggcataagccagaacataagcggccttaagcgtgatggctgggctttggccattgcgcttaaggtccttacacgcagacttctgctccagcaaacgcgtgacggtcatcagcgatgaaagtggggatgagatggcacatttaagtgaggttatgactcaagctgtaccaactgaaacagcgaccggattatcgcagcatgcgactgatttgctgatcggactcatgtatgcggatcggctggattctgagagtaacaccaagaagcggaaaatatttcgtggtggtcgaccattttttgagcgctatggacaaattgcaggggtagagcatcggggtaaattgaaaaaagcacggcgggagcttgaactgaatggcgccttggattgtgcgcaaccaggggataagtcctatcaattaacgcagacgccatggcagatttttaaacagttcaacgggatgatggcctccccggttcaagtgagtcgaacctatgatgttaaatcctttagcgagctattaaagcgcagcagtcttgcccataaaaactttccattgaatacggaaggggcagttatgctgcaaactgatacttttggcagtgaacaacccttgatgtatgctgtttcgccagcaacttatcaccggttgaccaaagccgaagcaaggatgaaaacaacggtaccagacacccgtcagcgactggttaacgttcaggcttggtcaattgatccggcattgattagcggctggctgcacgctggcctacccaccccgcaagccgatccgattcaccaatatttagcggctttatcatcttcatcgcttcaatttcaaaaagaagcggcacggctggttgcggcaatgctttactgaactttgatctcaagactgcatcgacaaggtgtagcgtttggggtatcggccttagcgatcattaggtgctaaggctgtttttttatgcttttggtttgcttggcagtgcgatcgtgtaaaataggactatcattaacaagcaatcgcagcacatgtgattaagatggaggtagcgatgacgacgaatacacggattgaatcagatactttgggaccggttgaaattccggaaacggctttatggggaccgcagactgaacgcagccgtcataattttcaagccggaccgcttatgccgttgccgctcatcaaagcgctgctgcaaatcaaaaaagcggcggcgcgggcgaatgtggcagctgatattttgcctgctcccaaaggccaactgatcacgcgggctgtagacacgttattggctttgcctgatgaaaaattacaagctgattttccgctgcatgtttaccaaacaggatccggcacccaaacaaacatgaatgtgaatgaggttgtcagtcatcaggcagccaaactcaatcctgacttacccattttacctaatgacgatgttaaccatagtcaaagttcaaacgatacatttccgaccgcgatgaacattacggccgcgattgctgtcaatcacttgctggctgctgttgatggcttgatcgcggcattgcaaacgaaagccaagcaatatgaccataccgttaaaattgggcggacacatttgcaggatgccacaccgttaacttttggccaggaagtcagcggttggattgcgatgttagcgcacgatcgaacggcgattgaacaattgcaaccggcactttttcgcttggccattggcggtacggcggttggtaccggattaaacgcagcgccaaactttgggcggattgtggccgggcgtttgagtgatgtctatcacttgccactgaccgcccaaacaaataaatttgcggcattggcagcccattctgaaatcagcaatgttcacgggggtattaagacattagccgccgatctgttgaaaattgccaatgatattcggtttctggcaagtggtccacgagcaggttacggtgaattgcggattccagccaatgaaccgggaagctcgatcatgcctgggaaggtgaacccaacgcaagcagaggcacttaccatggcaactgtacgggtgatgggcaatgataccaccatcaccgttgccgcctcccaaggtaactttgagctgaatgtctataaaccagtgatcatcagtacgtttcttgaatcgacgacgttactgacacagacgattaccagcttcacgcaaaaactggtggcagatttgaccgtcaatgccccgcgcatgcaggcactcgttgcgcattccttaatgacggtgactgcccttacgccgcatatcggctatgaaaaaagtgctgccatcgctcagctagctgaacgcacgggaacggatctcaaggatgcggcaattcaaaccggttacgtgactgaggcggagtttgatgcttgggttgacccggctaaaatgactggaatttaaagccagacaccactggtcaatagcgaaagtcacgattggagcgagcgacatgaaaaatcaaaaaatgggattcttcgggtttttgatcatcatctttatcattgccatgttggtacaatattggtatatctttgtcgcagtccttgtccttggcggtgcggcttatttgtactactatcggcgccaacaagccattgcagcccaggcagccaaaacggctcaagcccaagcagcggagcaggcgactattgccaggctaaaagcatacaaagatctgttagataccggagccatcacgcaggaagattacaatcacaaaaaagccgagctgttacggctcgactcacatgaagaacttaaattttaaaacggtggccaataacttaagggtttaatgttcgtcattggttgcggtagttaacggaacgcctttagcaccgccggaaatactttcgataaaatcgaggaaagttggcgcaattcccaactcgtcaaggtcttcaggggcgatctgatagcggatcgccttttcgtcgtgggcaagaattttttgcacccaatgtggctcgcgaatcatttcatggccgatagcaaccagatcaaatgctgccgcggctttttcggcctcttcaggggtcttaatgccgccaaccacaatgatcggcaaggcgccggcgacatgatcgcgaataacgtcattgatgatggcaggattatccggatcacgcaatgatgtccgccatacgtcagactgggagacgtgcaggtagtcgattttggtggcttttaaagcatcaatgagcgctaatgtgtcgtctaaagtgatgccgggctgttctaactcttccggtgaaatacggtagcccaacaggaaggggcgatcggcagtttcggcaatgactttttccgcttcatgcaccacggctaaggggaaacgcatccgcttgtctcgtgtgccgccccattcgtcggttcgccggttagaatgcggggagtagaattgctgaatcagataggtgttagcgccgtgcagctccacgccgtcaaaaccggcttcgattgcccggcgcactgcctgaccgaaatcgtgaatggttgctttaatttcttcagttgtgagggctcgcggcgtttcataaccagaacgaggcgcggcaaccgcactggcactgacgggttgctgcccgcgcaaaatcttgctattgctcatacgaccagcactaaaaatctgcaaaaccgctttagagccgcctgttttcatcgcagttgccagacgacttaggccgggaatgaaccgatcatcggccacacttaactcgccttcaaaccccttcccaagcggattaacattggcggttccggtaatgaaaaggccaacgcctccagcgcgcttttgataatattcaatttcgtcttgcgtgaccgtaccatcttcaaaagaaagccgagtcgtcatcggcggaatgacaatgcggttcttcagggtgatgggctgatttttgaatgtaaaaggttttagaaaagtataatcagacatataaactcctttgaaaagattcaacgcgtttaacgctgctgagtgaccggacgcaacagcacttcgttaaccgctacattgtctggttgatcaatggcgtacaaaaccgcgttggcgacatcggtagcggtgagtccgttatttttctcatcggcttctactgctgcgcggcgcttcggatcactgatggtactgaacaactcagtattcacagcgcccggggaaatcatggttgttttaatgtggttggctgcctgttcctgacgcaaaccgtccataattgcctgaattgcccatttagtgccggaatagacagcagttccgggatgcacgatatgaccggccacagaatcagtcgtaatgatttggccactgtgccgttcaatcatatgcggtaaaacggcggcgataccataaaggacgcccttgatattcacatcaaccatccgttcccactcattaactttcaactcagccatttctgaaagcggcataagaccggcattattgaacaaaacgtcaacgtgtccaaatgtcttaatggctaagtcgactagggatttgacttggtcttgattcgtgacgtcggttgcttggtaacgaatctgatcgtttccaaaaggttccgccaacttggcaaggcgatcctcacgccgcgcgccaatcactaactttgcaccggcttgcgccaatacctgcgtggttgcagcgccaataccgcttgatgcgccggtaatcacgacgactttatctttaacagtcattttgaaccctcctgatagtttctgctaattaaaaataagtgttatcacctttaaattaacgcgctcaaaagcagctgacaagtcgttttattgaaattctcatattatcttgaccttaagtgggctttaggggatagaattgaggtggcattggagtgtgggcgctgggggttgtggccggcgcacactcaccataacgcgctccccggcgcagaagtctgcgtgttaggaccttagtcgcaatggccaaagcccggccatcacgcctgaggccacttacactccgacttctaagcgcgccggctcgcgctcacgctataacgcgttcgccagcgcaggggcctgcgtgtaaggaccttggtcgcaatggccaaagcccggccatcacgcccaaggccgcttacactccggcccctaagcgcgctggctcacgctcactaagaaaggagttttgctgtcatgaaacaagtgcaattaggtggttctaattggaaagcttccagtgttgcattgggaattatgcggatgaatgttttgtctccggaaaaagcggcttcggttttggatagcgcctatgacgatgggattgatttcatcgattcggcggatatttatggtaaaggtaagtcggaagaggtttttggcgaggctttgaagcaagctaaagttaaccgtgaccagttgtatattcagtctaaaatcgggattgtggtagatccaaaacgttcacacggcagcttggttttcggcaaacggtatgacttttccaaagaacacctattgtcagcggttgatagcattctgcagcgcttgcaaatcgactatctggattcggttttactgcatcgtccggatccattgatggaagttgatgatgtggcggctgcttttgatgaattgcagcaaagcggtaaggtgcggcattttggggtttctaacttcaatcctgaacaaattgcgctgttgcaagagaacctgcatcaacaacttttgattgatcaagttcagttctccgtggcccacactggcatggttgatgcgggcatgcataccaacatggccgatgaccggtctgttgatcatgatgggagcttgctgccatatctgcaacgcaaacatatgaccctgcaggcatggtcgccgttccagtacgggatgtttgaaggtaccttcattgacagtcccaagttcaaagcattaaatgacgagctgcaaaaagttgccgatcattatcacacgaataaaaatgcgatcgctgttgcgtggttactgcggcatccggtgggcgttcaggttattctcggttcaatgaatcctgaacacatcaaagaaagtgcagaaggtgccgatattaccttgacgcggcaggaatggtatgacatttacttcgcggctggcaacgatttgccgtaatggtcaagacagaggggcacttcctgtaggcgccctttttggttgcgttcctaattcaggtggcaatagatggcgcttgatttttgactcgttcaggtgcatactctggaaaaattccttgatgcaactgtacaatggtagcagggtctatcgttttaggaggcactgtcatgtcagacaagaaacaagcgttattcgaaatgttgagtaaagcctatagcagtccggccgtgaaagctgatgccaaattaaagcaaataatcgaatccaacgcgaaacaactggaagatgcagaggacaaaacagcttatgtcgcagtcgtgacccagctatcgcatgatatttccaagtattatctcattcatcacacgattccagccgagatgatcgccgttttcaatgcgatcaaggcggatgtgccagcagatcaagtcaatgccaagcgttatcgcgatcaggcgctggctgctgggctgattgctattccgattgtctggggtggcgggcattaattagccgcatgggatatgagcttgttcgatgctgatgaactgtgtcatttcggcctttttacgactatgctgaaatacgcgcttccgattagtcgtggttaatgcgccacggctttttctatgcgctttggaccgggcgattcatgtccgcaataacgttaatcggcgaaaaggctacgtttatcgaaagtttgacctgaagcttgataaatttggtatattgcagttagcaattcaagaaaacgctatcttaatgcaaacacttatcgaccagacatggaggatcactcatgaatatggtgcaacgaaatcagattctgtttattttgaccggattaaacctgagtctgaaacaagcggctagtggtggcctgatggagacagaagcacaggaagttgtagatgaggccttagatattttaaagcggcctaatgtgctcaagaatcgagccgcagattacgccttgtcgcgactatacgcacggtttacgcgattaatcggcttgcaaggaatgaaactttcagcggaggccaatcagtggtggcaggcggtaaaagactttatggaaaatgacattcatggcgaattgagtcaggtaggcgggccgcactttattatttagacagttgttgcccaagccatggtctgattccagtaaccggcccgaaaagaattcgcttgtagccgcgtgtttccatagaattaaggaacacgtggtttttttgcttaaaaaagatttgccatattagtataaacggaatatactaagtgaaccatagaaaggggcatctcatatgagcaaagaagaagacaaggaattaatcaatgatggcctggctgacgacaccgtcattgaggaaacagatgcggcaatcacccaatcgcagcgcatgtcagcgactcaaatcattattttagggctggcactgattggggcttttctaggtgtgcttgacacatcgattgtttacacgggtaccgttaaaatggcggcacaattgcatttgaatgctggcgcgttgtcttgggtgcaggtggcctatgcgctaacttatgctgggctgatgctagtaggcggtaaattaggcgatatttacggacgcaaaccattattcattgcgagtttagctattttcggagttggcagtctggcagtcggggcagctaccaatgcgcttgtcatgattagctttcgcgctgttcaaggcgtgggcgcggccattcttgcaccgaactgtttggctttgttaacagacacctttcaaggaaaagcacgacagcgggcaatcggctactatgcttccgtcattggagccggtgcagcggttggtttagtcattggcggcttctttgcaacgtttgcgtcatggcgggtcggtttctacatgaatggtccgatcgcattaatcatggttggtattgcggcaagatatttacctagtgcaaaacgccaaaccggaaagattgactggattggtacgatcttgtcagtattagcgatgacttcaatctcatatgggttagatggcagtccatggccaatccccacgttgctgatttcagcagttctttgggttgcattcattgctagtcaaggtcgcgttgcccacccgacaatgccactggaaatctttacggatagggaacggatggcttcttatgtcagttctctgttgtttagtgccgctgcaatcggcttttggttctacacacctcagtttatgcaaggcgtcttaggattaacgccatttatgactgcattaggcatggtgccaatggccatcttactcttcattgtggcagtcaaggcccggaccttcgttgatcggtggcgtaattcaaaggtcatgatcttcggatttgtcacggtgctactttcattggctgaactggcagtggcatcacggtttgccaattactggtttttgttacttgggacactcggatttgcggtaggattcgcgctggcatttgccacactcgctacttcaggtttggctagaattcggccggaaatttcgggagctgcatcaggcgtctacaacaccgcccgacaatttggcggcgctttaggactggcaatctttgcggcgtcaactagcagcttaactaagattgcggatgtattcggacaggcaatgttgattggcgtcggcatgaccattgttggcctgatacttgtcgtcacgctcattattccggcagaaaaagccgccaagtaacggtatcattggtataatagaatatacacaatcgtttaatgggaggtatattcgatggctttttcagtcgcattttcgcaagcacttgaaatcacggcctacgtcaacgcaaagtcccaagcacaacatgaagactatttatcgattcaaaagatttccgaaatgctaaacattccggttcctagcattaaaaaaatttcgtccacacttaaaaaaagtggtattttaacgtcgaaaaccggtctcaatggcggtttgcgattagccaaaacgccacaaacgattacagtttatgagatcttaacggcaattgaagggacggcgccgttatttaagcttcatcaggaaatcgatccggccgcgtttgtcaacggcgagcgcgtcacgagttggttaacagcaagcaccaacgttctaaaccgagccgaagatgctatggtgcaagtgctaaagcagacgagcattgctgatttggctgaagccgcagaagcgtaaaaatcgaaatctaacttttcatcgcctcattcaagactaacgttggcgcgttggtattggatgaggcgattttgcttacggcattttcaggatcgtgcaactgtggggcagtcagtaaatagtcagcaagtgcgcctccattggcaaaccttttcggaaatggggacgattaacgcgttgtcaagtttcaaaatacaacgattatcggcgaaaacccgacgtttaaaagttaatgatccgtaacatgcgcagcctcggtatattgtgggtagcgatatcgaagctgcgttgcattgaaacgtgcgagtgaaggtggataaatggaaagaaaacgtcatttgctattgtcgccaggattttgcgttttatatatcttgcttttggttgtgctaatcagccagctgcttttaattccagcagtttacacgctgaaattggacttctgggctgggaatatcttatttaaagccatcattttactggtgatgatcgcacttaattggctgttactgaaacaagttatcgtcttaaaagtgacacttagtcgaccacgattgaagccagttatcatttggggactgctctttatacttatcgcttggttcacggttacaaatcgaacaccgattgacgtcttgcaagcagctgtgattggtactattgccgctgttcccgaagagtatttgtttcgtggcgtcatgcttggcgggttgattcgggcgttttatgttgcccatcatcgccatgccaaataccaactcttattttgcatagggttaagcagtcttgttttttcattggctcacctgagtaatttgcctgctcaagggcttgtgataacaattgcccaagtgatccaggcatttggcatgggggctatttttgcagcactttatattcgttacggatcgttgcttatgccaatattgatccactttttgattgattttgttatcactttggttagtggaccgtatccgaaagaagcgcctagtgatcccaacgctataacgatgacgattgttcacgcattccttattgccgggatttacctggcgattgcactgcgactttttcgccgtggccaaaacaatgaaaagtttctggcacgattgtcgcattcgtaaactggctgtatgtatcaattatgatagaacgagtttaaggagaaaaacgatgtctacgcgactgactaaactagtcgattatgggttgataatcgctaccattatttttgccatttatacggtcacatcggcaattgggtggaccaatcatgggagttttgtgacgccaatgttgattttgatgacgttgttaatgctgttaagcgagcgggaggaaaagcagaagagcgcgtgaatcaaaaaagattttggcgctgcttattaacatttattgtcggttatatgtgtgcagtttgtcatcatttccccggcgaatggatgcacatgctggccgcgagcctaatcgcctttctaagttggcttaagactggatgctcacagtggcgaaaaagacatgggtaaaagtaaatacagttgcagttgcttgagttttgaagagaaggcggcaatatcaaataatcgccgggtttttaacgataaacgtcaaaattaggttttttacgacgattttcttgcaaaaatcgacgttaaaaaattcattcccacaaacctggctgtctactttatattgatggggaagaagggaagtccttctaacaaagggaaaggaggaaaatgggatgaccatgcgaacaggactagctttgaaggaaatctcgggaaaaatgcttgaattgacgagcggtgggaatgttcctttatccaattgcagtgtggatccaccaaacgaacgccatccgccagcttacgaatcggcatttaagtataaactgccgattgttcatccaattaaggtggcgacttaagtgataatttaggctgatagatagattgaaaggctcataaaggaaaaaggaggaagaacatggatcatttaaaaactttaaacacggctgatttggcaagtatttctggtggcgataatggtaatctgtggacctttatcgggaaggccattggttcaaccgcgcgttcttgggctgaaggcgccatgtttgcgccagccattggtcctgccaaagagattgttgacaaacttaacggcaattagtatccgggatgaataggcactcgaacgggcaaacgtatgaataagataaatcttttaatgttagctacgtttatcttggtatatctattaggtgttttggtatatacgtgctgtaaaaaagatggtcactatcgcgtttggaatgataaatatctcgacagtgagcatcagatagcctttaaacgtgcttatattttgaatgccatctggtttattacctacgcttaaactttgagtgttccgttcaatgcctaagctgtacgctgtaatgctgccgtacaaaccaagtagcagaatttcgatggtgaaggtcaagtgactttaatccaggcatgccgctgatgactccatggttgtatttgcaaaaagttgtgcggtagatgagcattttatcgccacaatatccataacaaagacttttggatcaactggcgagtagtttcttacaaatacaaggaggtaattttaatgactaagttgaatgaagctgaattgagtaagatttccggcggtatcggaccgctcgcaatccctgtcgctgctattcttggattcctggcaacagatgcgtggagccatgctgatgagctggtggcgggagtcaagcaaggatgggaacgatcgtaataacggtgcgttaattcttaagcgttgtcgccgttgtaaaagtatctctgcccagaacaagccttttatctgtgggcgagcatgttctttctgtcattgctacggcagatctggcaatgcacggcgccaaacgtgttacaagtgaaggtgcactagcgcaacttttttggagtgaaagatgaagaaattgaaatggttttctggtgggaatgaacgggctgaacaagcgatacagcttatcgatgaactgcttcgcgacttcgatgacagttcttcccatagtgatcgcttacggacagtgctaaggaacaatagagaggccttaatttacaagcaagcagcggttccatttattttaagccgcatgaatctagaaatctctaatgccctgttgcaaaacaatatcttgttaaccaagcaacaatctgacaaattcgagcagctttcttcgctggcgaatatcagatatgggtactagaggccactcctaaaacggtgagtgcgcttgattatggttaggctcactgattcatttggtgcagatcaaactccgattgcgatgctggttggtatgggcctgttgtcaatggatgatgcctaaaaggttgtccattttataacggcgacgtaggcaaactagtttcgaatataacggtctaacttaaaaagacagagccaaaactgatcggtcgataaatgatttagtgatgagcaaagcgaaggtacgatgacgattcttaaaactatgcgcacatagcttaatgaagcttctttctggattatcgtttgtatctgtttcggcgggttttcgctcagtgatgtcttaaacaagctgattgtcgattgcttgggttttgattttttcatcgtccgggcgttcatagagatgctttcaatcttcattgttttgattcttttctctaaattaagtgtcacatcttcaaaggttaaagaccgtaaacgctctaaataacaaattttctttgtttgatttcaaagtattggtaaggtggcagtgttattgtcagtgggaagcctgtcatctcaaggagacagcaactattgtgacacagccatctgccaggctataataatgcaatatcggctgttcatgacggcaaatgagattttaggtgacactactgatatttgggaactgtttttagtgtcagaatcttgttacactatgttcgatcagccaaaaaacgcaaaagtctcctgatttgtattgaaacaaaaatacaaatcaggagatcttgcgcgtgagtatggcagaactgatgctaaataagatgagctttcaaaacccacgattgttttttcttcctgacagtaaaaggcctttcggaaacaatattaaataggtaaaatggcttcatttttgtgacttcttacttgtatgatgaccttagcagaacgtatagtatctccgaacctgtgctcgctaatttgccgcttcaatgtaaatttaaaggaagactcaaggagctttgcttatgacagttgtgatatattctatacttttgattctggcatttttcttcacattcgtatttgtaactgcgatcggctggcagatgatagacctcttaagacatcggcttcatccgcgaacatctttttgggagaaatattcccaattgacgcagttggccattagtatattgcctttttcttagaaggcgggagaacataaagaacaggttactaatggattactgaaagaagtaaaaataagtctgctcgtaaacgaggtgagcgtaatcgatcaatttgcaagattatcattccaacagaaagtgtcgttgcttgttgccattggggttttaataatggcgttttggtacttttcaccgggaattttaaaggggatttatgacgctggttatcaaacgggtcagtcgatagcacgttggttgaagtagagctgatgaagggtagcactgtgaatctttattacgcaacatggcttatctttttggcaactttgtttgttttcaaagatcgcaaatttgttaaaagaatgatttccgcgattttagatgatggaagtttagtatttggtatcagaactgtcatatggttggctcttttagggcttttctttgtcacaaatcacactgattggccttcagcagtccttatactgctcatcgttagtgcagtaattttaattgattggcataaaacctttcaggaggaatagtatttccaacctgtataaaccaaccaaataacgcatccttgatattgaggatgcgttatttgtgcgttcagctgtgttgattaacagaaatctaggatgattgcccagtcacactcttcttaagataaagctcgtgtgcctgttaagatgttgcgcaactcgcccattctccgaatactgacctcaagtttatcttgattgtccatataaacgaatcggtttgtgatgtccagacgcataacatgtgcgggattaatcaggatactcttatggcatcgacacaagttggtatatttggttgccagttccttaaggttgccaggaaaggttgtaatttcattttctgcatgaagctccagtgtccctgagacgccgggagcagtttgaatatagatgagctcatccatttcaagtgaaaaaatgctggagttgatgctgtagctaaacaatctgggagatgcgacctgacgcgcctttaaacgttttattgcataaagaatgttatttcgaattttcttttctgtcttcgaaggtgagttcttgttgatcatgtccaacggtgcgattttgtgctctaaaatccttaaagcttcatctacatggctggtgatgaagaggatatcgacataatatgactttctccgaatggctgtggctacatctacgccgcttgtcgctgaatctcccagctcgatatcaaggaggaagatactatcattgatggctgaccaatcgacagctgcaagcagttcagttgctgacgttgttgccagccggatcttggcgggtagttcttcaatcagaaggtactgctgcacagtttcttggataaaggttagatagtcagggttgtcttcgagaatataaatgtttaggattgttttgtttttaggcatgggcttttcctcctataaatagcgtgatctttaattgatcattgttgataattgctttacgcatgctgatattgggattttgttggattaggtcattgataatggacatgccttgcccgtggcctgagccctttgttgtaaatcctttttggttaagtcgagttaaatcaaagccgtcaggaatcgggtttgcaacaacaatttctaagtgatcgcgggcgggtaataagagaactctgaaagacttaagtttaagtgtggcagtttcgtcaatagcattatcaattaaaatgcccaagattctgataattgcaaatccgacatcactttccagggatcggactgtatctttggtatgcatgtacattgttatgccacggtttgcagattcggaccatttgagatacagcaaactcctgagcggatcactttcgatcaaagctaaggcatctttgcctatctcagctttttgaagtgcatcctgtgcttgagtgacaatcgttcgaacgtctgatgagtggtgtggtgatgatttctgcaagctaagctgtaacgttgcaagtaagtttttgtaatcatgaagaatcctactggtattgatacgttgctgctcaagggctgaatagtacgcgcgttttgaagcttccgcgtgcttgataactaacaactccaaagaatactgatatgattttacgatgaagaataacgagaatacattgataaccataaaaagaattaaggttaacaaaataagaagtgttaggatatcggtgatttcaagaaatgaaaaagcaaactctaaacagtaaagcgaaacgcaggtcactattaaataaataactgccggtctccaaatagctatttttttttggatttgttcacggatagaattaatgaatagcttctttttcattaacacctgagacatgacaattgcaaatatgacatcaatgatcagcttgatgctatttgagatagtggatgattggacagatagaaacagaaatacgattttagtgactagtaattgaaggttaataacaattaagttaagttctagaaataagaaaacccagaagatatcaaaacgctgatatttttttgaaatatttgttgcatataaaataccaaatgttatttcaccaactgatgaaagaaatgtggagagcgttcctgcggcgagtgaccataagaaaatatgcctgagtttgaagtcgttaaagtaaatatacgaaaggaaagtaagatcaatcaaaaagatcggtaagtgaaacaagaagtaatacaagtctgtagaaataatcatgctataatctttacctttctgtttgtaggcggttaacttcctaaaaattgccaaggtgctcgaaaatctgcgttaaatggcgaaaaagctacgtttattttttgcctaaccaaaatttttaaagatctggtacgatcactttgaacgaaagacaaaacgaagggagaaaaaggtaatgaaaaaatttaaagatgaggaaatgccaatgatgacagatcttgaactttcaagttttgttggcggaatgctccgagatgaaggttttacgtttaacaagtttaagaactggctaacgagtatctttggctagttttcttacgtgtgggagaagaacactcgtaaaagaggttacaaataatctcgtattgcgagctacacaatataaaaattattaaatttgcatatatttataatttttatattaatataactgctatggccctcgataaaatgcatgatagcacaatttacctagtcaatatagtgcttttacttattttttgttctggagaggctgatgtcaattggcaattcaatttttaaagtggagataattacatgtttaaacacacccccaaactaggccagatcacctactacaaacgcttctacaccgcacaagttgacgagcgtgactgtggtgtggctgcgttaaacatgctgcttaaatacaatgggtcggactattcgttagcccacctgcgcgagttagcgaagacaaatcaggatggcacgacggctttgggaatcgttcgggccgctgaagcactagcgtttgagacaaaaccggtacaggcggatatgcagttgtttgatcttgaggatgtgccttatccgtttattgcccatgtgctgaagcgcggtgaattgcttcattactatgttgtttttaaagcaacgcgcacgagtattctgattggcgatcctgacccgtcagtgcgcatgacctggctttcgcgagaggtgtttgaaaaagaatggtcgggtgtggccatctttattgcaccggcgccgcagtatcagccgcgtaaggaggacaaaggcagtttgtttgcgtttgtacccatgctggctaagcaaaaaggtattatcgcgaacattattctggccgcggtattgattacggtcattagtatcgttgggtcgtattttttgcagtctattattgatacgtatatagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttcgaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactaattaagacattactaattttaccattcatgaactcatgatgccattgccaaccaaacagatctcgcaaaagtattgcacaaaacagaacgagtgtcataactacaaaaaaataacttagccattttaagaactccatgaccaagttacttttgtttatcatacgtgactttaagatttacttcttatttgccggcttccccacatgcttgcctgattgcaacttagcagccagatcaaggatgtatgcgcggagttcatcttttacttccggatgggtcaagccatattcaacattagtcttgacgtacccgaacttattgccgacatcgtagcgatcccctttaaactcatgtgcaaagacgcgctgagtttggttcaaggtatcaatcgcatcggttaactgaatttcattgcctttgcccggtttttgattatcaagaatatcaaagatttccggggtcagcaggtagcggccgatgatagccaagtcacttggggcatcagcaacagcgggcttttcaacgaatttcttaacgttatagaggtctttggaaacttctttttccggatcaataacgccatatgccgatacttcatcatgcggcacctttttaacggcaagaatggacgcatgggttttatcatattcatcaattaattgcttggtcaacggcactttgtcattcatcaggtcatcacccaacatgaccacgaatggttcgtcgccaacaaacgatttggctaagcgaacggcatcaccaagaccacgcggatatggctgccgcacgaagaataagttgacgccgatgtcggttgtggaatgaaccagctgtagcaaggcgtctttatgtttttctttcagattctgttccaactcaggtgctgagtcaaaatgatcttcaatagagcgtttttgtttaccctcaacaatcagaatatcctcaatcccactagccttagcttcttcaacgataaattgaatggttggtttgtcgacaatcggcaacatttccttagctaaagctttggttgctggcagaaaacgggtcccaagcccggctgccggtatcactgctttgcgaactttcacactcatacaagtcccttctctactaatttaactacctactctactatactagaaaccgcttgcgaagagtacgccttttctgataattcccagaaaaattcataagttattcgtataaaaataaaaaaatcccagctactgggtatttgcttcgccattggatcctatccatccggaatctgcttaccaaatcatagctgagatgtcgttaatcgttgatttcgtgtactttgaatttcaatggctcaatgtggtgcttacgccaagctgccagcaacggctgaatcgcctgatgggaatcaattaaaacaatcccacagtcgccgccgcctgctccggaagacttggcagccccgcctgcttgctctgctaacgttaccagttgtcgcaatgctggcgtctgaatcgccacccccgagaagtgtgccaattcatccaacaattcgcgattgcgccgaatgccagcctgaatgtggctaagcgaatgctcccggaacccattgatcaatttctccagcgtctcacgactagcagttaagaagtcatggtaaagctgtggttttttggctttagctaacgtaattttatcgactaattgggaggttgaagccggcgatcccgtccagccaatcagaagttgcatatcagccggtgccgttaagagttcaatcgacaactccggccattcagcattgatcagtgccgacagcgacatttggtttctagctgccgccaaccatgctttgtcaaacgaacgataagcaatccaaccgccataaactgacgcagcaatgtcacctaaagagccattaccctgaacatcaagatgggcaatggccgccagtttatagatttgatccttggacatcttcaagtcatagaacttggcaagtgctttgatcgttgccacggtgactgcggctgagctacccaacccatactttttcccgtctttagcatccagttgtgaatcaatatacaacttatacagcgccaacggtttgttaagttcacgcgcatattgttccgttaatttaattgccgagagaatgtagtggaacggattatctcggttatcaaagaccatttcatcgccttgacgttgccaatacaacgaattttcctgatactgttcagacacgatactgccgaaatgtttcgttgcttcaacggttacagtgacgaattgatctaacgccacgatgatcgcagggaaaccagtttcgaccaccgcgtattcaccggcaacataaagtttacctggcgcctgcgctgttatcacacaatcagaacccttcaaattttcattaatcaaggaccccagaaggaatccgactgtaagtatagctgactgtacataacaaaattgtaagtcagcaaaaaccttactctttctaaagaaataccttaattattttagcagacattcgatattctgcaatggttacaaatttataagttaagggttgtcatattcactaactcaccgatttatatcagtgtaggacgcaaaaacttcctacactgatcgggattttggaccaaaatatccagtaataactgtctggaatgcaggccacattcggacaacacaaattctaactgaggaggaaacatcatgagtcgcaatgttaacaagcaaaccatcgtgtacaccctaactgatccggaaaacgaggcatttaagcaggtacgccggatgaacaatgtcgctgccgatgcgaaggacgagcaactggtcgcgatcgggcaagcctttgccaagctttatccaaacgctgctttgacgagcattgtcttgcagcaaaacgcagaagtcacagcctaaacggagggataatcaatgaaaacactgatttttaatttcaaatccgaagctggtaaatccacaagtattcggatcagcaagtacgaaggtgatatcacggctgagcaggcgcagaccttcgccgatgcggttgcaaaagcccaagcgttcaagaaagaaggcatcggcctgtatgcaactccggttggcgccaaggtgactgaaactcaaagcaccgaaatcttcaccacggagaaaaagccagcttaactgcctgcaccaacaccccaccccaacatgccgcggcatgttcgatctcgatacgaagccatttgccaaaaagttggcaaatggcttttttactgagcgcgagccggcgcgggtaggggccggagtgtaagtggccttgggcgtgatggccgggttttggccattgcgaccaaggtccttacacgcagatccctgcgccggggagcgcgttatggtgagcgtgagccggcgcgcttagaagtcggagtgtaagtggcctcagacgtgatggccgcactttggccattgcggctgaggtccttacacgcagacttctgcgccggggagcgcgttatgaaagtacaactcaactcacccttgaatccctccctacacgctaagactcctttttaacattctcatcttcgctatttgccaacttgttcaggtcatcaaatgttggcaatcccagcagatgcgaccaagcacgcagtttatccagtaaactggctttatcggacttatctgtggccaaatcatccgcatccccagccgagataatcccctgaaactcgcgagcatattgcgccaaaaccatccctaactgttggacatacccccagttagctacaagctgccgcggcgacattttcgataaaacgaacaggcttaaggcagcataccggcgaactgccagtgaagttaactccggcttttcccgagccaacgttaagaaaacggcacccaattgatgaatggcttccaaatcacgcttctgaaacttggcgtggacgctactggtcgcattgaagcgatagtagtaaagtggttcatcaataaagttgatctggtctattcgtggcaacagctgcccaatgaagtaggcgtcctcaagcagattgaagttcgccactggtaccggctggctaaataactcagcgcgaaacattttattccacaaatatccgcgcaggtcgcgatcctcaagccaataacggtacttgtcatcaccggcaatcttaaatgccttctcgtgaaaagaacgggctttcagcttggtgccgccgatatagttatagtaattgaccacagacatatcgacgcgtggagcccgcatcccttctgccatggttgctagccactggggatgaaccagatcatcactatccataaaggtaatcagtgatcccttggcgtgttgaatgccaatttgtcgagcccgtgcctgtccgccgttttccacgtgaataacacgtatccgtggattctgacgtgcataagtcgccaaaataaccttgctagtgtccattgacccgtcatccacacaaagcacctcaaaattgggatagtcctgagcgagcaaactatccagtgcctgagtcaaatacttttcggcattataaaccggcatgatgaccgaaaccactgcttcatgacctgccatatcgtccctcttttccttcgtgttttagtataacgtaattgctccattgttaaacgaaaccggttaacattttaaaaaaacaataaaataaaagcaggaaacaatgactgcttgcttcctgcttgacgatttgatgcttctggcacctcataacacataaaaatagtaatggtggtccccgttattccggaagcgtcttcagatcgtcttcggttaactgatatttagcatcaatcggatcaccttgcgaggtcagaatcttaggaccattgtcggtaatcactagagtatgctcatactgtgcgcacttacttccatcggcggttacatagtattcccatgtatcgccgggaacttgtttacccttaatcttccaagtaccttccgtaatcatcggctcaatggtgatcgtcatgccggcttttaagcgtaaaccgtgaccgggaacgccataatgcggaacatttgggctttcatgcatcgttggttgaatgccatgcccaaccaattcacgcacgtcgccatagccgttatcatcttcggtataagtctgaatcgcggcaccaatatcaccaatacgattgccaacaactgcttcatcaatacccaagtaaagcgacttcttggttacatccatcagcttctgatcagcttcagagaccttcccgacaccatatgtccagcaagagtcactaaaataaccattccaactgataacggtgtccacactgacgacatcaccgtcttttaacttcaagcccttacgcggtaccgcatgcgcaacctcatcattgatactgacacaagtaacatacttataaccttcaaaaccgacctgctcagccttggcaccatgggattcaaaaaattccttagcaaacttttcaatttcccaactcgagatacccggcttaataatatcgcgcaagccaacatgcatcgccgccagaatcgctcccgacttagccataccttttatttcacgtgctgatttgatggtgatcaaacttccagcctccaatacgaatttaactcgcaattagtgtagcattaattagaagagagcgcgacccggcgcattttctaaacaaccaaatgctgttagtatgcgagttgatcccatcggcaaatcagttaatgccattgactatttaccagtttctaagatatactttatctgtcgagggaaaggccatcaggatgctccccgatgacctcaacgtgatatcagatgacgttttgggtaaagctagccgtttcggttagcttttttgaatggatgcaaacccgtcaatatcttgacgcctcaccagcccctaaggtatactttagaagtcgaaaagaggccatcaggatgtagccccgatgacctcaacgtgatatcagatgacgtttttgggtaaagctagccgtttcggttagcttttttgattatcgcgtatgccttagcaccgctagtaagcaatatgcttatagcgacgataatcgttgccacgtccaacgcggcgatcccctttcgtctcctgattttggcatggctgtcacctccgttttatcaaaatgtcgagaggtgtgtgccatccaaatcactgggctcaaagaaaaagatgatgaatcccttttcaaagccgtaatgacagtctacagataatgagaattgacgtcaacaaaatacttccacgtaaatcaggagacgaagggggggacggtccaaagcctaccccaccacacatagccaacttcagtgaatctccccaagcggctttcccgtatgctataatcaggcgaatgaacaagaatgacagcctcgccgacttgtaagctcccgagtgctgtgttttaggaggaatacaagaaaaatggcaagcgcacggattgtatatgccagtttgaccggtaataatgaagatattgccggtatcattgaagaagcttttgaagacctgaatgtggacgtgacgaccactgaagtttcccaagcactcgcgagtgattttgaagatgtcgatatttgtgtcacggcaacttacacgtactcagatgtcggcgatggcgaactgccggacgaagcggttgatttctatgaagaattgcaagagctggatctaactggaaaagtctatggttgttgcggtagcggtgaccgcttctatgatgactttgccacttcggttgatgattttgacaaggcctttgccaaaaccggcgccaccaaaggagcagagaatgttaagattgatctttctcctgaagaagatgacatcaagcatcttgaagcttttacaaaacagttggttgataagttcaacgccatgcaatagtaagtaggcaaaaggctcgcgctgatttcagtgcgagccttttcgtatgccttagatcatcttatattggcggtcacggagtttctttttccgaatgtgctgacttcactcggcgtttcaaaaagtcgtgcactttacccttgctgctgtgcaaccggccgatgaagtattctgcggttaacgcgttaatcacagcgccccaaagcaagacgagcgcggagaaattcaaccacagcatgatcgcaataaacgtaccgatcgtgccataagaaagataacgcgtgccaaaataatgcatatataacgaaaatgcctgagcaattaagagccagccaataacggtgaaggcagttccgggtaacaccgtccacattttgattttgacattcggtaaaaaataatccaaaaacataataataatgaacaatgcggtaaccgtgatgggccagcgtaacgtattaaaggttcgcagccagctggtatccagtcgtagcaacggtatcagccattccaaaaattggcggccaaatgcaaaggcaattaaaatggcgcccatcacaataattaaggtaaaagtcatgagcattgataataatcgctgaataatgaagttttgcgttgcctccacaccgtagacttgattaaagcccatttttaagccggttacacctagactggctgcccacagcgttgcaattgccccgattcccagcaatcccccgctgcttgaatccagtaaatttgcgatgatgggatcgagccattccatgacatttgccggcactgcctgcgttaagtacgtggccaaactgctatacttcagtccaaggtacggcaaagcattggcaacaaataagattaacggaaaaagcgacagcaacgtatagtaagccaatgtagcagcactttgcccaatgttggagtcggaaatccgattaatggcaagcttgatgaaaacccagaacttggtgcgctttggtagcttcatgtctgctaaagccgtacgtcctgagcgaatgtcagctgcttgctttgccgacaataatgaccgtttcaacgggtgcttcttccgtcccatactttacctccctcccagccttgctcgttaatcgcagacgatcatcctctttaattctgccagaagcaatccgcagaaaacaagctaaacttatttttatgaataaattttgcaaatgaatccggtaaataaatacaccggctaatcaagcacttttaggctaaaacacgttgcttgactgcgcgcataaacgcagaataatcggctttcacctgattcagataccacttgctccaagtttgcaccgcactatcgaaatgtttatccagataaccggtcacgactgctgcttgcggggtttgcgcatgcgccatggccaaaagataagccgtaatttgcgtatagtacttgaactcgggaaaactaagctcatcaagatcaacggagcccttcatgtcgcgaaattggcggacatagtagctcttgttgtccacattaaaccaccccagaaacggatcggacgctttttggaggatcatttgagccgcaataattcgctgcccctgactgacttcttgttgcaaggtcatgcgttccatattgggcaataattcccggcgtggcggtaacgcctctttaacttgtagcaccaaatgactaccgcctaaaccactcagcaggatcaaataacaattcgtcccgaaactgccaatcccgacactgtgatgaataatgtcggtaatgcgatattggctcagtaaaaccaaaatgtccggacgcgtggttttgcgatactgggtaaagccatcataaattgcctgataagttgtttgatcaatgtgaaccgaactcggcggatcatctttaaatcgcatgtgccccgcttcattagtctcggtgtactttttaatgaccgaatcgttgttgcgtttggtcgcctttttaatgaatttggccaacaacggtgaatcttcggctccggggatgacctgcactaaacgttctacttcagtcgattgatagaaccgatccagcgcgcccagcttgaatagatcccgtaatgttttccgataaatactggcatcgttttggactaaatcgtcgagatcatcactgtcaaacccttgctgatcgccaagcaaataaacgctggtcagcaggcgcttgatgtcgaattcaaaactattgatctgagcttcatcaaagtcattgaggtcaaacagcaaattgcgttccggcgaggcataaaagccaaaattctgcagatgggcatccccgtcaattaatagattaatacctgatttttcgccttgccgcaaatcataagccattaattcggccgtgccgcggaaaaaagccgcctgagatgcacccattcgctgatggcgcatcggcagcaacgatttgataagattctgctcaacactgttaataaactggactggatcacggtcaatcttgctgaccgcccctagattttcaatcggaaccgcttgccgaatctttttaccggtttccttgaggtcgtcaattgtgtacttagtggcgactcgttcgcgtaataagtcttttagatctgatgaacttcccataataacctctttcgaacgccttctaacgcagatccttccatcgaggagcgcgttatgttgcatgtcagctatttgtaccagcatggcacttacttattaaatcaaaagtagcgcattggccgccagttttccagttttatgtgcatttggcgatcaggggctgaggtgaggtggctgtgggtaaaggggttggaggcggtggttaatatgatatatttgaggaaaatcgcagcagggacagaggtattctcttttgggcaatttgggagttttattttgctttctataacgcgttcgccagcccagaaacctgcgtgtaaggaccttagccgcaatggccaaagaccggccatcacggctaaggccgcttacgttctggtttacgcccataacgcgttcgcagtcgcagcaatctacgtgtaaggacctcgaacgcgatggccaggcccgggccatcacgcccgaggccgcttacgttctggtttacgcccataacgcgctcaccggcgcagggatctgcgtgtaaggaccttggtcgcaatggccaagcccgggccatcacgcccaaggccacttacactccgatccctaaccgcgccggttcacgctcaacaaaaaaaccgctccccccgcggaacggttagccccaattaaacttttaatagccttgggcgacttttgctttttcgaaccaagaaatgcgcgggtcatctgagaagcggccgttaacgatgaaatcttgtgtgaccgccgttaagatatcaaccatttgatcgcgtgtaatgtcgatgaaccctggcgccatgagattggcaatcccggttgctacgatccataccccgcaaatcgtattgcgtaattgtgcctcacttaaattcttagccggttcatacgcatcaaacacgcgcatagccgtactcatagcgtattcacgcatttcatcaacgccaaagtgatcttcaacaaatactgctcggtaaagcggccgattttcaagagcaaaatagatatacgccaaacctaaatcaaccactggatcattggtgtagtgttttgccatctttaaagccagcagttctttaatacgatccatcacggcctgtttcaattccgccatattcttgaattccaaataaatcggctgcgttgaacagttcatcttcttagcgatattacgcgccgtgaaacttttaaagccctgttccacaacgagatcatatgctgcatttaaaatctgatcatgtgtgatcgttttttttcgtgccatattgttccccttactttctttaagttatttaaaactaacttgcacacaacttaattctgacaaataaagttaaatctccactccaaaagaccaacttcatgtcttggtgttattttaccagacatgaagtcagaaggaaacagaatttactaataaatttcagtttttcttaatttattttgaagatttctgccacggcacagcagcattttgcactgagaattcgccgccctatggtaaactattgccaatcactttgaggaggagcgtttttatgacattatctaactttaaagaaagccttaaaaaatatgccgaattggcagtcgatattggggtggccgttaaacccggcgataccgtttacgtgcaaatttcagtggatcaagcacagctggcacgcttgatcgttgcggctgcttaccaacgcggtgccgcggaagttcaggttcagtggttcgatgatgtactcaagcgtttagatatggcgcacatggcagacgagcgccttttcaacatcccggcgtttgtcaaaggtcaattcgattattgggttgatcaccaagccaagcggattaccgtggtttcatcagatccggataacttggcaggaattgattccaaccgcattgccaagtatcaagaagcgttcgcaaaagcctacaaacgactcatggaagcaatcagttccatgagcattagctggacgattatcggtgctgcaagtccgcgctgggctcaaaaagtttttcctgatgccgccacccctgaagaagcaactgagctactctgggaggcaattttcaaaactacccgaatcgatcaacccgatccggaagctgcctggaaagcccacgatcaaaagctgcgggaaaaagcggcttggttaaacaacgaacaatttgatcagcttcattacatggctccgggaacggatttggtagtcggtttaccaaagaaccacatttgggaaggcgccggcgcttttaacccgcgtggtgaggaatttatggctaacatgccaaccgaggaagtcttcactgcccctgattttcggcgcatcgacgggaccgttgcttccaccaaaccgcttagttatggcggcaacatcctcgaagatatgcactttactttcaaagacgggcaagtcgtggaagcccacgccaaacaaggtgatgacgtcttacaaaacctgctgaaaacgccgggtgctcgttcattaggcgaagtgtcgttggttccggatccttcccccatctcacaatcaggacttattttcttcaatacgctgtttgacgaaaatgcttccgatcatatggcactcggtcaagcctatccgttctcagtcaaagacggggttgccatgaccaacgaacaacgcgcggcggtgggattaaaccaaagtccgacccacgttgacttcatgatgggctcagccgcgatgaacattgacggcatcaaaccagacggaaccatcatcccaattttccgcaacggcgactgggcctaacttctcatcgctaccgttattttagtaaaaaaccgagccgcgacttttttgcactcattctgcaaaaatcaacggctcggtttttctatgcgttattatttgtgtgagcgtgagccagcccggttagaaaccggagtgtaagtggcctcagacgtgatggccgggctttggccattgcggcaaaggtccttacacgcccctgcgccggggaacgcgttatcgcaagcgtgagccctaatcacgctttctccgtttgaatcgcctgcaacacatccaagaaaatctgcccatacttatcaagtttcgcctggccaactcctttaaccgccagcaactcatccaacgttttcggcatcgcattgccaatcgcttttaacgtcttatcggaaaaaatcatatacggcggtaaatgctgctgctccgccagttgccggcgagtactgcgcagttcttggaagactgtgtcatcaacttcaagcgtctgagtaactttttgcgcggtcttttggaaaacagttgtctgtccgcgtaacacttcagcaccttttgcggttaagccaagcgttggatactgaccaccacgcgtttccagaaagccaccggccgtcaggaaatcaatgaaggtcgtaatatcccgctgccggcgatttttcatcagcccatatgttgacaactgatcgagatgaaacgacaagacgcgttgattgtgcgcaccagccaagacctgggcaacaacgcctttcccgaatcgctcgtgcaatcgaacaacacatgacagaaccttttgcgcgtcaatggtcacatcaacggattcacgatcatctaggcagttcgaacaacgtccacacggggcagtgccagtctgaccaaaatagttcaaaataaactgctgcagacactgatcggtattggcatagcgctccatgattttcagtttgtcatactgccgccgttgatgcgcctcgtcaccttcagactgttcaataaaaaaccgttgcacctgcaagtcttgcggtctaaataacaagatcgcctcactaggcaacccatcacgaccggcgcgacctgcttcttgataatacgattccaaatctttgggaatctgggcatgaatcacgaagcgaacgttacttttatcaatccccatcccaaacgcgttggtagcgaccataatcggcttacgatcaaacaaaaagtcttcctgattagcagcacgttgcttttcagtcatgccggcgtgatatttggctaccggcaactgcttatgctgcaaaaacgcataaatccgatcgacttctttgcgcgtacttgcataaataatgccggattgatcaacattgagttttagataatccaacaagtaccgatcctcatcctgatcgcgcaccactttgaaactcaggttgtcacgttcaaaccctgtgttgatgaccccatcgtccgggatcatcaagcgttggcaaatatcttgagcaacccgcggtgtcgccgtcgcagttaaggcaatgaccggcggctgcgagggtaattgagccgcaacgttagccaagttgagataactcggccgaaaatcatgtccccactgtgaaatacagtgggcttcatcaatagcaaaaagcgagatattcatgtcaccgagctgctgaaggaaccaatccgcatcaaaccgttccggcgccacatataacaacttaatgttcccactgcgcgcctgttccagacgtgcagtaatttcacgataatccaacgtgctattaataaacgccgccggaatggcattgtcgtttaacgcatcaacttgatctttcattaaagcgattaaaggcgaaacgaccagcgtcaagcccggcagaatcatcgccggcacctgataacacaaagacttgccgccaccggtaggcatcacgaccagcgtgctcttaccggtcataattcgctcaattgcctgcttttgaccggctcgaaagtgatcgtacccaaatttttcttttaaaatcgtcgctggctgcggcaaaagcatctttttcctcctataaaaacttgactgactcaatcatagattatgccatcgcaattgaatttcccttttaaaaatttctgattagtataacgccaactgctacttcatcacagcaactaaaacatactgaccagtaaccagatgagcagactaaaactcagcatcactaaattcaacagtaacaaattcaaatttacccacgcccaccaagcaaatcctgctggccaaaacgtcagcaaactataaaagatcacaattgttaccagaaaagcaatcggcgcactctgccacatattttgcaaatcccgatgcgacaaagcaacccctggcgttaaaactaaggttaacacgaaaaaaatcaacagccaacgccagttaatctgcatcatttcgcgcatcataacccatttttcaccgagactggccgtggtcgcaaacacctgccacacttgactacctgccgagaaaaaagcccaccgccctagtaccagcaaaatgaggctaattccccaaaccggagcgctgctagaaagaaacagtcctagctgggcaatcggattatgccgttgatattgcaaactaacatgagcggcactgccttgtcgcggatcagcccgcaacgaaaaattcgtcacctgcaaaccaaatagccgcgcaacaattgcatgaagtaattcatggacaaaaattcccggcttcatataccagatctgcgtattagaccgaccaacgcgattaaccaaggcttgaactgtcgccccgttgaccgtactgatcaacacgatcccgccaataaaaatcagccaacccggaacatagatggccataaacgcctgcatgtaaggcccctccttgtttgctattgaaagatgcctatttcaatttaataaaaagcacagccaaatgactgtgctttttatgactgtgccctatcggaatcgaaccgatgacctactgcttaggaggcagtcgctctatcctgctgagctaagggcaccagacaaagtcaattatgccaaaagcagcagcgcaattcaaatagatttgttgtctcagcagctgcagctcaacgatatcgttcctcttagcctcattaagccgtcatataagaacgctcaatcgagtccaacatccggccaacattacgccgccgcttatggccgacaaatagctcggtgaccatctgtttaagctgcgccgcccaattaaccggctgcacggtttcactaacctgcacacgacttgcatcagcactaagcggcgtgatcaaataacgaaccttaaagcgagaaaaacgggtcatcgtcagcatcgcaaattcacgattgataacattttgcgtaatcttgacctttgcccattcaccatcaggaaattgtttgcgataggtataaccagcaagttcatcaacttcaaccttacgatgactcgccgccgcaatatcggcctgaaccggtgcaacgattttactatataaaaatgctgccggtgtctgtaatgttttctcgattttcatggggattacctcttttataaagtgagcgtgaaccggcgcgcttagaagtcggagtgtaagtggcctcagacgtgatggccgctctttggccattgcggctgaggtccttacacgcagacttctgcgccggtgaacgcgttatggtgagcgtgagccagcccggttagaaaccggagcataagtggccttgggcgtgatggcccgggtttggccattgcgaccaaggtccttatgtgcaggtttctgggctggcgaacgcgttatgagcgtgaacccgtgccccaacgcattcgccagacaaacaacctctaccaacaaacccttgacctacttctgtgcgtgcacttgctggtaaagatcaataatatcatccgcaagccggcgaatcgtcatggcactgattagatgatcctgactgtgcaccattaataacgttacgtcaactttttgccctcgtgcctcatacgtaagcatttgggtctgtgcttgatgtgcctgtttcaacttggcatccgcgtgctttaacaatttgcggctgcggtcgatctgatcggctttggctgcttcaatcgctgccattgttgcctgttccgcatcaccggctgcactcatcagtgtcatcattgcagccatttgttccgccttcatactcgccatgactgccctccatccttatcataccgctgatgcagcctcatgtgttgtttttgtgcttgcctttattgcgctgatcacgtagtcgcttttttttatgcttacgccgcggtttttgctcaggttcattagtaacaaccgaccgatctttagccgcaacctgctgacttttatgctgactcggtgctggcgatttgagcgtcaccggcgtttcgttatctggctttcgggctggtggtgtggtcaccaactttccatcggtcatataggcacgctgaatggcatattgcggtaccagctttttcaagtcccggcgatcgtggtcgtctcctaacgttaccaccagtccgggttcacccatccgaccggtacgacctgcacgatgaatgtaagcttcagcacgcttaggcggttcgaaattgaccacggcaggaagcttaggaatatccaatccgcggccagccatgtcggtcacaagtaataaggtaatccgcccgttacgaaaatccgtcaacgctttttggcggctagtctgtcggccctcccgtgacaatacggcaaaacgaacagcttggtggcgcaaaatgccggccgcgcgttccaacgatgcattttgattaaaaaacaccagtgccttgaagccatcagtgtgcgccaacgttcgcaaccaatcaatttgatgtgcccgatccgtttgcaagaataagtgccgaaccgtcccgcgtgtttgatcaatcgcacgaacatcaaccagcttaggcgtcttgccaaaccatttatgcatctcgctaaaatacggactcggtgtcgccgaaaagaaagcaagttgggcatcggccggagccgcagccgcaatttcgcgaacctgatcgaatcccggatcccgtaacatctcatcggcttcatcaacaaccagcgtctgtaagccatccaacttcagcttgtgcgattgaatcagttcaagcaaacgacccgctgttgcgacaatgacttcgggtttttcttttagcttcgtcaattgccgtttcacattagccgacccgatgatgccctgcaccgccacattgatatcgtgtgcatacggcgttaaaacatcccgtgtttgaatcgctaactcctgcgatggcgccaaaatcagtatttgcaaaccatcaccgggcacgattttttccagtaatggtaggccaaatgccaaggttttccctgagccggttggagccaaaccgatgacatcctcatcggttttcaacggctgataaaccgctgcttgaatgggtgtctgctccgtatacccggcagcctgccaacgtttttgaaacggggttgcaattgtcacaatatttgtcctccataacgcgttcgccggcgcagaaaccgcgccggttcacgctcactaaaaatcaagatttgcggacgtccgcagaattgacatgacttgatgaacttccttggccagctgccatgccttatcaaacgcattgcgatcatgaccggtgatagctttggcaaaataagctgcttctgcttccatcgggttggctaatttctcggtactaagcacttgatcatcgagcttgatagtttcaagttcagcagcattgtccatcgtcaacgtttgcttaccggaataaatttcggatggcaggaaactattggttgttttacccgtaatcaacgttactgcgaattgatcataatccaagcgcgcaaccccatcgccatccacaccactcttgagaaaatgcgggaggtaaacagcgttatcgggaaccccaaaccaagccaccgcatcgtagaccaaataaatacccagatccatcaatgcaccaccggcaaactcgggattaaaaacattcggcaacttgccagccaaaaaagcatcgtacttagaagaatacttcatataagtcaaggtagccccgtcaatcggatgatgatgggtaaattgatcgacaacctgaaaattgtgctcataaacatgccgagctgcctcaaaaagatacaaagaaggctttttgcgtaatgcctcgtctaatttttcaaattccatggcggttgcaaccaagggcttttcaacaatcacatgcttgccggcatcaagagctgccaaggcttgagacgcatgcaaactgttaggactggcaatatacaccacatcgacatcactaccaagaaaatcgtccattttggtatacgctgttgctggtgcagtttgatcaatgaacgcctgagcactctcctgatgacgtgaataaacggcagtaagcgtatatgccttcgtggccgccgctgcatccacaaactgcttagtaatccatcctgttccaatcacaccaagtttcaacatggtaaaatcctcctctaaacgtaagctggtgcgccaggaagacggggtgtaaggggtgtcctcaggcgtgacggcccgaacttgacccttgcaacttagctccttacacgcaagttcctacgccagtaaacgcgttatcaagcattataacagtcattcacggctgtacgtatgatatccagctctgccgtgatttaacatcaagctggcaaaactactcatgattattgtaacagcccagtaacagaaaaacagcaccactgtaaccactaaactaaaaactcatggtagactatgcttaaacagaaatgggaggtcgaaaaacatggcgagttttttacgcgggctgaaacatttactcgcgcaccacggtcatcatcagaaggcacaggacaaggcgcctaatcccgcattggcgttggcaaagaatttcacagggagttttgcttttcttgatgagcaaaccaataagacccactcgctagcgatttcgccccaactgcagattaagatcgacaataaaacgctacctgggcaagttgtcggcatcaccatcaacgagctgacttttctcgatcattatgggtacaaattagtcattaaggcggatgataacggtccgcaaaccatttatgacgaggcagaagatgctacctacgccattatcattcccagcgcataagatgcaaaaagtgcgatccgaaaatcggatcgcactttttttgtgtgagcgtgagctggcgcggttagggatcggagtgtaagcggccttgggcgtgatggcctgggcttggccattgcgaccaaggtccttacgcgcagatccctgcgccagcgaacgcgttatggtgagcgcgagccggcgcggttaggagtctgcgtgtaagtggccttgggcgtgatggcctgggcttggtcattgcgtccaaggtccttacacgcagacttctgcgccggggagcgcgttatagaaagtgatgcatttgattgctttattcaagttttgacaaggctgctttgggaacttccgaacgcggcacactttcccagctggtgaccccttttttatcattgtatgttacttttagataagcattttttctcagcggtcgatcttggttcgcattaaacttcaactgctgcagaccgcctttctcatcatatccaggcaaatcataggcataaatgatgtacttgttgccttcatcatcgcgatccgtcacccgctgaccagtgttggtaatttttgtgtagtatgtggttccgccatagttggtaatttcaaaaattttcaaaccgccaaaaacgagcacaatcagcacaaccaagccgatcaggacttttttcattatctgttcacctcgcttatcagtatgtcccaatcgttcaattaagtagatagtttcggcgaacattcaacgaacatttttgttagatcagtgcaatgctcggctttttgcacgaattaatggtggtccgactattgagccagcttcaaaaatgtgccgcgcttgcccatgaataccgctgctcgataggatgcctgaggaccgtctggcaaccgcgcaccgtcagtatattgccaaaagccgccgttattagcaggccgcttgtccgtgatcgtccaccgcggtgcttgtggaaccactgttttgaccacctttaaaatatcaggactacccatcagcaacacttggcgatgatagcgttgttgaatgaacgtgataaactcggttagatgctgtgtcaaccacgaggaacttggcttttgctcgcgataataacttaggtaaataccaatgggcaggtcgccaatgttggaacctactttgcggataaattgagttgcttgagcttgcggtgtcgtttcaaaactaaaaacgtgatacacgcctatgctcactcgactccctgctgcctgagtaaagttggtattgaaattatcgtcaaaatagctgctgccttctgtggccttcaaataaacaaagctaacccggctgctacgtaaacgatcaaaatcctgaacgccatcggtttgatcaaggcgaacgcccaacactggataagcggtcggatccggccgtggattacgcagcagccaccagccgattactaaggccgcgaccacccctgcgctaatcagcaaaaaccacaaccgtcgccgatgctgataagtatttgcataaatcactcgtcgtctacgcatcaacatccctcctactaaaaagtgagcgcgaaccagcgcgcatagaagtcggagtgtaagcggccttaagcgtgatggccgggttttggccattgcgcttaaggtccttacacgcagacttctgcgccggtgagcgcgttatggtgggctgagcgtgaaccggcgcgcttagaaaccggaacataagtggccttggacgcaatggcccgctcttggccattgcgtccaaggtccttatgtgcaggtttctgcgccggtgaacgcgttatggagcaagaaccagcacaatcaaagacgcacacctacgacaactgctctggctgttcattccacaatggtcttattgtaacaaagtcttccacaataaaaagtgtttgaactaattacggaatgaagcatagactgtactaaagttccagcatagaataacgagcataattttttctttctaagccgtcccaattgtctttcattcaaccctgctttaaaattggcttgtgataatcattgctagcgtcaagtaacaaagcaatcaatgaagatgaccagaaaggagtagcgcccatgcttgacgatcgccttttagggacaacgtttgtcttaccaacatcgcatcaagagggtgagattacgctttatggcattcattatcattaccgggtcactgatgacgctgcggctggcgatactgttgttgtcaatgcagtttcgccgctttatcttagcgtcgtcaaaccagaacatcgcttacattattgagattgagtcgtaattgactcgctcacacggggggctttcgcatgaatattatcctgatttctgttctagtcattgttttagtcatcgtcatcgcaattcttttcaccagcgttgccattatccataccggtgaagttggcattgtcgaacggttggggaaatatgtggcaacattggagccaggttttcatgtggtgccaccgttcatctatcggatcaccgaaatcgtcaacatgaagcagattccgctgaaggtcgatgaacaggaagtgattacaaaagataacgttgtcgtccgtatttccgaaacgttgaaatatcatatcacggatgttaacgcctatgtttatcaaaacaaggattccgtgctgtccatggttcaagatacgcgggctaatctgcgtgggattatcggcaatatggatttgaatgacgtcttgaacggcaccgaaaccattaaccaaaccttgtttcagcaaatcgccgaaaccacagctggctacggcttgaatgttgatcgggtcaacattgattccattcaagtcgatgctaccattcaagactccatgaacaaactgttgcgcgcttcacgggaaaaggaagccaacatcatggaagctgaaggtcataagcaagcagcgatcgctaaagctgaaggtgaaaaacaggccgcaattcttgaagccgaggccaataagcaaacgcaaatccttcaagcacaaggccacgcagaaagtcaacggctgattgcagcggcggttaaggatcaaattaactcgatcaatgccggcttgattgacaatggcgatttatatttgaaatataaaaatgtcgaagcacttgaagccttggctaagggcactgccaacacagtggtgctaccaagtaccgcgattgattcattaggcagtctccctgctgtgggaaccctattcaatcaaaaacaaccgtcagcatccaccaaggaaaagtaaggttaaaaagtcgaatcgcattgtgccattcgactttttaagttccgctactgcgtatcacatcaggtaaggctggtatcgttcaacgactttatggtacgccatccgcccttagctttcagaacaaccccaaacagcgtagtattgatgaaaacagatccgttttagtgcggatattttgaggtgaaaccatgtatcaactgttaaccgattcttgttgcgacttaccctaccagactttgcatgatcatcaagttgaatttgtctccatgcacttcaccgtcaacggcacagattatgaagacgatcttggagaagatcattacgatatcaatgcattttacgagcaactgaagcaaaatgtgatgcccacaacgacacaggtaaatgtcggccagttcgttgactttttcacaccgtatgtcaaagcaaacacgcccatcttatatgtcggcttctccagcggcttaagtggcacattcaattcggcgactcaagcacgtgccatgttactggaaaagtatccagatgcgcagatttacttggttgacaccctggctgcgtgtgctggcgaaggacaattggtgctggatgccattgaaaaacgcgatgctggcatgccaatcgatgaactggcgcactggctcacagcgcaccgattggactaccggatgtggtttacggtcgataaattggactttctgtaccacggtggccgcgtgtcgcgtacttccgcggcattgggaacgatgttaaacatcaaaccggtgatggacgttgatacggccggtaaattacgcgttgtgcgcaaggttcgcgcccgcaaacgctcgctgattgacttggccaacgagactttaaaagccattcaggaaaatccgcaacatcgcgttattatctcaacatccggcgattttgaggcagcaaactttgtcaaagatcgcctgcatgaagcctccccgcaaaccccgctgcagatcggtaacatcggcccaaccatcgccagtcacaccggctttggctgtgtggcggtcttttcaatggcggcttcggagcggaaataagttagactttcaaaaaattttaagctcagacttcattagcagctttttgctgttgttgcaggtaaaatagttgcagatgaacttgtgtgcagtgcttattttcacaatcgttaaggcttcatcacgtgtttcataactcgttgcttgacacaggaatctgcatgtaagggtcttggtcgcaatggtcaaacccgggccacttacactccggtccctaacccgtcaactcacactccataacgcgttcaccggcgcagaagtcggagtgtaaggacctcagtcgcaatggccaaagcccggccattgcgactgaggccacttacactccgacttctaagcgcgccggttcacgctcacttcaatcaaggaggattttattatggcagtccgccctgcagtggcaaccgatatcccactcttattaccgcttgttcaaggttactatcatgatagcccggtgccgctgaccattgactcacaggcaatggctcttcaccttgaccgcttgcgctccgataccagtcttggtcacttattggtcgccaccgttgatcaagaattagccggatttgcgattttataccgcagctttgagacccgggcgctgaaaccactgcttattatcaatgacgtctacgtggcaccaaagtttcgtcggcacgggttggcgcgtcaactcatgatcgcagcgttcgacctggcaaaagcgcacggatacagcggcgcaagttggcagactcgcaccagcaatcttggcgctcaacatttgtatgatcaaatcggcgaacgcgaaaccggctggctgcattactaccacgacctgtcccaagattgaaaaaaggtaacgattgtctcacggcaatcgttgcctttttgtttacgcttccccatgaacaagtgtgacacacagttgatctcgcggttctcgaaaaaggttcacataaaactcttttatttaaatattaccgatgccaaatcgtcagccgcttctgtggttgccgatacataccatcttgtggctgaacattaaatgcctggtaccatgcaggaaagttctgcaccggcacattcacgcgtaaggtagccggcgcatgaacatcttgccgcaaaacagttttagcccgctccggtcgcattttggtggcccatgaacgagcgtaagtgatgaagaatgcctgcagatccttaacatccggctgatcgcctagtaacgccaacgccacatccatgccggcgttatccgccatgttttcactaacggtcagtgtaccgttgaccttaactccttcatagtcacggccatcaaactgtgccgccatcgcttttaccagctgatcaaatgcctgcttatccgctggcgtccaccagttatgcaaattaccatgttcatcatacagcgccccgttattatcaaacgaatgcgagatttcatgaccgatcgttgcgcctgtccctccgaggttttccgcccgggtccacttgagtgaataatacggcggctgcaagataccagcgggaaaagtgatgtcatttttcagcggatcataactggcattcaccaagtgtcccggcatattccattgattccgatccaccggctggcctacctgtttaaaccaaaaggcctgcgtctgtgcgctcagtttcagaattgccgtcaacaaatcatcgtcagcatccacgctcaagtgatcatacaaggaaaagagtcgctccggataccccattttgacttgcatcgtggctaacttgcgcatcgccttttgcttcgtagccggactcagccaagtgttgttttctagctgtacgcggtattgcgcaagaatctgcttaaccatggccgtcacatctgccttagcatcggcaccaaagtaggtttgaccataatactgaccaatcacatcgtcaaaatactcattggcaatcccaaaagcgtgtttcgtccacgatgacgcctcaggttgacccgccaaaaaccgatcatactgtccggccaattgacgtaaatcatcactgaggtaagtggcgcaggttagcaattcgttaatcaccatccatgcgtgccattctgaatagttatccgccgtcagtagtttgcttaaatgcggaagataagccggtacaaccgcattgactttcgccggtgtttgcagcatgtaagttgcaaaggcttgtgggatccccaaataaccggccgcatcttcaaacgcctgccagctcaatggattgtcatacgtgctatctaccgctaagtcaacatttgctggcacataatcagccaaacgccgatcaaatcgtttagccgcttcaacatatgctgtttgatcagtctgactgaatcccgccgcagccagcatggcagctgccatctgcgaccacgctgccagatccgccgcattttcggcatcttcctgttggtacatcgccgcatcaggtaaaatcgtgtctggtccgccaagattcaggatattatgctcggcatcgtgcatatcagcatcaacgtagggactgattggtaagacgtattggtcagcaaccagtttgggcatagcggcgcgaaattgatcaagcgtcgtgagcgtcatcaaaaagcttatccggtcacgaactggctcaatgcctagctgctgacggcgggtttggtcattggctttggcaaacaaccgcgctgcatactggagcggcaaagttttggctgtttgcatcatcgtgcttaagtcagccactagtttttggcgaatatcatcggtcagattactatccgcactcacaacacttttgtcaggtggaatcggcgtcttggcttgccattcgccattgacggccaggtacaaatcatcttgaattcttggtaatgtcatgcaattgcctccgttttcatgtcgtaatctcagcatagatttaatccgccaaggcgtcaattgcttgcacatcctaggcgtaactactatgttgaaactaagcataaatcgaaggtgataagatgacattggaaaaatatcgttttgacggcactagcacctttaacattcaagcgtttgcgaccgcgccgccagaacattttcaaaataaaaaagagcagatcaaagcagacattgatcataacatcaaggtgctctctaaagttcagcaacacttggcggcgcagaaacaatacagcgtcttgattatttttcaagggatggatgcagccggcaaagacagcatgattgaacacgtcatgtccggcgtcaatccgcagggaacctcagtggtatcgtttaagataccaactgagcttgaactaggccatgactttttatggcgcatccataacgctttcccggctggtggcgaactgacggtgttcaatcgctctcattatgaagaagtgctggtcgaccgggttcatcccgagttgctattaaaagaaaacctgccgggaatcgataccgttgctgatgtccatgacgatttatgggccaggcgcttcaacgatatcaaggcgctagaaacgtatgcccaccgcaatggcatcttgctgctcaagttcttcttgcacatttccaaagccgaacaaaaaaatcgcttcttaaaacgaatcgaaattcccgaaaagaattggaagttctcattggcggatattcacgaacgccgcttttgggatgattaccagcaagcttatcaagaggccattcagcacaccgccaccaaaacaaatccttggtacgtcattccgtcagacgataagtggtattcccgactggttgtgtcccaaatcatcaaccgcgaagtcaccgctttgccgctaaaatatccggaaatctctacagctcagaagcaggagttggaacaggcgattattgacttaaaagattaggtttaaataaaactattttggttaaaataaaaagcgggtcgacttccatcaccaagaattcgactcgcttttttattaaccttcacccattgcatactgcttgatggcgactgctgccccatcatgatcattatcaggtacaactgttttaatgacatctaacacctgaggcaaagcattttccaaggtcacccctaggccggctgcttgcaacattggcaggtcattttcaccatcgccgagtgccatcgttgccgccattggaatgtcgaataaatgactgagcgtttttaacgccgcctctttcgacactccttgccggacaatttccagataagttgccttcgaccgactggcaaccaactgccattccggatgggctaaaacgatttgttcagcacgatcgatcacgtcaggctcccccatacataaaagtttatgcactggcagaccgtttgctaaccctgtttcaatcggaactgtttccggtgcaaaaccggtgatcgctgcttcttgccgggtccactgactcgtatcagcgacataccaatgcgtgtcactgaacacattcaagctcagtgttaagctaaataatgcggtataaactttggctgcaattcctgctggccaaggcgtcgttgccaacacttttagcttcttatcatcggttggctgagcaatgaccgcaccattaagactgacaagcggcaccgccaaccccatttgttgcgcgagcgcagtcatggctaaaggcggtcgcgccgaagcaagtacaaaagtcccgcccgcagcaacataatgctgaattgcttgcttaacgccgacagtcaactcgtgttttgaattaagcagtgtgccatcaatatcactcagaatcaaccgatagtgcaagaaaaaatccccttccctgtgcctttgaacgtgccctattgcatgaaacctaaaactgaatctgcatcatttggcggttaatgagccgctgggtgtaacggatcattcagtgccggaatactttcgcggaccgtgaaggcaaagcccaacaccgctaataaaatcaaaccggtggcaccgacaaacaacaaccgataactttgcgtaccttcaatcaccattgcacctaacagtggccccagtgcccggcccgctgatgcaaaaccttgaatcaatccttgataacgcccttgttgtgcaagcggcgtaaacaaagtgacataagttgaaactgccggcaatgccagaatttcgcctaaagtcaaaaccaccatggcgacaataaatgtcagatattgcccggaaccatttagcaaaatcaaaaaagaaccggcaaataacacaaaaccaccgatcaaccgcaaccggatatgctgcaacaaccagtgatcaaacgcagtcaaaaccggctggaacaaaacaatcagcagcgcattaactgtccacaaaaagctgtagtccttgactgtaaggccttcgcttaacataaaggcggaaatattgctttgccactgttcatacattaaccacgtcacaaacaacgtcaccatcagcatgatcaaccgtgggcgcgccggattgcgactgccgtgggcgactggctgttcggcggctgtcggagtttctttttcaatacgataatgccagatcgcgaccactaaaaagaccgcaaatagcagcgcggccaatgcaaacaccatagcaatcccataaggcaagacaaatccgacaatcagcgtgccgatcacaagtcctagatttgatgtgaaatacaaaatattaaacaccacacttgggcgcttgtcgcgaattcgcgtggcataagagttaatcgccgtggccgtaatcccactgccaaaaccggaaataaccagtagtaacggatacgccggccagccatggaaaaagatcaataagccagttgcgccaagattcagacaaatacccgccaataccgttccatacggttgccaatggtcaaacaaccagcccccgagactgttgccaatgaccataaacattgaattcaaaaaaaggacgattcccgccactgtgagtgattcacccaaatattcatgcatataaatcgttgttaacggccaaatcaaactaatgccggtattggtgattagtgatcccaaaaacaaccacttcattgccaaagtcttgtgctgcaccattctcccccatttcgtgtcactgatactgatcataatcgaaaccagccaaacatagcaacttgaatgagcaaatatttaggcggttatcatgattctgccgtcaagccgcaaaatataaataggcgtaccatcctgaagtgccccacaatcgttagagtatctgcctaacaattatggggcacttcaaaaatagtacgtctttatttcggagttgtaaattatagaaccaacctcgatacttggcacatactcacaattaacccagatttaacccgctatgctttaacccaacgtcaacgcggtaatactttcaatatgctgcgtctgcggaaacatatccaccggctgagtttctttggctgtataaccaaacgctgtcagcaactgcaagtcacgcgctagggtagcgggattgcaggagatgtagaccatctttggcggcttcatataccccaccgcgtcgataaaggttttatccaagcctttgcgcggcggatccaccattaggacatcaacgggcaggtccgcgtccttccacttctgcatgacgtcttctgctttgccaacctcaaacgtcacatttttgatgtgattacgcgctgcattagcctttgcatcgcgcaccgctgattcaacgacttcgacgccataaacctgttttgcgtgccgcgccatggttaaggaaatcgtcccgatgccagaatacgcatcaatcacggtctccttaccggttaaccccgctgcttcaatggctttcgtataaagcacctcagtttgaatcggattaacctgataaaaactgactggcgaaatctgaaactcactacctaatagtttgtctaaaagatagtcacggccgtaaattgtttttgacttacgcccgagaatcacattggtacgttgatcattcaggttaaccaccacactggtgacctccggaagagccaacgtgatttcttcgacaatatcattcagatgcggtacttgccatgtgcgcgccaccaacacaagcatcatctggtgcgttgcccgcccacgccgcaccataatattacgaatcacgccgcggttcgtacgttcatcataaggcggcacctgatatttacgtaacaagtcgcgaaccacaacgattgcctgatcgattttaggatcctgaatcagaaagtcctcaatcggcactaagtcatggctgtgttttttataaaaaccagtctgaagttcgccacgaaccaaccgcactggcacttgcgctttattgcgataacctagtggatgcttcattccgattgttggcaacactttgatcgccaagtgggcctttttatagagttcctggatctgatgttgtttgaattttaattgtgctggataagccaaaatcgacaacggggcaatcccggtgcgaatgtaagtactatcagcgccggccacgcgatcaggcgagtcggtcagtcgcttcaccactttggcaaaaccgtattgcttctgggtcttaagcacatgtacctgcatcttttcgccaggtagcgcgtcttcgataaatagcggaaaacccgcgactttcgcaacgcccatgccttcataagtgagatcctcaatcgtaacttccagatcctgattcttggtaacagctggttgggccaaattagtcatccttttcatcttgtgcgccgatttgaccatcgccatcaatgtcgcggtgggagatcgattcgacttctgccatgtagtctctttgcttctgggcatccgtccctaaattcttggttgggatctcatctacattagcatacatcgcgatatgttgctttaaattaacaaacgtcatcggtgcatcgccgccatattcgccatccaggttgatcttaagcgtgtcttggccgctggttttgactttcaactttttggtcttggtatagacaatattgggatcgtcaacatggcgtccaccgttgaagacaagcgccatcaatttcaacaaattggccatgttggcagtcttgacaataatcagcgagaacttaccgtcacccaactcggcatccggcacaatttgttcaaaaccgccaactgaattggtcaaaccaagaaagaacatgctggccggcccatcatagacaccaccgtcatattcaagcttcatcggcatcgtccggaccgctggcaacatttcggcgcccttaatgacataagcaaaatacccaaaaatagacttgacttcggatgggaccgaataagtcaattcgcttaacaaaccacctgctgcgatgttcataaaataatgatggtttgcctgaccgatgtccatcgccaaagtttgcccttttaaaataacccgtgccgcttcaaccggatcatcacgggaaatccgcagtgcccgcgcataatcattcgttgtaccggcagggataatcgccattttaggccgctttttggctggcgcaatcccattgacaacttcattgatcgtcccatcgccgcctgctgccacaatgagctcaaagccggcttcagtagcccgctttgcttcttcacgcgcggaaaaaggctttggcgttgtttgaaaggccgagctttcatagcctgcctgttccatgatgtttaaaatgtcaggaacgaaacgttttaatccttcgttcccggatgtcgggttgtaaatcaagcgcgcccgttttctcatgactctctgctccttcaatgcacaagccaattccaaaaccaactgacttgcgggttcttttcacgtggtctaaggtcatcacattctaagcatgtttaacctgaccaatacccgaaaaacggcggcccaatggtgtaccacggaccgccgtcaatcggttgcaatcgtatgtggtcaatgaataccgtaccacaattttcaataaatgcctttaacgctttttgatttctgtcatcaaaatctgattgacaactttaggattcgcctgaccatgggtttgcttcatgatctgcccaaccaggaaaccaattgcacgatctttcccggctttaaagtcatcgatactttgctgattgttgtccaataccgtggtaatgatcggggtcaacttagccggatcggaaagctgaatcagccctttttcgtgaacccactgatccggatcggtgtcatgctgaatgatttccttgaagaccttcttagccattttactggaaatcgtgccatcgccaatgagtttaatcatgccagccaagtgttccggtgtcagcgcaacgtcaccaagctccgtgtgtttggcattgaggtaaccggaaacttcacccattaaccagttagacgcttgcttggcgtccgcaccttgggcaacggtggcctcgaagaagtcagacatttccttggtttgcgtcaagacgccagcatcataggccggaatgccccagtccttaatgtagtgctcacgccgttctgccggtggctgtggcaacgttgcctgcacttcatcaatccactgctgggaaaccgtaactggcggtaaatccggttccgggaaatagcgatagtcatcggcgccttctttaacccgcatcaaaatggtctctttagtatccggatcccaacgccgcgtttcctgacgtacttcaccgccgctaagtaaaactgcttgctggcgcttttcttcatatgccaaaccatcacgaacatgaacaaaggagtttaaatttttaatttcggttttcgttccaaaatgcttttgtccaattgggcgaacggataggttggtgtcgacccgcatggagccttcttccatcttgacatcggaagcgccggtaaactgcacgatttggcgcagggtttcaaggtaggcgtatgcttcttccgggcttgtgatatccggcttggagacgatttcaaccaacggcgtgccttgccggtttaagtcgacataagagtaaccgtcgtcttcatgctggttcttgccggcatcttcttcaacgtgcagttccgcgatgccgacctttttcttcttcccatcgacttcaatttcaacccaaccgttagtgccaagtggtttttcactttgcgtaatttggtaagctttggggttatccggatagaagtagtttttacggtcaaaatgcgtctgccgggtgatgtctgcatgcaacgctaaggccaccatgatgccaagttggtacgcaccgcgattgatgcttggcaaaacgcccggaaagccccagtcaatgacattggtctcggtattcggctcttgcccgtaagtgactggcgctggtgagaacattttggatttggtttttaattcaacgtggacttcaagcccgattgtcgtttcaaaattcatcttacttgcctcccgggatctgtgctaagtagtcgttttgcgcttcaaaagctgcggcaacttggaagatcgtactttcatcgaaatgtttgccaatcagttgcaagcccacaggcaaaccatcaacaaatccagccggaacagaggcagccggtaagccagctaagttgaccgggatcgtcaaaatatcattcatatacatggtaaccggatcggtgactttttccccaatcttgaaggcaacagttggcgtggtcggtccaatgattaaatcataatcctcgaagacagcttcaaaatcccgggtgattaacgtacgtacctgcccggcttttttgaagtaggcgtcataaaaaccagcagacaaactgaaggttcctaacatgatccgccgctttacttcgggtccaaagccttcggaacgggaacgaacatagacatcttcaatgttgtggacatctttggcacggaaaccgtaacgaatcccgtcaaaacgttgtaagttggaactggcttcggaactggcgatgatgtaataagatggtacggcatattgggtgtgtggcaaggaaacttctgacacggttgcgcctaaagcttcaagttgcttagctgcagctttgattttagctgccacttcagggtcgaccccttcacccaaatattctttaggcaacgcaatcttcatgcctttgattgattgcccgatcttggccgtgaagtccggtaccggcgtatcggcagtggtgctgtcgcgttcatcatgtccggcaatcacattcagaatctgagcggcatctttaaccccgcgcgtcaacgtgccaatctgatccagactggaactaaacgcgatgagcccccaccgggaaacccggccataagttggtttaaagccgacaatgccgttgaaagcagcaggttggcgaatcgaaccacccgtgtcactacccaaagcggcaatcacttcaccggccgccacagccgctgctgatccacctgaagagccaccgggaacgcggctgtgatcccaagcatttttagtcgttttgaaagcagagttttcagttgaagaccccatcgcaaattcatccagattggttttacccacattaatcgcaccggcagcggccagcttctgcatcaccgttgcatcataaatgggattaaagttttccagaattttcgaagcggcggttgtcacaacgcctttagtcacgatgttatctttaatcgcgatcggcaccccggataacggctgatcatcggcaataccggcttcgtcaattgcggctgcctgcttcttggcaccgtccgcatttatggcaaggaaagcggccacttccggatcgattttatcgataccagccagcgtctcatcaaccaactggcgactggtcagcttgccagaacgtaactgttcatgaagttgatcaagattcgttttaaaataatccacgccctagtcctcctccttgtcaatgatcgccggcacttgaatataggttccttttttagtcggaacgttcttaagcaattcggcgactggttcgctcggcttagcaacatccggacgcatcacgttctcaagatgaatgctttgggtggtgactggtacatccttagttgaaacactttccaattgttcaaccatatccaaaatttcagaaagctgaccggtatacttctccaaatcggcttcggaaaattgcagcttagccagactggccacgtgtgccacactgtcttttgaaatcatgctatccccgctttcattttcattatcattcgtagtttaccatagtttcctttaataacttccaaatacatgcgtataaaagcctttgtccccagaacttcgcgagacaaatgcctggatgccttgggtactttgaatggtaatttcaattggcacaccggatggcaaatacttattggcggcagttgaaatgtactgcgtgaaactttgaatttccgtcaagccatagaactgagtgttaacggtaatcttcatgccgcttaaattgccatcttcataatgcgcctgagccgtgatccctgctaaggtcgggaagaagccttttacctgatttgtaaaactcgaaaagtcattggcaaccgtactgttaatcgctttatggtcactgacaaccggcagaatttcattttgctgattaagtttcttccaggaaccgagatccgttccactcttgctggtcgcgtgttcgacataaacgccgccaaccagactatcttgttcggcgtttttgtaaatacctaccaaaatcggtacatcactcggcactttttccattttgcgtagtcgtgcgacaacttttgctgccatggcctcgccttgtttcttcagcgttgcttcggaaatttcggtttgatattgcgcgccatattcggtcttggtgtagtaatcgacctgattcatgccaagcgcaatcgcaatcccgcctagtttcatgctattgccgtcttgcaccatgaagtcctgctccagaatctgctgtagatacatcggattacgggtatcaggatctttcttcccgttatcaaccggatttaagccatcgggattgctctttgactcccgcttaagccaacttcttgctgttgccgtgctcaataactgcccttcttcaaacgaatatttatccgttgaaaattgggctttggccaaactctccaagccactttccatactcttgatgttaaaagtattttcgccttgatcgttttgttgcagcatcaaaccacgtgcactgctggtctgatagcggccattcttgatcacgccttggtacatactattatcaaccgttccagtcgtttggtagctgccggttttggttccaccggtgctactgctgccgctgtcaagatttagcttgccgcacgccgccaacagcacaatggcgcctgtcagtaaggttaacgtaaaaaatttcttcattgatgaagttcctcaattcttcaagttcgtcaacaacgctgtctcatccataattggaacattcaaatcctgtgctttggtcagtttgctaccagctgcatccccggcaatgacgagatcggttttcttcgacactgagccagttacttttgcacccagctgctctaagcgtttcgtcaattccggccgggagaactcggcaaacttgccggtgatcaccacggtcttgccagaaacaaaactatcgcttactgccggacgggttggaccggtataacgcaggttaacaccggcagagcgcaattgttcaaccaatttcttcaccgtatccgttttaaaataggtgacaaccgcttcggcaatggttggcccgatattcggaattgccgcaacttggtcttggtcggctgccatgagctcatccaaactgccaaaatgctcggccagaatacgtgccgctttgccaccgacatggcgaatgcccaacccaaagattaggcgttcgacagaattttgccgactattattaatcgcatttaacaaattattaattgatttttctttgaacttatccagcttttccaagtcagtggccgtaagtcgataaagatcggcgacatccgtcacaagcttcttagcctgcagttgcgcgatgattttcggacctaatccatcaatattcattgcattacgcgaggcaaaatgggtcaactgttcttgtacttgcgccgggcacatcggattgatgcagcgtaacgccacttcatcatcaaggtgaaccagtttttgaccgcatgatggacattcttccggaatcggcgctggtggggtattggctggccgttttttaaccagtacgcgtgaaacttccgggataatatcgccggctttatgcaacatgacagtgtcgccgatgcggatatccttatcccgaatcatgtcggcattgtgcaacgttgcccgtgcgactgttgtcccagccaactgaaccggatccatcaccgcagtcggcgtcacaaccccggttcgacccaccgtccacacgatatcgtgaatcaccgttttggcttcttccgggggaaacttataggcaatttcccaccgcggtactttgacggtgtttccgagttgggcctgcaaagccaagtcattgacctttagcacaatcccatcgattccatacggcaaagcatcccgatcactggtgtatttcgttatataagcatcgatcgcttgcatatcactagccacttcggaacttggattggttgtgaacccaagatcctgcataaatgcgatcgcctcatgctgggttttgacattaaaccgatcggcgtcaattaacgtgtaaataaacgtatccaattcacgcccggcagtgattttagggttgagctgtcgcaacgaaccggccgcagcattacgcgggttggcaaatggcgtgtccccatctgcctccttgcgtgcgtttaatttggcaaacgcagctttaggcatatagcactcaccgcgcacttcaagcgatagtggccgcttcaaagtcttaggcaccgaagcaatggttaaaacatttttcgtcacatcttcgccgatattaccatcgccacgggtggagccttgcactaagcggccattttcataaataagcgacaaagcaaggccgtcaatcttcaattcaacattgtaatcaaccgcatgccccacattagcctgcatccgcgcatcccattcgctaagttcttcaaatgaaaagacatcgcccattgacagcatgggaatcgggtgccgaactttggcaaaatccgaattaatcacatcgccaacttgctgcgtcggtgaatcaggcgtcaccagttttggaaaagcggcttctaacgcttgcaagtcacgataatgatcatcataaacattatctgtgaccgttggagcgtctttggtgtaatactccaagcgccattgatttaactgttttcgaagcttggcaatctcggcttcggcttcttcaagtgtaaattgagcagctggtttacttaacacggcgaacctccttattcactacgcggttaacaacctttcatgcatcgttaagcttcaacttttttaatcggggcaaacgcagctaataaccgtttaatccccatcgctttaaaggctatatcaagttcctgatcgtcaccggtgccggttactttgaccacggtaccgattccccatttacggtgttcgactttatcgccggcttcccagcttgtcttaccggcaccagtggttggagccggtttaacggttaccggcgtcccggtggtttcaggatgacggctataaggcgaactaaaggcgcgatcggtgcggttgatgaacggtatatcacttttcggctgggcagcaccggaaatatcaagcaattcaggatcaatttcttcaataaaacggctcgccggattattttgacgctgaccatacaacatccgggcataggcattggtcaaatataacttttgttttgctcgggtgatcccgacgtaagccaatcgccgctcttcttcaagctcgccttcatccatggccgcgcgactcaacgggaaaagcccttcttccatgcccaccagaaagaccactggaaattccagtcccttagccgcatgcaacgtcatcaacgtcacttcctgggcatcttcttcaacttcatcttgatcagacaacagcgccaattcagctaaaaagtcgacaaaaatatcactgtcttcattttctggctggtagcgcgcatcaaatccttgggtcactgacaaaagttcttcaaggttttccactcgcgtttcggcttccaaggtgttggcggcacgtaacgtccctaaataaccgctatcatccagaattgcctgcatcatttccgtaacgttcaaatctttccgccgctgaccaagtcgttgaatcattttaccgaattgggctagattgccgcgggctttgcctgaaatcggactaagctcagcatttgccgctgcttccaagagtgaccaatcatgctgattagcaaaggcttccagtttagcaacacttgtattgccaatcccgcgcttaggttcattcacgatccgattaaagctcatatcatcatccggattgacgaccaaccggaaataagccaaggcatcgcgaatttccttacgatcatagaatttatgtccgcccaccattttataaggaatgttggacttcacgaacgcttcttcaatcgcacgggattgggcgtttgtccgatataaaatcgcaaagtccccgtacttgcggtgatgttctgccatttccgcttcaatgcggcgaatcacaaaaatggcttcatcggtttcgctttgagcccgataatacgtgatcttgtcgccggtggcattttccgtccataacgttttggcctggcgattcaagttgtttttaatcacatcattggcagcactcaggattgtcttggttgagcgataattctgctcaagcaaaatgacttgggctttagggtaatcctttttaaagtccagaatgttttgcatattagcgccgcgccaaccgtaaatactctgatcggcatccccgaccacgcacagattgtgataaccttccgccagcatatgcacgaggcgatattgggcttcgttcgtatcctgatactcatcaacgtgaatataccggaatttgcgctggtaaaagccgagcgtttcgggatccttttcaaataacacaatggtctgcatgatgagatcatcaaagtccagtgcctgatcactgcgcaggcgtttttgatattccgcgtaaacttgggccacagttttggtaaatgggctgttggcctgctcgtctgaataagtttgcgggtcgattagttcgtttttggcacccgaaatcgcgccaagaatcgacttaggatcataacgcttgggatccagattgaagtcagccaaaatgtgcttaaccaaagtgagttgttcggctggatcagcaatcgtaaacgcccgattgtaaccgagtttgtcaatgtcgcgccgcaaaatacgaacacacaatgcgtggaacgttgaaacccaaatatcgcgggcaatttcaggatcgaccagtttacccacccgttcccgcatttcccgcgcagccttgttcgtaaacgtaatggcaagaatgttccatggattaacgtttttttcttcaactaaataagcaattcggtgggtcaaaacccgcgtcttgccagaaccggcccctgccataatcaaaaccggtccttcagtggctaacaccgcctctgcctgcttatcattcataccctttaatgcggcatccattaccatttaacgaatcgtcctttcagaaaagccaagtgaaaaattccttgacctattgtaccaaactttggcgttaagcgtgagccagacaatcacgataacgcgttctccggcgcaagggcttgcgtgtaagtagggcttttggtcgcaatggccacgcccaaggccactagttctcctttacgcccataacgcgctccccggcgcaggagtcggctcgcgctcactatagcgcatattcattgcgttgcccgatgactctgatacacttaagtaaagaagttggaggatgcaacgattatggaaatgagaaatggacgaaattcttttttcgatggcggcttattggcttatattggctgggccattcttggtacagtgatcacaatcgccacgtttggcatctgctatccttgggcgttgaccatgttgtatggctggaagatcaaccataccgtgattgaaggccatcggatgcatttttacggttccgctgtcggtttatttggcaattggattaagtggctgctgctatcgatcatcacgcttggcatttacagtttctgggtctttatcaagctagaagattggaaagcgcgcaatacccgatttgttagctaaagaccatttataaccagcatgtcatcagtcgattcaagaagggtattgggatgaaaaagatttggttgggattgggtgttttactattgttgctagcggctggctgtggggtttcgcggcaagctgctaagtcaagccgctcctctgcgccagttcgcagtcggcaggccagcgccgcttcaacgccgccgcgcccgacccgactggcgcaattgaaggccaaaagcaaaacacagttagtttatgctccttttggcgacagtctttcagttggcctttttgccgataaaaaagccactcgttttacatcgctttttgcccggcagctggcccgattaaccagcaaaaccgtcaccgaggccggcattgcggaagtgggaaaaacggctactaacttgggcgtccccgctttaccgcaactcattgctcagcatccggatgtgatcactattgagtttggcaccaatgacgctgtcggtggcgcaaccccaactgcgctcgctgcctatcaacaagcactgacaaccattgtcaccacgttgcaaaaagaaacctcggcacaactgatcctcatgacaacctggtcaccaaatcaagggccctacgttaatgccgacttgaaattcgatgccgttgttaaagcagtggggcaaacctaccaggtaccggtcgttgacttggcaaccatctggcaaggtcatgatgatgtcaccggaccggctggcactgtcattccggatttcactgccaatggcccccgggatacgttccaccctaatcaacgcggccatgatcaaattgctgctcaactcattaaaactttggaggaatgatacatgcaaacaccgttaagattctgccctaactgtgggcaaccgattaaaccggacgatgacttttgcccaaactgcggctttgatttacggtcagcccgcctgcaagcgcagcaaacaagcgaaaacgaagcgtccacgccgcaaccgccaacgacccctgcatcaacaactgcagcagccccagcgccaacccgacatacgccgcactcacatcggcgctggccatggattgtcggcattgtcgtcatcttaatagccggttgtgcctatttagccggcgccgcctattatagtcaagaccggcaagttgccgagcttgccgaagaaatgacaagcggcgatgctgatgatatggcggaagttgccgttgccagcgatggaacgcctttgcatgaagatgacctcaaaccactggcccaactcattgaggatcgccattatcgcagccttttaaataccatgattcgggctaagtccaccagcggcatggtacaggtggtcaagcgaggtcaggaaatgctgtttttcccgaagtataaattcaagcttggaaccaccgcggtaaccgtgaagactaaccttaaaaacgcagcgttaacgctgaatcatacgccggtgcaagctgccaatcataatggtcaatacacgatcaacaatcaacttccgggccgctatacccttaaactcagcggcacgcatgacggtgctactaaagatttcacccgtgacgtgatcgttcccctgaaaggccaagccgctgcactcactttagacgcagcagctgcctcgtccaacaccgcctcgtcatcgtcacaggcttcacaaacaagtcgtgacactgatgacgacgatgatgatgactatgacgacaatggcgtgaccaaaaccaaccgcacctacccatctgacacttcaaaacgcaacgataatcactcaaccagcggcattgttggccggtgggaatccggcgatcgggcaacgttcaatttcaatagcgatggcacatacacagcaactaacaacaacaccccaagcaacggtacttgggaggtggtttaccgcgatgataatattttaaacatcaaattcacgaaaccagatggcaccagcgtggttgaaccatttgcactcgatgatggcgacttaatcgaaaccaacctcaagatcaaatgggagcgtgattgattcacgtttcgatcatgctgaacgacggtgttgcctgcagcttaacttggctattaagttcgtggtgctatactaatggcagaagttaacattcaatagcaggaggcgaagtatgatgttatcggaaaaatggcggcctttaatcgttactttgagtgttatcgcagcaatctttaccgccttattcgttttagcattcgttacccacggctggacagccattgcccctgataccatgatgcacggttttacatcttgggcttcatcctggcatatgggtggctgcatgcgttagtcagttaatagtttcaaccgataaacttttgatccacggtgtcttttttcaggcagcgtggattttttatttgcgcattgtcaacgtaagcagaaaataacttgcctttgcaaacatacgttcgtataatagccacagaggtgattgatatgcgctatgactattcgcatgaaccgcatcgcgtcatttttttgatcgacaacaagtccttctatgcatcggttgaaagcatcgagcgtggacttgatccactcaaaaccgtcctcgtggtgatgtccgaacaggaaaatacgaacggcggtttaattttagccacatcgccaatggccaaaaaaatgtatggtctcaagagtaacgtcagccggcaacgcgatttacctaatgaaccacatttaattgtcgtgcccccgcgtatgaacctttacattaagaagaatctggctatcaatgacatttttcgtcagttcgttgccgatgaagatttatggccatactcgattgacgaatccattctcgatttaacccatacttggcgactttttggcaagacaccacgcgccgttgccaagttaattcaggcaacggttcaccaacagctcggtttacgcaccactgtcggtatgggtgagaatccagtccaggccaagatagcactggatgtatacgccaagcacaattccgatttactcggcgaaattacatatgcaacggtgcctgaaactatctggcgaatcaagaatatgacggatgtctggagcatcggtcaccgtaccgccgcacatctagcacgaatgggcatcacaagtatgtatgaacttgctcacgccaatccgtacgccttaaaacaagagctgggcattcttggcacgcagctttttgcgaccgcatggggcattgatcgcaccaagattagtcagcggatcgtcacgcgccagccaagtatcggtaattctcaagtgctgccacgcgattatcgtaatcagttcgaaatcgaaattgtgattaaggaaatcggcgaacaagtggccgcccgcttgcgtcatcaccgcaaacgggccggtgaaatcacacttggaattggcttttcatacgctgagagccaagcagacggtcgcactgggttttcacaagctaaacgaatgctgccaacgaatcgcgactcagatatcgtgacgactttacgcgaaatttttcgcgataactggcatggcgaagtcgttcgtaatgtagcagtctacacctcccgcttggccccggacaccggcgaacaactcaatttttttgaaccgatcgatcagcaaatcaaggcaacaaacctggaacgaacgcttgatgcgatccgcaatcgattcggctttaaagcactcgtctacgccaaaagcgccatgcacggcggtaccgccattcagcgcgcatcacttgtaggaggccataatggtggcaatagctatgactaacgatctcaagattatcatggaacgattgaccccgttatttaaacggcgccggaaaacacggtactggatttcacttgtcaaccagacctacacgccggcatttaacttcttttttaacatccaaccaaaagatcaacgcctgcgttccatccccttgcacagcctgcacaactatgatctggcgcaattagagctttttatcggcttactgcggcaacagacccgcctaaccattgaattcatcggtttcgaggaactgcgctggccgcgaaccaatcggctcattcaacgacgcccacgtgcagacgaaacgtggcccaattaagcgatccgacactttttatcatgccgattggtaacggtgccaaggtttagtgcttcgttttactgaacccattagctgaaaaaagaccttagcgcaactgaaattgttaaacgctaaggccaattttttaaacatgctatttccggtttcgagaacatcccaaaacggtgaacttaccttcgattatttgttaataagcaatggtatatgaatgacgtttatctaagacaaaagcctctgccatctccggaccgtgttgcgcgagaatctggtctgccagatacgcttgaagatcttcatgaaaatacgtctctaaaccaaaactccacgcttgaaaaacatgttttccctgacgacgcccagctttgtaattttcataaatagcatggtagatcgcgcgcccagttaaatgaaccctcaccggaaggactaagcgttcaccgccgcgctgaaatcgggcattaactgtccggaaagtcataaatcgaataatgagcaagacacttggaatcataatgcccaaccctaccaatgcaacaaaaatagtgcccattacaaaaccaacggcactgactgccaaagcacccgaaataacaacgctcaggccaatgacaaacaaaatcaataatagcgccggaaataaagcaactccggctactaacacccagagcaataatttaaatgcgattttcataaagcctccaaaaaaacatgccgcttattctaccgaaatcagatgaacatcactgacgccgcgaatatcgccaagtttggttactaaatcatcaatggtcccttgcagtgccgaaatatcaaatgagatcacaacactagcccaattatggattggaatattctggttaatcgtcacgatgctggcctgtgcatgcgatatgaccgtcaaaacttctgacaaaataccgcgatcgtgatggagcattaatgaaatgaccgcctttcgcgatgccatttcatgatcaggcaggaaaacataatctttgtacttgtaataggtgccgcgagaaatgccaacttgcttaaccgcctcgctgacctgtttaacttcaccattttggagtaaggttcgtgcggcaatcactttgccaaccacatctggaagaattgaactgtcaacaatataaaactgcttcacgcaaaatccccccaaaataattgacagccaccacaccttacgaactacctgatagccgtttgaatatgttcatattgtaacagtcattgtcacttctgcaaagtaatcgttaaactgtaaccgacttgacatgttgtgatacctaataaaccctgtcgtttaaaagatttcgccaggccatgaatcatcaaccgaatcaatcgttaaatggacacatatgcaacgatcatcacagcaactcacaggtaagggctttaaactcaaggatttttgcagtaggctgatggtgactttttattaagaaaatatgatgattttgacgggcgtagaaacctgcgtgtagaggttggaaaatttccacgcgtcagggctccacacctgctagtttcgaaacgcaatcagttagttaagacccaaaaaagaaggcttttaaatgaaggcacggcaaccctatcatctgtcatggcaactattgacagcagtcattatcattggtttcgtcatctttgtagaatattggccacatgtcactgacaacacactaatgggcggtgctttggtcagtggcggcctgtgtatcggcaccttacataaggcacatcaatcagcccaccacaaagaaaagtaatgtttgaaggcaacgaccagcaaaataagctgcagagtaacctgcaacttatcaacggattcaattaatttgtctagtttggcattttggcaagaaatgggcgtgcataattgactttcccgtgcacactggctagaacaccgggcacgagttccttaatgagatgatcttcggcaacaatcgaaaatggcggttcaagtttgtaggcggctgctttacgaaatccgaaccggccgaagaattgacgatcaccaatcgcactgacaaaatcgcggcgtagatcggttgcccgcatatcaagctcagagacaatggccgtgcctaaaccgctcccttgatacgccggtgcgactgctaacggccaaagtgctactccgttcatatgcgcatccggcgtaatcgttgccgccgtcatgagcccatagccgactaaatgtccatcaatcatggcaacgacttctaaagccgcttcataatcagtggttcgcctcaattctgctacgagcgctgcttcgtcatgatagccgcgcttactggcgctaaatgcggtatgcaataatgcgtctacatcagcaaaatcactctgctgtattcgtcggatggtcataagggtctcctttttagtgcttatttgtttgcttcacactgcttgaggggcgtttggggatcggcgcccaataaatgtgatttgcttttacctatcaaaaatcatgtctgacgcttcactatccacccgcacgtccagaaaagctactgttactcggacttgggatggtcgtttgatgcagcgtcagtttctttggacgcaccggctgtcgatgacgttgtgcttgacgatgattttgttcccggctgcttttgtttaggtgccgtcgcctcatccgggaagattaaggtgaaggtcgttcctgaacccaacttggaatccacctcaattgttccgccatgtaagcccattaattgatgaacaatggccataccaagtccggattcgccgtatttcgtatttttgcgtgatgggtcggctttgtaatagcgttcccagatattcttcatttgatctttggacatgccgataccggtatcactgacggtaaattcggtttggtgataccctaatttaccgccaatcgtaatctgcccgtttttggtgaattgaaccgcattttggacaatgttaaacagaatctggacaaaacgatcatggtcagcgtaggtcggtaattgggctggcgctttaatcgtaatggtatcgcctgcttcttcggccttttgcgttagctgctcggtaatgttgtcaagatctttacgggcattaaacgtgtgcttgcttaaaagaatctgattggtgcgaatcttttcgtaatcaaggttttcattgaccaatctaatcagccgattcgtttcattgcgcatcaattcgatacttttccctttgctttcttcagggatcgcatcgtaagccaacccttccaacaagccattaatcgttgtcagcggggtacgcatttcatgtgctgcatccgccatgaactgacgccggcgatcttcttgccgttggatttcctgttggcttgcttttaacgagttcaccatatcgcgaaaatcatccgctaattcggccacttcatcatggctgcggcttttcattttaacggtcacgtcataattaccttccgcaacctgatgcgtcgcctgacgtaactgattaatgcgacgaacctgataagaagcaatgaagtaactaatgatgaaagctgctaatgttgatagcacaaatgcgatcaacaaattgtgttcggttttgttaatcgaactttggatctgctctaccggcgcaaatgcagcaatgacaaataacagtttttcacttaagaaaaccggctgataataaatcgtcatgctttgtgcgctaccgctaatcggattcgtcatcatttccggcactgccactgctgatccctgcttcaactttttccaataactcgctttaatcgcagtcatccgacccttttgcgaaacgggatattttgcaacgttattcgcatcataaataacaaaatgaacatgctgatcactcaaaatttcttcggcattctgaataaaccgcgcattgatgacatacgtattttcgtcaaccgcgttatttttcaaaacatccgtatactgttcaagttgtttgaacccatttttccaaaccgtattggtggttgagcgaataaacagaatcgacacgatcaccagcgtcaccatgatgaccgaaaaaaaaccgattagctgttgataaagcattttcattgatcaagccccgaatcatcaaacttatacccaacgccccagactgtttgaatgatttgtggaccgactttttcaattttttgacgtaattttttgatatgcgcatcaacggttcgttcatcgccatagtattcatagtcccagaccagctgcagcagctgttcgcgtgagaaaacctgtttgggactcttggacaaggtatgcaacaaatcaaattctttgggcgttaacccttcgatctgtttgccgttcaaataggcttccctagtctttgtgctgagtttaaagtgatcggtttcaacatcaaacccgtctgctttagtttccggcgttgcttgttccgcgccagcttcggctccaacctcggcgcgccgatgcaaagccttaatccgcgcaattaatgtaatcggcgaaaacggcttggtgacataatcatcagcgccgagctctaaccccaaaacctgatcactttcggtatcacgcgcagttagcataattagcggcactgtttcgctaatttgccgaatttccttagccacctgcatcccgtccattttcggcagattcagatcaagcgtaatgatatcaaagctgtcaggtgcctctttgaatttcgccagtccttcttcaccatcataggcgttgacaacttcccatttttctttttggaagaacatggccatcatttcggccacacttgtattatcttcaatcattaatagtttcactgctgaatccctcatttcacagatctttaaaacctttacggcgtttaggccttggcgcatcatccggcgcaacataatcatacggcagcgcatcgtgtgcctccagataatgcttcagtcgactttcggtataaacaaaaccgggcaagaataacaaaacagccagaaaaagccagataataaaatagttatcccacgctaaccggtgaattgcccagccagcaagtccttcaacggcgcctgtggcaattaacgcctgataaaaccacctttgtgccaaccgaaaactatcagcgttgacactggcgagatacgatgtgtagccccacaggccggtttgatgacgcggtcgaaaaatagcaagaaggatgcccattagtaattgcatgcatcctgcaacaagtaagatcatagacatgcccccataaaaatagcttaaaacctaagtgtgcgtcagtacaatgataactgcaaatgttttgacaagtttaattataccgtggtaatatatcatttgcaccttcttgggggtgtaatggtctcgacattgcttttcgcgcatgcggtgcacctcggaggctcggctccgtcatcaacggaacagttaatataactgcaaagaacgaaaattcttacgctttagctgcttaataaccagctagcgtgatccttccgacttcgctcaagggtcgggtctgggtctcaaatcattgagctacggttgatgttgccacctgaggcatcaacaagagactagtaggttagctgccttgtgttagccttgtcggttggcgcgacatcgcagcgaattttaaataaatcggctatgggtgtagagccgcatgtagcaggggtgatggacaggagttcgattctcctcacctccacttatcattatcattagctttcatcggtgttcaaaatgccgatgtaacagcattttatgtttggcagatagtcgctgattatcattagttggtaacatcaggtaacatttaggtaacattttaatctgctaggcaggcggtggtcgtccattatggacggctattttttcgctttcagaaaattctatcgtctgctatactatggtgcgttacataaattttggaggcgaacaatatgattaaggaatttcgggactttattatgcgaggcaatgttcttgacttagccgttggtgttattgttgggggcgcttttacttctgtggtaacttcactgactaagaacttaataaatccaattatttcaatgtttgcaggaaagactgatttaagtggtctgtattttacactatttaatgccaagttcaagtacggtaacttcttgaacgatgtcattaacttcttgatagttgcatttgttgtcttccttcttgtcaaagccgtcaatcgaattatgcccgcaaagaagagcgatgttcccacagtatcaaaagaagagctgctgcttacacaaatacgtgacttgcttcaaaacagcaaatgattgcatacgtaatcctaagctgctaaggctgattattttacattctaatggttgtgtgtctataattaaattgtgcaatagatattcaatttaattgaaggaggaattattatgcattttctttgggctttaattgttggtgctattattggtgcaattgctggtgctatcactagcaaaggaaaatcgatgggctggtttgctaatatcatcgcagggttagtaggttctgctattggtgaagggcttttaggccattgggggccacaactagcaggaatggctttgattccatcaattatcggggcaattattgttgttgccgtagtctccttctttgttggcagatccaaagactgataggaggacaactttatggacgctttaaaagctgcatttaagtttatggttgctagtactctaatcgttggcggtgttttagttgcaggtacagtcttcgcagctaagggcattgataatgctggagataaactacaagaaaagctacatgactaacacaaaatagccacttcgctatgaggtggctatttttgtatccattgactaggttgactaggtgactatttgtcacttgcttcccataagcaggtcaatatttttgacttggatagcaagacacgaaattcggggcctgttagttgcttcaatattatcgagcgatcattgaatatcagagggggtcgtgttttgcgacccccatttatattgccagaacgaccatactcaaggcaaacttgttcagcttgcaccagaatgcgtctgtcagcacaacaacgagctgtgtatttacagatacacaccaaacatttcagttcaattagattgacctatttcgctatcgttttgaatgatagcagattataataggccattttgaaagacctgaaagtgggtttgagccacttagaacttttccagcacaacaagcaaacatctcagtgtgcttgagccattgagaactttttcagcacacaaaaaaacgggcatctctgcccgcttcgcccaatgatattgctactttagatgaaaaaaatgaaacaagtcaaggaaaactatgactatcgtatcagcgagggttgaggaaggtccttcacttgctacgagaaatcaatctgacttggtctataaaatgcgccaccggttagctatgccgtgcgtcggttaaaacggatctacccgcttatcgcctaggactatcctaattataagttaaaacttatttattggcaactggtttccctataatcgttgtccattgttttttggctgtgtccggtgtcagtttcacgatgtcgtactgctttccctgccattcaatgcaccatgagttaaggatagtttctggctgatcataccgaataacaaaggtcaccgtatcttcgagcttcgtcccaactgacgccttcacttcgcttaaatattggcttaacacaagtgcccatgtcgtgaagtgctctttcctgacgttgctcacaggaaccccatttacattacccatcgtgtagctcactaaagtaatgggttcatttagttggctgatgctatttaccagtggcatagtcaacaccccgcaattgctgaatcatgctcacaacgctatctggtacatacgttgccccatcgacaccacggttaatataccagtgttgtgctaacaacgagacagcaaagtcaaaacgaggatcatctccaaagttttcatccgtaagggtctggtcaaccgcgctaatcacgaactgctttgccgtcaacaagtaggctgacaacatagcatcatcttcgttgtggctaatgcgcagtgctctctttaaatcttctgtggtaacactcatgtgttcatctcctatataaaaataggggcgtaccctaaggcacacctccactaaattatgctgctggcgtggctgctaccggtgtaatgtcaacaattcgagcagcgtctggatcaaccacttcatagtcgttgcggatgacaacagccaagccttggctataactgtcgaaccgttcccactgggtgttgacttcgttcttttgggctaagaaaattgcttgagcaaagtccccgatgatgatccgataggtgcccgccttatcagtcggcaatactttgttagcaatcacgatcaccggcgccccaaatagttgcttgcctgatggtgccgtgatggacggttgtaacaagtagcggccttcgctgtctttcagggtatcaaggtagttgaaagcgtcctgattgacaataacagacaaggacaatgctgggtctagctcaatattgaaggttttcttgaggtcatcgagaccagtacctgtgatgtgcttgaagttatcgttggttcccgtcttgccagtcagaacactgataatgttgctattgtccgtgttttgtaccagcttcttgagttgattcttaacctcggcaacaatatcaacttcactgtcttctaccagttcattagacagataaatcttgccagcacggctagcaactttgtagtcaacgccacggaataggtttgaatcgatatctggaatgtctgcgagttctgcctttgtggctaagacaccattgttagtgagggcaatcgggtacgtgccgacgggggttccaacttgcttcacagtgacatatttagccagatcgtaatcagattcttttagatcgaatacgtcattgatgacttcttttggtacgaccgcaccagcagtggttgtcgttatgccgtcacgttgttcacccatgctgcggatgtagtcttcgtaagcgcgggattcggtatgttctttgttgtcgataatagttttttcggtcatggttttatctcctttttctggttgttcagtattagttttaagccactcagtgtagctgcgtttgtccacttggacgttggtatcgtcatacgctggaatagctaccagtgagacgtcaaacaagctctttacttgcttgatggtacggatcacttgcccgctgtcgtccttagtgaacgtgtcaccgtctggcgcagcattgaaagtaaaactcatggctgacagattaccagcttggacgttgttataggcatcgttggctgtggtcgtatcgggtaaggttgcttcaaactgcaagcctttatcatccacatttaaggtcaaggtgccggccttggtgctggctaagacttggctaaaatcatggtttgaaaccatatagacgtctgataagtccacatcatcgaaggcgtgcggatcaacaacttctttaaagccaccgaggtctttacttgggctattgaaaactactgcataaccacttagtttctttggactgctagtggtgtctttctgttgttgtgtgtctggatcgtcttggcctttgctgtcgtctgctttggcagttagaccagcgttaggattcagacgtttttctacgtcatcttgattcattttctggatcactcctttgtcttgtgttttgatagtttgtcaggttgcttagtggcgtgtagttcagactggccataatctcatctccaccggtaattggcggcaggtttaacttggctcgtgcttcattagtggtcagaacaccgccttgtagccccttaactgctagttcttgcatcgtggctgggtccgctgaaaacagcttgtcagtgttgaagctgtaccggttgtcacctgtggacagtttggcatccatctcacttgtgaagcaggtaaaatactgaatcagcgtgttttgcaagtacatcacgttagactgtacggcatttgagtgctcgctttcgatacccagccgatccagtggtaacccgaacgctttggcaatctgcttcgtggtccaatcgctagaattgactagattcagcacgtcagtattaacttcgagttgcttgtaatccatatcattgtccagaatgatggtctttagggcattatcaccactattggcagcttcaaatttattccggatgttttctttggccttactgtctagctgggtcttgttgactttaagaatgcctgtcccttgaacaccggtgttaaagaatcccttcagcaacgcatgcccagacttttgtaccccaacctcatcatggaggctataaagtggcgatattcctttgtaaccgtcttgtgtgaagcacttgaagtgtaagacctcgctggcatttaaacgctgtgagcgaccgctgtcaggcgtgtattcgtagctgataatgccggtcgtatcgtcttgtttaaccaccatctggctgttagggaccaactcgaagccagtaacttgtccgctgggattcttagtaacccgtgcaaagctgttaccattcagcagcatgttagcagctagggcaaacttgaatgcccacgcggtcatgtggtcattgggtgccttgttaagaagcacgctgatgcgcttgtcactgtattcaatcggattagttgcaagatcactggcaatcacgcgcacggccgtaaacacatccgaattacgtaaagcaccaattcccacatataggccgctgtcgttactggtcatgctgacaagcgcatctaagaacgggtcgctgttgtcatcgcgtggttgtgtcgcgctattcgtgaaaaagctcattgtttcacctccctttgttaaagttgataatgactgcgacagagatcaaggtcgtgccgactgctaacataccaacgccaaacccgaacagccaccagatcccgacaaccatacagatcagtcccagtagtaatagcacggtctgcacattaaaaactaaagtcatcgctcgaataaaagtcattgtctgccacctcgctttccttgttttgatccattgcaattgtgtaggcattcatcagtgcggctacggggtcaatcttcgtagcgttgtgggccttatcgataattggattgttgttagcgtcatatttcagaattgcgttgttcaccgcataggccagtaactgattatcagggtgctttaactggccattgaagagatcatcacgaaaacgagttgtcggaattgaaagtgttctaacaccttgtcgcacctcaagcagtggcaaatcgcgtttttcaaattctggaatcaggtagcccatggcgaagggatcataacagatggcacgcacgttccactggttccgctcgatcatgtcgagaatgaagcgtagcacctcgtcatagtcgatcatgccgctatcaagtttggtaatgctacattcgccgcgactagcaccactgatgtaatcgaacccgtcacgcttgattttctcttccagtccgtacttcgtccccacgaatgagtggctgtcggcatacaggtagccatcttctggaactaaccacgagatactggtcaggtcgctagacttagagagatccagcccgatatacacgtccttgcccatagtgtctggtggctcgataatggctttctcccagtcgtccagactgatgtaactgtctgctctggctgattgccacatgttgaagttcttgacgagaattggccgcaacgttccttgcttggctgctagatcaacatcagcttgcaagctaggtcgcatcgtcttcgctctttcagtattagccagtagtggatttgacttctcccaagtctctggtacaaaggcttcatccttgctatcctgttcaaaaatggcaataaaataccgatctgcttgttcgcgaccggttaagactttggagacaaatttatattctttatacatagggccattcaggtctggccccgtggtcgagatgacggctagtaaactgttgtcgctgttgatctggccggattttagtgttcgtagaatctcatcagtacgagctaaggcgaactcatcaataatggccaagtcactttgataaccatctaagctatgcagatcagacgcaagcggaacagctcggctgttgctcggcaagtcgataatttcgttgcgattgatcttcaaacgatcgcgcaccgatttggacatcttggagacctgacgcaaaccactagacagcatatcaaaagccaaatgtgcttgagcgttgctattggctgtgtagacgatttcgcggttcatggctggtttgttctccatgaggagataaagtgcacctagatcagccgtcaggaagctcttaccattcttgcgcgccatgctgatgtaggctcgatcataacgacgattgccggtttctttgtctctccacccgaaaagctctgagatcaaatatttttggaaaagttctagcttgagtggtgatccatcacgtgccggcatcagttcgataaactcaacggctttgttggcaaagtcctcatcaaagtaatacggccatggattctttttgcgcttgctggctttcaagtctctgcgataacgtcttgctgcttgcttaatctttttgccggcaacaatctcaccacttagcaccttgtcggtatattcagtcgcatagttcacgatgacaccagctccgcgaacggatcgtcaggcttcttcttagtctcactcttcaaggcaagtttcgcccggctatacactgacaatcccaatacttcgtcaatgcgcatcatttgatttgtggcatcgagcttcattttaactgctgggttagctttcacactatcggtggtttcaaccatcatgccttgtttttgaattagctcggcagctttctgaatgtcagaataggcttggcaatgactggcaatcagggcggcatctagttcactcactggaatgtcttttttgagcaatggtacaatacggtgccactcggtcacagcatagtcatcaagccatgtagggggctgtacttgcaattctttgtaagtgaacagtgctttttcagaggcaacacgatcagctaactgttttttggataaatgtgcacttaggttagtcactgattttaggggtgctcccatgtgtaacgtcctttctgaatttgtattcgtttatacctattataattataacacattgattatacctatgttctatgattttcggtattcatcgaaaagaaaagaggccgaccgttcttttgctctaaaatttgagggcgggggtcgatctgtcgggggatctcatccggcgttgtgctacctcccgtgcggtcttagcgttatgacaagtctggcacaagctttgtaaattgctctcatcaagcctgtgttgccaaccataagctgttttgattggctcaatatgatcaacaagcacagcttgacgaataatcccacgtttcaaacagctagcacaagttggattgcgcaacctgaatgactttgaaagctttgtccatgttgttgacttgtagaaacgtaattccttctcttcgtattgcatgcgttcctgattcgtcgcttgtttgctcttgtcttgcttatgctcctcgcaaaagcgttgattgaacgggatcatgcgacggcacccggggtgcatgcaaatgtgcaaaggcacactcatttgcatcacttcgctttcatctcggccttgggggttcttaatatctcttatccttgacgagatcaatcatgcggtcaattgaactaatagtgtcacttgctgaggagcaaagttcatggtatgcaatgtggctaatgcttccatatgaagatcgtgtcaatagattaacgtgtgagaattgaaaaccatctgacatttcaaacgttggatatacttcaatttcatagccttcacgttgcttaacaatgatgaaccaatcttttggtgtcatgctacgaactaagtagcgttcttttacaagcgccccaagttcagcccatttgtctcgatcgtgtttaacgtctacaagtgctgctttgcgatatgctgtttttgtcatttcaatttctccttgtgggtagttttaaacttgcttgtctttgacgtggtccacgtggtccacccgggcaaacgctgatatgccggcgttttgaattgcaacgcacgtggtccatacccggtccacacccggtccagtttcttagctgtaaacggtggaccacgcatggaccacgtttagcccacgtatacaaaactcgcaatccattgctgtgcgtgggattgaccacgtggaccacgtggaccacgttagaaacgagaaaactatgtccgtacataaccatgtggtctgtttccgttgacgcgcagcctttgtgcttgccagccttccatgttgtccataatgagcttaatacgttttgcatcagagtttgtgcgccccatcaggtaacgatcgactgacttgtcgaacaccacttccatgatctctctagtggtggtttgttgcagtggttgtaattctccagcatccaagtgctgttgtaaccaagtggccacatcaccgttatggtcaatatgagtgtgaaagaagctggcctttaggctcaatgacagattttcccaattcgatggcactttcatgttgagaaagtcttcaatggcctctttcatagggtcaacggtctctgcttcttgttgatatggtttagccagttgcatcagcttatcatcagcaaagacactctcacctgcatccacccatgttttgacctctgccagtatctgatgtatatcgtggttaatcttaggcacgctttcttcattgcgccatacggtctttgtgggctttgtaacgccgcatctgatagggaagaaacggcgttcaccagtagcgtctttcaagtagtcctgttgattagtgctgccaatgaacacacacttgcgtaaatgtggataaacataatggctataactccctcggtatgaatcagactgggcgctaatgaaactcttagccgactcaatctcagtttttttcattgcagaaagttcaccgagttccatgatccagttaccttgcagcttcttataatcttcgtccgttttgcccattgattttaatgaatcgctgaactttttcgggaacaagttacgagcagccgtgctcttaccaagtccttgtttaccttcaagaattggaacgagttcaaacttgcaacccggctgatagacacgttttacagccccagctaaccatttacgagtaacagcacgggtatattcactatcctcggcacctagatagtcgatgaagtaacgttctgctctaggggtaccgtcccattgctcagcttcgatccagtctttaaccggattaattgaatgttccttgccaacaacaaccatggcatcttgctcattctgcttgctaaacaagagattgtgcttacgctccatatatgagcggacgacagcgtcatcttcatcagtccagaaacctttacgaatcggcaatcctttaacgccttttgtcttgatgagcatctctgaaaagtcgtcccaagcaacgacattggcgaaggttggatcattttcaagtagcagttgaatattaaccactgaatcttttctaatcccaccattgccatcaagtttaaggtcatttcgccattgctcttgacctgtaaaatcaacgttgaccactttctttgcttcttgcttaatatcttcgggcatcgttttaaccaaccgcacgcctcctctcttcggctttcaatactgacttgaaaatcttattaacttcggcttctgccagtggtgtatctaaatagttatcattagttgtaaacagcaagttataaactgtctgcggctctgcgcctgtgaagaacattttgccagcaatcttagtcagaaaatcattgcgattgccggtactagcgccgtttactatttcatctagcagcttgcctgtccatcgtttgcctcgataaactgttgaaccaccaaaccctaggttagggtggctgacacgttggatttcatctagtaaccacttaggtgctggggctaatttggtgatcttgtgccctttgagtggttgatacatgccgttctcgcgaatgctagggaaaaccggcactccagttgcaacatagtcaaggccggttttctcgccattctttgagaacaaatccgatcgactagttagtttcaattccttgggataggtgaagaaaatatgaagtccaccgtttggcgttgtttctatataggtagaaggaatttgatcagcacgaccctcagcgctcaatttagccaacgactcattgccattagcctcgcttttatgccccatatcgatatcgaataccagcacgccatcaagccctaagccgatattgtaattaggatgttcgccccaccattttttggcctgttctgggtctttggtggcatctttgtacccatgcgaaccagtaagtggtgttcgtgtctctggcgcaagtggatagactgaaaagccatgctgctgataaccaagcgctactttaagcacgtcgaccatcggcagcatctccctccataagtagacggcgagcatcaataatcatgtcagcgactgtgtcggccagtgctgattgctgttcatcgttgatctgatgtcgcaagatattcaccattgcacttgtatcactcaaaagtgcctgtgcggttgtatagtaatcttccttcatcatttgtttacctcatcaatcgttgccaagctgctatcaacgtattcttgaattgttctcaggagcgccatccatgtataaaatgatcgattcgtaccgtatgccaagattgcagcatttttttcattacgatcgtttcgatatgaaattacagagccttccatagtgtcgaattcatcactaagagcttctagaagtccttttgcagtgcttaggttataagacgccattcctaaatcaggcgctttggtgctgtttgaaacattttttatcataattgcctccattttccttgacaaagtaaccaattcgaggcaagctaaaagtcgatatagattttttcgcttgtcttcttctcgccttgagttgccgctcttgacgatttttttgtggcctcaattagtgagcgtttttcggcttttttagctgcccaataccgatcacaatcagcgtcagcttggacgtagtcatgccactgccagccaaattttgtgctaaccctttgtgccatgacgatcgtcctccgagaattgagcataggcaccacagacagctccaaccatgaaagccatacagagcgccggaacaatgagcgggtggcttagtagccacgtaataatgctaatcatcagcatcatcctcgttttcatacatctttaggatttccgatacccgcagcagctcttttgcagtcgtaacggccaactcgctattgggaatatacttgccatcaaccgtgacagtactgtcttctgcaatgccatgaacgttaagctgaatgtcgtcaatcaaatttccaagctcgtgatctagtgctatctcttctttactaaacaaattcataatgtttcctttctggctttatgttcctgtcataagttacttacaattttccgcctgcccagcgtgattacttgccgtggttattcatgtaatcgtctatgtctgcggtattgatccgcttaacgccaccaaccacttgcatcggcaaaccttttctagtccaagacaacagtgtgttacgagccacaccggcataaaccgctgcttgaccgatgttcagctttttaggctcatcatgttgtggtgcaagcttgctaactgcttggatcacttcctgatgaatacgatcttgtagctgcttatcgaagtcttctgacaatactagttctgctttcatgtatattcactcttttccgatgaactgttaagttgttaattaaccttaaatctggttacttaacaacataataatgcacctttcttttatgtcagtcaataggctatttgaaaacttttatagtcacacgacttcaaattttgtataattggccgtgaggtgacgaatatgcttcaaaatagacttaatgttttaattgctcaaaagggatattcaattaaaaaagttcatgatgatactgggttgtcaagaacaactatttcaaatttggtcaacaatgttggcggtggcattcagtcggtaacgctcaatagactgtgtttatatttcggtataactccagctgatttttttgattttgtaccgtttgatctatcttatgatgctgttgctgacaagctttccgcactgaatatagtttctgaaagcgacgacccaggtgggagttttttcaatttaattatttcagctgataacggacagctatctgtgaataaatactattttagagttggggtattcttttttaataaaggcctgagcgatcctcaggattataaggtaccgtattcggcttatgtatacgtcgctgggtggtcacaagacaagcaccaagaagaagcgttgcaatttaaacgaatgtatttcgataaaatgcctgcagcatttcaagaacagttttatacttcatgcacccagcacattgtcgaatatgtctcgcttagtcttgcacccaaacgccttattttcgaagccgacagtgattataagatgattgttaatcttccatacggacgtactgtagaagcatctattattccaaaataataaatccaatatcatggccgaaaaatcggccgccaccttttcgccattttcggcgaaaactctccaatctaacaccgcctgcccagcgtgacggataggagaagaatatggcaattaagaaagtcaagcttaagtctggtgcagttcgctaccgcgtaacggtcaatgctgggcttgttgctggaaaacgcaagaatattgttcgcaatgttcaaagcatgcaaaaagcacgtctactagagtcaaaactcaagctagacgtggctaatggtttatatgatgaagaagacactaccccaccggttcatacctttagtgatttgtacaatcagtggtggccgatctatgttcaaactgtggaaggaagtacagcctataagactaagcaacttttccataaccacttgatccctatgtttggttctaaaactctcaccgcgataaaaaccggcagcattcaaagtgctgtcagtcagtggcgagaaacaaccaccaaggcatacaaggaacgtttcatttatttgaaaaagatactctcatttgctgttaagatgcagtacatcgaaaagaaccccgcagacggtgtcgaattgccacgcggggtacgatctggaaagtcaccagtgtactgggataacaagcaagtcgcccgattcctaacttgcattgatcctaataacgatccagaaaagtacacaatgtttctgctgatggttagcaccggtatcaggcgtgaagaactatgcgccctgaacgtatcagatgttaatttcaaaacgtccacactgtcaatcaataaagcctatgcaactggtctgaatggtaaggaatcaattaaaggcaccaagtcaaccgcgggtatgcgcacaataccattaaccccgaaagtgacaatacagcttaaaaagtggatagcattacttgacacaagcaagattatcagcattcgagatgatcggccactgttcccatctccacaacactttgaaaaacgtttaggcattaacaggcctaacaagtggctgaaagatattattgaagcaaaccaccttacacctcgcatcacattgcacggtctgcgtaagtcttttgtaacgaatatgattcgcagcggtgttgatgtttcgactgtacagcggcttgccggtcactctacgcccgatgtgacgcttcgcatatatgctggcatgaatcagtcggatgctcgagaaggcatcgaaaagttagcagattatatggaacaggtaacattttaggtaacatttggagtaaggccaccgcacaaatgctgttatatcagcggttaaggctaatggagttggagactcctcacctccattttgaccctttttcttgtttctggttagtcccgaaatgctgttaaatcagcgtttcggggctttttattttgtgctgtttaggggtgtttttgaagtgaagtgcacaaaaagtgtacgtttagtgtccgatcttagctgttgaaatcccctattcaaagtgagttcagtccataagaatctcacttaacgtgaccaaataaacttcacctttaaccagttacatttgttaaaatacggatattaaacgaaagaaagaaatcatcaaccttcgccattgtttttgtgccagctatgacccaccgcaactctagaaaggaatgtcaaacttgaaaaaagccaaccatttaccactcagtatcataacaattgttgctggcagcctcagcatcattgccggcgctatgaatcttgcttcaggcatcttactactggtgaaaagccgccattcgccatcataaattgttgaatggcgacaatcaaatatcatgaaatgaaaaaagcccgttgcaacgagcttttttttgttattgttcaaatttcaaactaggcgattaactaaacccgagccgcgtagtaacgtctcaagcatgtccaaccttctgctgcttgcgagtctcaggttgatgcttgccggttttggttgctgtcaccccgtcaaaagtcaataaggccgattgatagtcaccgatcaattgggcttgttgccggttagcgccattgaattggatcggtaagcgaacgccaacccgctgcaagacatcaccggaaaccggcccagtgtgaccgtttacccaataacgttggtttggctgggcaaccggtatcttcatatactgcacggcgcggctgtctgcatcggcaaggacgcggaagaagcctaagactaaacgcttgcgggaatgatcgcttagcagccatgctacttgattctggctgttggattgacgtggcaaaagcagccgaaaatcaccatttaagactaatggttgtaattcatgataataagcaatttggtttttgattgctgccaatgccgcatcatccagtttggttaaatccaattcatagccgagaatgccaaatgctgccacacgaaatcgcgtagccaacggtgtggagcgtccgacttgttcattcggtatcgccgtcacgtgattgctcatacaacttaacggataagccagtgcggttcctgattgaattgccaaccgttcgatcgcatcagaatcatcactggtccagatttgcggactataaaagagaatccccaaatcaaagcgcccgccaccaccagcacagccttcaatcagcaggtggggaaaggccgtgagcagcttttgatagagggtatagacgccttgtacatagcgatggaagaattcaccttgaggatgcccaatttttgccaggtagggtgaataggcttcggtaatactgcgattgagatcccacttcacataatcaagcttggtttcggtaataacgcgttgcatttgcgcaaaaatattattcacgaccgctggattactaaagtccagaacatattgatgacgcgtgatcgacattcggccgcgcttgggacggaccacccaatccggatgttccttgaaaaattgcgatcgaggcgataccatttccggttcaaaccacaggccaaactgaaggccgaggccatgaatttcctcagcaaaatgccctaagccatccggaaacttatgcttatttgtgaaccaatcccccaatgaacttaaatcattatcacgggtaccaaaccagccatcatcaagaacaaaacagtcaacccccacctgacgtcccaatttagccagatgcagcaacttttgttcattcaagtcaaaataggtcgcttcccaactgttcaaaacaaccggacgcggcttttggcgccattgcgggtcaataatatgccgggccacaaaacgctgattgacttgggataaaccagctagtcccgctgaactaaagcttaagaccacttcaggggtagtaaaactggttttcggatctagtcgccagctaaaagaagccggatgaatgccagccaaaagccgcgtctgatcccattcattaacttcaatgctatccagaaagttccccgaatagactaagttcgcaccgtaagcatcgccaacagcaaagggttgtccggctgcgtgcaatgcgacgaacggattttgttcatgactcgatgccccgcgcaaagattccactgaaaacgttccttgcgtcaaaggctgtgtctgaatatgccgctctttggcccagttacctgacaagtgaacaacatcataacggccttggggtaaattcagcgccccgctcaacatccgctcaatcataaccggctcagcaccttggttcgtcaaagtagctacccgaacgaccgtggcactatccgaaaaaatcgtatactgcagcgttaataataactgcgccgtttcatcttcaaggtgaattgtcaaaatatcggtcagggctggattaccaaagctcgttggatgatgcaaatcccgcattttggtgtgactcacctgataatctttaaacacaaaattcggatacacgggtgcgtctgcttgggtcacacttaaactgccttgccgaaaatcgccagttccataaaccggatactcctgttgcgcatcacctaatgcaaacggctgatcgtcggaaaagttagccatccacgcaaacggactggaaccttgcgatagataggtcaaatcagcagtcgtcaacgataatcttgggccaaaatagagatggcccaactgaccatttggcaataacgcacaaatatagctgatcttttgattatataaatgaaaagcatgatcgtcagtaacatcgatcaattagggtctcctttccgcgataaatatcacctttgttatagcatataaactgttttgatgtacctttctataagtggcattctgccgtcagcatcggtgtgacaaaaataccgttttcgttaaggcttggttcgacccattaagcagatcgcgccaaatggcaaaataaaaacgaacttcccatcgaaagaaaagttcgcctttggttagcttattctgtggcttaccgttcaggatcccaaccagcaatatcctgctgcgtaaaagcataggataacggtttgccataagcggctgcatacgcttgacatttttgggcataatcacgctgcatcatgtaaaaactattgtcgcgcgccgaaagctgcggatccggataaattggatcaagaacatgcaaaatataacggacttcgcgcagttgctgattctcgcggactggcagatcacgaatttccgtaaaacaggagataatcggaacgcccgcctcggcagcatagaaataagcgccgcgcttaggtggtcgtggtttacgataattgaaccacatttcctgttcaggatagatcaacacccagtgatggcccgcaaacgccgcatttaacatttgtttaaacggaccatttaagaaactggggcgtccggacagcggaatcgtatcatcatagttcatcacaaagcctagcagccctttcattgccaagtttgtatcctgactgacaatatacatgcggtgccgtcctgccagatgcacggctttacgcacggccatattttcaaatgggctgaaatgattgcttgtaatcacaccgccacttttgatgccccgaattttatcgaccccgactacttcaacatctttggtcacctgtaacgcataggcattaacgaccaagcgacaaaccagtgtcttgagcttaaacagcttgtcctgacgctgttgtaagtaatgtgtcacaatccgctgctcctccgacttggaaaacaccggatcatgttcttcaactttaatattaaacgctttagccgccaccgcacgccgaatattgccaacaacttccgcgcgatccggaccgacaaaccggcccgatttcatagcgccacctgctcgccatgtttaacggcattcaaaattgtattctccgtgtggcaaacatcaatagccgtctgcaacatcccactcatactttgccgatcagcctgctgatccgccaacgtaaatgctgccaactgctgcttcagttccgcctcaaatcccgaatccggtgcataccgccaaaagcgatcgcctaatttagcatgatgataatgccaaggcttgccaaacaaattatagtgaatcaactttccaccagcttctgcagccgcagggactccggtttgcatattccagagtttcggtaaatatttgatgcgatgttgtgcgatgacattgatataatcctggtcggcagcaatcatcgtaaagtggtaagtcttcaacaagtgcaagaaccgatcggaaaaatgctcctgacgcatctgcgcaagattcatcaccaaaacaccggaattaatatacttacctggctgaatgccgaaatcgcgttgaatgtaagtcatggtttccggataagtcatcattaccggatcagccacaccggcaactaggttatcacctaaatccgttgcaaacaaagtggtcaagtcgtcttctgccaccgtatccgcatcaatataaatcgctttgtcatactgtggaaacatatccgcgataaacaaacgaaaataaatggtcatggtcacgtaatcaccgcgcagtttgtttgtatcaccactgatttgtcgcgtgaccttatccatcgcgataaagcgaatgtcaaaattggatgtccctaaagcagccaaccgcttttgattggcgggtaataagccattattaagaatattgatttcaaaattaacgcgtggatttttatttgcccgaatcgaagtcaaagcaacggccagacaagggacgtagccatcatcgacggaaaagaaaattggaaccgtagttggagttggcatttaggacacttctttcaatttaggtgctagccggcgatagtctttcagcaaatcatcatattcatgcaatcctagctgctgatgaacggcatgaatctgccacggcttgaccgtcacaatgcgaaaacgcggccaaaagcgaaacgatgtcgtaaagtgctgaaaaaccgtatccggctcaagcttatgctgctcattgtattttggcggcagaatccgtttacacttggccagcttatttaaggcactctgatccggcataaacagccaccgctgctgtaacaactgacgacagcgcgctaataaaccatctgcgcgaattctagcaagattcatcagcaaaacgccggaattgagataatcaaaccacatcaaccggtgatgaaaccaccatttgccatagtggtccaacgcgccggcaatatcaacaccagtcatggactcatggtaaaacgcagcaaatggccgccgacaaatgacatcggtgtccagataaagcatgcgatccggtaactgtggcaccaaatcggcatacaaccgtaacatacaataaggcgtaaacatcgttgttagattagcgcgcggcggatttgcctcaaacaaattcgttatatcaattcgcgtgaactgatgcactgggttttctttttgcatcaacttggtcatttgcgcggcggtcgcaactggaaacggcttataacgatgatcgttaactgtcagtgtcgcggtcaaaacaaagatatgcagcggctcacgcgtttgccgcatcaaggataaggttgcaagcaaaacaccatcggtcatgttggcatcaccgcaaaataaaatattcatggtcacggttgcgcctccttttgctgctgatagtgaatataggcaacgttgctcaatttagctcgcttcttcattacggtccggactgtggttgctaactgtttttggcgcatttttaatggcagctgctgatccggccaataaggaccatcgacatacaaaatgcgtttaggccgaggccaccagtgtcgccgttgataagtcatggtggtgacaaatacgggtgcatttagttcagccggataatgaaatgcaccggactcaaacgggcggataccggtataatatggccaaacgtgagcctccggatagatcatcacaacttgtttggccgcaattaaccgtttgatttcagtattaaaggcgcgtagttggtgcaactgtttggggactaatagaccaccgccgtatggaaccaaccgtccaagaatcgggacactcaaatttgccggtgccgctaatgtcgccacccgtcgcgcctgattaacgcgcatcggcgtaaaaacatccccaaatggctgcgtgtggttgccataaacaaagtaaccgcgaccggctgcctggcgtaaaacgctgcgatgacgcacctgcaccccgatgcggcaatacccctgagcaaacagccacgcaccggcataaaccagatcggccttgaagcgaaaacccaacgtcggcttccaacagtaattagcaggaagccgatctttttgattaggggcagtcacaatatcatcggttagtcgctgataagtcacaacttttaccacgcaaagcccctcttcctgtcgacaatgtgcgttatgccgctttttccgctcgccgcagcctccgcaatataaagagtgtggcaatccacacaattgcgaagatcagcgccgataacattgcgcgatcaaacatcatgatcactgcggttaatagcagaaaacccagcacgagataatcggcaaatgggtacaagggcatccgaaagtcggtactgtggggatgcaacttcttgtaccgcaaatgtgccaacatgatcatgccccaaacaaacagaaaactgatcgttgccatacttgaaaccagcgtgaaaaccgagccggggagaaaaaggttcaagacaaccgctacggcaatgacaccggttgagactagaatcgcccgggctggcacctggcgtcgtgaaagtttggcagtccactgcgctgattgactttttccgttcaacgttagcgaaaataataaccgccctgtgctaaaaatagatgaattacaagccgaggccgccgcggttaataccacaaagttaataatatcggccgcaaacggaatccccacattattaaagacttcaacaaacgggctgttaaccggggagacatgccgccatggataaatacacatgatgacaaacaaggcccccacataaaacagcaaaatccgcattggaatttcattgatcgcttccggaatcaccttatgcggatttttggtctcactagcagtcaagccgaccatttcaatgccgacaaaactaaacacaaccatctgcagcgacatgagaaaaccgccaacgcctttagggaaaaagccgccatcgttaacaagattgtcaagactggcatgaccaagtggcgttttaaagcgaacaattaccatgaagatgcccaaaacaatgagtccaatgatggccacaattttaatcaaggcaaaccagaattcggcttctccgaacaatccgacactgaccagattcaacaacaacaagatcgctaaagcaattaaaccgggtagccactgcggcacatcaggcaaccagaaccgaatatataatccaatcgccgtcacttcagccatcgcaagtgctacccagcatatccagtaagtccagccagtcacccatccggcatccttacccaagtattttgtgatgaaatcaataaaagtatgtgaatccacatcagacatcaacaactcgcctaatgcgcgcattagcaaaaagcaaatgccaccagttattaaataagcaaataaaatggacggtcctgccgagtgaatcgattgaccagagcccaaaaacaagccagtcccaatcgtgccgcctattgcaatcagttgaacatggcgactcttcaaatgacgtgctagttcaggccgatcatctttttcggcttgcatactcatcctcctttaaaagcataaaacagtcttgaaacttatttttcatcttgtttcaacggcgcgaaccaagcttaaaactaatcattgtctgactatccttgtgtcacacttattaatagagacggccaaaatagttgttgccgtctgaataatagcatgcggtattagaaaaattatacaccattttcagaaaaccccaaatcattcacacctaatcgtcaatactaatgcggtcaggcggcatcttgtcagctaaaaatgcgttaatggtcggcggatcctgacgaaactgcaattttaacaccgtcagatttcccgcctgtgccaacaaaaccgttcctttaggctgagcttgtaagacaaccccggtcagattctgatacatgcgaatactacccaaaccaccaatgatagcgggatcagctaaacctttttgccagcttgcaaaacaaagaaacatgacaacaatgaacccgccgctgatcaagtcgtcaaaggaacggctttgttgcaaggttaacaccagactaaacgccgcaactgccagatataaaagaatacgccatgctttcggacgcgctcgtatccgtacctgcacaatgtcaaaaatcgtgacgccgacagcaacaatggcaatgagtacgtaagcaatactcaataacgacataaccaacctcctgtttataactatctattctacctgattgttccccaaaaagcagaaaatgccctttgaagaatcgtctcggtagcttattttgagtcaaaaatagacgccagttttctgacgtctaacgattcatttctaacaatcagcaataggcaggattgatttttccctttaagagccagcttagcgatgatcccactcgccacattgtatcgccggaacctgacgcaattccgcatagtcttcacagacaagccgccgcgccctattgtgcaatattggcggcagcccagtctttaacctttgcaatgaaggcggcgaatgcctcacgatcattcaagttcgggaactgaccgagtaagacttgtttagcgcgcttcacgtcctgacttggcttttgaagaatcagcaggctcttttctgcttgcttatcggcaaaaaaatcatctggcaaattaagcaagccttggaagtaagttttttccgccagccatgcggttaaaccggcagcttcttcggactgaaagacccgacttggtacataaaacatccccaatccgcctggtttcaatactttcatgctttgttcaatgagcaaatgatgcgcatatgaatgaccctttttggctgcagtcgcaaatttctttgcccgttcatctacagggtaataccccaccggcaaatcggagaccaccacatcaatatccttaaataaaagcccatccagtgcatcttgatgaaacagttcaacgtccaggtgttgtaagctactgctcatcccggcaaccgccaacaaggcctcgtcattatcaacaccgtaaccttttaccgtaacgttacgtgctttgtgtagttgattcatcactgcaaacaacaagttcccgcttccaactgccaagtccgccactttgagttggttcggttgctgctgatcaaaaacggtcgccataaaggttgcaagactggccatggcatccggtgtgatctgtttattgggttcaatgccatcaactttgatggctttaaccagtaccagctgcaaagcctgccgtatttcttccggttcatatgttgccaacttcacctgaccaaacaaagcttccagtttcttcttagcttcatcattaggcaacccatcttcttgcatcacttcaccagaagaaagatcttcgccagcttcagtaattgccgcaatatcagtagatttcaactgctgatgcaaaatcgtggtgctttcatccaaaacatgataaagcttctcaagatgttcattcgccacaaagacaaccccctaaataaagtgagcgcgaaccggcgcgcttagaagtcggagtgtaagcagcctcaggcgtgatggccgcactttggccattgcgactgaggttcttacacgcagacttctgcgccggtgagcgcgttatgattgagcgcgaaccggcgcgcttagggatcgagtgtaagtggccttgggcgtgatggcccgatcttggccattgcgaccaaggtccttacatgcagatccctgcgccggtgagcgcgttatggttgaagccgcgcatcatcatgaccatatacggccaataagcattttattgggagtctgctgctaacgcgccccttcaacgctccatttaccagtgtaccgattggaaataccttattcaagcgggatcattctttaacctagggcaccgatttggtatctgtctcactgaccgtcttttcaaccactggcattgacctcgttggactgacacttacttcactcgcctgactagatttcaagctcgcactgtcagctgtttctgacttatcatgatggttgactccttccgcattttgccgccactgcgaataagccgacttaaactgggacttttcgacttgcttaataatttgataatgctgctgccagcggttaaactgcttaaacatcccaattgtcatcgtcaaaaatataccgaataaaatgatggtattaaccagcacacttccacgtaatttcattgattaagccgcaccccgccttcaaaagtctggttagtacccaatcttatctcatacaaaaagccatgaacggaccccaaaaattggccggacttgatttgcataaataatggaatatggcccccatcattggttctagcgcgaatcatactgttgccatttttggtataaaactcaaaaacataaaatttcgattgatgaccatcttttccctgaagcctgacccgtttctgtttaagcgactcgagtttcatccgatgggtccgcacattagcctgtaagtctgcatctgcttgcagtgcatgcagtaaatattgatcttgatttgtaaaacgttgaacgcctgtcaaaagcggcgaccaaagcaacatcaccgcgactatgattcctaatccaatcacaacttcgatcaaggtgaaggcgctaagggttaaaggtatagctggccgtcgagttattggcatcaacccgaacctcctttgcgctcaccactaccttccaaacatcagggccaacgctaacctgagtttccccaccacgcgcaggcacccgcattaaagcaacgcgagcggcatagtaagcagtggtttcttgtcggacaggtatgacaacttgctgataagtcctcatcaataacgccaaccaacccacagccatgagaaccacgcccaaagccgcaagatgttcgactaacaacaccccacttaatttttggtcaatattgctcgcccccatcctagctgaaaacttatcttccaagtaatgtctttaaaatgtctgaaatataacgatcctgccgtgactatttttccgtttgggttacattccatcctactttcaccaccaaatgccaatgattcagggaaagcaaggatctttgtcttgccttgagtcacgaatctaacttcccttttttcaccattcacatacatattgccacttgatggttcagctcttgcccgcattttaagcatttcccattcttccaccaaggcttccataaattcacgttcgcggtattgcgttaaaacatttcggccaaccgggaccgcaacgattgctaatgcagttatgacaaacatgacagccacgacttcaatcaaggtaaaaccatgtagccgtttcatttgctaaacgtcggtggtgatcctgctgtcagcttaaacccgccttttttaagggtgtctgcctggctttgtgaaatcacgtcttttttaactaattgatccggagaactaaaatcaaccccgccgtgatctggctcattgtaagtcatttccaactgggtgttgaccgtcgccacggttgctttcaggttctgagtatcaacacgtttcatctggccctgaatggtcaaaaccagcgcgagcgtcagtagaataatgactcccagcgccgcaactacttcaattaaggtaaatgcgcgcaacttttttcgtttcatgcttaaccccctatagattgataaagtggtaataagatttgtaaatacaccagtaaaatctctccgccgatgattagaaacaaaaacggctgtaccaagctcaccagtcgttccaattgttgttgaagccgcgagaaaagctgttcaccaaaaagttttaacccggttgcgaccaaatgatgcgattggcccatggttagcaaacgggcaacttcagcgggaatcaacggctcttgaagcgccacacttaattcgtatccctgttgaaccttcgcctgaatgcggatgcctaatttccccatcggtccgtctaaggttgctaagtgctggcaaaagttggcaatatctgcacctgccaacaaaaattgagccgctcctgctgtaaactgaaactgataataggttcgtagcagttggcgcatccccgggacgttctgtaacaccagtagacgtttgagcggcgacaaacgatgccagtagcagtaacccaagaatccaatcactgtcaccacgcccaacccaatcaattgaagcgcgactaaattcgactgtggtaaagaaagcgccggaagaacgccaaaaacaacgacaatctgtaagaccaccagcattgccaataacagacacggataaaccagcaactgtacaatgcgttgccgattgcgaacccgtaagtgaagataatccgccgcaatcgtcaacgctttcgctaagtcaccatgaacctgagccaactgcaattgttggaaaagaatcggtgccagatcctggcgcgcaactgcatccgaaaaggctatgccgttagccaattcattttcaattccttgccaaatcgcggtgtgtttaggcaaactcacttgcaaataggcgaatacgtcactcagattgaaacccgccttcattaaggctgcactttgacgacaaaaacgttcctgaacgatcagaggcactttcacgaaaccacctccgttgcaccgctttgatgcgccggctcaaaaacaaccacttcagctaccggatgaatcgttggacgatactgcaacgtgattgcggcactggctgttaaggcggcagaaaccaattcggcaggtaagccaaagctagtcagtctcagtggggtgtcgttggccgaacgtgcgtgcacggtcgcaagcacaatatgaccgctaatggcagcttcacaggcgctctgggcggtttgccgatcgcggatttcaccaatcagcaatacatccgggcgatgacgtaaagcggcctttaacaactgcggataactcatttccgcttctgggttaacctgaagttgcagaaactggggctgattaatttcgacaggatcctcgatagacagcaccattttcgaggcggccaagcgagttgcaagctggtacagtaacgttgttttacccgatccggttgggccagccaatgtcaacatgcctcggcgttgcgtcaaaatactcattaatcgatccaacaactgacgtgcaccctgcgcatctggaataccactgatcagtcgcaccaccaatgattcgcggccccgaaaatctgccaccgagcttaaacgcagaaaaacatcagagtccggatgataaaatgcgcctaactggacacggcgatgctctgcaacattcatcccagccatgaacttcagataattaatctcttgctgacctatgcgcgtttccagttgccctaaagtcactaaccctgtcggtaaccgaagccgaatcagataaccatgcggatttggcaaatagtaaatatcgctggctcctttgtctaatgcgttggtcaataacgttttcactgactgcatattttttcctcctgcattaaaagaattcgcaggcaaggacgagtttgtcattaacataaaaaatttacccgtcatgctttttcgggtgtcatcgtttgcacataaggacattgatcacggtgattaaaaatacgatcattatgtctcaagatgctcacactctgtcccttagccgcgctgtttccgccctagctatgcaacgccatccatctagccagagattactccgccttggtgctaaaatcgttaaatgctattgatactaatgtagagaatctaaaaggcgtaccatttctcgtcaaattcgagaaatagtacgcctttagtttgaaactgggaatgatagcccagcctcttcactcatttattcaactcattaatcgtccggccagtcgccagctgtgtagacttcttgcacatcatcatcgtcttctagctgatcgatcatggcttggaattgttcgactttatctttaggaatcggggtcagattttgtggtaccatcgtcaattcgttctggacgaatttataccctttttcttccaaagcatcgcgaacctgtgcgaattctttgggatcggtgtagatttcgtaagcatcgtctgaagtttgcatatcttcagccccagcttcgagtgcatcttccaacatctgatcttcatcgacatcatacgcttcacgtgagataacgagataccctttgcgatcaaacatgtaagaaaccgcaccggctgccgccatattgccgccatgacgggtgatggcaacccgaactgaactggaggttcgatttcgattgtccgttaacgcttcaaccaggattgcaacgccacccgggccatagccttcataggtaacttcatcataattagccgcatcgcgatcactcgccttgtctaatgcccgcttgatattgtccttaggcatgttggcagctttggctttgtccatgaccaaacggagggatgggttaccactggggtcaggaccaccttgctttgctgccatgtataattcacgtgataacttctggaaaatcttaccacgcttcgcatcctgagcgttcttacggccctgaatgttatgccatttggaatgtcctgacatgataaaccctcttttcataagtatagaagcatatggatcgctaaaattatagcaaagaacgcgcggttattcaacgccgcttctgacgccacaaccatccccacatgaaggtcactgcaatcgcagcggcaaccgtgtctagcatcacatcctgaaacaacggcgtgcgcccgcctgtcagcatttgatgaaactcatcaaatgctgcaattccggtacaactcaacaccatcagcggccaatgcaaccaccgatttttttgatacataaacgtcccttgcgtcaaacccaagcccaataagaaaaagatactaacgtgggcccctttgcgcacaaaaaactcaacgaacttaaaatatccgactttagcaactgactgtgtctcgccggcataattaaactgaatgctacttaagaatggcttgaacggctcattatgcaacaaacgttccattaacgggacggttgtttgttccttataggtcatgctagaactgacgaacaaaacaaataaaattgcggccgtcaaccataatccccaatgccgtttaaaagaattcacaaattcaacctactttcactcatacttttctcatctactgtataatgaacctatttggaaaggaagtgctgttatgtcttaccccattaattggaatcttgattcaatcttcccaggtggcatcgactcgccacaacttaccgcacggattcagacagtgaccgacgaattgccccaacttgaagcccaagtagcagcgtggtcgcctgaagatgatgcccctgagtttaccgatttcaaaacgctttggcaactttttgaagatatcagtaaaggtctcggcaccacaggcagttttgtcgaaatgattgccagcgccgatactgccaacttaaaaaccggtcccctgctaggacaacttacaacactagaaacccgttttcaaaacattaacaaccccttggcaaagaaattagccgccatgccacaaactgctttcgatcagttgacggctactggtacattggctgagagtcgttttggtttaagtgaaattcgtgatcaggccaaggaattgcttgatgataaaaccgaaaccatgatcaatgacttggcggttgatggattcaccggctggagtaatcactatacaacgctcagtggcagtcttaagttcccgatcactcaaaatggcgaaacgaccgagctaagtgccggtcaaacgcaaaataagtttgaaggtgcacctgatcctaagacgcgcaaggacgttttcaatgtttgggaacaagtttggagcgatcatgccagtttgtttggcgaaaccctcaaccatattgccgggttccgcttgaccaactatcgcttacatcagtatccagattatctatacaagccactgcaatataaccggatgaagcgtgccaccttggatcaaatgtggcaaaccatcagcgccaataaagcgcctttcgctgcctatctcacgcgcaaagcccaattaaccgggcagtccaccatgcaatggcaagatcaatgggcaccagtggttgttggcgacttcaagccgaagacctacacttttgacgaagctgcagaattcattgttaataattttgcgaagttttcacctaaaatggccgcctttgcgcaacatgcgtttgaaaatggctggattgaagcagaagatcgaccgggcaaacgggcaggcggttacatgaccagtgttccggatgtcaaagaaagtcgcattttcatgacctttgacggttcggcgtctggtgtatcaaccattgctcatgaactagggcatgctttccacagttctattttgaaggatatgccggttttgcgacaaaactatgccatgaacgttgccgaaactgcgtcaacttttgccgaattgattgttgccgatgcgacggtgaaagctgctagcgaaccggcagaaaagctcaacttattagacgcaaaaatggccaatccactagcgatgctgctcaacattcatgcgcgattcttgtttgaggacagtttctatcaagaacgtgagcacggtattgtaagcgttccccgcctgaaagccttgatgaccgcggctcaggagaaggcttacgctggcggcttgagttcatttgatccgatgtattgggccgataagttgcacttttattttgacaacccaccgttttataacttcccatatacatttggctacctgttttctagcggtatttacgctaaggcacagcaaagcgatcattttgaagatgattatattgccttattgcgggacaccgccaacatgagcacggaagcactagcgaaaaagcacctcggcgttgacttgacccaaccagaattttggcagcaaggaattgatttagccgctaaagatgcccaacaattcatggcattaagtgaagcgtatcttaagtagccttctttagatcgctcggtagccttcaataaacaaaaaaactgtttgccacatttggcgaacagtttttttgtttaatccccactgacattaaatttaaatatcaacttaaccgtcatggaatttttcatgccattatgagcttagacctattcaacagtaaccgacttagccaagttgcggggacggtcaacgtcatacccacgatcggaactcgtgaagtaagccagcagttgtgctgggatgatcgtaaccagtggcgccagaagcggatcaatttcgtcgacgataatctggtcacctttttgggcttggctcgccatggcaatgtgtaataccttggctccgcgcgcctgcacttcatcggcattgctgcgggtccgagcagcggtcactgggtcggagatgatggcaacgactggggtatccttttcaattaaagcgatggtgccgtgctttaattcgccagccgcaaacccttcagcctgcacataactgatttccttgagtttcaatgcggcttcaagactggcatagtagtcgccgccacggccaatgtaaaaagcattgcgcgtggttttgaacatatcggttgccaattcatgaatccgatccttttgatcaatcagtgcttgttggccggttgctgccaaacctaattggtgaatcacatcaaagtccttagcgttttgtaagccctttgcttcaccaacggctttggctaccaaggcttctactgcaatctgggcggtgtaagccttggttgatgcgaccgcaatttccggcccgccatgcagcaacaaggtgaaagttgcttcacgggcaagggttgagctgccaacattggtaatcgtcagtgtctgataaccttgcgctttgacttcaaccaaaacctgacgaatatcagcagtttcaccactttgggtcaggaaaataaacaacggatgtttggagagtaatggctgatgataagcaaattccgaagcaacatggacttcggttggaatgccagccagctgttcaaacaaaggagcaccaaccaacccggcatggtagctggtccccgcggcaacaatgtaaagccgatctgcattctgtaaggctttcattaagttttcaggaatcaccacatgctgctgattatcggtatacttttcaaccagtcgccgcatcacaattggctgttcatcaatttctttgagcatgaagaatggataggttccctttgaaacttcgccatcatcgactttgacggtaaacggcttgcgatcttctaccttaccatcaagggtctcgatatgaactgcatcagcggttagggtcacaatttcctgatctttcagttcaacaaactgatcggtttcgctcaacatcgccaatgcatctgaagcaacgacattgaagccttcaccgcggccaatcaataaaggactcttatttttagcgatatacaaaactgtcggatccaaacgatcaaccatcgaaaaagcataggaaccttgaatcattttcaacgttttccgaaaggcttctttggctgacaatccttcccgagcgaataacgcgatgagttgaaccacgacttctgtatcagtatcactgtgcaattcaatatcttgaagatactgttgcttcaggtcattggcgttggtcacaaccccgttatgcacgagataaaagcgttcatcattggaaacttgcggatgtgcgttggcttcggtcggaccgccattggtcgcccaacgtgtatgtccaatccccatcacgccttgaacatcaggcgttactgcttcttccaagttcgaaatatggccaacccgcttaatcaaatgatcatggcctgcctgatcattaacgtaaatacctgctgagtcgtaaccacgatactcaagtttttcaagtcccttaagcaagatttgggttgcatttttcttaccgataacaccgacgattccacacatagtcaacatccttttccgactgtctcaaaattggtttagacaggtttatttattggtattgttaaaaacaaggctaactatatgttttacaaagcgatatgtcaacacctgtttttcagtggtatactttagtaagtaaaaccggtctatatcagatcgccaaaagccgtcatttcggttaatcgtttccctttataacaaggttttgcacaaacgcgcactttagtcttaaaaaaatttaaagaatacgcctagcaacggcaactgaaaaaagttgactaaaaaaatcggtcgtagcgacaaacacgtcactacgaccgattcacttttggaaagatttatcgaatgctgatccacctcagcatcaagtttagaccttcatcatccaactcaacctaagcgagctgacaattcaattcaaaccagagttaggcttccgagcttcccatttcctgcttaacaacatcgacaatttgatcaacatatcgtgacaccaagtcctcggttttggcttctgccatgacccgcaacagtggttcagtacctgaagggcggacgagtacccgtccatcacccgccatttctttttccacggtatcaatggctgcttggatttccggataggcttgccaattttctttgtccgccacttttacgttgacaagtttttgcgggtaatccttaaccggtgctgccagttcagaaagctttttgccagtctttttcataacattcagcaagtgaatacccgtgagcatcccatcgccagtgttgtggtagtcaaacaaaatgatgtggccggattgctcgccaccaatgttatagccgtctttgcgcatcgcttcgacaacatgccgatcaccgactgccgtttgaaccgacttcatgccattagcttccagcgccttatacaagccgagattgctcataacggtcgtgacgactgtgtcctgctttaatcgaccttgagacttcatgtagttgcccaggatgaacatgatcttatcgccatcgacaatattgccttcctcatcaaccgcgatgcagcgatcgccgtcaccatcaaaagccaagccaacatcggcccctttttcaactacgaacttagctaaggcttgcggatgggttgagccaacatcagcgttaatgttcaaaccatccggcgttgtcgccatcgtatcaaagtcagtttcaaggtcagcaaaaatacggctgaccaatccgctggtagcaccattagcgccgtctagacaaacatggatgccactcaaatcatcagcaagcgtctgttccaaaaactgcgtatatttaagggcaccttcaggataatcatcgactgttcccaatccttctgcagcagggcgcggcaacttgtcttccggtgcatccagcaaggcttcgatttcttcttcggtttcatcggagagtttataaccatcggcgccgaagaacttaatgccgttgtctgctaccggattgtgtgaagcagaaatctgaattccggcatcggccccttgaattttaatcaaataagccacagccggtgtggtaataacaccaagatccagcacttcaattccgaccgacagtaaaccggcaatcaatgcatcggccaacatctggccagaaattcgcgtatcgcgagcaaccaaaaccaatgggcggcgactggcatcttccttatgctgcgttaaaacgtatccgcctgtccggcctaaccgaaacgccatttccggactcaattccttgttagcaatgccgcgaacaccatcggtaccaaaatactttgtcatcttaattcttcctcatttcttccagtcattaatcttcacttgtcgatgtgctttcacttgaagagcttgattgagaagcactggcacttgtactagcagtctttgatgaagtagccgagctctcagcgccactgctattattaccactattgtcgtcatcaccgctaccggtattaccaacactgacagtcactttaatcgtttccggactagcggcagaaataccatcgtttaaatccgtgacattaaatgttcgggtagtacttgatgttatgtcactgacatcaacgggaacggtcaatttactgagcttgtccaaactctgttgatctccatatacggtaacctgttttgtatctgacgacaaggcatacgtatgtccggagacggcattgccagtttgcttcagctcgacatttatttttttactgggctgggaaattggcaaggtgacgtgcactgtttgcggtgatagaacaacattcatggtattgccattgtcatccagtgcctgtaataagacttcttgatcaaccgacttacgcgtattatgcgctaacgagacatttgcaaccacttgcgcaatagaatcgataacggagcgggcaccggtcacttcaacagtgcgcgttgaaagtttcggttcaccagctgcatagccagatgcaatacttgccttattataccgaacctgaatcggcatcgtcttgttatcccgaacctggatgtcaactttcactgactttggcgaaatagaatagctaagatccttattcaatccttccgccttcagccgaacccggtgtttcccgacacccaaattggttaaatcagcaatgacgcgaaaattctgtgtgtttgctgtcattgtgactaaagaagccgtgcccgtcaatgctactgaaacttttgacggatatccagtaataaaatacttgtcggtattggcattaacctgaagcggcactttcacggtctgcgttttattagcgaccaaggtggtgtcatcattggcactttgccgggtattattaatactctcgacattaacataggcaaacaaaccgattgcaagaagcaaggctaacaaccgattgacccatggtttatcccataagcgattcattgcttgccctccttctttttacgttgactaaaaagacgtgaaaagaaactgacaaccggattgggatcaggtgcttcttctttaggtaccagctgtgcggtcagaaacttcatgtagtcttcacgggtcagattgcgaatcaagttgttgttattcgtaatcgtgacttccccggtttcttctgacacaacaattgtcaaagcatccgtgacctcactgatccccactgccgcccgatgacgggtgccaagttctttgggaatgaggttgctatcagacaatggcaaataggccgcagcgacagcaatccgattatcccgaataatgactgccccatcatgcagcggtgtattaggaataaaaatattgatcagtaattcaccgctaatatcggcatcaagcggaatccccgtctcgatataatcttcaaggccggtattcttttgaatggtgatcaatgccccgattcgacgcttgctcatgtactgaattgctttatccaattccttgaccatccgcgcttctgcttcatgctgattattattgctacggaaaatcagtgagccccgaccaagatgttccaacccgcgacgaatttcaggctgaaaaatgatcaccagcgccggaacactccatgtaatcaccaaatccgttaaatacccaactgttttcagctgcaagaaccaggaaatgatcttgatggccgcaatcacaaagacacctttaagtaattgaaccgcctttgtaccgcgaaccagcataatcaagcgataaatgacgtaccagacgacgaggatgtcaaccagattaataagtgtggaccaagttaataagtttgcgagataggtgcgcatccgcgtccctccattattgttaaaaatcgaacttctgaataattataccacgagaaaccgaacgggcgaggacggaaacaaatgacgaagcgtggcaccgccttcacagcctccaagttcaaacgcagcatcacaattagcctcatcgccgcaattcctaggcatcggtcgagatacgtaaatcagttgcattttttaacaaatagcttacaatgcaggtgagtgagtactcactatcaaaaagaaggtggcgaatcaaatgtcaactcaagcaatcgtccaggtttccgatcttcaacagggttacggtacaaaaacggtgcttagccacatcaatctaacattgaatcgcggtcagattctcgctttgatcggtcctagtggcgctggtaaaacaactttgatcagcaccattatggggatgatccgtcctcgcgccgggaaggttaccgtttttaaccagcatgttcccaatcgcttattattaggccgcattggttttatggcgcaaaccgatgcgttgtacgaaagcttaaccggagccgaaaatctcactttttttgccaaaatgcaaggcgttggccgttacttactgaccaaacagttaatgtatgctgctgacgttgttgatttacaaactgcccttaaacaactcgtcaaggattattcaggcgggatgaaaagacgtttatcattggccatcgctttaattggcaaaccacaattgttgattttagacgagccgacgattggcatcgatcctgcgttacgtcgccaaatctggcaggaattgcatcgactggcaaaacaaggcgtgacaattattttaaccacccatgtgatggcggatgctgaagaagcggatctgctcatgatgattcgcaatggtcaagcaatcgctcaaggcacaccgaagcagttgcaagttgactatcaagcgaattcgattgaagcggtatttctagccgcagggaggcagcaagatgcgcattgaagctttgatgataagaattttcaaagaaatgttacgtgacaaacgcacactggccttaatgtttatcgcgcctttgtttatcatgacgttaatcttcttcttatttcagtccaacacaacgacaaaggttgatttggccgtgcatggcgtccaaacatccttaaccaaggcgatggatacgaagcatttaagattacatcacgttggcactgaaaaacctacccgcataatcaaacagcatgattatgcgggcgttttaacgcaacatggcaatcagcttacgttaacgcttgccaacaccgatcagggacaaagcacgctgttgaagcaaacattacaggctgccaccgttaagttaagactaaaagctgcggccaccagccttaaaacacaagcgattgccttaaataaactgacggacgcgttacaacaagccacgcacggtgcggtacaagtccccatcccgcaacaacccaagcagaccaattatcgcatgacaacccactatcgctacggctcgtctgaatccacttactttgatactttgttaccgattcttattggctttatcgtcttcttctttgtcttttttatttccggcattgccttactgcgcgaacggacaaccggaacgctttatcgcttgctggcgactccgattcgtcgcggtgaaatcatcagtggatacctacttggttacgggatctttgcggtcattcaaacggttttgattgtcggttatgccttggtggtctttaagatccaaattcttggaagcattccggccatttttctgatcaatttgttgctggcatcaacagcccttgcgctcggcttgctcatttcaacctttgccaacagtgagtttcagatgttgcagtttattcctattattgtgatcccccagattttcttcaccggattgattcctgtcaatcagatgcttggatggctgcaacccattgcgcatttgatgccactttattatggtgccaatgctttaaccggaattattaccaaaggccaatcactagcagttttataccctgatgtcattgcattggtaggctttttcctgctatttttagacttgaatcttttgacaatgcgcaaatatcgtcaagtttgaaattaattcaatttatgaaagaagtgtagctcgatgaaaccgcataatatcaccgatttattctcggcatcccttgcagatagtcagctatcaaccaaacagcaagccgtactcaaggccagtttaaagctcttctccgaacaaggatacgatcgcaccagtacccaagaaattgcccgggtcgcccaagtcagcgaaggcactgtctacaaacagtttaagaccaaagaaggtattctccgtgcgctattggctccgatgattcaacaggtcatccccagtgcgatcacagagtttattcatgaagttggcgagcatcatctgcctgatttgcatacttttttaacgtttattgtccgcgatcgcatgacatttgccatcaccaatcaagcccaattgcgtattcttattgccacccttttgcgcgattcatctttgagcaaggcactagcaaaacagtttcaaacgcaatttttgggtgaagccacgcatttactaaccgcgtatcaagaaaaaggcgttctcgttaattggccggtgatccgaattctgcagtacattttcggcacagtgttcagttatctgcttccggtcatactcgatatccaatcacaatttgatctcaacgccgcggtgaatgaagccgtcacctttcttgagcgcggcttacaaggagaagtcgcttatcctgccccgccaactcatgaaaattagcacttttggtgttttccatcccgcagaacgttagaatggagttaaacgttttttcaaaggagacgtgcttgagtcatgaagaatgaaaaggagacgcggcgtaagtttgccactgaatcaattgcagatttaatgactgatttacacacaacttcaaccggattgagtcaacaggaagcttcaacccggctagcaaaatacggtgaaaatacgatcacccgcgaaaagcaggcatcgcagctgttgatctttctcaagaactttaccagcgtgatggcgatcttactttgggtcagcggatttgttgccattttgtccggcacattggagctaggcatcgcaatttggttagtcaatattattaatggtgttttcagctactggcaagaacatgaagctcaaaaagcgacgaattcacttatgaaaatgctgccgacctatacgcaggtctatcgtgatggcaagttgcagcaagttaatgcgacccaaattgtccctggcgatgtgtttaatctgcaagccggtaatgcggtccctgttgacgcccggttaatcaaagctacctccgttcaggttgatcaaagtgccttaaccggtgaatccgtacccgaatccaaaaaagttgcttttgatgccggacaaggcgagtttgccgagtccaaccttgtttatgccggtaccactgttggcgccggtactgcaacggcggtggcgtttgcaacaggaatgcatacggaattcggccggattgccgcgttaacccagcaacaaaagcgcagtctaagcccattgcaactggaactcaatcgcttaaccaaacagatttcgttgattgcgatcagtttaggggtacttttcttcgttgctgctattttctttgtccattatccggtcgcgcaaagctttatttttgcgctaggcatgatcgttgcgtttattccggaagggcttttaccgactgtcacgttgtcgctggcacaaggcgttcagcggatggcgagaaaacacgccttactcaaagatctaaacagtgtcgaaacgcttggtgaaaccaccgttatctgctcggataaaaccggcaccctaacgcagaatcagatgacagttgatcacgtctggacgccggcgcacacttataccgtcactggccaaggctatgtcaacaacggcgagatccagctaaacggtcaaccgattcactatggtagcgatccggacctggatttactcatccgactggtcgcgtttaataatgatactgaagtcgaaccggcaaaaggcgaagcacgaccgaaaattctcggcactccaaccgaagcctcgctggtcattttggcgcaaaaatcaggcatcgatacgaacgcctacacccagaagttcccgcgactcaaagaattgccgttcgactcggatcgaaagcgcatgaccaccatccaccaacacgatccccagacgctctccatctgtaccaaaggctcattaagcgatttattaccacattgcgataccattcaagaaaatggtaaagtccgaccgctaaagcaagctgacaaagatgccattgatgcggccaaccgtaaatatgcagctttaggtttgcggtcaattgccacggcatatcgcgaaatcccacaagcagctgacaaagaaaaacagctcgatggtctgacgattgaaacggctgaaaccaagctcacattcgttggcttagcaattatgtccgatccgccacgaccagagatttacgcggccatcaaaaaatgtcataacgccagtatcaagattattatggtcaccggcgattcgtcgttgactgctaaatctatcgcggtcaaaatcggcttaacctctgataaagcccgcgtcgtcaccggcaccgaactggatgctatgagtaaagccgacctcaaacaagcgcttgctggcgaaatcatttttgcgcgggtagcaccggaacaaaaatataaaattgtctcaacccttcaagaaatgggtgaaattgttgcttccaccggtgatggcgtcaatgatgcacccgccttgaaaaaagccgatattggcgtggcaatgggcgtgacgggaacagacgtcgccaaagatgcagccgatatgattctcacggacgacaattttgcttctatcgttgcggcgattgaagaaggtcgaactgtttacagcaacattcaaaagttcctgatttatattttgaactctaacctgcctgaagctgtgccatctgcgcttttcctcttctcacgtggcgctattcccctaccgttaaccgtgatgcaaatcttaaccgttgacctcggaaccgacatgatgcctgctttgggactgggatctgaaaaagccgagcccgggattatggacaaaccaccgcgcgcacgtaatgctcacctgatgagccgaaccgtcttgtggaaagccttcgcgtggtacggactgattgcttcaatcatctctagcggcgcctacttcttcgtcaatcatctggacggctggccgacacatggtttagccacaagcggttcaacttatgtcatggcaactaccatgaccctagctgcgattatcttctgtcaaattgccgcagccatgaattgccgcacggaaaatgcctcagtcttcaaagtcggtttgtttgccaatcgacttgtctggttcggcattatctttgaaattttcctgctggccctactcagttacaccccgttcttacaggaactcttccacacgggcccactagccctcaccgattggatcttcctagccatcatcccgattccactcttcttaatcgaagaaggacggaaatggctcaatcgtcggcgcttagcccatgcgaaggtaaagcgtgtcgaataagcaacactaagaaaatggccttggaatttgaactttccgaggccattttttagtgtcacttttaatttttaaatcaaaattaccatgcatatcttttgataagcaagataaacttatgctacactcgtcgcgaaaaatgagagcggattcacacccaggatttacctgactgatgcagatcattctggccaatcaccaatttttaaaaaccgccactgtttcgccaatcgcacaaaaagctaatgccaacataataatgatatatggccgattaatatgaatcaccgttgccgcggccaccaaacttccaaccgccagccatagactgatacaacaaacgatatccagccacacaccttcactatgccgactatgcttcttcatcgcgatcacctcattcctatggtacccgattgcagctgcttgtactactcatttaaaaaaaccgaataagcacgcccaagcgtaaagtttgcattaatctatctcactgccttaaatttaaaacggtattgggaaattacgaactaataaaaatcccattgcactatttacatgaaacgttggcatttatgaaagaagtgatatcccaaatcaaaataaacctaattgttgtatctaagtattatcacacaaggctttggtgttgatcctatttaagtgtcgttatgatacaaaagctttttgtaaaggggttggatttttatgggcaagataaagattaatatttggactgccatttacgacattgttgcctgctttatcttcgcatcatcttggtttgttatctttgcaactgccgttaatgacgcggccaataaaaccaatgtcacatctggcgcaggcattttcttttacaccgttgcgtggattggcgtagttctaaacgctgttgcactatggcagagctacaaacaccatatttcacttgtcggcggaatcctgggagtcattggatcactctgctttggcatttctgctgtatttgcgtttcctgctattgttctattaattattgctattgtgttcctgtttttgcaacatccacgcaagcaaaacaaagttgcttagtcagcatgatagtcctaggaggagaaaatgaaaaaactgattttagtgacagtcgcaaccttatcaatattttttttagccggttgcagtagttccagttcagcaagtaaggataactcgtcagccgccaaaacttccactgctgaaaaagcagaaaaggcagaaaacaaaacctctaccccaaaaagtggttggtcctttaaaaatgatacttgggtcacagcaaatatgaccttcaagttcactaaagcagaagtccaggatgcctacgagcaaggaaagaagaatcttgtcttatttgtggacgttacaaacacttccaagaaagaacagatgccaatggctggaatggtatcgatgaatgttaaacaaaaaaatgacacttcaaatgtcgacttaaccagcggaatgcctaaaatgaatgacgatggctcaaatcctttcgaagcgcaagagaacgctatgcataataacttactaccaggtaaaactgttcaaggtgtctttatttatgaactaaaaaatgataatccagtgactgttacgtttgaaaatgccagtttccaaactattggcaccaaaacctataacgtgaagtaacatttaggcgcaataatcggccctcggaaaatcttcctgtcaacgcttattctccaccataagcggtaagattttgagggctatttttgttgtccaaaaatataaagcatcgtttcgaaggtatttaaagcagccaaaagtccaaacaaaaaagcccgccaagtcagctttttcagctaaccgtagcggactgaatggtaccaaaaccctcagcggcggtacatcttaaattctaagaataaatcattgtatagaccaactttagccggtggcagatcggaatagatctcaagatgtttcatggtttcgtcatcagggtagaattggcgatcgttttgaacacttttaggcaatagctttttagccgttgcatttggtgtggcgtaacccacgtattctgcattttgcgcggcgttctttggctccatcatgaagttgagaaaggcatagatcgctttgaaatgcttggccgtcttaggaatgacaaggttatcaaaccagagattgctgccttcttgaggaacgacatagtgcaggtgtttgttgttagctaacatttcgctggcttcacctgaccagtcgacggcaattttagcttcattttctgccatgtacatcttgatttcatccgcaacgacagctttgacgttgggcgagagctgatcgagtttggctttggcaacagcaagcgtttgcggattggtctcgttgaccgatttgcctagcgagattaaggctggcgcaaacacatcacgagctgagtcgatcaacataatcgagtctttaaacttcggattccacaattggttccagtgttgaacctcactggcattgacaaacttgtcattataaataatgcccagcgtgccccagaaatacggaatgctgtacttgttgtttggatcgaattctttattaattaaacgcgggtccatatgctgcatgccgcgtaatttacttttatccagcggtaatagcaaattggccttcttcattttctcgatcatataatctgaaggaacggtcaggtcataactggtgcccccctgttgaatcttggtaaacatcgcttcgttggaatcaaaggtctcttgattgacatgatagccagtttgcttttcaaatttactgatcaaggccggatcaatataatcgccccaattaaaaagattcagtgtattgtcaccggtatctccttgcgatttttgtaagttctcgctccaaacagctaatccgagacagactgccaggatcgcaactgcaatactaatgagtcgtttcattgagtaacgcctcgctttctcgcttgtgttttgcccgcctgctctgtcccgcttgttggataaagtagtaccccaccaccagcagcaaagcaaagacgaacatcacgccagataatgcgttgatttccaagctgattccctgacgtgcacgggcatagatttccaccgccagcgtttcaaagccgttaccggtcacaaagaaggttacggcaaaatcatccagcgaataggtgaaggccatgaagaaacccgagaaaattcccggtgtgatatatggcacaatgacccgcgtcagcacctgatagtttgaagcacccaaatcacgcgcagcatcaagcatggaatggctcatttcctgtagccgcggtaaaatcatcaacaccacaatcggaatggaaaaggcaatatggctcatcagtaccgaccagaaacccagcggtacttttaacgcggtataaaagattaagaaactggccccaatgatgacatccggactgaccattaaaatgttgttcaatgacagcaccgtatttttaaccaccggccgactggtacgatcaatcgcaagcgcacctaatgccccgataatcgtggcgatcaggctggatagtaacgccacaagcagtgtatccaaaacgatttgaatcatccgggtatccgcaaaaagttcggcatagtgtttccaggtaaacccggaatagttactcatgcgatcgccggttgaaaatgaataaatgaccagataaaaaatcggaacatataaacagatgaagacgaaaatcagataaaggttggaccacttaaacttacgcttcatgacggcggacccccttcttctttcgttcaccggttaggaacataatcacaaacatcgccacaatcaagaccacgccaattgtggaacccatcccccagttcatggtggtgagaaaatgctcttcaatcgcggtccctaatgtgatcacccggttcccgccgatcaagcgcgttaacatgaacaagctcaagctagggatgaacactgcctgaacgcccgatttaacgccggaaatggttagtggccagacaactttggtaaatgtctgccaccctttggcacccaaatcacgtgaggcattgaccaaattttcaggcaattcttcaatcgcattgaaaatcggtaaaatcataaacggaatttcaatataagcggcgacaaagataaagctgaaatcagtaaacaaaaattgctgcggggcaattccgaacatgcccaagaaactgttcacgccgccatcctgactaaagattccgataaaggcatatgctttaagtaacaaattaatccaggttggcagaataatcagcaacaaccatagctgcttgtgcttggcataatgcagaaagtaagcggtcggatagctgattagcaatgttgcaagtgtgattaaaaaggcataccagactgaattaatcgtcatcataatataagtgcctgattgaaaataagtctgataatttgccaaggtaaaatggccgctaatatcaaagaaactttgataaacgatcaacaccattggcgcgatcacaaacaacgcgagccacatcacgtaaggcgtgtaaaatgctacattcgtggtggattttttcacgatgaccctcctcagattagaaatcaaacggtgcttagccgaaaccgtgcgttaacggacacggtcacagtaaagtcgctgtcaatactgtgcttaatcgccttcataagtttccagccgcgcatcgaattcttcttcggattcgtttagccgcataacgtgaatgtcttcaggatcaaacgtcaaccccaccgtctcgccgtcttttgccggattggtcgagtgaatcaaccactcattcttaagctgatcgtaagcaacgatttcataataatcgccgcggaataattgggtatcgacttcaacgttcactttgccggcatcggctgcggtgatatcaagatcttctggccgtaaaaccacttcgaccggttcattcggccgcatccctgcatcggcacattcaaattgcttaccgttaaattcgaccaggaaatctttaatcatatgcccctgaatgatattactttcaccaatgaaatccgcaacaaagtgattcaccggttcatcgtaaatatcaaccggggtaccactttgctgaacctgaccatcattcatgacaaaaatttcatccgacagtgccagtgcttcttcttgatcatgggtcacaaacaaaaaggtaatcccgagccgttcttgtaactcgcgcaactcatactgcatatctttacgtaactttgcgtccagtgccgataacggctcatccaataacaagacttgcggctccagcacaatggcgcgggcgatggctacccgctgctgctggccgccagacaattcagagatttcccggtcagcatagccttgtaaccgaaccattttaagcgcgtctgtcactttggtcttaatcgtttccttgctcatccgatgcagacgtaatccaaacgcaacgttgtcaaaaacattaagatgcgggaataacgcataatcttggaataccgtattaaccttgcgctgatttgccggtacatcattaatccgtttgccatcaaaaagcacttcgccttccgaaacatccagaaacccggcaatggcgcgcagaatcgtcgttttaccagacccggacggaccaagtaatgtgtagaacttgccttgttcaatttcgatattgacatcttttaatacctgcgtgtcgccataacgtttgccgacatgcttcagttcaacaatgatattgctcaatgaccccaactccttatagataagatgccgtcgcaaccagcaggcatttgctgcgacccgttgcggcgttcaccagttgatgttgtttcgttgcgtggaaataaatagtttccccttttttagcgacataagtctgttcacccagcaacaacttcactttgccgctaaccacatacacaaacgtttccgccggtgatggttcgaaagttttaaaaatcccatccggtgcaaaatcaatcatcaccggctccatctcgttttcattgctttcgggaactaaccacttcaattgataacctttgtcctcatcaagataagtcacctgatccgaagcatgatagaccagtgaatcaactggttcttcacggaaaaaatcggctggcgactcacctaaaacgcttaaaatatcaaaaaaggtttccagtgacggcgaactttgatcatgttcaacttgcgaaatatacccctttgataaatcagttcgttcccctaactcttcttgggtcaggtttttgcgaatgcgcaaatcacgaattttgctgccaatgtccatggcacaccgcctttataagtttcgttaaactaaactttaagtttactaactctgcctattatacgaacgtcacgcaccaacgcaagcttttatagctgattttcaaaaaaaaatttcacggcagcttaaatgccctttgatacaacaaaacggcgcccgcacatgctcatttgagaacatctggtcgccgtttgtttgtcgagatattttttaatcccagttcctaaacttcttccatcgaagttaaagttgcagcattttccgtgaagttaacattttgatttaagcgctgggccatggccatggtgatataccctttttcaagtagatcatgaatggccgttcgctcggctgcaaacgcaatcgcgcgtaatcggccgagttcatgttcatattgcgttgatttgtgggtgtttaacgctttaaccgatgcaattcgattgcggtactgaacaatcaacgaataaatcacttggcggttgtaatgatgggccttgttttctttttgacgaagaaattgcgacaaatacttcaagccgccttttgctgtttccttttcaataaacagtttctcattgaaaaagcgatgcgagcgattctgttcactcgcgaccgtgtaccaaaagtgggatagcttcaacgcggaccggtcaagaagcatgcgcaatgttggtcggccggagcgtttcgccattgaattcaaatcatccaggcgatgctgcagttgtttgtgagctttggcataacttttggacatgattttgttctcgcgccataagtcatctaacgcgtataattcgccttgaacccccaccttacgtaaatcaagttcatcttgaaccaatggcggaatggcggcgccggtatcctcggctagctccaggcgccgaatcagattttgatattcggcgatcagatcaagtgccgctttttgatttgactcccgccgctcggattcaacgcgagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactaactagccaagcgatgccactcagccaatcaaaggatggatggcagagaaggacaggtaagaagccaaaactaaatgtggtaagcagacagataatggttattgttgcgtaactggcaagggtataatccaacttttttgataaacgtacgtcaaccatgatcgaaatgaagttgcacaattgatcaatggtcgaaaataaccaaatgggtggtaaaaggtaaactaaaagccaaggtaaatgcgccatcagccaatgaatcagatgctggtcagcatgatagctttggaaactgaatgcatcagaagaaccgaaaataaccaaaagtagttgtaatggcataaaagtgaccaaaatgatgacagaaataaaggaatgttgtaagaagatcattctggtttgagctgctataagtcttgtcactgcgcaccttcttttctaaatacgacatgctaataaatctcaattttttgaactaactcggcatttaagtagttaaaggcaaagatgagcagcaaacagctgaccgttgtgacgacaaagttacctttaaaccaactctgggcaatgaataggttgtaagcattgttaagatgcgggcttgcaaacattctggcaaaacaaaccgtaaaaataagcgccagacaaatcaaaagcggcagtatattggctttgggtagcaagtaagtcaacgtgaaaaagacacttcccatgaggcatccgttaagtgcaaacaaacaagcgtcaatcagcagtgaagggacgacaagatgctgaataaaactgccaataatgatccagtaaatgaacgaagaagtccaagcgtggaccaacacggtgaataggttgcgcctaaaaatggtcatccgatcatgtacgcgaacaagtaaaaaggcgtcgtgacgctgtttgcacaagaacagcccgattatgacgaccataagataaaaggattcaacgttgggcttaacatgagtgaaaagcgagagttcgtacccgaccgatttttcgccaaatataagggccatgattgaaaggctgaaagcaagctgaatataaacaaaaagcttgaggttacgtttacttgatgtcatcagtttgcaccacccgccaataaagaatggcgattaaaccggtcgtcaagaatagattgaccgccattaaccaaggcgttattacgttgtatccttgagaaggaatgagaaaaatagccggtgaaatttctgctaagccaaccaacgggcctatgagccattcactaaggaaaacgataaagacaagcagaatggcgatagatctgcggttagttaacttgaaaataagaaatgtggtcgttgccatcatgccggagaaagcaaaaaataatccgagatagcctaataagaattgcaaaggactatgaataaaagaagcaaagtaagttgttcctgggctgattacctgaccagaaacagtgaatggatcaatgatgacaccttgttcacgggttagcgcgatcaaagcatcgagtacaagtggtaaagtaagcgcgccaccgccaactaagaaggtaaccaacatgttgacaagggtatatttagttttaccaagcttggttatttcaaaaaaataactgtggtgagcgcggctgtctgataacacgaaagaaccaattaaactagcgacaaggggaaagactaagtaataaagactagataatgacgaaaagtcaaaaccgatcatgatttgataggcagtcggagcagtattccaagaaccgcgagaaatggtagtggtcagctggtggtaaatggcaatcagtccggctataaggagccatagcgtgaccatccgattgtccaggagccgcaataactgagttttgaaataagctttagtcaaatatcatcacctccagtaaggttatttagttaataaaaaagtatgtcgggttcttcccggtaaatcggggttatcaacagataaacgtaagctgtgactgttgaaggcgccggataactttttggagaggcaaaaaacatagcgataactagaggcatagcggcgagtgccaaaaggtgatacttcgtaaatgttgttattatcgacatttaaggtaatatgctcgcttgaccgatagcttgagactgccttaacgacaatgaattgttttgtttgatcatcctttagtattcgttgttcttgctgattgaagactttggcaaggtcggtagtcatctcaacatgggtgatgcggaagggatgcttgcgatataacagcgctgtttgccctaatttgatatttttctcctgataacagtactggttagtgtttagattctttacacttgccccgatgatagtaacgatcatcaccgctagaatgagcatgaggcaatatttggtttgcttaagcatctcgcaacgctcctttgaccatgccgttttcgatgtgaatgacctgttgaccagggacctggatttcttgatgactgtgtgtggcgatgataatcgtggtgcctttttgtcgttgcacttcaataagactgttcagacggactagcccatcagtatctaaagcattcgtcggctcatcgagtaatacaacttcctgattttccataaatgcttgcacaatcgctaatcgctgacgcatgccgagcgaatatttggtgaccttttggtgttgataggcagtcattcccatctgtgacagataatgctgtatctgttccgggtcaggagcaccattaattgaagctaagaatttgagattctggaaaccggtataagtgttaatgaagtccggggtttcgatgatgacgcccatcgtgacaggcagctgcttgccgaaactgattttcctttgatccactgtgatgctgccttgatccggtttaacgagaccacaaatggtacgtaagatcatcgtttttcccgaaccgttgggaccttttagaatcgtaacggtacctttttcgatgttaaaagacatatgattcaacaccgtgacgcctttgattttctttgaaacgtcattaacttgaatgtacatgtgactctccattctgttgatatttaggcaaaaaagccataaaaagtagtttatcgcagtctgtgacgatgatgacctgagtatcggatacggttggtcgcttgcaagagcatgcttctctcagatctaaaaattttttgaagtgctttcagcttatcctaatagaaactataactcaacatttaattattagttacagaggttatttattcagggaggttaattttaatattcttttataggcaatgaacgagtgacaaccaataataatataataagttttcaaatacttattcaaaagaaagattatggtcatcactcggaaaaagtgcgataaataaatgaaacccccgcaaccactagcaatactgcttagtggttggcgggggtatgctgaatattgaacgttacatcgccggccgtcttggatgatgcggcgtttgagtttgatcaatggcgactgcgcctaacatcaaaataataatgatgacagctgccattaattgcccaaagaccatcaaactaaaagcgccgatgaaggcaaaaatcaacaacaaccaatcaagctctgagaatgacaacccaatcatctccttaaaagtcagactccgaggcatcgtaacccattgccttgctaggcgacacatagacgacaagctcatcgctaaatcgcttgagacaataggcaatgatgccaatagcagcaagcgttgtgacagtcttaatcagcggctttttcatgctctcgctcctttgcctgtacattatcctgtacactatatagaaggtattaaacacaccttaagtttacacccgctgcgtgaagatagcagaagcgaggtgggaaaattgagctcatggttcgagatgcgctatgatcggctagcaggcactgatggtaacaacatttaaggcaatttaagcgaatttaagtcaaaataagtgctttttgccaaaactgtggtatactgaaggcattaaaatcgaaagtaggtatgagcatggatacaaaagtaaagaccgttgattactcatccaaggaatactttgacaagatgactgcttattggcgggcagctaactatgtgtcagttgggcagctttatttgaaggacaatcctttactggaacgaccactgaaaagtgaagatgtgaagccacatccgatcggccactggggaacgattgctgggcaaaacttcatttatacgcacttgaatcgggttattaataagtacgatctcaatatgttctatattgaaggtccgggtcatggtggccaggtcatggtttccaactcctacctcgatggttcgtattcagagatttatccacgggtttcccaggataaagaagggatgaagaacctgttcacccaattttcctggccgggtggtgtggcatcgcatgcgagtgcccagacaccaggctcaattcatgaaggtggggagctaggttatgcgctgagccatgcaaccggggcgattttggataatcctgatgtgattgccgcggttgtcaccggtgatggcgaaacggaaacaggtccgttagccgcatcttggtttagcaataccttcattaatccaatcagtgacggggcaattttaccgatcgtgcatatgaacggcttcaagatttctaacccaacgattctgtcacggaaatcagatgaagatctgaccaagtactttgaaggcatgggttggaagccatactttgttgaaggcgatgacccaaccaagcttaatcctgaaatggcgaaagttatggacgctgcgatcgaagaaatcaaagcgattcaaaaacatgcccgtgaaaccggcgataccacgatgccacattggccagtgattattttccgctcaccaaagggatggacgggtcctaagagctggaatggcgaaccaatcgaaggctcgttccgcgcgcatcagattccgatcccggttgatgctgaagatatggaacatgccgattcactggctggctggctgaagtcgtaccatccagaagaattgtttgatgaaaatggcaagctgattccggagctggccgcgttaccgccaaagggtgacaaacgaatggccgctaacccgatcaccaatggcgggcttgatccgaagccactggtattgcctgattatcgcaagtatgcactggataacaaagaacatggtaagcaaattaagcaggatatgattgtgtggtcagattatctgcgtgatttgatcaagttgaacccgcataacttccggatctttggccctgatgaaaccatgagtaaccggctttacagtctgtttgaagtcaccaatcgccagtggctggaaccaattaaggaaccggctgaccagtacttggcaccggctggccggattattgattcccagttgtcagaacatcaatcagaaggctttaatgaaggctatacgctgactggccggcatggcttgttcaccagctatgaagcatttctgcgcgtggttgattcgatgctcacccagcacttcaagtggattcgcaaggctcatgaggaaccatggcacaaggcttatccgagcctgaacgtggtttcaacttcgacgtccttccagcaggatcacaacggctacacccatcaggatccaggcattttgactcacatggcggaaaagaaagccgaatacatccgcgaatatctgccagctgatgcgaatagtttattggccatttcaccaaaactgttcagctcacaaaacacggttaatgtgctgatcacttccaagcagccgcggccacagttttacagtattgatgaagcaactgttttggccaatgctggcttgaaacggattgattgggcttccaatgatgatggtgttgagccggatgttgtcattgctgctgccgggaccgagccaaatatggaaagtcttgctgcgattaacttgctgcatgacgctttcccagacttgaagattcgcttcattaacgtgcttgatcttttgaaactgcgcagtccagaaatcgatccgcgtgggttgagtgatgctgaattcaacagttacttcacgacggataagccgattctctttgcttatcatggttttgaaggcttgatccgtgacatcttctttacccgtcagaatcgtaacgtcctgattcacggttatcgtgaagaaggcgatatcacgacaccatttgatatgcgggttctaaacgaacttgatcggttccacttggccaaggatgtcattcagcatgtaccggcatatgctgaaaaagcggctgcctttgttcagaagatggatgatacgttgcaatatcaccacgacttcattcgggcaaacggcgaagatattcctgaagttcaggagtggacttggaaatcaattaagtaataccaatcgagtcttggtacaatcgctcagataattaacaaatcggtattagcaggtgaccgctaatgccgatttttattttgtgaaattaaatttagatgataactattttaatcgatataaatacgagtggcgatgtaaccgcatacactcatggcgatgaaccggtttaagaaaaaaggtcaccgactgtcagccaaaaagtgaacaaaatatgaatactatggcaaaaattgtgtaaaaaacacctttacatctcacgagttctaatatactcttaatgtattatcattttgagggtgagtagatgaaagctaaacgaatgatcgccggggcaatggtagttgcctcagcagttctcttggttgcatgtggcagcaagagcagcagtagcaccgaaacgtttaatcgaatggaaaaagatgtcatttcgaccatggataacgcgcatattacagatgttattagtggtcaggcagcggtcgatacgggcgatggtctgtatcgttacaagggtaagaagttgcagccggctgtcgcaaccaaagtggtgaagccgactaataaggggcttacgtacacgtttaatctacgtaagaccaaatggagcaacggtgatcctgtcacggctaaagattttgtttttgcttggcgccgggcaaccgatcctaagactaagtcagagtatgcttatctgttctcgggtatcaagaacgctgacgatattactgccggtaagaaggcgccatcaacgttgggggtaaaagcagaaggcaattacaagctggtcgtaacgatggaacgtccgattccttatttcagtactatgatggttaacccagtcttcttcccgttgaatcaaaagacggttgaaaaatatggtaagaaattcggaacgcaaagcaagtatctggttttcaatggaccgtttaagctgactaactggaacggcacagggaattcatgggacgaagtgaagaataagtcgtattggaatgccaagcaagttaaactagacaagattcatgttcaggtggttaaagacgctaacactgcggctaacttgtttgcaaccaagaaacttgacgatgctgttttaaccggtgaaatcgctaaacagcatgctaaagataaagattacgtgggcgacaaacagggtcggacctcttatcttgatatgaacgaagaaaaggttccggacttcaagaacctgaagttacggcaagcggtggcaatggctattaaccgtaaagagttcgctaataaggtgatcggtgacggctcatttgggatttcgacacttacgcctgaaaactctggctcaaatcctaagacgggtgaggacttcgccaaggaagcagctaaagaatctgaaacggttcagtcatacaacttgaaggaagccaagaaactttgggctgaagggctgaaagaagttggcaaatctggcgaacaagttacactgacgacagacgacacggatgttgcgaagaagtcggctgaatatattcaatcagctttggaacagttacctggtatgaaggtttccatttcctccgttccattcaagactcggattcagcgttctttggatggcaccgcccagttcattctctccggctggcaaggcgatttcccggatccgatttccttcctggatctttatacaactggaaacacgtataacttcagccactggtctaacaagcaatatgatgagctgatcaaggcttctgagaccactgatgctaacaacgaaacaaaacgttacaatgatcttttgaaggcacaggaattgctttctaaagaagccccagttgcgacactgtatcaaaccgttcaagggcatttacgcaatccgaagttgaagggcgttaccttcagcccagccaacatgtataactttgttggtgcgtatatggctaagtagtaaagattaaaattttcatttgaaagcccctgcttgcgttggcgtacttcaccaacgtaggcaggggctttttgtgtgagcttcagctagcagatattaaagagtttgtattgtggtatatattatctaataatttcaaaaccgataattctacccaaggccggattaattatgatgtaagataagtacaacacacatatgttaatgaataatatttcgataaaaataatctttaaataaaaataaaaatagcttagaaatatactagagcttaataaatccgtgtagaaataaatatttatttaaaaacggattgactagattggattttacaccgtataatttctatgtgatgttctagaaaagacaacacagggcagttaatccttcacatgggcatcgctacgagttttatacgaacacaaggctggatatgtacaattgtgtgattggagactgttgttctgggattccaacaactgtttacatgcagagctggagcaacggcaatgctaacggatggcggaaaccggatatttaatattttggaggttctatgatgtgccgctctttataagaatggagcggcctttttgggggattgatctctttgagaaataaacaatactggcagtcccgatcaaccatcacggctttgttactcgcagttttatttatttcgagccacctgattgcaaatgccggctatgatgcagatgggggaaagcatttgacgggtttctactttttttcgccatatatgaactggttgccaattgatatttcttcaagtttacctgttgcatggaatttggctgcgccgcttttatcagttcttgccggtggtatgatcgctgcttcccatgggcgcagtgggtatgccaagttaatgcgatttcggcacagctttgtggcttatcgcaggtcggttttcttggctgcgggcgttcttggtgcaattgtgccaatcatggtactgagtttagacttcctgggtttgcttgcgattcatcctaatgtgctgccgaatcaatggctcaataataatgttgcgattagttatttgggacttggggggaatcttttttatacccatacttgggcctacatgttgggatggattgctttactagccttttacggggcaagctatgctattttttcgaattttctctattttgtcacagggaagatggtgctgtcgttgattggggtcatgatggttcagttaatattattaagcatttctataatctttaagacgagtttagcgcctattacttatttacagattgttccaactattgggcagccttcgctagcctacgttcttttatggcccgccattttaattgcaatgagtatttttagctttcgagtgccaaaaatcgaggcttagtttatgaaaataagaaaatatcagttgtttctacattttatttcacgctggcaaagcattttgtttttgatgacagtgcttgttttcgccctgactttcgttcttgccggaattatgacgggacggtttgagatcagccaattggatgccaacatttcggttcaacgtgcatttggacaggtgatattttatttgcccatcgttgggatgatgacgtttttacttgtgagtcaagctcaaaacacgagtcttctcataagaattggttccagaagcttgatagcaaaatatattttgcgggggttattttatttggatcttgtgatatcggtggcggtctggatggtctggataactgcggtgctgttcttatcgcgaggtcaaggcgggatgacgtcagttgcggctaatgctaatttattgatgaatatctttaccgggctgtttttgtatacgctaatgatacttgctctttgtatcgtttttaggtctagagtgattggcatttccttagggctgagtttgattatctgcttttatatcgttccttttgtcaatttaactgaagtcgcaaatctggtaaccccgaagttaactaaagatgcaatatggccgatcaatattgctaggcagtggttggcaatattcattggcgctcagataatcacgatattatttaaccatgttcgcttgcctgtcgaggggtgaagcttaatgaagatacaatggcaaaaaccgcttattgataagcgcatgatagtggttttactgcttgaggtcttactcttgataagctcgctagcgttgtattttgatcaacagaatagcaagttattgcaacaagttcacgatccggtgatgactgtatttatgggcgcaatgccggatcggtttgcgagcagtcagttatggtggttgcttctgtgggttggattcatgtctttacccatcttcatttgtgccggggtgacagatgcttatcagcgtaacttgtatacgtttcttagcttgcggatgcatcgaagacttggtgcttatatctggcctttaaagcaagtggttttgagggaggcaagccttttattggtaatgggcattgcagtcggcacactgacacatttctttttgaggacgcagcaatttggcgaggctggcttgttcattattcttattattgtgagtcaaacgtttttagtggttttagaagcggttcttgaaggttactttggccccatgattggggttgtcggaacgttaacgattatctttttaagttttctgcaaatgccgttgatgcctttgcgttttgccattgcaagtacctttgcaacggatccacagttattaggtgcgattgggtatcagatcattttgatcattcttttgctactgattcaactcttttatatgccaggaaggtggggccgatatggcacaggtcgggaataaatcaggtgttcgtgttgatatttcacatatgtccgtgatgatgagacggaaaaagattcttgatgatctttcactttcttttgtctctcctaatatttacggcattgttgggccaaatgggtcaggcaagacagtttttttaaaagcaatgttgggatttatacggcttgtcagcggtagtgtgacgatgaatgaggttccaattgatccgcggcgggcttttccgataagtgtcggcgctattattgagcatccgggttttatgaatgacatgagcgggcatgataacttattggctttgggacagattcgtagtcagcttgatgatgaagcgattcatgccgtgatgactcgagtcggactgccagatgacaaaaagccagtcgcaacctattcgctagggatgattcaacgtttgggaattgcccaagcgatcatggaagatcaggaatttattgtgttggatgaacctactaatgcactagatcgtgaaggtatcgtgtttttgactgaattattaaaggaacttcgcgaccaggggaaattagtgctgatcgcaactcacgaccttttgtggttgcaatcgctagcagatcagatatttgagttgtccaatggtaaacttcagcaggttgaggatgtggtttaatgatgaagccggcgcatcggcgaatttactttttaatcggcggttgttcaacagtgatgataattcttgtagggctgtttgtttggcgctatcaaacccttaatgtgaatgttgcacagccggcagtttgtacgcgacggctgcggttgccggcaaaagtggttctgaatcagacaacggtcgtgctcgaaaagctggaaacaaaggtaacgaatgggcgttggcgggtgcgactggtttttaaacgcgcaattacgaaacaaaaccttaagcacatccgcattcaaatcgcccaacaccgcgaaggaagcgaagtagcaaatgaacaacttgcggtaatgagccgggataagaaggtattgactttgacggatacctattatagtcaggcgaaatacaatcgtgttgtcatgacgacattgccaagggttgcacgttcacaaaatctcgttcagattgtaacgttcaaggaatgagatcgtgttaacataacttgatgactgaatgcggtttagaggagttgagcgctgtggttcaagaaatagacgacttgagatttcaactttcaccacatgctaaatttgatttccgtgctgccgttttactggtgcatgacaatcaagtgttagtaacggtgcagcctactagtggtgttgccattgtccccggaggtgcagtgaagtttggtgaaacttccggtgtggcggctaagcgagagctatatgaagaattgcggcttcaggttgatgagccgccactagtaggcgtacttgaatcattttggcaacagcctgatcgaacctatcaacaactgatcatggtgcatcgcttggtactgtcccaggcgcaaattgacgaactggtttggcaggaggggctgcaggggcagtggttgccgaagtcagaggtggctaaacacttgcaaccgcgcgctttggcacaatttttagaacctagtgcaacacttttgcaccttgtcgatcgtcattcggaatgaaacttgagtggttttccggtttgaaagcgtgcacacggcatctcaaattataaaatatataattagaggtgcttattttgcctttctttgtcaaccttgatacgcttaaggtaggctacagccggaagggagttgcatttttatggatataacgactagaccgacgttgcagcaatttttagcggataccaaacagggtccgtatgtatcactgtacatgtcttggccggagcatacaccggttgagaagttgcggatccggttcaagaatatgcttaaacatgtcaagacggtgatggcggaaacctattcgggcaccgactttgcgccatatgctgccgaacttgaaccatatgagcaagatccgatgttttggcaagacagcgaagcaaacgggattggtatgttgacgaacggtgcgcaaacgtatgtaaccccaatgtatgaagcagttgatgaagtggcaatggtaactgaagtgccacagattttgcctttgatgctggatgaggcaaccgcaacagattttgatattctggcgcttaatgctgatagtattcagctatatcataaccatggtcaccaagtgcgcccggtttccttaccggatgatgcgccacaaacattgaaaggcacacttggaacggaaattcgcggcggcgagttaaatagtgtgtctcaaggcggtggccacgtcacttaccatgggcacaacgaaaaatccgccgagaaggcaagcgatcaacgtcgattctaccaggcagttgatcaatatttactgacaaattattcgaatcctaaaaaaatgccgctggttctcatgggcttagcagagaatgtagcggtattccgcgagatttccaagaaccatcatttactgccgaaacttgcagtggtcaaaagtccggcaacgcttgattttgttgagctggatgacttacttgaaccagtgcgcgccacattgcgtgatcggcgccgacaacacttcgctaatgtcattgaaaacgcacgcggcaatggcagttacaccgatgaattggcaacgattgtatcggcggcattgcgtgggcaaatcgccatcctctttgttcaagccggcgcacgcattcacgcgcggcttgaaggtgatcagattgagcgcgattccaaggctgctcagcatgcgaatctgttaaatacattggcggacattgtattaggccacggcggtcaggttgaacttttgcccgaagcccatttatcagctaaagtcggcgctacgatgcgttatgcttagtcaatgattgtgaacaaaaacgagctgccaagttggcggctcgtttttggttgatattcaaatatcgcgatactagtgaatcacccaaaaatcactttgacaatttgttcagcggttttgaggctcacatcattgaccaatggccgcgggctggcagtggtgagccagtgaacgccttcagtcgggacgccccagaagaaaaggccggcttgtggatgttctttttggtcaagtagctgttgggtttgacggtcaatggcaatagcgcctgactggaagcgtttgtcggcgttgagctgcagttcataagtgtgtgcgtacccgtcatgaagcagctgctgtactaatggattttgggcagtgggcgcattgactgccggaacgcgtgcttctagcaaggttttggcttgaagcgaaaactttggatcgctcggggtttttaaaagaaattggccgtcaatacctttgatctgcatgccaggcggtaaaatagtgacgataccggcacccattagtgcttgcagttggtcaatccgcaaagcaggcggtccgattgaaagaaaatcattcagtgagttaaaccagcgcaagaagaagtccaggtattgatcctgactgagaagattacgctcaacgagttggcgaattggatcgcgcatgtcgcgtaaaacttcaagcgcgctggtcagtggtccggttttggtgccgcgcatcgcttcttgggcatcctggcgcagataatgccgcatgaagtcttggtacggctgaccgcttggatgcgccttggtgggatcagccaaagcatcccaatcgagacgatctttagcggcgattggcagtgctcccaaggtggcaacagggtcggcaataaaatcgcgttcaaaagctgcctcgtcaatttctgggtagcgttggggcaacaaaagccgatagtaaatcaactcggcttcgtgctgtaaggcttcccagaaggtttgaccgctcacttcgccatgagtttgccaagcgtcaatttgttgtggtgtcaagaaatgcggctgccattcttcacccggtcccttttggttacggcctttagcacgataagggaaaccgcgtcgggagccggcaaaaatatgtggttcgcggccgctgggatgataaacaagcagaccgtccggcgctttttggaattgtccgccgcggccttcagtgagacgactcatcaaatcaaagaaactcaagcccagtccgcgaatgatgaccggtgattgtgcttcaatgccgctgagatcaccttcttcggggaaacccggttccaggtaaaagagctggtgtgtttgcgcataatcgtgcaatgccttttggtcgcgcgtcaatgagttttttagatttcccaaggccatgaccacttgatcggtttgccagctttcttgggtggtggtgatggtaaatccggcagcttttttatctagccggttcacggtttgctgcttataggtgatgatgttggtgccggcttggtgtttttgcaagtcaaagaaccactgttggtagacgccgtacaacgcgcgggacgcatagctgttgggtcccagattggcagcctggcgcatcagaatcgaacggttgttaatttcggggtgagcatcgaggtaatcggcagcaagcgtgagcgcccaggtgcttaagtccggaccggcaataaacggtcccacgcctgtcactgtttgatcggtaaataaggtgatttgtgccgcagcagtattcataatgagattagggtcttgatcgatcttccaaacgcgaccgccaattggataaggatcaactaggaaaacggtaagttggcgctggggataacgggtccgttgccaactgataagccgacctaaaagcattaagccacgtggcccggcaccgataagcgtaatgtgcatgccgcatctgctcctttatgagatgataaattaagaagtaacaaatttattatacttggaagtgtccctaagcagttagcgacttgctttaggtttcaccgttttcgtgtcataatgtccttattaaccatctagaagggaaggcagatgctgatgaaagttgtcgttgtgggctgtacgcatgcaggaactgcggcagtgcgcgaactgttgatgaggcacccggaaacggaagtagatgtttttgaacgtcgtgaagacatctcttttctttcatgtggtattgccttgtaccttgaaggcacagtcgggcggctggaggacatgttttacgcaacgccggcctcactcgaagcattaggtcccaacgtgcatgttcacttaaaacatgacgtcttatccattgatggtgccggtcatgtgattgtggctgaagatttgaagacaggcacacaacagcattatccgtacgacaagctgattatgacaactggcagctatccggttatcccaccggtttccggtgtaagcgttccgcgggtcttgatgtgtaaaagttatgatgatgcgcgcaaaatcaaggagagtgccaaagatgccgaaacgattgcaattgtcggtggcggctacattggcgttgaactggcagaggcttatagtcgtaatcaaaaacacgtgattttaattaatggggttgcgccattgctgagccattatgtggatttaccgcttagtcgagaaatttcttcagtattaacggagcatggcgttgaattaaaagtcaacacggtggcacgccatttcgatagtgacgcggagcatgttttcattcagacggatcacggtgagattcaagctgatttggcggttgtctgcgttggttttcgtccgatgaccgagttgttggttggtcaggttaaaatgaatcatgatggctcaattcatgtgaatgattatatgcaaactagcgatcccgatatttttgcggcgggggatgcggttgcggtgcattttaatccgactggtaaagatgcgtatgcgccacttgcaacgaatgcggtgcgtcaaggaaaaatggcaggtgcaaatatttttggcccaacgatcaagtatatgggcacacaggcaaccagtgcgttaagattgtatgatcatagtctggcggtcacggggctgacgcttgctcacgccaagcgcaatcaactgccggcagccagtgtgacgatggttgatgattttcgaccgccatttatgccgcacacggtgaagattaccatggtgctggtttatgataccagtaatcgtcaaatactaggcgcacagttttacagcaagtatgatgttgccaatgcggccaatttgatttcggtgatgattcaaaatcgtaataccattgatcagctggcctatgtcgatatgctctttaatccgaattatgataaaccgtggcattatctcaatttgttaggacaattggcagtagcacaagcagacaactcagcggtgtagggggaaaattatgaattcgtggaatcttatcggactgttcgcgtgggtgatcctgatcgcctacctattcttcatcatttggcatattcggcggcgacatattaaagctatcgtcaaatccgggcggcaggtttccccttccgtcgtgttggttgatctggtagaagtagcggtgttgttgctagcggtcgccggaatggtatgggtgagttggttgcgtccgattgactaccgggatagccatgaggtgacgattagccacagtgcacaaccacttattttgcagaccggtgatgaacattccttttatgtacgggttcgcacgggaaatggtaagaatccgattttgtactatacttattggacagaaggcgccaagtatgaaaacacgagtcataacgcggaagtgagctccggcagccaaccactgacaccgcgagcggccgcatatccgtggtccaaaaaggaacttaaaaaactggatcaaagcgctgatcgtgcatatgtcgcaactgtatcggcgcagtataagcctggttttcttaacggcttaggcatgcatgtcggtcacagtgccgatcggttttcgattttacgggtgcctaatgatacatttgttgaaattgatccggttgaagattaaagcgtgttaactaaacaatttgaaagatcgttggtgtgaaatgcggcatcagcgatctttttttcgattgacaagcttagaaaaaacgaagcagccgcgattctgcgtgtgttttttagcttagccgaatcgattagtccgcggtacatggtatgatgaaagcattcgaaatgggtaatataaaaggtgcttgtctggttctaaccgcgccggctcgcgctcagttttactaggagatttgctaatgaggcatcgtagctggtgattgctgccgttgttgctgcttttgggctttggtcttgcggggctgcaaccggtttaagccgcttcaggtaaatggtatcgagataatggcaacatgatgggttctgaaagtaagacggttatcaaaaagctgaacgaccaaacctttgccaaaataaccggtcatccccaaattgccgtgatcaccgtcacgtccctgcatgatgacgagattgaagactatgccaatgagcagtttgctaagcttggaatcggcaagaaaggttgggataacggtcttttactggtgctttcacgccgagatcgtaaatattggctggaagtgggttatggactggaagatgtggtgccagatggcagtgccgatgagattgtcactggctcggtcaaaaaactgcttaaagcggaagactacgatcatgccattgcgttgtttttgacaaatatcggtaagcgggttgcggctcatcaaagcgccattgccacgccgacgcagataaaagccaagcgtgcccatgatgccgccgttaagcagcttttgataacggtagccttggtagtggtcggcatgatggtgctcttcttcatcattcatgctgccataaccgctcgcttacgtgatacgatgcggcatgtagctgccatgcagacgttaccgatctatgccgctgtgactgctgccgggattaaactgcaattagacacggcggcggttccgctatttcgctttgcctggtcgcatgacaaattgcgcgtgatcgggatggcgaatttgacgaggcggggatttgaatcgtggacgcgaaaagtccgaatgatggtgccgcacccttattggtactatgacaacgttcgcggagcccttcgcaagttgccagatcagacgctggtaaatgcgccgaccattgccgcggtggctgaattgttaagcccggcgctggcagatcggtttaaaaccggacaaccttatgaagcagctttcacggcctggttgaatgaacagaaaagtgttgccgggcaagcagcggtgacgacttggtctaagttcctggcaaaagttaaaccgactgataccttctcagatgcaacgctagccgccactttttccgctattcttttccatattcgccatcccgatcaagatcaggatttgagtcaatccgatgtgccattgtgggttatcagtgattttggctcggcgactagcagtcatagtggcgactccgatgactttggaagtggcttcggtggcggttctagtggcggcggtggttttggcggtagttggtaagccagacccgacccttgaaagtgacgcaacacgtaggctaacataaaaaatatatttaaaacgatgggtggcaggtagctaccgccattaaattcaaaaatgaggctagataaatggagcagatgttgttgttaatgggtaccgggttgctaggcggtattctgggagccgtgctaggaatcggcggcgggatgattattaccccgattttgacaatgttaatgggattaccgattcaatatgcgattggtgccagcattgtctcggtcattgcgaccagttcgggtgccactattgcttatctaaaagatgaaatgctgaatttacgggtagccatgtttttggaaattgcgacaacggttggggccgtcattggtgcggttatcactggcctggtgaatggcaaggtattgtatatcttatttggcgcattgttgatattttctgccttcaacatgattcgcaagttgcggatgaaagacgatggtgtgcgccaaacaacccctgatgcgatggccacaaaattacgcctgaatgggacgtattttgacaaggcaactggaaaagaagttaattatacggtaacgaatgtgccaggcggctttgcgatgatgtttggtgccgggattgcatcagggctactgggtatcggaagtggcgcttttaaagtgattgccatggatacgattatgcatatgccgttgaagccatcgagtgcaaccagtaacctcatgatgggagttacggcggccgccagtgcaacagtttattattttggcggtcagcttcagccacaaattgccgccccgcttgccatcggaattctcgtcggggcaacggtgggctcgcgggtgatgcaggttctgccaaataaagtcttgcggctgattttcattccggtgattgggtatatgggcattcagatggcacttaagggatttggggtgaatatctgatggataagaaactcaaaaccgaaatcgatgatgttgaaatcatgattggtaaagtgatgcagattggggtcattttggcggcagttgtgattatttttggcttgatactcttgttggtcagcggatcgaccggttatccggccggtgttcatccgacgcgaattggtgcgattataagcggcacggtggcactgaaaccttacgctatcctgatgacggggatctttttgctgattctgacgccggttttgcgcgtcgtggtatcaatctatgcgtttgcggttgaacacgatcacttgtacgtgtggattaccaccgccgttttgattatcctgctcggcgccatgacgattgggtatctgggcaaccgttaattaaaaaatagcgcttttgcaccgggttattgatccggtgcaaaagcgctattttgatacttcgtctggatgatgagtggcgtttagcacgcaattgttcatccttcgcggggcgtcattacttaccacttggcttgtgttccatgtagtccttcagcgtggcaacgacggaagaatccggcatctcacgcatggatttaatattgtgaatatgttcaactgatacatggctgttaagcgccatctctgtgtccgttagatgatttttacgctggaagtcgataatttcccgtgaaaatgcactgatttgatctttttcagccaaaacgattcctcctcgtgaacctttactaacagtataacgatttttgtcattatgcgcacgtatgacatccaatcgtaactttaacaccattgatttgaaggttttcaagcatatcgtaacgatgactgaagaaaagtctaaaatctccagatgctgtgttcgtaggctaaatacatgaacgaaacttaatgattgcaaagccgaacaagcgtttgtataataaagatgcaccaaggaaatgggatcgcttcgttaattaagaaccgcatctgttagctgcaatgttggttagttgattaggagtgccaccatttaagcggatggtgtgtaagttcatatgcgtgatgatcgcgatcgtaaaatacacgccttgacccgatggcgacaatgtatgcttgcccggttacaagttgttgataaagctttcttttcttgacgagctggatacccttcaacaggactttgaggatgataaaccaaaagctgattaacaaaagccataaccacccattggatgttgagtgaaaagttgaggcttgcagggttagcataagcggattccaaagcaaagcggtggcatcggtgattagctgattaaataaagcagttggtgttgcaaacagagatatgagtgtgatgccaaagataaacaatccccaaagcatataaggtgccatgatcaacacggtaagcgcgcggagtaaggaatttggagtatgcaaaacgatagcctttcgaaaacgatgccatgcatagaacggatcttgatcggctatggttatcatctcccagttgttagtgaaacgatttcgtttaacaatctctttttcatacagatattgttttgatgttttccggacaaggtaatcgctagtcttagaatagcgcaatattgccttgatcgaaaggtaaggtgagcttatggaacactatgcctatttgcaggatctggcagccaatcaaagggatcgggaactgcgcgtgcggatttgggataataagaatgtcattattcggcgaaacctcagccagcatcagggcttggctactcaggtctgggatgcatggttgcgtcaggagctgcgacgttttaacggttttgagccaattattgaagttgatgatttttccgggcatcaggaaattaagtttttcaaggaaaatgaattagcggatgccgttcatttcattcttcaaggcgaaggtgcggttgaaacagctagctaactgtagccagattagctgggcgtgtaagcttttacatcctctatgttatcagtatactgaaggtaatgaggtgaggacgatgaaggcgattattttatatgcatcaatcacaggcaacgcgaaaggaatggctcggattgagcagcagttctttgagcattatggttgggatgtcacgcttggcgaaatgattcagactgatccggcaacgattaaagactttgacgtgttggtgctggcaacttatacctggactggcggcgtgatccctgaagagacccaagacttttatgatgacttaagtaagctggatttttcggctaagccattggtatttggagtgctgggtacgggtgatccgtattatggcaaggattataataccgctccggaaaaatttgaagccgttttgaaagctagcggtgcagttcaaggcgcaaccgcggtcaagattgctttaaacgttaaacaagaagagatgcctcagtttgcgacatttacccaaagtctgatcaaaaaaaccgaagcgctgcaaaacaagaagtgacccgttggcgcgtggtatactaaagccagaaagcgaggggatcttcatgagtgaggaaattgttttcttcaatcccggcgatgcagttgccaatgatttcgacttcgcagctgctcggcgtagtgcgcagatttacaaagcacagcatgtcgttgatgaaggcttggtagttgccaaagataaagacggcaagtattcggtcttttatgaggctgccggtacacctgattcacaggctaaaggcgcatacaaagatgttggcaagtatacgatcctagctcacttatgacgaagacagtctggtatcgcgtagccttggtggtagttgctgtcattcttatcggagttctttatggtttaatgcagcaagaacaaatcgcgaatccttttttggttggcagtcttggcttaattctcggcgttgaccttgctttactgcttgccaatctttggcccgtgcatcattcgcgcaagccttaaaaataatcattcaaaaaatgccaatcaatccgcggccggaaaatttgcgccgtggcttggttggcatttttgcttcgttgaccggtaacttagtcgttgacaatatagcgtggctgtttgcctgacaaaatcgccaaagtgttgtccgtgacaatttttgccatggcatcacgcgcctcgactgttgcgttcccgatatgcggggtcaaaaccacattatcaagggcctttagttctgagctaacgtggggttcggcttcgtagacatccagcgcagcaccagcgaggcgatgcgccgtgagttgttcaagtaaggcagcttcatcgatcaagggaccgcgtgcggcgttgatcagataagcgctcggtttcatggttgccagtgcctgagcatccaacaaatggtgggtagccgggactagtggcaggtgaagggtgacaagatcgctttgttgcaagagtgtcgcctgatccgtaaaggtggcacctaggctttgctctttttccgatggcagttgatgatgctgcgtgtaaaggatgttcgcatcaaaagcatggacacgtttggcaactgcttggccgatctgccccataccgataatgcccacggttttgccggcgagttcatggcctaagaagaaggttggcgcccagccggagaacccgggaccgcgcatgagccgatcgccttctgtgacgcgatgtaaaacggcgagcattaaagctagcgtcacctcggcagttgacgtggttgatactttgggggtgttggtcacgaggacaccatgcgctttagcagcagtgatgtcgatattattgaaaccagcgccgtaatttgcgattaatttcaaatgaggcgcttttgccaatgttgcggcgcttaccggagtcgatagcgcggtgataagcacttttgcatcgcttaaatgtgcctggagctcggcttcggtaatcaagcccttaccgcgataggcttcaaagtccacgcctgcacgtttcaaagcgttgttggccgatttcggtaaggttgcagaaatataaacttgtgccatgaatatccacctttctgtggtcatccgtatctgattcacttttagtttaatacagcgcagagaaaaaagtgtgggcgacgccaaactcagcgcgaaagaataaccttgttggtaggaacccagtaaaaaacgaggcaagatatgacgtgcacgactcatttgtgttacactgtttttggtaacaaaaagtaagcaaaggggattgatcgttgatggcaactttaacgcaagatatgaaagatatgatcggtgcacagctgaattacttggcgacggctgatgaaaatggtaatccgcaagtcggccctaaaggtaccatgcgggttttggatgatcaccacttgatctataacgaagaaaccggcaaacaggcttggcataacttgcagtattcaaagaaagcagccgtagcaacggttgattacaaagctttgaagggcttccggtttgaaggcaccgttgaatttcataacgatgatcaaatctttgaagacgcgcaggcttttgctaaggagcgtcatttgcctgcagctatcagtgcggttgttatcaatgtcgatcgcatctataagctggatgccggtccaagtgccggtgatctgatcgaaggctaatgccgcgttgatgatatcagcgtgattttagacttgtaaggcgatacggacagttccgttaatctttttaattagtaaattcataccccgccgttgtgacaaagcgcataacggcgggcttttttgtgttctgaattaaatactaattgttattattagcatatttattgcgaataatcaggccggttcgttaagcttaagatagtcagaaggatgtcaaccaaaagaaagggtgagaaccatgatgcatttaatttggacactgattattggtgcggtgattggttgtattggtcagctgatcgtcggacgcgacatgccacttggctggatcggaaatattatcggtgggcttatcggtgcatggctcggcacggcgttacttggtagctggggaccatcactggctggtatggctttgattcctgccattatcggagctatcatcgtcgtcttccttgtttccttgttgctgggcacgactcggcgcaaggcataggaggcggcaggatatgaaaccgatcacgaaagtattgttcggtattgttgcgatttgcggcttacttcagagtattggctttggcctgttgctgtggcccaatcgcgaatttacgcgcttttacgtacagcaggccggttggttacgtcctgtcatgattggactaaccgggcttgtgattctggcttttgccatcatgctgcttgtcgctatcttccgccgctccaccgccaatgctttgattctagccggtgacgatggtgatctgacacttgataaaagtgccatcgaaaatacggtagccaaagcgattgtcgaccggcattttgccaagtcggtggatgttgatgtcagcatccgcaagaagcaagtggcgcggatgcgaattgaggccttttccggaaacgtcaaggaactaaaacaagaggcgcagcgtatcgaagaaactgcacgccagaagttgcaagcgtgtctcggcgttccggtcaaacatgtccgggtacatttacttccagcaacgaaagtaaaagccaagactgcgcgggtcatttagttcaaacgactttgatggatcactgactgtcattcaaagcgggtggccgtaactggcaccggtggcagcagtggttatcagctacgaaagggtgatacacgatgcagcaaggaaccattggcgctgttgtcggcgtcatactagcctttgcctggatgcgtttcgggtttatgggcatgttgcttgtcttgatattcggcggtttaggctggctcattgaacgttatctggtgcctaattgggcgacgttcacaagttggctgaccgcgggcaaagatgcatttagcaaaggaaagtaggtgagtagatggatgcagtagcaccgccaaaaccagcatcagttgcaagccatcaagaaacactgatggccaacagtcgcttaacatttgaagataaggtcgtcgaaaagattgccgcaatttgtgcacaaaatgttgatggcattctagggatggatggttcggtgatggataacctgactgaaaccttctcaagtggcgagaacctgaccaaaggcatttccgctgaagtcggtgaaaaacaagtggcccttgatatggatgttttcctagaattcgacagcaacgcacaagccattttcaaacaattgtgtgagaaaatcagcgcacaaattgaacgaatgaccgggttgcagttagtcgaattaaacatgcatgtcaaagatgttttgacgaagcgggaatggcaaaaacgctaatcggcgctaagggaccccataacgcgttcgccagcgcagggatcagcgtgtagggatcttggttgcaatggtcaaagtgcgaccatcacgtccaaggccgcttacactccgatccttaaacgcgccggttcacactcattttaaaggagagattttaatggacaacaagaaacccaacggaatcaataaggaattgaagttcgatgatgctgtgatcgcaaaaatcgtcgggattacctgcaatgaagtcgaaggtgtttattcgcttgaaggcggcatgatggctaatcttacggatatgttcagcaaggatgaagacccaaccaaaggcgttaacgttgatttgagcgataaccaggacgtttcagtcacacttgatgcaacggtgcgctatggtgagaatgtgccggaaatcttcaacaaagtcaccatggcaattgccaaaaacgttcgccagatgaccggtctgaatgtgacagaagtgaaaatgaccgtcaagaacatgctgacaaaagaagaaattgcccgcaatgaagctaaaaacagcgacaagaacagtgacaaagaattacagccggcttaatgagtcaatatatataaaccggtaaaaagggatagcccatcatccatcgggggctatccctttttgacgttcaagaagcaattttttcgaccaacgcgggtagttctgtcagatttggcagggaataagtcggcgttatgtctggtagtggtgataattgctggcgattaatccatacgcaaggccagccgagtttatgacagggtacgatatcccaccaataccccattgccacgtggagatggggttggttgagtcgggtttcggccgtggtaaaaaaggacaaagttggtttataacaatgcgtttgctccggtaaaatggcttgatcaacttggtgctccagctggtcaaagtggtgggtcattaaatccggggtggaattggacatgatgatgattcgatgaccggcttggcgcaattgctgcaaagcggggatgacttctggccatggttgtaagttaatataggactcaaataaatcatgaaaataatggctaaatagtgaattggtgcgaaaagtcatatcaagatattgcagatcgcgcttcaataaggtggtgaaaggcaaggtggtctcgccatacatgaggcgatcctcccacgattcgaattggtgccatgcagcctgaccgtcaataccatgacgagcactgaaggtcataaactgggttcgaatggggcgggtgtctagcaaagtaccatagcagtcaaatgtaatatccataaaatcacctttttgagtatcttagcatgatcaaggctgagaacaagtctttaaaaacaaaggtatcgatatattcggcagggtcggggtgtcttcatagccgagaccaatatagtaggttagataatggctgttcttaatagttgcacggtttaactaattgacgttcctgccaataactattaaactttttaccaatatcaaagggggaacatcatggaatatttgaagctactcggcattgtcatcattgttgttggctttgccttgaaatgggataccaccgcggttgttgtgctagctgcgattgtgacagccgtgttttctggtatgagcattccggatttgttgacgacactgggacaaagttttgtggataatcggatggtgtcgttgtttttcctgaccttaccgatgatcggattggttgagagtcatggtttgaaagaagtggccgttaatgggattcagaaactgaagaaattaacgccaagccgaattttgaatctttacttggtcattcgtgaattaggcggcgtctttgggatttccttgtccggccaggttcaatttgtgcggccgctgattacgccgatggtcactgccgcggcagaagcgaaacgtaagctgacggataaagaaatcgacttgattaaagcccgatctgccgccacggataatttcggaaacttttttgctcaaaacttatttgtcgcaaccgctggcgttttgttgattgcgagcacgatgaagagtctcaagcatccggtagagccgatgcaggtggtgctggcatcaattccgatcgcgattatcaccttggttgtagtggcggtttataatcgctggtttgatcgacaatttgaagagacgccgcgtaaaggaggcaaaaagtgatggtcgacacgttactgctcattctttatgcactcatcggcgttgtcatggcgattgccgggattgaagcctttcgggcaaaagacaatccggctcgaatcggaaccggcctgttttggatcatcatggcaattgtttttgcgttcgggacgctattaccggcaatggtcgttggtattttggtcgttattatcggtattttggccttattcaagcagattcaaatcggcaagatcaagccggttgatggtgcgcatgcggctcaggcagccaaacgacttggcggctgggtgtttgttccaagtgttgtactggcgatcgtttcaattgccgttgcccagtttaccaagttaggcgggcaggtcgggatcggcattggcgcggcggtctcattgattgtggcgatcatcatgaccaaggcccccgtcaaaatggtttataatgatacccaacggatggtacgatcagtcggtgcagccggtattttaccgcagttgttggcaacattaggcgccgttttcacagctgcaggggttggcactttaacggctaagttgattgcaggtctatttccggcaggcagtcatcttggcggggttattttgtactgtgtggcgatggcattattcacgatcatcatgggtaatgcgtttgctgcctttgccgtcattacggcggcgatcgggattccatttgtgattgcccaaggtgctaatcctgcgatcgttgcggccattgggatgacttccggttattgcggcaccttattgacacctatggcagcgaatttcaatagtttaccggttgcgttgctggaaatggaagatccattgggggtcatcaagcagcaggcacccattgcgattctgcttttggtgattcaaatcggactgatgtatttcctggcgttttagaaaggacgattaagtatgaagattcttgtgacagggtttgatccttttggtgacgacaagattaatccggcgattgaagcggttaaacgtttgccagatgaaatcggcggggccaaaattgtgaagttagaaattcccactaaattcaatgtttcggcagaagtggtgcatgatgcgattgttaaagaaaagcctgattacgttctgagtattggtcaggctggcggacgttatgaactgacgccggagcgagtggccattaacttggatgacggccgcattaaagataacgctggctatcagccgttaaaccatacgatccatgaagacggcgaaaacgcctattttacgcaattaccaattaaagcgatggctaaagcgatcagagaagccggtgttcccgcggcggtttcaaatacagccggcacctatgtttgcaaccatattttctatcaagtgcagtacatgcgcgataaggaatttccgacgattaaagcgggcttcatgcacatcccgttcttacctgaacaagttgttgcacggccagagacaccggcattgtcgcttgaagatgacgttaaaggcattaccgcagccattgccgccatcgtcgcacacgatggcaaagacgaccttgaaaccgttgaaggcaaaaatcattaattgaagattcacgttgacattttccgcaagctcactagggcgtgcggattttttaatggccgatttttccgttttctccgggtgggcgatataataaaggcagagataaggacacggatacatcctcagtttggcaaagggaggttgtgacaacatgagtatcggaattattggatcaggtaatgttggacgtgcgttgggacagctttttagtcatgttggcgagcaagttattttgtcgcatcgacatggggtggcatcactggctccggtgattgcggagatgcgatcaacagttgaagcgggtacagttgccgaggcggccaatcaggatattgtcgttttggcggtaccgttcaatgcgttagacgagttgccggcgcaagtgaaagctgatgccgtggtgattgatgctacaaattattttcctagccgtgacggcgaacgatccgaattgacgagccaccaaatcgcttcatcgcaacttgtggcgcaacactttgggactaagaaagtcgtcaaggcgttcaatacgattgcgatgacgaaaattcgcagtctggctaaaccgaatcaaccagccgggcggattgcgatccctattgccggggatgatgcagcggcgaaaaagacagtcactgcattgattgaaaagatcgggtttgatgttgttgatcttggtgatttggctaatagctatccggctcaagcagatggcccgttattcctgttcaccggtgatgctgatcaagttcgggcgcaggcaaataagtgactgcagcatggtagctcactttgcacacaggagaaaaaattgatgattttcttttatggcattttgttcatcatcgcgctgactttcttgtgggtaattagcaccagcgagtacgcgcgattggttcaggaaggaaagtcgcggccaagggcgtttgtttcggccttgctgctgggctggatgagcattttttaaaaagccgctcgctgcaattgaagacatgataatcaaaaatcggccttagtggagaagctctctcactaaggtcgatttgtttgcggttattttgttattggcattaacgctgtgtctaattttgatatgtgctcactgtaccggctggccgatacgctttttgtgatttgccacaatcattttggcaatggctttggcgatgttttggttcttaaggactggaccgtgtgagtaactgccgatcgtattcttatagcgcatgccttcaacaccgtcttccggattgttaccgtagccttcgatcatctttcctagaggttttagcttatttttgtcgtcaaaataagttcgcccgctatggttttcaaatgccttgacggtaccgaactcggtttcgtatttggtgtcgccgatcatacgactgtccggtttgaaaacagtatgcagcggcaaaataccgagccctttaatgaccgttccttcactagtcttgtaatagtcaccgagtagctggtagccgccacagatagccagcatcggtttaccattttcgatgtagcggcccaaggtttgggcatagcgcagtaaatccttggcgacaacggtttgttcataatcctgaccgccgccaaagaaaatgaagtcgtagtcatcggcattgaagtcgtcaccaagactgatgttatcgacttgtacttgatagccttgttgattcagcaagtaacgcagaattttaacatccccgctgtcgccataagtgttcatgagatcctcatacaaataagcgattttgatcgtatcagccatggaccgagcgcctccgtttttttgattggcaacagcttaccacaagtgaagggaaaaagagaagtgagctgattgattggtgatggacaattaaagaaggcgggtaaagtatcagctggaacaacgccagactggtgctttatccgcacttagttgccctgccatatgaatagcaggatttaacgtttatgtgccttgatccaaggttgagccttttcctcaatcgcttgataaattgcatccatatccgagtagtcactgatctcaaacacgaattcatctggctgatcgtgaaaagtcggcttgttgtttaagatgatgttcagctggtcaaactggttgtcgccggtatctttgcgaatttggtaggtgaaaaacgccgcttcataattttgaatattgtcaggttcttcatacaacacttccataaactgatggtcggtcttgtagttgtcctttttcagcttatcccacagtgcctgatactgctgatgaagttcagttaactgagcatccgttaattgttcgttttctttaatttctttaccgtctaattccatttttttcgcctctgagttgaattacttccttattatcgaactgtgtcaggtgattgtcaaaagtgaatccttagtggtaagtgtcaacttaaaacaagacaattagctttcactggccttaaagaagtcgagccagctcggagtatcggaaatcacttaattatagtagaactgagaaagagttggcctttactcccataacgcgctctccggcgcagaagcctgcacataaggaccttgaacgcaatggccaaagcccggccattacgcccaaggccacttatgctccggcttctaaccgcgccggctcgcgcttctaacgcgttcgccagcccagaagtctgcgtgtaaggacctgagtcgcaatggtcaaagcccgaccatcacgcctcaggccgcttacactccgacttctaaccgggctggctcacgctcactaagaatacagttgaggagatgccgcttttacgttacacttgacgggtacgtgaaaccctgtttgttccacaaaatcaaacccaaaaaaacggaggcagacatggatccaacagcttttgtccacgccttggctgatcacggtatcgtgttgaatgaccaccaacaggatcagtttgcggcttactatcagtatctgatcagtgagaacgagaaaatgaatctgactggtatcactgctgaaggggacgtctacctcaagcacttttatgattccctaacattaggcttggtggtgccaaaattgcaaagccagccattgtcgctgtgtgatgttggcgccggggcgggttttccatcaatccccttaaaaattgcgtttcctcagttgaagatcaccattgtcgattcgctgcagaagcggattggctttttggaacgtttaacggcgcggttagagttgaccgatgtgcagctctttcatgatcgggccgagacttttggtgccaaaaaatcgccgcaccgtggccagtatgatctggtgacagcacgcgcggtggcggcgctgaacgtcttagcagaactctgtttaccactcgccaagcagcacgggcagtttgtagcgatgaaggccgccgcaactcctgaagaattaatagcggccaaaccggcaatcaacctacttggcggtaaactcgttcaggatgcagcgctgaccttgccggaaaccggggatacgcgccatttgttagtgattgaaaaagttaaaccgacaccgaataaatatccccggaaaccgggaatgccgaataaacaaccattgggaggtgcatagcgcgtggcattatcattttttggccataaaaagtcagatgacgagacggtcgtgcaacaattaccgcttaaagctattgtccccaatcaatttcagccgcgaaaagtttttacttccgaatccattcaggaattagctgctacgatcaaagaacacggcttgttgcagcccattattgtgcgtgaatacgcgccagatcagtacgaaattattgccggagaacgacgctaccgggcaatgcaactgctaggttgggaaaaagcaccagccattgtgcaaaagatggatgatgatgaaagtgcgtcaatggctttagttgaaaacctgcaacgtgaaggtttaagtgcgattgaagaagggcaggcttatgttgcgctgatgaaactgaatcacctaacccaaggcgcattagcccaacaattaggtaaaagtcaggcttttgttgccaataagatccggctgctgaagcttagtgcgccggtgcaagaagccattatgaatggtcaaatcagcgagcgtcatggccgtgagttgttaaaactcgatgaatccgaacaagtaccagccttacaacaggtttttgcggaaaaactgacagtcaaggaaacagctgcgttagtaaatgaacggttgcgcccaaagaagcccacaccaaagcctaagccaaaagttcggcgatcagcggtgagtcatgatacccgcatcgcttggaacacgttgaaacgttcggttaagatgattcgggatacgggaatgacagtcacggccaaagaagaagataccgatgacgcataccgtatgatcatcgagattccaaaagagaagagataggaggaactcatgacacatatcattgctgttgccaaccaaaaaggcggtgttgggaaaacaacaacgaccattaatctgggagcgtgtttggctaacctgggtaagaaaattctgattgtagatgctgatgctcaaggcaatgcgacaagcggtgtcgggattcaaaaggcccaagtcgaaaaagatatctatgacgtgttagtcaatgaggatccgattactgaagccattttaccgacaaagcacaagaatctttttattgttccggcaacgattcaattagcaggagcagaaatcgaattaaccagtcagatggcacgggagatgcggctgaagttaggtttacacccggtggcggagcagtacgactatatcttgatcgattgtccaccatctttaggccagctttccatcaacgcgtttacagcaagcgattcgattttgattccggtacaaagcgaatattacgcgttggaaggattgagccaactgcttaatacggtgcgccttgttcaaaagcatttcaatccaagtttggcaattgaaggcgttttgttaaccatgtatgatgcgcgaaccaatttaggggcgcaagtgattgatgaagtgcgcaaatattttggtgataaagtctatacaaccgtgattccgcggattacccggctggctgaagcgccaagttatggcctgccgatcgtggattttgatccgaaatcacggggatccgaagtttacgaggcattagccaaggaggtgctggctgctcatggcgaataagaatagtaaaggattaggtcggggaatcgatgcgatcttcaaggattttgaaagtcccgatctaagtgccaacaataccgttgaggaactgccgctggtcgatatccgtcccaatccctaccaaccgcgtaaaacctttgatcaagaaggcttaaaagaactagctgattcgatcaagcaaaccggggtttttcagccgataattgtgcgcaaaagtgtttcgggttatgaaatcatcactggtgaacggcgctttcgggcgtcaaaactggccggcaaggaaaccattcccgccattgttcgcgactttaatgatccggaaatgatggaaattgccgtgttggaaaacctgcagcgagaagatttaaccccgttggatgaagcacaggcatatgatacgttgatcaaacgcttaaatctgacgcaagcagaggtctcggcccggctaggaaaaagtcggccttacatcgctaactatctgcggctattgacgttgccacaaccggttaagcagatgttgagcgctaatcagctgtcgatggggcaagcccgaacgctgctgagtcttaaagataagaccaaaatggtggcagttgctaaaaagacgatcagcgaaaatttgacggttcgccaacttgaacggctcattaatcaaatgaatgccggcaccaatcggccagcgaccaaggaaaaaccgaagtcgccgtatgtacgcgcaaccgagaatcagttaggtgagcgcttcggaactaaggtcaatattaatgaaggcagtaaaggcaagggcaagatcgaaattgattttagctctgaaaaagacctgaaccgtattttagccatgcttgacgtcaatattgattaactggcaaaacagttggaggtgggcgcatgtatcaactacatgatctggttcaaatgaagaaaccgcacgcgtgcggcacaaatcgttgggagatcatccgcttaggggcagatatcaaagtacgttgcaccggttgcggacatatcgtgatgatgtcgcgccgtgattttgagaagcgactcaaaaaagtgttgggtcaggcagaacaaacagactaaatagaaagtgtgaaataaccaaatggctttaacagcaggtattgtcggacttcccaatgttggcaagtccacgctttttaatgcaattactaaggcgggtgcggagatggcaaattatccgtttgccaccattgacccgaatgttgggatggttgaagtgccggataaacgactggcacgcatcgatgaactgattcccgctaaaaaaatcattcatacgacttttgaattcaccgatattgccggaattgtcaaaggtgcttctaagggggaaggactgggcaacaagttcctggaaaatattcggcaagtggatgcgattgttcatgttgtccgtgcgtttgatgatgacaatattaccagcgtcaccggtaaagtcgatccgctagaagatatggccaccattaacatggaactggccattgcggacttggattcagtcaacaaacgctatgccaaggtcgaaaaagtggcgcggacacaaacaaacgataaagaagctcaggctgagtttaaagtgttgcaaaaaatcaagccagtactcgaaaatggcggtatggttcgcagcatcgactttgataaagatgagcaaaaaattgtcaaaggcctttttctgctcacgagtaagccagttttatatgtcgctaatattgccgaagaagcgatggctgatccggattcagtcgactatgttaagcaaattaaagccgaagccgctaaagaaggtgccgaagttatcgccatttccgccaagaccgaagaagaaattgcggagttggacgatgacgaaaaagctgactttttggcagcggaaggcgtggatgaatctggcctcgataagctgatcaaagcgagctatcatcttttggggttggcgaccttctttacagccggtggcaaggagacccgtgcgtggacattccgtcgcggcatgaaggcgcctcaagtagccggtatcattcattcagacttcgagcgtgggtttattcgggcagaaaccatgtcctttgccgatttggataaatacggttccgttcaagcggttaaagaagccggacgttatcgctccgagggtaaagaatacgaagtgcaagacggggatatcattgaattccggttcaatgtttaagctgactggccaaataaggcccgcagtgatgatgattttttaagataggagtttcaaatggcagaaaagcatgaagcagacacgagtcaagcggtagacagtgctgcagttgatcaacagcaagcagcaggcggtacttctgaagcttcgtccgcaaccgatgcggcaagtaagaatgcccatgttaaacaggtgcggccggcttcaacagttccggaaatgattgaacaactcaccaaaaagaatgatgagtacgtgttcaagttgcggcgtgaattgaaagatggcggcatgtctgcaactgatgaagagaccttacttaagacgatgttgccggaaatgattacggcgcaacgtcaaggcaagcccgctacccagctatacgggccggtaacggtgaaggcaaacgaaattttgcatacgcccaagcctgaacccaagaagccaatgtggttactgattgtcgatcaaagcctgttctttatggcgattttggcggttatgtacggtgctttggcctacttcaatcccaagacccagaacacagctactagcggttttcttagcctcttgctgctgagttttatggccggaattttcttcgtgtactacgccgactggatgcaaaaagacaagaaagaacgccgcagtgcatggttggttcttggaggcggcgtcttattggtcgttgcggttaccttcctcagcagtgcgcttgcgttgctcaatacgccgctgactcagccgatgccatggtttgccaacattatcgttggggttgttgcttacggcattcactgggtgttgcagcatcggtatcatctcaagagctttttccaacggtagacttgggaaatcaaaggttgcggttcttgaacaactaggctcaataaactcaacgggtgctagaagacaggatgcatatgtcttctagtgtccgttttttctttgctgccaaaggaaattaagcgtgagtagcttgaaaactaaacgcctcggagctaatgccgaataataacaggtgattttatgagcatgattgcaaaagacgaacattaatttcgcaaactggcaaccgtttttattttgttcgggtcttaatgaacaattatgagattttctttcatttttaagcctatgataccggtcttttcaaaaaaattaacgtctacgtttgacgaggccaatttccggtagtacattagtcaacaactaaaattgaaagagggatttacgcaatgagtaattgggatacaaagtttgcccggcgtggttttacatttgatgatgtgttgttgatacctgcagaaagtcatgttttgcctcacgatgtcgatctgtctgtacaacttgcggacaatctaaagttgaatatcccaatcatctcagcggggatggatacggtgaccgaaagtgccatggcgattgcaatggcgcgtcaaggcggtttaggtgttatccataagaacatgagcattgaggctcaggctgatgaagtgcttaaggttaagcgcagtgaaaacggggtcatcgttgatccgttcttcctcactgctgacaagccggttagtgatgcagaagcgttgatgaagaagtatcgcatcagcggtgttccgatcgttaataatacaaccgatcgtaaactgaccgggatcattacgaaccgtgacttgcggtatgtcgatgataagagcgttctgatcgataccgtgatgaccaaggaaggtttggtcactgctccggctggcacttcaattgaagacgctgaagccattctgcaagcccgtaagattgaaaagttaccactgattgataagcaaggccggctcagtggactcatcacgattaaggatatcgaaaaagtggtagaattcccgcatgccgctaaagatgcccatggtcggttgttagtcgctgccgcagtcggggttacctcggatacgtttgaacgggcccaggcgctgttggatgcaggggttgatgcgattgtcattgataccgctcacggtcatagcgccggtgttattcgtaagatcaaagaaattcgcgaacattttccattggcaaccttaattgccggaaatgttgcaacggcagaagcaacggaggcgttatatgacgctggcgttgatgttgtgaaagtcggcatcggccctggctcgatttgcacgacccgaattgttgccggcgttggggttccccagttgaccgccgtttatgacgctgccagtgttgctcgcaagcgtggtaaaaccattattgccgatggtgggatcaaatattccggcgatattgtcaaagcgcttgctgccggtggtaacgccgtcatgctcggttcactcttggctggtaccgatgaagcaccaggccagtttgagatttatcaaggccggcgctttaagacgtatcgcggcatgggttccttaggcgcgatggcacaggctcatggatcaagtgatcgttacttccaaagcggtgtcaatgaagctaacaagctcgttcctgaagggattgaaggccgggttgcttacaaaggcagccttggcgatgtgatcttccagatgcttggcggcattgaatccggtatgggttatgttggcgcaccgaacttacaagaactacaggataatgcgcagttcattcaaattaccggtgccggattacgtgaaagtcatccacatgacgtccaaattacccgggaagcaccaaactactccgttcaataatcaagatattcagtttaagagcttgcagttacccacttgaggcagctgcaggctcttttttagtgagcgcgagccggtgcggttagcaatcggagtgtaagcggccttaagcgtgatggccggtctttggccattgcgcttaaggtccttacacgcagattgctgcgccggggagcgcgttatagaaagcgagcgtgaaccagcgcggttagggatcggagtgtaagtggcctcaggcgtgaaggccggtctttggccattgcgcccaaggcccttacacgcagacttctgcgccggggagcgcgttatgataatcgcgagcaagacagttttaacgtgcgagcttaccggttttgataacgtgtccgatgaaaagcagtcagtatcggtgtgccaaaagtggcggcaattgctaacggccaaggaacggggtgctctgtggtcgtcaacaatgtttgcagccattgcgcagtcggcagtagttttatcagccgatgactggagaattgggtaaataacagattctcactataaaataggatcaggtgccgctgtagaagcgggtcatggattggcaacagcaaatcattgctattattgcgatcacccaaaaacagtggcagtcctgcgaagtcgcgttgtaaatcaaatgtccggcttttatgagcactggccattgctggcgtgagtcgtaacatgaaaaccagtttatgtgctgctgcccacaacaacatattggcaatagcagcatcggttgccgtgaaattgaaagcaagctgctgtgctgcaggactggcgaatgcttggcgtagctttgactggagctcagtagtggtttgtttatctgaataaagcacctgcagctgccgaacaccgcgtagccaatgaaggtgggttgccaagcgtagggtcaaccattcgtcttggtggtgaagcagccaataggtactaccgcttgaatgggcaatgttaataccggcaatttgcatcgtttgcggcaaactggcagctacgagggttgttaattttggcaaaagaacacctcccacttgaaatgcaaagcacgcatggcgctcgttttcttagggttttcgtaaagaattcccggtccaattttggtacaatggacagtgatgttacagtccctaacgattgccgtataaatggagtcaaaattatgaagatattaattgtagacgatgataaagaaatcgttgaactattgagcatttatgttaaaaacgaaggctatgaacctattcaagcatactcgggcaaagaagcgattaccaagcttgtgaccaatcccgatattgcgttaatgattttggatattatgatgccgaatatgtcaggcatggatgtggttaaggaagtacgcaaggattcgcaaattccgattatcattgtgtcagccaaaacagcagatatggataagattcaaggattgatcaccggtgctgacgattacgtcacgaaaccatttaatccacttgaggtgatggcgcgagtcaagagtcttttgcgtcggagtcaaaatgaggtgaccaattcggagccggatgtgctggaagtcgggcctttgacgattaaaaaggatagccacgaggtcacaactttgaccggcaaacagattcagttaacggctttggagtttggaattctctacttacttgccagtcacccgaatcgcgtcttttccgctgacgagatttttgagcgggtttggcaacaggagtcaattgtatccgccaagaccgtgatggtgcatgtttcacacctgcgtgacaagattgaagaggcaacagatggtgagaaggtcatcgaaacagtctggggcgttggctacaaggtcgaggcctagttcatgagcgaaaaggtcaaactcactggtaaggaaaagtccgagttgtggattgaaggcattgtgacagttattttgttactgatgctgaactttgcgttgttagtgctgattaatcagatgattgcgcataatcccgggttggagaatgcaatctggggtgtgaagacgaatttgacttttggccgcggcggttttcatctgtggagctggtcgaatcttttccttaccttgatgggcattgcagacgtcattgtggtgtactggcgattggcacggcgatatcggcagatgcagatgcgccacgtgattgcagagttgcattatattgcggatggccacttggatcaccgaattaaatttgaggtgaataccgagctgcaaaaagtggttagcagcattaatgcgctggttgattctaccgtgaactctatggaagaggaacgacgaatcgaacagagtaaagatgagctgattaccaatgtcagtcatgatatccgcacaccgttgacctcgatcattggctacttaggcttgattgaggatcatcaataccgaagtgaagcagagctactcaagtacacgcacacagcgtatttgaaagcaaagcagatgaaggttttggttgaagatctgtttgagtataccaaggttaaatcaaccacgaccaagttgaatccggtccggttcaatatgattgcgatgttggaacagcttgccgcgagctttgagttggaagcccataagaaacacatgcggatcctagtcagtggcgaaccgaacccattaatgatggaagctgacactgaaaagctgggacgcgttttcaataatctgatcgtcaatgcgttgaaatacgggcaaggcggacggcacattttccttgacgcccagcgaattggcagcgaagtcgtcgtgaaggtttcaaatgatggggctcagattcccaacgatgccttaagccagttgtttgatcgcttttaccgggtggaagaaagccgctcccaagaaaccgggggcacaggactagggttggccattgcgcaaagcatcattgcgttgcatggcgggtatatttacgcagattccagtcctgaattaaccagttttgtgattcatttaccattaaaagttggcgcctcgctgacggataaacaaactaaatctaatgaggaagcaggaaagacgaaatgaagaagttgttacgtgggttggttgccgcaatggtcgcggtattaatgataggtggtgctgctccagcggcgtccgttgcagctgccgaaagcagtgatacaaatctggttaatgccaaagccgcggttgcaattgaacctacaactggcaaggttttatatgctaagaatgcaagtacggttttgccgattgcatccatgaccaagatgatcagtattgagttagttctcgatgccattaaatcaggcaagatcaagtgggacgacaaggtgacgttggatcagtcaatatggacaattagtcaagaccgtgatctcagcaatgtgccgctgcgacgtgatggctcatactcagtgcgcgagttatatgatgcctcgctcatctactcagccaatgcagccatgatgttgcttgcaaaggcagtagccggcagccaggagaagtttgttaatcaaatggatgccaaactcaagagctggggcattacagacgccaaaattgtcaatgtgacagggctgaataatagtcagttgaaagatgccaaagtaccaggcactggcgacaacgcggaaaacgaaatgtcagccaaagatatggcacaagtcgcgcaacacttaattaaggatcatccggaagttttaaaaacaaccagtattgccaagcagaccttccgtaaagggaccgatgatgcgatcaatatggaaaactgggattggatgctcaaaggtttggtttcctacgataagaacctgccagttgacgggctaaaaaccgggacttccgatgcggctggcgactgctttaccgggacggttgaaaagaatggcatgcggattatcaccgtggtgttgcacgcaaacggcgatgccaagacacggcgatttgatgaaaccaaaaagctgatgacccatgttctggaaaactggaagaccataacgcttgcgaatgccggacaaagtatcaagggctacagtaaggtcaatgtcaaccgtggcgcatcacggacaacaccgattgcaccaagcgcaaaagccgttgccgttgttcccgctgatgcaagtaaaaagacacttaagtatacttacacaccggctaagggtgtcaaaaagaacacaattgaagcacccgtcaagaaaggtaccacgatcggtaatttgaaggtaaccgcaaaagacgatcaacttggctttgtgggtgataacgcacaagaaggtatcacccttaaaacgaccaagtccaatcagaaagctaatttctttgtcctgattttccgtggcattggtgatttcttcagtcacattttttagtcggcactgctgacatcatgaggtgaatgttttggactcccggttggaggtcaacgcgttcgccttttttgtgagcgcgagccggcgcgcttagaagtcggagtgtaagtggcctcaaccgtgatggctgggctttggccattgcggttgaggtccttacacgcagacttctgcgccggggagcgcgttatagaaaatgagcgcgagccagcccgtttagaaaccggagtgtaagtggcctcaaccgtgatggccgggctttggccattgcggctaaggtccttacacgcaggtttctgggttaaaaaacgcgttatgatggaacaggatcacgaagcactgaatttcatgggaggctagcaagatggtaacgtatcatgaaattaccccggctggtttggctaatcttaaacaagaagttgcggatctcaaggcgattcggccagctaagattaagaacctggctgaagcagcggctttgggtgatcgttcagagaatgcagaatacagcgccgctaaacgcgaattacggcaattagagggtcgcttgcgatatttggacaagttgattcggtatgccaaagtgacgacgccggccgcggccaaccttgctgatatcggtaattgggtgacacttgaatttgacgatgatcaggatgaagacacttatgagttggtcgggccagcagaagcggggatgggggcagctaaacttgccatcaactcaccactgggagcagccgttcgtcgccatcatgttggcgatacggtcaccgtcacggcaccgagtggcacttatcaggtaacggttatggccattagtccgcatgcgcccggtaagtcagtcgagcagcacgactgaagcaaactcctcgatttatgacggaaactttcaatgctgatgcgaggatcatgttggccataaccgaatgtcagaagaacaagcatctgaggcgtgtttttcatcatggtttcaaatagatcaagatgaaagctgccacagtgcttatgctataatgaagcttgaattcacggcatataaaaaggagtagcagcccaatggcactatcacttagagcttgtattttattattgaaggaacatcacttattaaaaagtgcggcaattcagaccactgaagatgtcgatatgaccggcattgcctatgattcacgaaaagtttccgggccgactttgtttttctgcaaaggggacaaatttcggccgatttatctgtccatggccaaagataacggcgccagaacctatgttgccgaaaagccttacgtggaaggtaatggtttaaatgccttaatcgttcggaatatcacaaaagcaatggcgattctcagtgcggcctttttcgattatccgcaagatgatttgtttgtaattgcttataccggtactaagggcaaaacaaccgccgcttatttcaccgaggcgattttgaatgaggctcggccgcggcacatcgccttgttctccaccattgatacagtggttggccctgagccggatcagcggtttaaatcgaacttaaccaccccggaaagtttggacttgttccgggatatgcgcgaagcagttgaaaatggtatgacgcatttggtgatggaagtttccagtcaggcttatttacgtaatcgcgtctttgggctgacttatgatgtaggcttcttcttaaacattacccccgatcacatcggaccaaacgaacatccgacttttgccaattatctgcacaataagctgcagttgttggtcaatgcgcgcaaagtagtgattaacgcggaaaccgagcattttgatcaggtctatgcggcagcaaccaccacgacttatccggagagcatttatttgttcgccagcgctggattcaagcctaagcgcgacgacattgatattgatttccgatttgacagccaagaagctgatgtcgccgaaagtcgctttacactcgtgccggtaacggaaaaagcagcggcacttaatattggcggtcattattcgctggctttaatcggcgacttcaatgaaagtaatgcgacagcagcgattatcggcgccggcctggcaggtgtggatgcatctgctgcggtgcctggcatcgccaaagtcaaaattccgggacggatggaacattttcaggttccgggccacggtacggtttatgtggattatgcccacaattatgctagtatgaaggctttgttatcgttcctaaaacgttcctacaaagatccgcgcttgctggtcgttgtcggctcccctggtgataaaggggtttcgcggcgcccgggctttgccaaagtattaactgagttggcaacagaagcctttttaacaacagatgatcccggctatgaggatccagccaatattatcaatgaaatcgaccttaagattgatcacaccaaagttaaggttcacaaggtgcttgatcgtaaagaagcgatcacggaagcgattaaggccagtggtcccaaagatgttgtggttgttgccggtaaaggcgcagatccgtatcaaaaaattcggggcgtcaacacaccttggccgactgatatggccgttgtcaaggaagtcacccaatcgttacaggaaggctgatttgaatgcgtcaatttttcaccgttattggtggcatggggacaccggcaaccgagagttatgtgcgtctgctgaatcaacgcacgcatgcccatagcgatcaggaatatctcaattatattttggtcaatgatgccacagtgccggatcgaaccgattatattctggatcacagtaaaccgagcttcttcccggatttactagaagacgttcgggcacaaagtctgttgcagcctgaattcatcgtgatcgtttgcaacacggcgcactacttttatgatcaattagctgctgcatcgtctgtgccactgttacacatgccgcggctggccattcgcgatatgtgcgagcgattcccgaatgaggagcggatcggtcttattgcaacccaaggtacgatcaaagatggcatttacagtcatgaaatcgaaaatacagggcgcaaggttattttaggagatcaggcgttgcaggacatggtgacagagctcatttataagtacgtcaaagaaaagggcgaagtcaatgccgagttatatcatcgcatcttgaaacggatgcacgatgattttcaggttaacgtcattgttcttggctgcaccgagctttcgtttgctcaggaaaaagccggtgatcatccatatcatgtgattgatgctcaaagtattatcgtggacaagaccattgcactcggtaaggcttttcggaaaagtgaggcagcgggtaaggcattgttgaatcaaatgatggtgcgttagtgtgccggaaaaaggcgtcggaagcagctggttcatatcagtaacttccggcgctttttatgactataggcatcgagcgggtcatgcaaaataatacttacttgtggtaagctttaattagtacccaataaaggagatggcatattttggcacatttaaccaaattaactgacacatataccttgagcaacggggtcaagattccaatcgttggttttggaacttggcagacaccggatggggaagttgccaagcatagtgtggaagctgcgttggctgccggttaccgtcacattgataccgcagctgcctatggtaacgaagaaagcgtgggtgccgggattaaggcgtcgggcgttgcacgtgatcaaattttcttgaccacgaagctttggaatgctgatcacggttatgacgcaactaaggcagcgattgaccgttcgcttcaaaaattaggcgtagattacgttgatttatatttgattcactggccaaatccagttaagttccgtgacaactgggaagaggccaatgccggctcttggaaagcgatggaagaagcttataaagacggcaagttgcgggcgattggggtttcaaacttccgcgccaagcatttggatgcattgctgaaaaccgctaatgtcaagccgatggtgaaccagatcttcttaaatcctagtgatttgcagccggaagtggttgcttataatgatgcccatgatattttgagtgaagcatacagtccactgggtacaggtaagattttccaagttgacgcacttaagaagattgctgcacggtataacaagagtgtggctcaagtcgttcttcgctggtcgctgcagcatggcttcctgccgctgccaaaatcggtacacgatgaccgcatcaaggaaaatacccaactctttgactttgagttgagtcatcatgatatgacgttaattgatgctttacatggtgaagctggtttagcgacagatccggataccacgaatttctagcgttaagtcgtcaaccatgatttttggcgattaagtaaacgatagctgtcaggtcgataacaattaaataatccagcacccaaaaattcccgcaaacgatcattgcgggaatttttttgtcaaataagtgcgtgcggctggcgatggcgaactgtattaaggtagggtcttagcgccggttttggcattgattaactggatgctgttttcggttaaaaattcgtggtatttagcggcgatatcgccataagtgacaatcgcatcgatatcttgcacagtgccgtacgtgagcagcgatacccggccgaatttcgattgatcaatcaacagaattttgcgatgcgccttcttgaaaatctcagacttaattaaatattcgttgtactccgagttggataatccgcgggtgagcgaaattccggttgctgccataaaggctttaccgatattgaaccggctgaaaatattcatgttatcaatgccggtaaacgattgggtacggcgatcaaagttcatgccgatgatgacaagcttaatattggcaagcggcgcggcttggttgatgatttgaagattgttggttaccaacgtaaaaggaaaatcggtcggcagaaattcgcccatctccgcagtcgtagtgccagagtcaataaaaattaaatcttcaggttcaatcaactgtgcagcagcccggccaatttgtcgtttttcgctaggtgcggctaattgacgctcgctgtaaacggtgagcggattgtcctttgtgctatcaggagtggttgtgaccccaccatagactttttttaccgtaccgtttgcaattaaggttgctaagtcacgccgcaaagtgcttggcgctatcgagaacttatcttcgagctctttcatagacgcggttttaacttcgctgatataagcctgcatcgcatcaattcgttcttttctaagcatgaatgtcaccttctttaagccgtcttcgctaatctgattatagcacgttatgaatatattttggacatattatgaccatgttttaagcccgatgccgaagcatatagcagtaacgctgatttccgtagactcgttgataagttggaacgtcatccaaagcgagtcatttggggagctcgtgaaaaaatagacatcgctcgttaggctaacaagtacctgactagttacttttatcatatcattttgctacatgccacttcatttattttgatgaagtcgctcacaagtgaacatctaatgattaaattatgaacactttttagttgactttgaccatatctgcttatatgatgacaatgtaatcgaaaagtaagcgcttaaccgatacgtggaaagactcttgaaagtttggaggttaatagcatgcgtaaagcaggggttgttactaacaaaggcgatgctgcactggctccccagccggatttgggggttaaatccgaaaaattgccaaaatcggctcgtcgtcgtttgcgggttatctcgattatcgcaacatttggcgggatgctttttggatatgacactggggttatcaacggcgcgttaccgtttatgaccagagcaggcgaactgaatatgtcgccttccatggagggcttagtggccagctcgttaacattgggggcggcctttggtgctgttttgaccgggcgcatttcggatcggcgtgggcggcacaaggtcattaccggacttgctatcttgttcgtcgtttcgaccatcgcctcagcattatcaccgaccgcaccaatcttggcgtccgttcgcttcgtcttgggcttagcggtgggcggtgcttcggttattgtgccaacatttctagctgaagtcgcaccgtcgaatcttcgcggacgaatcgtcacacaaaacgagttcatgattgtttctgggcagttgttggcgtttgtgtttaacgcgattttggggacaacgttaggtcacattcccggcatttggcggtggatgcttgttttggcaacggtgcccgcagttattttgtggattgggatgaattttgttccggaatcgccgcgctggttagccgctaatggcaaattggatcaggcgttaacggtgttgcggcaaattcggacagaagaccaagcgcaagacgaaatggaaaaaattcgaatttccttaaaatcggaacaagaagtgcaaagtgcctcgattaaggatttaaagattagatggattagacgacttgttttaatcggcattggcttggggattatgcagcagatcgtcggtatcaacgtcatgatgtattatggcaccacgatcctacagacaaccggatttggccaaaatgccgctttgattgccaatattttaaacggtgtaacttcagtggtcgcaacgattgtgacaatgcatctcatgggtaagtacaaacgtcggccaatgttgctgactgggattatggggaccttattctcgttgatcggcatcacgttgacgagtcattttctcgcgggcagtccaatgttaccgtacttcacgatattattgaccgtcatctatctggctttcttccaaggagcattgggtccgctcacctggttactgctgtccgaaatttatccagcacgtatccgcggcttaggtatgggttttgccaccttcttcttgtggatcggtaatttctttgtcggatatttcttcccagtcatgttggcaagtataggcatgtcgaacacgttccttgtatttgtcggagccaatattatttcactgatttttgcttggaagtttgcaccggaaacagcaggcagaacattggaagaaatcgaattggacaacaagtttgacgataagtttcctgaaaagagcaagattaataagaattaagtttcttaagtcaatttatttgaaaatgtaagcgcttcataccattcttgagttggacaggggcgtgtgtaaacgggtgatggagccagcgtgaggactctggggcgcatacactccggttcctaaccgcaccggctcgcgctcataacgcgttcgctgcgtgtaaggacctcagccgcaatggccaaagggcggccatcacgtctgaggccacttacactccgacttctaagcgcgctggctcacgctcataacgcgctccccggcgcagaagtctgcatgtaaggaccttaagcgcaatggccaaagcccggccatcacgcttaaggccacttacactccgacttctaaccgcgccggctcgcgctcactatacgaaaggggtttgttttcatgacaacgcaacaagcagttaagaccttgaagaattttattaatggtcaatgggttgatgctaagaccgatacttttgaagatgtttataatccggcgacgggagaggttttggcacgggtgccgcattcgactagcgaggatgtggcagatgcagttgcagcggccaaagcagcgtttgaaacgtggaaacgggtgtcgattcctaaacgtgccaagattcttttcaaatatcaacagctgctggtggagcatcaagaagagttgggacgtattgtcacgcaggaaaatggtaaaagtctcagtgaagcgattgccgaagttgggcgcgggattgaaaatgttgagttcgcggcaggcgtgccgactctgatgatgggggattcgctctcggcggttgcgactgatgttgaggccacgaattatcgttatccaatcggtgttgttggcgggattaccccgtttaattttccgatgatggttccgtgttggatgttcccgatggcggttgcaacaggtaatacgtttgtgttgaaaccgtcagaaaagacaccgcttaccagccagcgtctggttgagttattccaagaagctggtctgcccgatggtgttttgaacatcgtcaacggggcggttgatgtcgtcaacggtctgttggatcatcccgatgtcaaggcaattagtttcgtgggatccgaacgggttggcgaatatgtttataagcgcggcagtgaccatttgaagcgcgttcaggcattaactggcgctaagaatcacacgatcgttttagccgatgctgatctcgatgctgcagttaaaggcattatcagttcgtcatttggatccgccggcgaacgctgcatggcgacatcggttttggtactggaagaaagcatcgctgacaagtttatggcgaaatttacgcaggcagctaaagacatcaaaatcggtaatggtctggataaagatgttttccttggaccagtgattcgtcaggagaatcaggaacggacgttgaactatatcaagaccggggttaaggaaggcgccaagctggtcttagacgggtcagcagaagccgagaagcgtgatggttatttcgttgggccaactatttttgaagatgtcaaaaccgacatgaccatttggcacgatgagatgtttgccccggtactgtccgtgatgcgtgcaaaagatttaccggaagcggttgccattgccaatcagtccgagctagccaatggcgcttgcctgtttacggattcggccgcatctattcgctacttcagagaaaatattgatgcgggcatgctgggcattaacttgggcgttccggcaccgattgctgtcttcccattttctggctggaaacattcattctttggcaccttacacgctaacggcaaggatagtgtggacttctacacgcataagaaggttgtgacggcaagatatgaccagcatcgttttaattagaaattccagatgcttgacgaggaggcattaacgatgagcttgttgtatccaaagcaaaatcaggaaatacagccgggcgttcatttgattcaagacgtcaatgcaacgaattctcccatgaaatacaccgcagtgaaagtcttggagcttgatgcgcaacgttcatttgccgagactttaggtaacttcgaggccggtattgttattctggcgggtaaggtgaccgtcactgtcggtgatcagcgctttgaaggtatcggtcaacggcaatcagtctttgacaaaattccgacagacagtgtttatgttggaacggacttatcctttaagcttgccgcacaaactgccgcgaaggttctgattgcatattcgccgaccacgacttcatttccggttcggttgattaagggcgatattcatcaaatcgaacatcgcggcaggtatcagaataaacgtctggttcaaaacatcttgccggatgatctcccatttgcggataagttattgctggtcgaggtttacacggactccggaaattggtccagttacccgccacatcgacatgatcacgataatttaccgacagaatcgctgttggaagaaatctattatcacgaaatgcagccgaagcaaggatttgtttttcagcgcgtgtataccgatgatttatcgcttaacgagacgatgacagtgcaaaaccaagacgttgtgattgttcctaaaggctatcatcctgttggtgtaccggatgggtatgacagttattacctcaacattatggcgggaccgacacgagtttggcattttcacaatgcgccagaacatgcctggattattgatcgaaagtaatgaaaaaggatagctttgcagctaagttgacgagggggggacattttaaatgtcacaaaaattcgatttgattgctattggtcgagcagcagttgatttaaatgcggttgaatataatcgacctttagaagaaaccaagagctttgcaaaatttgttggcggatcgccggcaaatattgcaatcgggtcagccaaattaggccaaaaagtaggattcatcgggaaggtgtccgatgatcagctgggtcattatgtgacgcaatacatggcagacgtaggcattgacacaacgcaaatggtcaaggatgatgcgggccacaaaattggcttaacgtttactgaaatcattagtcctgaagaaagcgatattttgatgtatcgaaatgaagccgccgatttatatctgacaacggctgatgtttcagaagaatatttagcgcaagccaagatgttggtgatttccgggaccggattagcccaaagcccgtcgcgagaggcgattttaaaggcactcacagttgcaaaatcacttggagtggaagtggtgtttgaactggattatcgcccgtatacctggaaaaatgccgaagaaacgagtctttattatcaattagttgcccagcgtgcagatgtgattattggcacgcgtgacgaatttgatgttctggaaaatcatcacggcaacacggacgagcagacaattgcgacacttttccaatacgatcctaagctaatcgtgatcaaaagcggcgttcaggggtcaaatgcgtatacaaaagccggcgatcattatcactttggagttttcaagacgaaggttcttaagagtttcggcgctggcgattcatttgctgccgggttcctatatgcttacagccacgacttgggaatagaaactgccttgaagtatggcagtgctgcagcgtctattgtgattagtcagttaagttcttcagaagcgatgccggatttggcgaaactcacggcatttattcacgaagcagagaggcaggaggtgcattaggatgagcgcaatggagttgaaggcgcagggaggagaagcaaaaccggccgcggccgataccgttcgattgacaaccgcgcaggccctcgtgcgctttttaaaccaacaatatcttgatgttgatggtgaggtcaccccgtttgtcgaagggatctttgcaatttttggccatggcaatgtactgggtttgggggaagccttgcaggaagacccggggcacttaaaggtttatcaagggcataacgaacaaggaatggccagtactgcgattgcctatagccgtcagttgtatcgccataagatttttgcggtgactgcttcggcaggtccgggttcggctaactttgtcacggcggcgggaaatgcatacgtgaacaacattccgattctctttttgcccgcggatacatttgccacacgtcagccggatccggttttgcagcaaattgaagtggacagcagcgcaactactaccacgaacgatgcgttgaagccggtgtcgcggtactgggatcgcatcgaacggcccgagcagctgatgagcgcacttttaaaagcctttgaagtgctgacaaatcctgaaacagcaggcccggtcacgattgcgttgccacaagataccgagggtgaagcttatgattatccgcgtagtttcttcaataagcgcgtgcatgtgatcaagcggattcaaccgagtgcggcggaattaacggaagcggttcaacttgttaaggccagtcgctatcctgtcttaattgtgggtggtggcgccaagttcagtgaagccggttcggcgattgaagctttctcggataagctaaatattccgattgttgaaacaccaactggcaagtccactatttcggcaacgtttgccaataatatgggcggtaccgggattctaggaacaacagcggctaatgaagtggtcgcaaaagctgatctcattattggtgctggaactcgctacacagactttacaacagcttccaagacggctattcatccggagaaaacccgcgtgcttaacattaatttgaatcgcatgcagtcgtataagtttgacggctttccgattgtggcagatgtccgggatacactgagccaactgactagtgaattgtctggatatcaaagtgactttaccaacctcgcagacctcaaagctgcttggcaacaggaacggcagcgtttggcccatacaaactatgatgcgccagattatacgcctgaggttaagggtcaattcagtgcggcgacattagctgagtatgccgagaagttacaaacccatttcactcagacggaagcggttattgctgtgaatgacacgattgcgccggatagcattattgttgctgcagcgggatcgttaccaggggatgttcaacgaatctgggatccaattgtgcccaatacctatcacatggaatatgggtattccatgatgggttacgaggttccggcagcattggggattaagttggcacaaccggataaagaaagttatgccttggttggtgacggcagcttcatcatgttgcattcagaacttgtcaccgcgctgcaatatcataagaagatcaacattttagtctttgataattccggatttgcttccatcaataacttacaaatggctcaaggcagcaatagctatcgaaccgaatttagaactgccgaccatgatatcttaacaatcgattttgccaaaattgcggaaggatatggggctaaaacttatcacgtcaatgatcgtgacagtttagtcgctgccttggaggatgccaagaagcaaacagtttcgacattaattgatatcaaagtgctgcctaaaacgatgacacaaggatacggccaaagttggtggcgagtcggggtttccgaagtatccgacaatccaaacgtccaaaaagcgtatcaagacattcagacaggtattgatcaggcatttaaatactgaggaaaacaacaatacaaaggagcgattgacatggttgtcaaagttggggttatcggtacaggcgcaatgggacgcgcacacattgatcggctaaccaatgttttaaccggagctgaagtcattgccgtcacggatattgatcaagaagctgcccaagccgctgttcgggattttaagcttaacgcaaaggtttatccggatgacacgagtttgttaaaggatccggacattgatgccgtttttgttgttagttttggcggtgcacatgaggcgactattctcaaagccttagacaccgataaattcattttcaccgaaaaaccgttggcaacgacccttgagggagctaaacggatcgtggataaggaaataagcaaaccgcgaaaagtcattcaagtaggctttatgcgccggtatgatgagggcatccatgccttgaagactaagctggattcgggcatcatcggaacgccgttggttgtgcgcgccagtcatattaatcctaatgttgcggccaattattcaaatgaaatggccattacggatacattgattcatgaaatcgatgaaatgcattggttacttgatgatgattatgcatcgattcaaatcacctatccgcgccagtcaagtcaggtgaccaatgaagggttgcgggatccgcaattagccacattgaccaccaaaaaaggaacggtcattcaagtgttggttcatgtgacggcgcagtacggttatgaagtcaaactcgaagttgtcggcgaaaccggagaattaaagctaccggattacggattcgagccaatcgttcgcacccaagcaactcagcaaaccgctatggaaacaagttgggtaaaccgcttcttgcaagcatacaacaccgaagttcaggaatttatcgatcacgtggctaaggatcaatcaccggtcggcccgagtgcctgggatgggtatgttgcagcggtgacggccgaggccgcgattcgttcgcaaaaggatcaagaaccggttttgatcaatgttgccgagacgccaacattttatcaaacgaatcaaccggtaaaggcttagccatctagtcaagcaatgtaaaaaagagggggaaaacgcgatggttcaaagggaagttaaaattggcattgtggggttaggacgacttggtaaaatccatgcaaccaatctcgccacgaagattccacatgctaagttgcaagcggcaacgagtgtggtaccggaggagttagcctgggcacgtcaagaactcggagttgaagaaacctatgaagactttgatgacatggttcaacatgccgatattgacgccgtctttatcgtgtcaccgtctgggtttcatttgccgcaaatagaaagtgccatgcaagcaggcaagcatgttttcagtgaaaagccgattggattagatctggatgccattaaacacactcaggcagtgattgccgatcacccggagttaaaattccaacttggatttatgcggcgctttgatgattcatatgtttatgccaagcaattagttgatgcaggcaaaattggtgatatcacccttattcgcagttacagtattgaccctgcagccgggatggaaagttttgtcaagttcgcaacttcagccaatagcggtggcttgttcctggatatgtcgattcatgatattgacgttattcgctggttgaccggtaaggaaattgataaagtctgggctatcggcttaaatcgcgcctatccggttttggatcaggcaggcgagcttgagacaggtgctgcactgatgcaacttgaggataagacgatggcgatcttagtagccggacgcaacgctgctcatggctatcatgtcgaaacggagattatcggaaccaagggcatgctgcgggttgcgcaagtgcctgagaagaatctggtgacggtcatgaatgaagaaggcatcattcggccaacctcacaaaacttcccagagcgttttgcccaggcattcttaagtgaagaacaggcttttgtcgacagtattttaactggtgagacagtcggcattacggcggaagatggccttcaagggaccaaagccgcgctggcactgcaacgcgcgtacgaaaagaacgatattgtcaaggtgaccgatgttgataaaaaggtaggtgcttaaagtgacgattgcattaggaattgccccgattggctggacgaatgatgatatgcctgacttgggcaaagaagtgactttcgaacaggccattgatgagatggcgctggcagggtatcaaggaacggaagttgggaataaatatcctaaagatccagtggttttaaagcattacttggacctgcgacatctgaaaattgccagtgcctggtttagcgcctttttaacgaccaagccctatgaagaaaccgaagcagcgtttatcaagcatcgtgattttctacacgccatgggagccaaggtaatcgtggtagcagaacaaggccatagtgttcaaggcatgttggataagtcggtctttgatgataaaccgcattttaccgatgaagagtggcaacgcttggccactagtttggaacggttgggggatcgcgcccatgaagtcgggatgcagattgtttaccatcatcatatgggcaccggagttcaaacaacggcagaaattgataaattaatggccatgacggatccggataaagtgtctcttttgtttgataccggacatttggttctatctggtgaggacccattaacaatttttgatcgctaccatgatcggattaagcatattcacttcaaggatgttcgtcctgaacaagcccagcaagaacgtactgaccacttaagcttccttcaaggcgttaaaaatggcatgtttaccgtgcctggcgatggcatgattgacttcaagccgatttgggaagccattcaaaagcaacactatgacggctggattgtggttgaagctgaacaagatccagcaaaagcaaatccgtttgaatatgcgctaaaggctaagcattatctagatacgatcatgacgattccccaagcagtttaagggttctgttcgagaagggatatggttttatggcgttgataccggcaacaaaactgattcaagctgcactggcagatcacgcagcaatcggtcactttaatattaatggtgccgattggttggaaacgtatcttaaagttgcgcagaaaaccggaacgccgattattgttgctacctctgatcgaattattgattttcttggcggattcgatttcattgctagctatgtacgctttatggtgcaggcattgcatatcaccgtaccggtcgtattgcatctggaccacggcctgtcagttgagcatgtttatcaggctattgatgcgggatatacgtccgttatgtttgatggctctaagctgcccattgaagaaaacgtggctttaaccgacgaagtagttcgttatgcgcaccagcatcatgtttcggttgaagcagaagtcggcagtgtcggtggcaatgaaaatggcttaatcaatggtatccgttatgctagtgtcaccgatgccgttaaaatggccgcaaccgggatcgatgccctagctgcagcactgggatcggttcatggcgattatgtgggccgtccgaatctgaactttgaacggatggctgctattgccgccgctaccaagttaccactcgttttgcatggtgcatctggcattcctgatgatcagattcaacaggcgatccaaaccggaacggctaagatcaatatcaatacagaagtgaacacggtatggactgcagctatcacaaaagcggtgcaagtcaaacgttccggtcatgatccgcaaccgattcttttggcaggcaaaaaggcgattgcgcaattagttgaaagtaagatgaaggcatttcatattctgggaaagagtaaacgctcagtgacctttgaataattgtccggtcgcatggcgattgaactggctcatgtcggtcatagtctaataagaatactgattgtcagttaccgctgcgtatgaggaggggaaacgatgccattagttcgatttgacatgttaaaagggcggtcacccgagactattaaagctattttgcaaataacccatgaagtgatggttgcagcgtttgaggtacccgagcgtgatcgttatcaaattgtccaccaacatgagccatatgaaatggtggttgaggataccgggttgggcataccacgaacggatcaggtggttgtgatttcgttagtgagtcgcgttcgtacggttcaccaattagagcagttttatgaaagtttggcaaggcgcttatccgaagcaggattagtggataagaacgatctcatggtcaatgtttcgtttaatcatgatcaaggctggagttttggccaaggcaaagcccaatttttggatggcagtttataaagagaatatcaagtaaagcaggatgccttggccgcttctggaactttgccagaggaatcgaccaaggcatttttgtgaacgcgagtcggtgtggtcagaaacgggagcataggggcgtttggtcatggtgctcaaagttcgtatatgtgcaggttgctgcaccgaggcgtctgtatcggtggcgggcaactgctttagttgacgccacaattgcgttcacactaagtcgcagattgtttgggtaggcgaagagaagtgggggagtcgtgatggggatagaactgacacaaatggctttgaatcgaaaaattgctcagcagcggccactggcgaaattttttcaattagccgaagctgctggcattcatcaagtcgagttacgcaatgatatgaccacttctgatggctcagagactgtcattgatggcatgcaggttgcagaatttcagacgttaaagcaaaaatacgacatgcagattttaacgattaatgcgattcagcaattcaataatccagccaaattaagcaaaaatcgcgatcttttgaccaagctggcggaattgtcggcgcaaattggcaatcaggcgattatctttgtaccggaagttaacgcacgggacaagcgaaccgagcaacagcgacttgatgataccgttagcagtttacaggtgtttggggacattctggctgcttaccatttgacgggattcattgaaccgttgggctttagggccagcacaatgcggtatccgtggacagcgctggatgccattaatttatctggccggaccgagtttaagctgacgattgatacgtttcatttcttcttggcacatctaacagccgaacaattcaaagcaggtgttgatattaaccgcgtgggattaattcatctgtcgggaattgagccgatccacgcattgcgagaagttgtggatgaagatcggattctgattaccgaacgcgatatcatgcaaaatattgagcaggttcatttgtttgaggcaatgggttatcggggccattattcatttgagccattttcaagccggttggcagccgaaaccaaccagcaacttactcagcagatattagcaagtattgaacggttgaatcagccaactgcagtgtttagtacggaggtgacgcaaccatgaagttagcctatgatccttctatgttccgcgactcaatgaccttgaagcaaatgtttgatgaggttgcgcggttaggttatgagtatgttgaattgtcgccacgccgcgattttatttggttctatgagcacccagtagccgatcacacgctaattaagcaggtaaaaaagtacgctaaggatgccggcgtgaaaatttcgtcggtactgccggtacagcaatggtcttctcctgatgaacaggagcgcgagtttgcggttcgcaatttgaaacgtacgattgaaattaccgcagagcttgaggtgccggttttgaatactgaatttgctggcgataagtttcagccgcttgtttctcagggacagtggtataagtccatggcagaattagcgccggtgtttgaaaaaaataatattgagctggaaattcaaccgcatcccaatgacttcatcgaatctaatctcgctgccacacgcttgattcgttcattggatttggattgggtgcatcaggtttggtgtagcgcgcacgcattttatatggacgacgggcgtggagatattcgtcagcagtttgctgagtcgggggagcggattacccatgttttaatcgcggatacatttaaccataaaggtaatttcagcttgcggtatattatcaatccgcctggggctccggtaacgattcaccaacacttgaacccagggggaggagaagtcgattttacaacgctttatcaggtgttgaatgagcgccattttgacgggatcatcaccaacaatgtgtttgcgtggcctgatcgcgttgattggtcaaatgacgtcaccttacaatcaattcagtctggtttgcatttattgaaaacgtgacgagcctgtcgcggcaattgaatcaggtttagcttttttctgaaaaacggcacctcgaaaaagaaatccgagctgccgtttttgtatacttaaaatgatgtctttggttaatacgatgttgtccctattgttactgccgggttgcgtcaatggtggatctgacgcgacggaaaagcggtgcagtttgactgttggtttgaatcgcgctgatcatgaacaaagtgtccataagactgagctcggcgatcaaggcgtgaagggcttcggtgcgatagcgggattcttcagccacggcaacaaaggcggcatcggccattttggctaagtgtgagccgggagcgccggtgatgacgattaagggaacgttttgcttttttgctagttcggccaaagcgattgcatctttgtctttgccggagtgggaagtcaaaatcatcgcatcggcagcagtaagatgtgttgcagccatcagttgcatatggtaatccgccgcgtaaacgaccggaatagcggttcgtaaaaacttgtgataaccatccaaggccacgagattgctggcgcccaatccaaaaaggcctaactgatttgcatgggtgatccagtcgaccgctttggttaaagcagccgagtctaaatttgtcagcgtggtacgtaatgcatctatattggaggtgaagatcttatgagccagcgtttcgaccgaatcagcgggactaagctcagcaaacagcgtgtgatctggttcaggtgttgattggaccagtgccattttcaaggcttgaaaacttggataccctagggccttggcaaaacgcgaaattgtggccgtactgacaccggtgatggcgcttagttccgcaatattcgcgtggctcgcacgatcagggtgctgctgcaaataatcagccagttttttttcttggcgacttagattcggtttataaatctgcaattggaccagaaagtcgtgcatgttgccccctccatttcaagattattatagcatcattcgtttgaattgaaaattatttacgaacaaattgctttatttttgtaattattttacatacaatggcaccgtaatcaagaaagatggcttccaggaagaatgattcgttgttgctatctaagatgaatcggcggtgtcttgaagatgcacagaagttaaataatggtagattcattggtacagagattgattgatgctcgcgtggtagccacgccggctcacgcgcacgcacaggaggttgcaaacatgcaagtaggtatggttggtttaggcaaaatgggaatgaatctggttgcaaatatgcgcgatcatgatattgaggttgtggcgtttgatttgaatgatcaggcgcgcacggaagttggtaagtatcaggttaaggcggttgcaagtctggatgccttggtaatgagcttggcctcaccgcggattatttggagtatggtaccagctggcaaaccaaccgcggcaacgattcagcagctggctaagctactgagtcccggcgatgtggtcattgatggcgggaattcttattatcaggattcaattgcgcatggtaagttgttagcggcggaaggcattcactttttcgatgtcggcacttcaggcggcatggctggagcccgcgcaaatggtaacttcatgatcggtggtgatgaagaacagtttgctcagatcgagccgctttttaaagccatcgcagctccaggcgggtatctctacaccggtccggttggctcaggtcattatttgaaaatggtgcataacgggattgaatatggaatgatgcaggcaatcggcgaaggctttgatgtcttagcccacagtccctatgcctatgacaatgcggcggttgccaaaatgtggaatcatggttccgtgattcgcagctggttgatggaactggccggtgacgcctttagtgaagatgctgacttggcgaaaattcaagggattatgcatagttccggtgaaggtgcctggacagttgaagaagcgttacgtttgcacgttgctacaccggttattgccagcgcgctcatgatgcgttatcgatcagaagaggccgatacaatgaccggtaaagtcgtagccgcattgcgtaatcagtttggtgggcatgcagttgatcccacaactcaacgtcactgagccgatctatgcgttatggtgctggatgagagcaacgttttggagaatggacggctacgatcattgccgctgaaacttcatatcgcaaaaacggatcaggtaaaagctgtttgaagtgtttcggcatgtgacgcgaaggtttgacgctggcggatacagattgaaaaaggagaagatgatgatgacggtcaaatacatgatcggggttgatttaggcaccaccagcactaaagttgttttatttgatctaaaaggcaacgccattgcgactgctaataacccatatccgttgtatcaggatacgccggacatggcggaggaagacccagaagaaatttttgccgcaacggttggtggtttaaccgaggtcatgcatcgtggcaatgttcaacctggcgaactaggtggtgtctcattttctgcggccatgcatagtttaatcttgatggatgaacatgataagccgatgacgcgggtcattacctgggcggataatcgggctgcggcgtatgcgaccaaactgaaacaaagtgatttagggatgacgttgtttaaggctaccggcgtaccgactcacccgatgtcgccgttggttaagttattgtggttgaatgatgcgcatccggagttaatggcgcgggcgacccattttattggcattaaagattatattttattccgtttctttggccgctatgttcaggattactcgcttgctaatgcgactgggctgtttaatattcatacgatggactgggacgatcaggcgttgagtgttgccaaagttcgccgcgatcagttgcctgagcttgtggataccagctatcaactaaccggtttgaatgccaattatgctgcggtgaccggtattgacgatcagacgccgtttattctcggcgcgagtgatggtaccttgagcaatctgggtgtaggggccattgatccaggtgtccttgcagtgacgattgggacctcaggcgcagtgcgggttgtgacggacaaacctgttgtcgatccacaagggcgtttgttcacgtattacctcgcgcctaatcagtgggtcgttgggggtcccgttaataatggcgggattgtatttcgatgggttcgcgatcaactttttgctccggaaaagttgaccgccgaacaattgaaggttgattcttatgagatcttgacggaaatcgcgagcaagattcctgccggggcagatggcttattattccacccgtaccttggcggcgaacgtgcaccgatttgggatgcaaacgcccgcgggagcttcttcggcttaacccgtcagcatacgcgcgcacacatggttcgggcagcactggagggcattgtttataacctgtatatggtcatgctcatgattgaaggtatcaccggaaaaccccgggcaattcaggcaactggcgggtttgcccgcagcgcgttgtggcgccaaatgcttgctgatgtctttgagcaggaagtcaatattccggaaagtttcgaaagctcagcgctaggggcggtcgtcatcgggatgaagtcgttgggtttgattgatgaccttagtgcagttaaggatatgatcggggtgacgaatacccatgaacctaacgaagcgaatttcgcggcgtatcgagcgttattgccaatttggattcgtttgacacgcaaattgggtagcgaatatcaagccattgcggattatcagcgggcgcatcctgatccggcggcacgcaatcaggcgcaggattaggctttaagtttaaagagtggacagtttgtgtttatgtcttgcaattattaggtgaccggttttaaaacactaaatgatgaacggttaggtcgacagacgcattttgagtttagacgcggctgccgttttttataagtggtattgtaagcggtttcggttgccgggatgcgagattttggttggctcgcgctcatattaacgcgctccctagcgcagggatctgcgtgtaagaaccttggtcgcaatggccaagcccaggccatcacgcccaaggccacttacactccgatccctaaccgcaccggctcgcgctcataacacgctccccggcgcaaaagtctgcgtgtaaggacctcaggcgcaatggccaaagcccggccatcacgcctgaggccacttacactccgacttctaaccgcgccggctcgcgctcataacgcgctccccggcgcagggatctgcgtgtaagaaccttggtcgcaatggccaagcccgggccatcacgcccaaggccacttacactccgatccctaaccgcgccggctcgcgctcactaaatcctgaggaggaaattaaatggacttgcttgtcttgatactaggtattttgttgttattggtactcatcatcaaatttaagtttaatacgtatgtttccctgattattactgcagttgttgtcgcacttggtttggggatggcgccggctaagattgctacgagtatacaaaccggcattgggtcacagcttggcgagttggcacttgtctttgggtttggggcaatgcttggccggttggtggctgatgccgggggtgcgtatcggattgcccataccctgattaacgcatttggtcgacgggggttacagctggctgttgttttggcgtcattcattatcgggatcgcgttattctttgaagtggggattgtcttgttagtgccgatcgtgtttgcgattgcggctgaagcaggagtcccgattctgacacttggcattccgatggcggcggcgttatcggtcacccacggattcttgccgccacatccggcgccaacagcaatttccacagcactaggagcgtctgccggtttggtgctggcatatggagttatcgtagcgattccgactgtttacattgctggtccattattttcaaaactcgcgcatcggtttgttcctgatgcgtttgaacggcgcggtaatttaaaagcattaggcccgcaaaagtcctttaaactggaagaaaccccgggctttgggatctcggttttgacctcgttgtttccagtcattttaatggcaattgcaacgatttatgaattagtgattcacggtggcaaaatgccaaagaccccgtcaggcatggataatgtgattgcctttattggttcgccaagcattgccatgttgatttcgcttctgtttgcgatgtgggcaatgggttatgcgcgtcagttaccggctaaagacatcatgaccacacttgaagaggcagtgaagtcgattgcgatgttgctactggtcattggtggtggcggtgccttcaaacaggttctaatagatggtggcgttggtgattccgtgaaaaatcttttcgtcgggtcatcaatttcaccattaatactcggatggctaattgcggttgtacttcggattgcccttggctcggcaaccgtagctgcaatgaccgcttccggactagtgctgccgctgatgcaaagcgcaggcattcaaccggcattaatggtgttggcaatcggtgccggttcgttagctgccagtcacgtgaatgatgccggattctggatgttccgtgaatattttgatctgactatcaagcaaacgttgttgacatggacattgctggaaacgattatctcagtagtcggtctcggcggggtgttgttgttaagcttgtttgtttaaataatagggagtagaaggtcggcatagagtcggcctttttgcgtgaatataatggtggtagtggtcgcgatgattcgttcaatatgataaacttacgccatctatagatacagaaacggagattataaaattatgtacgaaccaaccaaaaaacggcgcgttgccgaagatgttgccaagatttttcctgaagaagtgacaaatcagatttttgatgtcattgcggtgatgcgtaaggccaaacagattgtgacggcgccggttgcgattgctttttccgatgattataccgatgacgaaatgtatgcgatgattattcagggcaatttggcaccggcgcaggagtttccgctcacttacaaaggcgacaagccattcttaggtcatggctatatcttagtggtcaaggacaagcctaaaacgatccgaattgacttcagtgcggccaatccactcaaagctgcggaaaaggactgatctgcgggtggtcacagaggcgtgatttcacactcatggctgctcgtataccgatcatccacggataccggctttcgtgtgatctaaatagcactggtcttttcatgaaaacttcggtacaatagtaaatcgtaatcgttaccgtttgctattgggaggcagctatgagtgaaccaattttgaccgtggaccatcttcgtttcgggttccgggatcagcagctttatcaggatttgagttttcatttggatgttggctccatgacgagcttggtcgggccgaacggggtgggtaaaacgactttgattcgcctgttgatgggccagttgaagccgcaagccgggaccatccgttttcgtaagcaaccttcagttcgattgggatatgtgccgcagtttcgaaatgtggatgccgagtatccgctgtcgatccgtagttttattcagttgcgccagttggatcacctttttttctggcatactgccaaggaaaaggcggctttagctcgggtgattgaggcgacacatttaactcagatcgcgaatacacggctgggcatggcgagtggtggcgaaaagcaaaaggcgtacttagctcaggcgctgttagatgagcctaattttctgattcttgatgaatcgactgctagcttagatgttaatacgaagcacgagttaatggacttggtacaagagcttaaccaaacccaaaaattaacggtcctgtttgtcacccatgatctcagtttagccaagcaatataccaaccagtatttattgctgacgggggacagttacgaaatgaagccgactgcggaaatgaatttggcttcaatgccggaagagttacgcaacgatgccgagaatcgcggggtgatcgcatgaatctatttgcctatgcttttatgcaaaatgcttttatggccagcacctttattgcgattacaacggggattgtcggggtctttgtggtggcgcgtaacatgtcctttttggcgcacactttgtctgaggttggttttgccggggctgcgtttgcggtgtttgccggcattaggccattggacgggatgctgctctttaccgcgatcagcagtatcagcgttgggcgcatgtcggttcaagcctcgcgtcgggaagcatcgatcagtgcggtttctagcttgtttatcggtttaggtattctgttcttatcactttcgagtgcgaatgccagttatgccacaacgattttattcggcagtattattggtatttcccagggtgacgtgtggcagctggttgcattagccgcgggggtgttgttcaccttgtattttggttatcggcggttggcatttgattcgtttgattcggtcggttctgccgcacaggggttgaagagtaagtatatctcgatttatttcctacttattctggcagtttcggtatcaattggcgcccagattgtcggcagcttgcttgtgttcatccttttgaccttaccgccgaatgttgccaagtatctgggcaaaacgttgccgcagatgattgtcatctcggttgtgaccgcattgatcggtgtctggagcggcctttaccttggctttttgacaaactggccggttacgttcttcattgctgcgattgagtttggtttttactttttggcattgtggtatcaccaaaagacaaactaagagctgcttggttgtcttcaaataaaaatggccctagagcgacgagaatctcgttgctctagggccatttttatatctgaagctgtaaagaaccgttgttggcgccagtgggttatcgatgcggtttaagttgacgcaaaaaagtcgttacttctgcgcgataatcgtgtttttgctcgaattgtgccagataaggagcattgtgggtgctagtggctccggtatgccgcagcttcgtatatacctctaagtaaggcaaggcagcttgtttggcttgggctaattcggccgcagcgtcatatggaacctgacgtaaatccagatccgtcattgccccatgatgaaggctcagcaaagcatagtctgcataagtcgtggtttgtaaatgtggtcgcggtgaatatgcttgaccaattgagccaggattcagtatcacctgaccactgctggtgtagcgcagtaattgctgatgggtatgcccgtaaatggcaacgtcgattttggggtcaggcgcgatctggtcgaaattgctttgtggttgatccggatagagtcgatggccgtggttgctagtcggcaagttgtgggcgagactgatcgtcagaccgtcttgttcaaagacttcatgtaatggccagtggcgaatggcggtcagtatgtcagcatttagctgcggccataaataagcaacgagccgactaaagtagacatcggtgggctggtttaagtctaccgggccgtccaatacccagaataggtcatcatcccagttgcccttaaccagatgcgtcaacggcagtgcatgcagtcggtcccaaagcttggctgctcccggtcccggtaggaataagtcgccaaggaaccagtattcgtcagcgtgatgtgcctgtgcgtctttaagcactgctgaaaaggcggtcatattgccgtgaatatctgataaaatggcgatttttgtcatgcgttcctccagtgatcgttcattgtgactaagccttgcgttcccagatcgcctttaccggctgccaccatgttagcgtataactgttcggccagttgggttgccggtaactgcagatgcatttttttggcttcatctaaagcaattcggagatccttgagaaaatgttttgcgaaaaaaccgggggtataatcagcctgcaacatgcggggaccgtaattgcttaagctccagttggcaccggccccgctgccgaccaccgtgagcatttcatttaaatcaagcccggccgctttgccataaaccagcatttcagtgagtccggtcatcgtgccagcgatcataatctgattggccatcttggcatgttgaccagatccggccgggccgaaatagttaaccgatgtcgcgatcggtgcaaataaatctttcaatcgagacagcaggtttttttcaccgcctaccatgatcgtcaaagtgccgttcttagcgccaatgtcgcctcccgaaaccggcgcatcaatggcatgagctcctttgtctgcagctttggaagcaatacttttggctagtgttggcgtactcgtggtcatgtcaatgattaagtcaccagcgtgggtaccagcaagaaccccgtcacagccataataaacggtttcaacgtcctgaggaaaaccgaccatggacatgacaacatgacactgtgccgccaccgcatgcggagattccgcccaagtggccccggcatctagcactgtttgcgcgtgggcttttgtgcggttgtaaacgatgacctcgtgaccggcattaagaaagtttttaacgatcccggtgcccataacaccggtaccaataaatccgagtttcaaacgactcatcctttctgcaagattttttccaattccatcaagcgctgttcaaatactgaaaaggcggcttcaagataatcgggtttggtcatatcaacgccagctgttttcatggtgtcaatggcatacttagaactccctgacttcaaatagtctaagtaacgggcagccgcgtcaggttcgccgctactgatgcccgctgctaaggttgaggcagcagcaaagccggttgcatactggtaaacatagtaattgtaatagaagtgcggaatgcgggcccattcaaaggcaatttccggatcgcgtgcaacttccggtccataatatcgggcgttgagatcggcgtaatattgtgacatgctggtggccgttaacggttcgccttgctgatcctgttggtgaatccagtgctcgaactcggcaaattgtgtctgacggaaaacagttcccttaaaaccatcgagatagtaattcaaaatgtaggctcgtactttggaatcatccgaatgtgtcaggaaataatcagttaacagattttcgttggtcgttgaagcaatttcggcaacaaagatcggataatcaccatagacatacggctgattgtgacgcgtgtaccaactgtgaacgctgtggccggtttcgtgaaccaacgtatagagttcatcaacggcatcgtgccagttcaataagatgaacggattggtatcataagcaccaccggaataggcacctgaacgtttgcctttattttcgacaacatcaatatagcgattgtcaaaaatttcgcgaacatgctcaagataatcatcgcctagtggggctaaagcttttaaggcctctgctttggcttgttcaagcgtataagtcaacggcggctggccagtcagtggtgtgtaaatgtcatacatgtgtaactgatcgactgccaacacctttttgcgcaaggcgacataacgatgtaaaagcggcaggtgggtgttaacctggtcgataagcgtcgtgtacacactttccggaatgtgattacttgccatagcggcagcacgcgcatttttgtaatgatgcgccgtcgcgttgaaattatgggctttcacttgaccacttaacgtttgcgcaaacgtatttttcaaactttcgtaagcacgcagaagggcctcgaaagcctccttgcgtaatttacggttagtcgagcgaatcaattgaccgtacaaaccgttactaagctggacggtttcgccatcttcattttcaacaaacccgaattgcagatcagagttgtttaatacattgaaggtcgcgtgactggcatttaaggcatcacccgcacttgcaatcaaggcctcggcagcggttgtcaagacgtgttctcgatttaccgtgatggcatcgataaaatgtccgaatggcttcaagctttcagtgtcacgccaggccgttaatttgtcgcttgggatcgccagaatttccggatccaaaaacgctaactgactggctaattcagcacccaggctttcagctttggcattcatcgcctgataagtggcgttaccggtatcttgatcgctttttaaacttgaatagacgtaaaccttctcgaagcgtcgaaaaactgcaagtacggctttaatgccggtaacaagggcgtctgccgagttgcctaacgttcctttcaatgcgacggccgctttggcttgggcacggacagctttaaagtcggtttcccaagctgaatcatctggataaatcgttgtcaggtcccaggtcaattgcgttgggacatcctctcgtgctggtaaatgttgcatctaatcagctccaatttctaatatttctttaatgttaccatatcaagccgatttttgagctaattcccttttttcttcataattatctgatacactaccgtggaaactaaaactggagtgaagcacatatgtccaagcaacaaaaatctgatctacgaatcaaaaatcgcaaacccaaacggcgccatccaattttacgtgcggtggttctcattgtgctcgtggcgctttttctggcgggtggctatgcagccaggttctactcacaagcaaaaaaagcagttgcgaagacttatgacccggttagcacgaaaacagtcaattccgacctcaatggcaaaaagccaatcagtattcttttgatgggtaccgataccggtgcttttggccgcacggatacaggtcgttccgacacgttgatgcttgtgaccatcaaccctaaagaaaagaagacaacgatgctcagtattccccgcgatacgttagcagaaatggtggggacaggcgatcaatcacctacctatgaaaaaatcaatgcggcatactcgtatggcaagtcagacgcggcgatcaaaaccgttgaaaaattactaaatgttccgattaattattacgtgaccgtcaacatggaaggactacaaaagattgtcgatgctgtcggtggagtggacgttaatgtgccgtttacctggacggatgcgaatacaggcgggcaaacctttaaaaaaggtaaggcgcatcttaacggtgaactcgctcttgcctatgcccggatgcgtgatgaagatcctgaaggcgattatggccggcaaaaacgtcagcaggaagtcatcaatcagattgttaaacacctgatgtcagttaaatcactgacgaactatcagaaggttatggactcgctgtcatctagcatgcgaaccaatcttacttttgatgacatgatggcaatcgcccaaaattatcgcagttcggcttcaacgattgagcgcaaacagctgcaaggcattggtgtttatattgataacgcggcttatcaggttatgaagactgatacgcttcaaaaagcatctgatgaaatgcgtgctcagctaggcttgtcaaagaagacattgaataatttcaatacccaccaaaacgaaattaacaattcacttgggttcgattggactggcaataatccggtttatacggtttcacttgatggtgtgaccacaggaccttgaagcgtttgataaagttagtgtcaaaaagcatggccacttcggtatttgaaggcgaccatgcttttttgtgtcttatggaaatgatgatgaaggtggcatttaaaatggttactctggatcaggtaaatcgggtgccaattttgcgccgcttaatttagcagcagcaagaccacttaagaagccaatgataaggaacggtacaaagtccatgccaactgagaaccaaggaataaaggtggtagcaaagtgctgaatggctgcgaagaatggcagttgcgctaagctcgtcggcagggcatgaatcgcatcaagcaatgcgggaaccagcgtgaaaccgatcgtcgttttgtaaatccgggtattcttgccaatccaaggatgaagcaagcctaacataatcagcgcaatggctaatggataaagcagcatcaagatcggcgtggaataggcgataatttgatcgagcccaaaattggcaatcagaaaagcaccaatagttgtgatcggaagaaagaaatgatagcccagtttcggaaagcgatgtcccaaatcctgtgaaaaagaggtgaccagaccaatggcagtggttaagcaagccagcagcgtcatcgctccgagcaaggcagtacctataaggccggtgtaatgcgtcataatttgattaaacgcggtgccgccatttgcggtgatcttagaaaagccgaggctaatggcacctaacataatcagcaggatatagatgagtgcttcaagtcccattgccaatgagccaaccttggcaacggctttagcccgactggaagcatgatgtaatcccatcaatttcagcgcggtaatgatggtaacgccaaagcccaatccggcaagtgcgtccatcgtgttgtagccttgtaagaaaccattggtgagattgccggtgataagctttgcgttggcagtgaagctaatagctcgaatgtcgcctttaattaacaaggcccagaagaaaataatggccagtaaaagcaacaatagcggattcagcagcttaccgatgtaggtcgtgattttactttcattgcgggcaagcagaaatgttatcaaaaagaaaataaacgaaaaaatcaacaaaccgatttgctgttgccctttgtttagaaaaggtgcgataccaatagcgtaagtaacagtggcagttcttggcgaagcaattagcaagccgagactggcatgggtggcaagcaggaagaataaggcgaatccatggcctgctggacgagcgagatcatacatactactcgcacgggtgagactaatggccatgatggatagcagcggcagtaaaacggccgatagtaagaatccgatggcagccggtagccaagccgctccggctagctgccccatatgaatcgggaagattaaatttccggctccaaagaacatgccgaataacaaagaaccgagtgtgaggtattgacgtttggtgagcttagcttgcgttgacattgtagatccctccatgtttataaaatcactgcgacactgaatgctgactgtcgggtattttttccataagaaaagcccttaacagtcagaactgttaagggcgtggatcacgctgtaccaccttactttaccgccaacgtcaccgaaagcggtctcgccgcgtacggcctgattcggcgatacgcgattgctgtaatgggcgcaatcccagccattacttccgaagtcgcaatggcaactcgtagactactttccactagataatcagaggtctcttcccaccaaccgagactcgctgacactgacaatccaggtactcttctactcatcgtttttgaaaatctgttgaattgatctttattttacgaagaagtggggaaaagtcaaatacttttttaaaaatatgagttagtttgatgagaaatgtgagggctaatgaggaagcggtacccgttaaaatacccatataaaggcaatggcgctggtgaaatccaaacagttagctagtcatttttctcatatcaagcatgacatggcctgaagttcacgatagtcacgactggctgaaaaaatcccgcatttaaccaatgaacagaaaaaagccctctcgctcacacatagcgaaaggactttctgattttagctaataaattagccaacaacttcaactgtggctgtcatgacgccagctgaaggaatctgtgagttaggcatcgcgacatccagctgattaggattgccgttagcaaaactaccggtgtcattaacggttcgataccaaactgtgccatcggataatgtaatcttcaggcgagtcccctttggaaagacggagagattagctgcgacaccatcgtaacccatgtttgaacccaatacggccggatcatagaagcttaatttaaaggtccctttgttggtcgtggtttgggtcgtgctcgttgtggttgcactagccgcagctgcacttgcattagccgcctgctgggctgcttgtgcctgagcctgctcttgggcagcctgttgagcagctgcctgttctgctgcagctttttcggctgcggctttttcagctgcagcctgttcctcggcagccttagcagcggccgctttttgctcagcaatttgatgcgctgcttcggcgatatcgtttgtgccgactgtgatggtattttctttcttcgggttgatcagtgaataagtatccgcttggtcagcctttacgtcattctttgcctcgttgcttaccacaattgacttagctctaatttgactattgtcactatcattattggcgtggtcagcaatggcttctactttttgtgaatgattacttgtcattcctagtagaggcgccacactgagtaacgcgatgatggataatttgatttgcttagtaaagataaaaattcactcctatattttgaatagtcgtcattttgttcccccgagaacacaaacgaagtatatagggatggtgtgtcaataaaataccagcatcattacaaaaacatctaaattggtaatattgttacgtggatgtaacaaacggaatgttaaaaattttcgtaacaatcactgaactttttcggaaaaagtgggctcaacccttgaagtttctgtgatttgcggcacttttctaccacaatttgtgaattttcggaaaatttttgggtgcctaaactttcgtaagtgggaaaatgttatgctaactttacgtcttcaagtcagcatttgcggacatgaagaatgggtggtcaagaccaaagcttggtatttggtggcttgagatggatggattattattgatattttttattcattataatgtgttcccaggtgcagaggtcagcgtccgaggccgcttacactccggtttctaaccgcgccggctcgcgctcagctttagttaacgagtttttccataatcaggtataatgagacaagacagacgtgaccgatttacttgtaggaacttacaggattttaaatgggggaagcgtctatttaagggaggacttgaatcggtggcaatgtatcgggagaagcggtttgaagaaatcaagaagctgttggcagcgcgtaatgagctcagcatcgaagatattatgaaggctgttggcgtttctcgtgacactgctcggcgcgatatcgttgccttagatgctcaaggtgttgccagacgtacccgtggcggtttggtgtcgttgaattttggccacacgattcccagttattcgacccgcttgaagcgtttttctacccagaaaaccaaaatggcaaaagccgcgttatcgttgattaaggcgggcggcgtctactttattgatgactcaaccacgcttttgaaattgtcacaatcgattcatcatccggtcacggtatatacgcatagcttggacaacgccattgccctttcagtcgaagaacgggttaatttgcatttgtttggcggtaagctcgatcatcatgcacggtttttctttgaacccacgatgctggagactttgcggcgaattgcctttgatgctgcgtttattggcgccacagcgattgccgaagatggcgtgtatttttcttatatggaagatgctcaggtcaaacaagcggcggcgttatcggcacggcaggtggttgtagtttccgaaaccgaaaaattccagatacaggcaccgtatcgcgggttggaacttggacagattgatacactgattactgataagaaattagcgcaaacgcaaaagcagtggttcccgactaagacggacttcttaatcggtgattgataccaacttaagtaaaaaggattgatatgtattcaatttcagcaaataggctatcaacagcggacacgtcaggaggtgtcgccatggtaacgccacttgtgacgatcattgtgccggtttataaccttgaaagctatgtggcgcatggtttaaaaagccttttagcacaaacttactcccacttacagattattgtgatcgatgatgcgtcaagtgatcgctcgccgcagattgtgacccggtttgcgcaacgggatcggcgcattcaggccatcttaaagccggtgaaccaaggtgtttcggcggcacgtaatagcggactggaacaagctcggggtgagttggttgcgtttatggacggagatgactggtatgaaccggacttcattgcccatgccgttgatgtgatgactcagggatgggatctcattgccatgccgttttttcgtgacgatcccaatccacgtccggttcaagaacatctgcgtaaggcgaagcaattgacgagaaaagggctcatccggcagatgctgcaccccattggttatattcgcggctatttatggaacaaagtgtttcggcgggatgtgattgaacgcctgcaattacgctttgatgaacagatgtccattatggaagacgagctttttaccgccacatatgtgatggcaacgcggcattttttgtataccgggcatccggcttatcatcatgtcgtgcgacgggattcggccactcaatcgttaggtgttctgggggcaatcccgcagcagctctatgcgttgtggcgcattcatcaagtgttgcgccatgcccaccgctacgaaaagggtactaaaaaagaagcaattaaaattgaccattaaaacaaaggagtatggatgttgaccgagaatttaatgacttaccgagagctgaagcataaggccaaagaacaactaaagaccgggacgaatcgccgcgatttgatgctggcctatctactgccgagcttgttgcaggcggcagcctcgattgttgcttatttggcgatcttggcggtgattcagagcttcggggtagaaaaaacactgacagatccaaatggctttcaagcgtattatatgcaaaacggcaacaacaccgggacactcaataccattcaaagtctggtgaataccatgctggtgcaaggggttaactttgcagtactggatcttgtccggcatcagacgcgcgttcatccatttcgtgcggtattgggtctttttaacggcaagtggttctggggttcgatttcgttatggatctttacctatttcctgacacttatcggcttttccttcctcattattccaggtgttttgctgatactgggatggcggcaggctttttgggttttcaaagacggacatgaagcagatcaacgtttctcatcgatttcggcattgatcggctcatggcggctcatgcgcggctttaaagctaatttgctcgggttgtacgtctcgttaattggttggtacttgctggaaaatctgacgttccacctttttgactgggcgattaatccctatcttcaactcgtgcacgctaattactatgagaatcggcgtgcttataaaatggcggcgcaagcgtagtccttttggcgtgtctttttaaccgcaccggcgtatactggcggcgtctaagtttatgaaggaatcggacaagtgagaaggatgggtgcttttaccatggaaacagaagcatacatgaccttggctgaagtcaaaagccggcagttggcattaaaacggcaggtaccacttgatcaagcgattgcagagaatattcagaactgggcgcagtggttgttggacgaagggtttgaaggcagttattttactgccaagctagagggggcagctattttgattcgtgatcttaatggacagctagttgcaaccatgacgactgatgcgcctagttatgtggcagcgttcaagcaggctgatcggatgacgatgctcgccattcaaacgaagcttcggcgtttaattgatcggcacgggctaaccttgtcgtgattgagcacaggttggctgacgactaaggctgaaaaatttcatgacagaaaagcagcgatcaaaacaaaataccatccgccgttactaaggtgagtaacggcggatggtatttttcgtgtatcttataaattaaaaaatcttcaagcgatttagcggccaatagcgccatacgacgactgactgaattttggacttatcaacgaatccaaagtcacgactgtcatgcgaaaccaaccgattatctcccatgacgaaatacttgccagcaggtacttttgccgacttagttgaagatagggttttgatgttgaaatcgttggtgaatttaatcgtggaggaatccagcccttgttgactggcccattgattaatttccgttcgtgcaaatttgtgattcaagtaaggctcggcaatggcctttccgttgacgtaaagcttatcgtttttagcgctcaccgtgtcacctggcatgccaatcacacgtttaatatagagggattttggtcgatcaggtgcgtttatcacgacaatatcgttgcgtttgggctgcatgacgcgaacggaataaagccgttcgccgttttccaatgtcggttgcattgacgtgccttggacaacatctttgctgacgacatatttcatgagcagctgggtcgcaaaaaagatgacgatgaagagcacaagaaattcgagaatcgttcttaagacggaatgactgttatttttcacgatggcaccttccggtagagatttacttaagtctaccacaagccttggcgccacgactaaaaagttcgcttgtcaattaatcatatttcgggaaaaaaccgcttttttcagcttgccggcagagatcgacaatctgggcatattctgccagtgtcaaacaccaacgatgcggtaagcttgtgtacccataggctaacccagccaagccgccggttaatgccgcagcggtgtcggttgccccaccaagtgcaagtgcgtgtaagacggcatcgtgataatccggccaagtcgaaagcgcatgcaacacccgaacgagcagacttaaaggatcggttgccgtagcatcaagtgaggtgggtgccgcgagcagagattgaaatgagtcaaaaaccggttgttccgcctgcttattggcaaaatagtcgcccgccttggtgataccggtagcgatggcagttggcaggtccggggcatccgcgagtaattcgatggcgatttgggtgtaaatagccgttgctaccatattctccggatcggtgttggtgagggtgacaaagttttgaaagaggcgactaccctctgcttttttgaatagatctgtgtcaaacgtttgataagcaaaaaaagcaaatggtaaagcgcggatcaatgcccctggttcgttaggggccgccgtagcttttccagtggtcaaagcagttgccacactaggccaaatatcgggattgcgttttccataaggtgcgtgttttccatttttaaaccacgcttggtaagcagcgattagctttgcctgatcaaagccggattgtaaggcgtctaggccggcaagtgtgaggccggtttcatcggaatacgtgccggctggttggttgaaggtgccataacccttcatggtcgtgactggcgcagcagccagatcggcctgcgactgccccttaaccggtaatcccaaagcgtcaccgattgcaaacccaaccgttccgtgaatcaaacgagattccatgatccccatttttgccatctccttatcaaaatactggttcatgcatgtcgcatttcaagcagttgtcaccacaaaaaccgcgatgaggtagtaaataccaccgtctatttaatcggctgatgcagtcattatttctccggagaagcagaaaatgcaaaaaatttgcctcgttgtcaaacatcaagcgctgtgatagcctagctagcagtagctattttcagaaagctgccgtgttgagtgcgttgacggccggtttgaattcggcctgaaaagcatactggcagcgagataacgggcatcgtggggcatcataacagtgtgcggatggtttgaaaagccaataccgcggcgaatgagagtacaagctttttttaagataggcttcggtgatgcttgacgttttttatagaaggagaatgaaatgagtgttttaaccgtaaccgggttatcgcagcggtttttagacaaggtgttgtatcaagatgccagttttcaggtgaatattgaggatcatctcggtgtgattggccaaaatggcgtcgggaaaagtaccttaatcaagattttgactggggccttaacaccggatgcggggaagattatctggcaaaagcatcttcatgtcggctatttggaccagtatgccaatttggtgccgggacaaacagttattgagtttctgcggaccgctttcgatgagctttatcgtaaagaggccaagatgaaccaaatctatgccgattatgcggctcacccggatgatgagcttttagcgaaggctggtgaattacagcaagagcttgaagccggtgacttttatgagctcgaaaccacgatccagacagtggctgaaggcttgggcatcacggcgatggggatggatcatccggttgatgctttgtctggcggccaacgctcgaaactaatcctggcgaaactgttattggaaaagccggatatgttattactggatgaaccgacgaattatcttgatgtttcgcacatcgcctggttgactgattggctccagaactttgaaggagcctttattgtgatctcccatgattttgactttctcgaaaatgtgaccaatgcggtattggatattgagtttggccaaatcaccaaatatacagggactttaaaacaggctatgcgtcaaaaagaagctgaccacgagacgtatctgaaggcttttgctaaacagcaggagacgatcaagaaaaccgaggcctttatccgcaagttcaaagccggcacccgcgcgaccatggctaaaagtcgggaaaagcaattagcccgtatggataaattgacacccccgggtacgcgagccaaggcgcatttagcctttccgtatatgccggttaaccgccaaatgctagtggacgttaacgatctagtcgttggatatgataggcctttgttgcagccgattaatttttcggtggctaaggatcaggtgattgcatttgaaggctttaacggtgttggtaagtcaaccttattgaagacgattctcggtttgttgccagcactgggcggcagtgtcgagattgccgacaatgttacttttggctattacgaacaagaactgcactgggatcagcctaagcaaagtccggttcagtatttgcaacaacgctttccggccttgacccaaaagacggtacgccaagtgttgtcacgaaccgcgttgacaagtgaggaagccaataatccgctaacgatgctgtcaggtggcgagcaagctaaagttaaactggctgatcttatgttacagacaaccaatattctggtgatggatgaaccaacgaatcatctagatgacgacaccaaaaatgcgctgcgaaccggactgcaacagtatcccggcgccgttttactcgtatctcatgaagcaggcttctatgatcattcctgggtcgacacagttgtcaatgtcgaacaattgcaagtcaaagaatgatagcggacaaaggctagttacgatgattaatggcggtgcaacaagctaggacaccaaaatcagacgacacctgagcgaatgcgatggtgtctttttatatacgcgcaataaatgaactgatcggcgggggcacgcttaattcttgggatgccacatcaattgtgtatatgcataggtcaggtgatcggttaccggcatgtgcggattttcatgaccggtcaatgctttagccagacgttccgccgccttgacgcccacaggtaaaccaagttcgggcagcatatcactgacagtcgtttgctcctctaggtggtaagtcagcgtgtgcgtttcaaatggaatttgatgtaagcttaaccaattttgatagccggcaacgcgacttggatcggcttgataagcgactggcatatcgtggcctaaaagagttagagcgtggcgaaccaaagcatcatcttgctgtgtttgaaagttcaggatgactttttttcgcgccagagcgtttaaaagtgataactcttccggcaatagcgttggcagttgactgacaaagacaagatcggcacttgtcgatgaaacaagttgatgccaatcatcggtgagataagtcatgcttgtttttttgttggctttcaatcggatttttgcatatgtaagcatcgccgaagaccagtcaattaaggtgaggtgacggacatacggggccaatcggatagcaaaacggccggtaccggcagcaaggtctatcaatgagtcggctgggagcaacccattagcgatcatccaggtagtcacatcatgggcaagcggtagccgggaatcttgttcagcggcagcatagtctgcggcgaagtgattccaaaaatcacgatcttcctgcataagaaaagaggtctccttttttgaaaaactttttttaaaaaagttgttgacttgggatgggaaactgcgtaatatagtacgagttgtcagtcatcaaacattttaagccgctcagcgatttaaaaaaagatgttgacaaagagttgccaatttgatattctaattaagttgtcgcttggcaacaaagtagtcctttgaaaactgaacaaagtttcgtttaaatgtgcagggtccttgatacttcggtatcgaggcaaaaagtatagcactaacaagaataggtcttcatggcctttatggtctagtcgtcagggtgttgcacttgaattgtaaactggggtgaaacatttagtcaacatgctctacttcgttcagatctattccggttattatttattcgagtacttcatgcacgaatttttccggacccgcaatggccgcaacatgttccgcggacatctttcccgtcaaggcaatgttttatggacactgcctgcccgtctcacattaggcgctatgtggttgattgattgctggccgaagattcaaggtaaagagtcatggttcattgacaagctccggttgccatttagctggttacaaccggctgctaccagtggtgcctctgctgctggcgctgatgcaaccagtgctgcttccggggccgctgccggtgctgccaaagcaaccaagaccgtcttctccctttcatatcagtatggtaatgatccgatgatggtctttgacaagatgccaaactggtactacagcattaccaagaccttgattcctaatcagcaagttgccttcttcatgcaaaaggccatgacgattatggaaattctgattgggcttgcgcttgttgccggtttattcacctggttgacctctgctgctacgatcgcttttgtcggcgtcttctgcctcagtggtatgttctactgggttaacatttggatgatcccgatggcctttgcctgcatgaacggttccggccgcgcatttgggctcgataaatgggttgtcccttatctccagaaagtctttggcaaatggcgctatggaacaccgcgatctctttacggtaccgatgcactcaaataattgtctacacaaaaggctctgggtggacttacctagagtcttttttcaagagcgggaagctgctgcggtctcttttatcggccacgactgctccccgtccttcgtgttcacatcatcgttttgaagtcatgaacttgaacgcgattcaatttcactagattggaggctcacaatgaaacggccaaatacctttaaacgttatcttaagatgattcgcccatttgactggatcattgttggcggcctgtttatcgcagcgttcattccgtatcttattttcggcattcatgagaatcagcagcaagcaaccgcctcgcaacaggtattaacagccgtggtgacccatgacggccatgaagtttatcgcaagcgactaaccggtcatactgggaccagccacttcacctatcgtgataaagacggtgactggaataagattgaagtcaaaggcgcgggaatcgcgattacggaagctaactgtcaggatcaggtctgcgttcgccgcggtcggattacgaaacccggtcaaacaattgtctgcctgccgcataagctactcattgcgattaagtcaaataaaggcgatagcaacacgggaggtatggtgaccgaatgagtgtttataaagccgaccgtacccggcagtatatctatattgccttactctgcgctcaaggcgtcattatcggcctactcgagcgtatgatcccgtttccctttgcctttgcgcctggtgccaaattgggcctggccaatttaatcacgatcatttcattgttcacgatgtcaattcccgacagctttattctgatgtgcttgcgactgctgctcaccacactacttggcggcaccttgtcaacctttctttacagtggtgctggtgcggttttatcgtggtttggcatgttactcattaaacaattaggtgaaaaacgtgtcagtatgatcggtatttctgcagcaggtggcattttgcataatgtcggccagctcttgatggcatccttcatcgcccaaagctggaccgtcatgctctatttaccgattctcgcgtttatgggcattctggcgggcattgcggttgggattgctgctaattttctttttgaacacatcgatatcttacgacgactccgctatgatcgcaccaagcgtcgtaaaaaaggagctacacatgaaaattcatcccatgtggcatgaatacccgacgttggcgccggagcttgcttcagcgctaacgttgattgaaaaacagatcacaaccaacaatacacctgtggccaaggcgatcatggaaatgattaatggcggtggcaaattgttacggccggcgtactgtctgcttttctcccggtttcaagacacggatcgcgagaaaatgattgcactggcggccgccattgagacgcttcataccgccactttgatccacgacgacattatcgataaatctccaacccgccgcaatcaggtgacgattcaaaaacaattcggcccggacacagcagtttatgctggcgattatctctttgttgtctgcttcaagctgttggcacattacgcctcaagcctccgcagcattcaacaagacagcggcagcatggagaaaatcttaaaaggcgaactggatcagatggccacacgctaccaaacccaaatcaccattaatgactatctcaagcaggtttccggaaaaaccggccagctctttgcgttaagctgttttgtcggtgcctacgaaagcggcggaacaacgaactttgccaaaacggccgaaaaaatcggcatgaacattggcatcgccttccaattgctagacgacattctcgattacactagcgatggcgaaactttgggcaaaccggtttacgaagatgtgcgcagcggcgtctactcagcaccactcattttggccatgcagcgcgatcgccaagcctttttgccgctgttagcgaaaaaagaacacattagcgataccgagatgattcaactgcgcgatcttgtcatcaagtatgaaggtgtcaagcaggcctacactatggcgcaacaacgtactgaactggcgactgccggtttgcagaagttgcctgccggcgctgcacgagacgatttaatccgtttgacggagagccttttgaagcgcaaatcttaattcgtattaaccggatcttaagcaaccagcagaaattgagctggttgtttttttgttaatgcagatgtacaacaaatcctctaactcctagatcgctatcaggttcgatttttcttactctcgattaatgaccattaacttttcatttttgatctgtttatctgcccatggtctttacggcgtcttgtcgatatgtagcccattttgatggaaaaatctcttcgcttcatgagacaatcccaagacttttttactttcacaattgttagaactcgttatttaaagtcgaactttcatctgcggaaaatcagctaaataaccaaactaatgtaacagtctcattcgatgaatccgcttgcaatggcaacgaaatcagcttactataggttcacaatttcaagtcgtagaagtcagaagtctatttttgaatagtgggtaaccgttatggaaaataaagctaaagtcattaattccggcaagataattgtcagtcatatcgtctttcccttggttctggctattgctgttggcatcaccacttctggatcatttgtttaccaagccgttaatcatgaagaacccgttgtcgtccaggctgcttcataccccactcctgcaaagcgcggtatcaccctatatggattgggtaatgatacggtttatgtttactattcagcctcacaaatggctgcagttaaagcggcttcaaacacccaggcaaatgctagactagcttttgcggcagcttttggcgctataaatcaatacgcagggcttctggcaacggccgcattgattcgaacaaacacccagttcaacaactttagagaggcgatcaattcggctatttctaaaaagaaaggcttgcagcttcaatacaacacaactttcgatgatggtaataacagcgctacctggggagcatcatttgttgttaagtaattagcattccccttaaatcgaccccatgcaatgtacattgctgaattgaaggaacaatcagctcatctgctggttgtttttttgcgttccacaaagcatagttatccatagagccttcaaccattctcaacccaggaaagtgtgagtgacatgacaaccattgccgtcttttcagatatccatggcaacttagcagcgttagaagccgtgtatgcagatgcgattcaacatggctctggagcttactggttcttaggtgatctttttgggcccggaccagacgttcagccattgtgggaagaattacaaaccatcaacccgacgatcaaaatccggggcaactgggaagatttcttggtcaccacatggtcaggtaaagatcgtctatctaccacgcaaaagaaaattgaagcttatattttgaaccacctgcatgatccggccaagatttgcgccacccttgccagctggccgcttcaccaagaagtgacggtcaatggggtgcaaattgggctctcacaccatcttcccgccaataacagcggggatacgctctcagtccgtgctgaaggttccgcattatcggcattattcagtggaccccgtagtacccttgacttggccatctatgcccacattcaccatcccacaatgcgttatgtcgacttaagcatgccgatccaaaccgctgatgcctttgattatgccaaagccgatgaacgccttgttttgaaccttggctcagtcggtttgccttttgacaagccaactcgccggtatcaagagtggcgcgctgagtatctcttactggaagtgactgacgacggcgcaatcaatccgcagtttcgccgaatttcttatgatctgcaaagggaattcaagcaggcgctggcaatggacatgccgtttgttgagaattatcggcataatttctatatttaagcgagggaggtttgctgtgcatacttttctgcttttgttaggattttagttagcccaacatttaaaaaattcagtacactgatatacattgtaactggatggcatagagactgtttacaagcaaaaaaagtcccataaaattgggactttctgtacttcaaacactcctattaaattgttaaggatgatgctattagttgatttatcgcatatctggagaaaatatcctgttaatatcgtatggaagccttcactactctgacctatctttaaaataaacgctccctatgagtacagcaatcattagataaccagttaatttaaaatattgcgtccaataaagctcacccagaaaaagaagatcataaccaatattaaagagcatcaacgccaaccatagtaaaaatcctccaagatatgtcttggctttattcttaacgtttaccaccccagaccgcattgtacggcataccatgccaatacggttgccataacagctgcattacgtttaataccctgagctgctactttagcaacgatagcctttgctgcttccaaccagagctttttgtcaatataagccacgatagtattgacattgaccatgcttcggatttcctcaccgagttttcccagcatgcaatttccaatatcggctagatcgcgttgaacaattcgatgctccgttggaaaaatacgagattcattctcagagataccgataaacctttctgtagcctgaatttcatcttttccatatttggcaatgagataatcaatgttaagattttcaatatcgccatctacaaacatcttttctagttccttggcgacggcttgctcttttggcgttgccgagtttacagtaatctcgtctgctttagttgctgcattgaccggtttggctccggttagcattagactaacaaacaatgtcgttgtgaatatcgctagcaatgcaagaaatttaggtgttcttttccacttcgactgaaattccatgtgaatccccccatttgttaagcgagttactcgctttttttgtcaacatccgccataatttatccaggaacaataataacgtcatcacccaccggataagtgtcattcaggatctctgttaaatccggcacacggattcccccctttctcctccaacctcctccgacatctacactgataatttaatcaaacttcagctaaaaaaattcaaaggtcgagtattttctacatgagaggtgaagaaatgtttgctgatcaatttacttgtggtaacttatttcgccaaattcgtgaacgtcgtcatcttaaaatctccgatgtacaaggacccttacacaagacttcagtttctttctttgagactaaagatgccaacatccgtctttttagcctgatggagatcttgaagccaacaatgacagaaccccaggaattctttgagttaattgatcaaacgcatagtcaattgcgtcgcttttttacagagctcaataccttatatgaaagtctggatttagcgggcttgcaaatgctcttgaccgattatcatggaattaaacgatctgaaacaccacagtatatgctcaagctaatcgttatgtcttgtattgctaaagttaaggaacaaagcccgattttctcggctgaggatgaagagtgcatccagcaatttttgttaacagaagggcgttggttccactttgagtatctggtatacgccaatttgtgtcactcgctctccaattgcgtcaatgaccgtttacttcgccatatggtcaacaaatatcaagaatttcacctatctcggtacgatcaagcttttgttggtactttttataatatttccgcgaggtacttaaaagatgccgattatgaccgtgccttatcaatgctagatatagttgccgactttcctgtcaaaaatacagccctgtatctgcggcatcatgtggcattcatccggctagctgtgccgattttaaagtgccaagatcaggaagccaaaaagaaactagctaccttactgatggccacagagatcattgacccgaagttatataagacgaatatggcgtggatgaagtctctgaatttagatcccgaggcaatcttaaataacatcacctgaagaagtgctgggtccccatggaagaagagaacgattaacctaatattctaaggtggaatatttgatgtcagcctaggattaaatagtttgcaaaaagcagcaagtccacccgtcttagcacagacggggcgaacttgctgctttgttaatttcatttattcaaggctgcacatcccaaacaaagtcaaaaaatgtatagcgctaaatctcattgattcactaaggttccaacataccaagttgcccaaataagcaacaaagacagtacgccgaccaggacaaatcgtttcaaactgaactttttatcaggaaccagccgtacgtaccctatataaccggccatggcaagcgttaacacgattagcactcgatgtaaaccttcaagaaatgtcataatttttctagattaatctatgcctctgccctttgtcaaactcaactagactaattgactcgcatttttaatctttaacaagaccgaatccaagccggcttgacacaattatccgtttcacattcaacaaatctttatgatcgtaaatcacactcacgctttttgaaatatcagcctaaactcatcagccaacgaaagcggcgcaacactatatggcacgtcatgagtcacaagtcctaaaacaagcttctcacgtgttcccttatccagttttgtcaaatcaataagcacccgatcacgatcagtatctaatatcgcatccgcactaacatcggttaacagctgggatgtctgccgcattttcaaaaagtttggctggctctcatgcatattgatttgtttgacaatcttgcctgctcgcagaaaaagaatgcgatcggccagactttgcaggttgtccagtaaatgcgagaccatgatgacgagcttgccatcttctcgcagttgctgaatttgacccgagatcagcgcaatattttccggatcaaggccgttcatggcttcatccagtaacataatcggcgtatccgaagccacgaccattgcaaaacataggcgctgtttcatcccgagcgaataggtgctgactttttgggtgatataactgcgcattttcaagccatcgattaaggcatcgagcgtgatctgactctgccacatgtttcggtacaatttcaaatgttcatagccagttaactcaccaaaaagctcgctttctaaagggaatgcgcaaattttttgataaatcgccttaatcgcttgattgctttcgtagcgcagcccgtccacctctacatagccacggtcaggctttagattattcatgatgacattcaaaagcgtggttttacctgtgccattcggagccacaagtccgacaatttctttctgattcaaagtgagcgtgacgtcatctaagacatgctttttgttggcaaaagacaatccgatatcatttagctttagcatgatgccacctctctctttttcgggtgccgtttgtgagtcaggcaaaatataacaacttcaagtacgactatcacactcagaatcatgatcaacccgaacacgaaggtcatttgggtcgtctcatacctgaagttttgaaagcccaccaccaaccggccgatattgaagtaactcggcaacaagtataacgagttgtgattaatggcgactaagccgggtagaaaataaagactttcgctaactatcaacaggattgtcaccgccaaactggcaaactcactttttaaaattacctgtaagacaacctgcagacgaatgatcatccatacgcttaacagtaaaagaataaaggcttccatcataaactggccaagtgaaatcgtgctgaaagtaagcccttcatacaccggtatcggtagggacaaactaccgaggccgaacttgatcatgttaaacggtaataagatggccaaaaagccaagtaacaagccgccactcatcagtaacgctgacagagacttgtcattgagcatggcccaagttgttaacgggaagtttttcaaaatcgattgtttcttgcgatctcttgtcactaaatctgtactgatcatcgccgtcacaagcaataacgacaacgccagtccataaaataacgcgcgttgcagctgctgtaaggctgtttgttgattaatcatcgctgccgtgacactattgtttggcatatgtgcatattgacgcaaccgagtccgcgcctctaaattccaataatggccattacggttctgattgcctgaacctgcatcgcggaccacagtcggatcactgtaatattgcagcggataactaagccacggttgcccttgtagcactaggcgatcggtaagcgctaattcatcagccattgatgctgccacctgattgtatttgccttgcccagccgctttcaactgcgcgcgttcatctttcataaactgagggacataggtaccagcgttggcaatggtcggatagttaggaaatgccggattgaaggatttcatgaatttcgcatttttctggtacttagcggtcacctcctggcgtgaaaagttttccaaggtgccatttgcaggtaagtactgatagcagaaccaaaaactccatagcaaaaaaattaagcacgcgccccaatttttcttactgaggagattttgtttgatttgaaaggctatgtatgaacgattacgactcattttttgcacgcccccaccttgaaatcacgaataaaatacccatcagccagattaacatcatccccaaacctgtcacccaaccaatgggcagatgatcgtttattagaaaatggcctgaatacacattagcaatgcttaaataaggtagcggtgttaaatagaagactgctggcaacgatggactgaatgtcacgatggttaacacgacaaccaaagcgaggagtgtcgcatagaaacttccgatcagtcgattcaaccaaatggctacaaccgacatcaatactgtgagcacaactgcatagaccgcaatcagtaagccggcaagccaactgggaaccgtggtgattttgtttatcaaggtaaaagcggttggatagttccagtccccgaaaccgataacgattcctaaaagtattaatcccacaaccggcagaacaaagaacagtccgatacttaattgaaagtttgctttgacgtgggccgccattttaccaagaaaatgaaccggcatgttcctcaaaacactttggtgctcaagttctactaaccatgaatctccgactaaataggcgattaaaaagggtgcgcacacagcgatggcctgaaataataaggcgccatagtcactggcagtcttgatggcaacccgcggcgaaccttgaacttgttgtaactttctggcaaccgcgagcttccccgtcacggcttctttggttgggattaatagtccgctagcaccggcaaaatcaagggaataacttttaagttgcgcctgagccaattcaacctgcccattaagaatcatgctggcatcatggacgagtaagccactatcaatcttgccggttcctgaaagttgctcattcaacgcctgcaccatttttccttgtttgctggttttcgaatagctttgggcatcatagcgtaaataactcgattgcaccgactgctgaatcctaaatgtctcaatctttaaatcggcaatctgctgaaatttagcaacccaaaacaagccaatcactagaaaaaccataaaaagttcgcctaccaggtttttctgattcagcatcacttgcttttgaaaaaaggcgcttaactgtttcatcttagatgcctctctgttcacccgtttttgctttctctggtcaaaactttactcaaagtaaaattctgtgagttgctttaacataccaaatcaataggtccacatattttgagtatattgataaaatatgagcccagcaaaaaccagctatttctttactagttcataccttctattctctttatccattgattagtacatgatgagctttacattacattaaaatgaggccgccatcaagtaagagctcaaattaatcgtgcatcacatccgccataacgcgctccccgacgcaggtccctacatgtaagggccttcctttactcctataacgcgctccccggcgcagggatctgcatgtaaggacctcaggcgcaatggccaagaccgggccatcacgcctgaggccacttacactccgatccctaaccgcgccggctcgcgcttaccaaaaaagccaaagcacctcagccttcaaaaaaactgggtaccttggcttattaaacccgcatcaatgagtgtgaacttttgcagcgatttgtttgccgaaatctgtttgatcaaaatgttcgataatatccttaagctcggcataccgcagactagcgccgaacaacggacttcccggttcggtcataatgccgtctgctaatcggttatgaacaaccgtgtcaaagcccattcgatcaacaaaggcagctacttgatcaacagcagcgggatcatcaccggtcacaaacagcgccttgcgttttggattccctttaggccgcgcttcttcttgcaggttatgatagcccatatggttgaaggttttgacaattttggcacctttaaaataggcttgaacctgttcactcgaggtggtcgttggatctaacacttcttcacgaataccgtctgtttcccaccagtaattcatcgcatcaatgactaaatgacctttgagtaagtctgcatcaatatttttataccggcttaacgggattgctaaaatgatcaagtcactgttagccaccacctcggcattttcggaagcaatcgcgtcggggacgagggttttgatggttaaggcgatttttttgactgcgcctgagccggaaatccggacagtataaccggcatctaaggctaaaccagcgagaacgatgccgactttaccagcaccaagaatgcctatacgttgaatcgccattatttcaccgccgccttttctgctagaatttctttaacccgcgggatgactttcgtgccatacaactcaatcatgcgttcacgctgagccgcagtttggttaccggcgccgtaaacaaggtcaaagcggcccaaatccagcagatcaattgtttctgccatgcgccgcgccacggtttccggattgccgacatagaaggagcccactttggtttcaccatcgaattgttcgcgactcatcggtgcccagccgcgagttaagccaatgcggtcaaaattggctttgatattcttaaaggcgacttcaattgcttcatcttcgtcatcggcaataaagccatgagagtggacggcgattgggaattcgggtttgccgagctcctttgcggcagcatggtacagctgaatatatggcttaaaccgactcgcctgaccgccaataatcgcgatgatcactttatagctgaagttaaccgcccgaatgacagattccggtgagccgccgataccaatgtatgtctccagtttgccgttttctgttttgggataaacttcctgattcttcaaagcagcgcggaattttcctgaccaggttaccgctttttcattgcgcaaggcatcgtacaagccaagtttttcgttgaacaagtcgtcatagtcggtcaaatcgtagccaaataacggaaaggattcggtgaatgatccgcggcccaacattacttgcgcgcgcccgttagacaaagcatctaaagttgcaaagcgctcataaacccgaaccggatcatcggaactgagcaccgtgaccgccgtggcaagcttaatttgcttggtaactgtcgaaattgctgccaaaaccgtttccggacttgaaacgctataatccgggcgatgatgttcgcccactccgaaaacctgaatgcctaattcgtcagccagttgaccttcacgcacaatctgtcgaatcgaggccgcagccgtttgtaaactgccatcttcattcgccacaatgtcaccaaacgtctccagcccaaactgtaaatgctcaatgtctaccatcaaaaatgcctcccaaacgataatacttactttttgtaagtcgataatcgtatcatagccttttttctggcgggtggcaagctttcacacagatattcatacgaggatgtgccaataaattgctcagagacgcaaaaaaagtccgatcatcgtgcgacggtcattagccaatattgacaatgacccgctgcgtaaccggactttttaaatgaagtcacatctgaaaacttattcttttggtttcggtcgacgttccaagtggcgccgcattttatcgagcaagaagagttgatcattattccatgggctattacggcgagctagatgcgccgcgtaactggacgtatcatggttgaattcacgttccgagcgttgcacttccttgagaaagtcgcgcgaactgatgcgtaaggcaccacgggaaaagaccgtccactgctctgcttgatcactggtgaccacgaccagctgcaccagcggcgagttcatctcctgagcgagtcgttcgatatagctgtcggcagtttcgtcttctttcgtgaaaaccacttgcaagtcccacttggcgtaacttttaccgattcccggaacatacatggcatcgaaaaccacaatcattttcgcattttcatgactgcggtattcagccagaatatccagtaagcgatcacgggcgacatcgaaatgatcttctgctttcaacttggcgagttcaggccagttaccgatgacgttatagccatccacaatcataatatgttcgcgcatttacttaccctcatggcgactggcaaaagcttgatacatcaagatgcccgccgcaacactcgcgttaaggctctgcacgtgaccgaccatgggaatggcaatggtggcatccatcaatttggcaattcccggcgaaatacctttgccttcattgccgatgactaacgccgtgctgccttttgcgtcccactggcgataatcctgcccgtccatggcggtgccaaaaatccacatgccgcgatctttcaagattttgatggtttgcgctaggttcgtgacccgcgcaaccggcacatattcgatcgccccagtgctgactttggccacggcactggtcaaaccgactgcccgatgctttgggataataatgccatgcaccccgctcgcatcagccgttcgcaaaatcgagccgagattgtgcggatcttccaagttatccagcaataagaagaacggatcttcccctttatctgccgcgtgcttaaacagatcgtccaatgttgcgtaagcatatggcgtcatcgccaagagaaccccttgatgattgccgtggtcactcatgagatcaagtttttgctttggagccgtggcgactaagatcttcttcttttgcgccatgccgacaagatgctgaatcggttcgctttttagatcggtctggacaaacagcttgttgatggtggctgcggttcccgccttgagtgcggcttcaactgcatggcgcccgaagacgaattcatctggctcgtgttcattatttggtgcttgcggctgttttgccatgacccgtcttcccttcttcaacgtattggatacaccatgcggctagctcggcaacgcgattatcgcggccttcaagatgcaagtaaccaaacagtgcttcaaatcctgtcgagatgcgatacgtgaccacatccgtatgtttggcatgggtgtaacttttggcattgcgcccatgcttgaaaacttctgtctcttcggcacttaacaaatccgccgtctgcatcccggcaatcaacgccgcttgtgccttggcggaaacaaaatccttggctgctcgttgcaaggctgccgggcgcaccagcccgcgtttgagtaagtgttcccgaatatagacttcataaactgcatcgcctagataggccagtgcaatcccgttcaattgttttggatcaaatgtcattttctgcgccaccgtgtcccttgaggagtgtcttccaaaataatcccttgtgctgccagctgatcgcgaatctcatcactcttggcaaaatccttcgccgcgcgcgccgcatcccgagccttcaccaaggcgtcaatatccgcatccagattggtcgggtcggtgaaaacaaccccgaaaatctgcagccaagcgtcatactgattcaggagatcattgacactttcctgtttgacggtatcttcattggcatattcattcaacaatttggcaagatcaaatagcacagtcaggccattttgcacgttcacatcatcgtccattgcagcaatgaaacggtcttttaaggttttaagctcagcagtgatctgtgcatcaacgccgtcagcagcattggcacggcgatagaccaagttttcccgggcaattttcaaacgatttaagctattagcagcattctttaaattcgcctctgaataccgaatcggcatccgatattgcgtccccgccatgaagaaacgtaaaacctggggatcgaccgttttgagaatatcatggaccgtaataaaattacccagcgacttgctcattttctggtcatcttcgccaatggtcacaaacccgttgtgcatccaataacgcacaaactgcttgccggttttggcctcactttgggcaatttcgttttcatggtgcggaaattcaagatcctgaccgccgccgtgaatatcaaatgtatccccaaggagttgggtactcataaccgagcattcgatgtgccaacctggccgccctttaccccatggtgagtcccaactgatttcaccgggtttagcagctttccacaaggcaaaatcgattggatcttctttcttgtccagctcttcttgtgtgatatgctgactggcaccttcttcgagttcatcaacattttgatgggataactcgccgtaatgtttgaatttacgggcgcgatagtaaacatccccatcaaccgcatatgcatagccttttgcaattaaatcctggacgaaatcgacaatatccgggatcatctgactggcacgcggatgcgccgtcgccggttcgatgccaagcgcagtggtatcctccatgaacgcatcaataaatcgttgtgccagatcaaggggggcttctccggttttgtgtgcagcggtgataattttatcatcgacatcagtgaaattcgaaacataggtgaccttaaatccgcgatattcaaaataacggcggattgtatcgaacgcaatggcactgcgcgcgttaccgatgtggatgtaattatagacagtcgggccgcagacatacattcggatttctccgggatgcaagggtttaaacggctctttttgtcgcgacatcgtattatatagcgttaacatcggctcatatccttcctgtagcgtcttacctgcattttacaggaaacagcagcgtttataaaggaacgtgacgcgttgtttcacagtttttcatcaaaaaacggcgtccggatatgatcaaccggcgcggctgcatttaatcaatcttccgctttggattcaaaatgtttaacggatcaaacaagtctttgatgcgatgttgaagctcgtcaacggcaaatccaagctcttcattgttccattgattcttgctcatccccacggcatgttcgccggaaattgttccgcctagtgcaagagctttgcgaaacatcaagcgaattgcctgcagggcttcttttggcggttcaacttgatcggctggccaaatgacggttgggtgaacattgccatcgcctgcgtgtccggcggtgtagatttcaacgtttaactctttggcgaccgccgcaatatagtccatcatttccggaagcttggaaagtggcacggccatgtcttccatgatgtgctgaccgtttgcaaacacagcaggcaacatgtcttggcgcagtttgatgatcgcggctgattcagcgggatcactggtcacctgaatgtttttagcgtggtcagcggttaatattttctcggcaattttcaagcttgcctcaccaccagtatccaggcggaaaatgagcatagcttcggcgccttctgcataatgcgtgccttcataacgatctagtgctgccaccgttaacccatccagcgcctccagtgtcaccggataaataccggacagccgcaaatcctcgacccctttggctaaagcggtcatattgtcaaaatacgccacgccgacaaccggagtgccaaccggaatcggatttaacttgacggtaatttccgtgatgatccccagcgttccttcagagccgacaaaaagatgggttaaatcataactgaaggcatgcttataagtacgcccgccaagcttgatttcacgtccatctgccagcaccacttttagtcctagcacgttgtcactggtagtgccatatttcaccgtgctcatgccacctgcattcgttgcaacattcccgccaatgcttgaaatcggcttggatcccgggtcaggcgcataaaataggccttgttttcgggcggcttgatccagatcgccattgatgacgccaggttccacaacggccaataagtcgcctttgctaatctctttaatccgcttcattcgcgccgtggacaaaatgatgctcccgtccagtccgtcagcaccaatcaccgtgctagtgtcagctccttgaggcacgaccggaatatgatattgccgtgccacctttaaaacgccctgaatatcaggcacgtcccccactgcaatgtatgccaaaatgtgcccggctatctcctgttgggcattgccattagcgctatgttcgcgggcaactttatcatctgtgtgaatctccgcatgcggcgcggcatcctgcaatgcggttaaaatctctgcatgatcgtaagctgtaaaaatcgccatgatctaaccccctgtcctgaccgtcaatcatgaaatgttactgatacgactatttcgcttttattatgactcaattcacaaaagaaggtcaggatttagtctcaggggcaaaccaagataaattaagctaggcgattggtatcgtcaagattgcgatacgacagtttaggatggacggtaatcaccgcttctcccaaccacgttaaatctcgggccattcttttcgtctgcaatggtcgccgcggatagccaacacccgtcactttcgtttgtgaggccacacaaatggtcaagacatccgtgtcggcgcaggcatccggctcatgccgaaaccgcagtgcattgaaaacttgcccgggcgctatttgcaagggctctgcgatttgcggataagcaacgcgcaccacatgccgaccatgagtatcaaaaccggtcaaaaccgcgacttcaggctgccccagcaagcagaaatgatgatcaaatccgtcaaaccggctaaatcgtggcaaaatgtaataaaaagtcggcaccaatagtttcagcatccgttgaccggtcagcattagcccagcctttccagcaaaacaaccggctgcggcagaaccgggaatatagcgcaacgcaaaggcaggatattttgaggaagtggtaaccgaattttccggggatgggggttggcgggaaggcaacatcaacattcactcctatcgcatcattagactataaataaaataatactcggttaactgctgaaaacgcacgcgataacccttcgccatgccatcaacctaaccttataaaaaacaggccgggtgtcagctgccgaatccgacgctgtccccctgcctgtcacctgaaacctaccccaaaaaatcaacatcacccagcttgttcgaaacgcacccgatcaagtccgtctcgttctcacaactcggtcatgccgcagtatccatcgcctttccgttcatcacgaaaagagccacccacttaacagacgaaaaagccctgtcgtaaccaaccctgtcacaatgcccgccaaaaaatagccgactttggacatactgcgtttacgtttcattttcgcttcacctcagatgatgttaccgcttacccgtcccaacaacttttattttaccctatcgagatgcacttgtgggttttcccaaataaacgtcggaaaatcaccgattaacgttgtgctgagtcgtcaagagttggattcaccgtccaagtaacgggtgaaaaaatgttttttctataacgcgccggctcgcgctcacacaaaaacccgcggcaaacgtatgcgcgcgggttttaaatttgcttaaagttgtgacgtgacaatctcaacattcttcaagacttgatcgcgtcccattaattcgatggtttcggctagttgtgggccatgcatccgtaatgttgcggcaattcggattggcatgtaaagcttgcgtcctttaacttgcgtctcctgcttgacctcgttgacgatgtgcccaatggaataagcatcaaacgtgtcgagtgcccgaatctttttggcaaaagcttcgatcactggcttagcgttatcatctgccagttccttgcgctcatcatcagtcaaatcagtggccttatcaaagaaaatatccgccaatttactaatctgagctgtataactcatttgatcagtgtaaaggctgatcagctgccgagcccattcaatcgtcttgggatccggatcgctttgaatcttgccatcttcaattaggttagccaatgacaggctcattaactcatttggattggtcttttgcttagccttgatgtactggttattgacccattccagtttcttttgatcaaaccgtgccggactcttggacaaacgcttaggatcaaactgcttgatgaattccttcttggtaaagatttcgtcttcgccaaccggagaccatcctaacagggtgataaagttgaacattgcgtctggcaggtagcctaattcacgatattgttcgatgaattgcaaaaccgtttcatcgcgtttggacaacttcttaccggttgcaccattgataatcaaggtcatatggccgaagatcggtggttcccagccgaacgcatcataaatcgctaattgctttggcgtgttggcaatgtggtcatccccgcgcagcacatgactaatttccatcaaatggtcatcgacaaccaccgcaaagttatacgtcggcatgccatcacgtttttgaatgacaaaatcgccgccaagcgtgttggcatcaattgaaattttgcctttaacgatatcgttccactcataagttttatcagtcggaatgtggaaccgaatgactggctgtaatcccttggccttggctgcagcaattgcatccgccttttctgcttcactcatgccttcatattcgtactcgtaatgtggcatttcgtgacgggccttttgggcttcgcgatcggctttcagttcctcttcggtccgatatgattcgtaagcaaagcccttatccacaagctgcttgatcaacttgtcataaatgtctttacgttcagactgacggtatgggccaaagtcgccacctttatcagggccttcatcccaatcaataccaagccagtgaaggttgtccatctgactcttttcaccgtctgcaacgttgcgtttcgtatcggtgtcttcaatccgcagcaccaacgtccctttgttgtgccgtgcgaataaataattgaacagcgccgtccgtgcattgccaatatgcaaatgcccagtcggacttggtgcataacgcacccgaattggtcgatctgccaatgtcttagcctccattttctgtaaacatgcactgatagtgtaccacagaagggcaaacgatggacgggtccgggtgcaattggcacctacttaattagctaattcgttgaccgtcaacgcaaaaatctttagactgttatcaggctcagaacaaggcttaattacccttgttctttgtttagcggattggatggcacacacccctcaacattctttgaacgcggaggtgatagccatgccaaaatcaggagacgaaagggtttcgccgcattggacgtggcgtcgattatcgtcgcgcttgccatactggttaccagaatggccaaagcttacgcgataatcaaaaaagctaaccgtagaggctagcttttacccaaagtcatctgtgaactgcgtcgaggtcatcagggcaccacctgatggcctcttttcaacgccattattataccttggatgttaacaaatcgtcaagaacgaccagacccttccttatcagacgtcagcttatcagattgaagccaattacagcactcgctgaacctgctcggctttagtcgctaacttgtcggttgcgcatcgtccgttgccatagccagtaaacaagtcccacgatcaaaagtgactggccaaccagcaggaattcttcaacggtcacactcaacgcacccacttgtgtcagtgccgcgggaaagtcgatgaaagcatgtaacccgatcggaaccaatagccagaaccattgcttccgtttaacgataagcaaccaaaccacaacggaaagggcaatctgtacggctaatgccatgatccgttccagcaacgacagcgaaactgtccacgcactcatacccgttaactgtttcactaccgcggtgatagcggaccgcgagctggcaggcgtttggcttaataccttctcaattgatccgctattgatcaacatggcaaaaagatagttactgagcactgtcatactcccaaccagaatcatctccaagccgccatgtcctaagccatacaggaatggcgtctcaggatcgttaattttatcgggaatacgcttttggataaacttgaagcccaaaaaccggccaacttcttcaaagacaccggccaaaagcgcgccataaagtgcataagcccaaggtgtgtgctgaaactgccgggcaattccacgaaacgggccttctagtacacccgcaaataggaagaagattcccatcccgatgaagaagattttagtcgccccttttttgggatgacttcgccgcttaataacccaaactgccagcccaatcggcaacgctaagcagatgagcatttgaatcaacatcatggtcacggctgattggctgaccatttgattattcacaactttttccattcgcttttacctctcaatcaaaccagaatgctaagagcacaataccaaggatcaataccagtgttagtcccattaagacccaactgatcggccgagccatattcaatgtaaacccaatgccgatgcgcttctcgacaaaaatggctgggtcgccgggattgtagtaaaaaacaccaccgatccaatgctgattgtcgttcagtaccttgccttttgcatccagtttacgcgtgccagcaatataagccatgggcagtaacataaccgagaccagcgtcagggtcgcggtgagaatcacgttaagccactgccagtcgctagacattgccggtaacatcagctgtaagaccagcaggctttgtgagaggaagccaattaaaagcagatagtacaaaatagcgttacgcacgcgcccggatcgcggttcggcatccggattaccacgaaccgtaccacgtgctcgacgggtcaaataaaaagcggttaataagatcagcgtttcgatgcccaacgccattaaaagcacgatggtatctgcggaaggctggcggaaacccagaaaaatagccagcaagcattgtggcaacagaaccagacccgctgcggccgggaccagtgtttgcggctttaggtttgccaagtcaattgtcacttgatggttagtcaacgcctgatctgcatgtaattgctgcatcaattgtttacttttccggtgaccagcaatgattaatacaccattaaggctcactgtcgctaaagtagcggcaatttgaatccaggcaagggtcactgacgacaatgcccaaatagccacggccccgcctgccaaaacggcaatcaccactgcgcctaacgacgaagcaactagataacgccgtcgcaatgtcactgcttcaggacgttgccaaattgatgtgcgtgcgtaaacaacgccgaagagaacattgcggcgcgacagccatggcagcatcgcctgaatggcaacaagcacaagccaggttatgacaaggatcaaaatttctgctttcatctatcttcactccccgttaattggtcgtacagctgatcaatcattttatgcaccgtgctacggtcaaggttccgcgccactgcttcggcaacgactttttcaagtgctggccgcaaaacattctcgacagcttgttcaggggcgccgcgtgattggaccaccgcaccgcgtcctcgttgtatgactacgaagccttcttgttgcaacgcttgataggctttgttcactgtgtgcaagttgacacccagctcatttcccagtgcgcgaatagaaggcaacacggttccatttgcgagcgtgccagtcgcgataccattcacaatagcatcgcgaatttgttgataaagcggtactttagaagccaaatcaattgtcaaacgcacaaacccgccttcttcccgttacacttgttctacatcatgtataacactcgtgcaaaaaaaggtcaacgaattttggctaaattgccgccgctcgactttttttattataagtaccctaaacgacgccttttttaccgcattaaaatcggcgtaccaatttgtgcgagttgatcatcatgcgtaatcgcaatcaccaaccgcgtttttgccagctcctgcagcaagtgaatcacatccgctttgatttccgggtaaatattcgcggtaggttcatctaaaacataggtcgtggcgtgttccttgctcaaggcctttagaagtcgaaccagttgcaactcgccacttgaaagaatatcgacttttttatctagtaaattgaatatgttgaaattaggcgaatggaacacctgagtaaaatgcttcggttcttcatttaaaaatgccgccacattgcgacagtcatcggctaagtattcgccaactgtcagatgcgggctaggtacatcttgaaataaaaacccaatttgctcgcgccgcacttttgtcaagtcgacttgcgccgcattaagcccatttatcagcacatcgcccgtcatttcaggttggtaaattccggtaatggttcgaacaaaagtcgttttcccaatcccattgtcgccggaaataacataaagtccgggcgtccgaaatgaaacattcatgttcttggcataaaacatctcatcgttacttggctgctgggaaaaccttctgacattgaatccttttacctcaatggagtgaatcccattcacttgtccggtccctttttcatcaggcgcaatgcttagaatttgtcgcatgcgtgcaagcgaagcccggtatgcttccgtgcccattgctaccgtcagcagctggtcaaccgaatttaacaattgactgaaatattgcaaaataatcgagaaaaagccaatggtaatctgtccattgagcactgcaaatccgccgactaagaagaaacaggtttgaaagatcaactgaatactgatttgcgaagccgacatcgtaaaccgaatccagaaatctttgatataagtctggaatagccctgcttcaacccggttcaagcgctttgcttcgttctgaaaactaccagcacctttaatttcaatataacgaccgataaaatcattgcgcgccgtgaagtattcgttttgcttgttcttaactcgcaagctgatcgcgtagattttctggtggaagacaacgtaaatcacaaaataaatcgggacaaagattgccatcatgccaaaaattttagcatctgctttcatgacataaagagcaatggtcactgttgaaacgataatgccaatgagccgtaccatagtatccgcaaagaagccgacaatttcgttgacgtcatcgtttatgcaggaactcaaggtagtcggactccaggtcaggattgcgagggtcttcttagtaaacaagcacgccaaaatactgcgattcatcgctaggattgttcgccgtcgcgtcaggatctgaatacgattctgaaaataggaaacgatcagccgcgacagcccgattcctagaatgattagcaataaggtgacaaataaggtgcgatcgtgactgtacacaaggctatctaacaatttaccttctagataagtcccgccagtgattaaactggttccggccactgccagtaaaattaatgcgatgaaggaagccgtccgttttttcagaacatgtttaatgatgggtggcataggcgtacctctgtttcacgtttgacgtgtttcgactggttctgcaaaaaggtccgggttctgtccggaaaaaacatagcattgttacatcgtcctgacattctcgccgcatagacaactatttactgaaacagaactagcttgtcaggataatttgtttgtacctgtcttcatgtgattcgtcaacgatttacttaatactaatgccattatcaaatatttctttaattttataacttaatcttttgcttagtaactgaggcagcaatttttgtgatcgtgttctttttacgtttgccaatcaattatgaatcctaaccagttgtttctttttgcttgttgaccaggctgatattctcatggccgaattttagaatatgtaaagtcgttttttcatttcaatttgtcaacttttcgccaccaaaaaaatcggtcctcaaatactgagaaccgattttgcttaatctccatgtagctgatttagatttactttcaaccatcactggcgcttcgccttacgaaacagctgcgtcgaaccaaggcccataagtgataacaacgctaaacccactgctgcaataccgtactcgtgcttttcgttagtattaggtaaccgtcgctgagcacttggcgttatgacttcagttgtggcagactggctgctggttgatggtaccgttgatgtttccggcgttgttggcgtaactggaatagccggtttcgtatagacaaagctgacaaccaatccggtatctttaggaaaagttcctgatgctgcagcactatcagctgccaggcgcacataccggtaaccgttaatcgtgatcggaccggtcgtataagccgatccactctgacctgtcaacactttgttaggtgctaattcgttaccattttcgtcaacataacgaaccgtgaccgatccttgtgtggctggcacctgcttgtaaacaaaggtaacgatcacattgccgttgataaaggcattaccagccggcgcactgccttgggccacacgggaaaaggcatagtcgctaatctcaatgggccgggcttcatataaatcaccaacttgacccgtcagcgtcttatcaggggcgatgcgcttgccagcctcatccacaaatctttccgtcacgcttccttgcgctgccggtttttctgtataaacaaaagtcaccgtctgcggattagcagtaaagcttcctttttcaggcgcactgtttgcagccagatgcgcatattcataatttttgacgttcgctggcacggcagtatacgaaccaccgactgtccctatcagggttgtggctggtgcgatttcattgccatgttcatcaacatacttcacattcaccgttctttgagctacagggacttttgtataaaccaaggtaactgtcaaagtgcctttactaaaggttccgttaattggcgcactgccattagccaactttgtatattgataattggcaatcgtcgctggtttaattgtgtacacttttccaacttcaccttgaagaatcatgtctttaacaagcgtgttcccagcatcatcaacacacttcaccacaacttcattgctgctcgttggcgaatcagcgttcattgtttgctgattatttaaattcaattcttgcccaagcgttgccggttgcacggccaatgtggctgtcctagtcgccattgagctcgccttaacttgattaggttgatgcccgatagccaacgcaaagacaccaattaaagctaccagccatagctttcctgacttatataatctataacgagtcttctcttctccaaataaacgcaatggtcttgcccctctttcgtgatccagccgaaaactttttcaactgaaaacaacaaaaacagctgctcatacattcacttgtattgtagcattaattagtttttaaagagttatcagctacaccttagcatgccaataaagccgctacgtcagcgtttcataaactttatcaataaaatatcggagttccaattttctttttgaatacacactgatatggcattcagcgttgattcatgcttctagatggttgacactgctttttgataccgttgttctgataattaatttgaattccgttttttaaaaatgaacaaaccggcgagtaagaagcaaccaatataaacgacatacccgacagtgatttgaccaagtgttaattgggtcatcctagacagctgttgattgccaatttgttctcctaaattcagcatgttgacgggattccattttagccatgggtgttgatcaatcatcatgaacattaactggttaaagatggaaatgacaaaataggcgctgatgccgacaataatcgctggtgttgagttttcaaacaatgtagcgataagttcgacaaagcataacaagaacaataaggtcaaaaacgtggcaacgatattcagtgaccatagctgccaaacgtgtgcatttaaggcaaactgattgttgagcactaaaattttgatgatgacactcatgcatgcgctactgacgtacaacaaaatgacaccaatcaataaagccagccacttactcagcaaaatttgcgcaaatgaatattgccgatacagcaatgttttcaatgtcccatactggatttccgaagagagttgcgtactccccactgcgatcatataaaacacgattaacactggtgcaaaaaaattactgacgaaagtggccttaatatttaataaatttggatacttcatagcaatcagggcaactgctaattgaaagcaaaaaagtaaaataataaaaactacaagtgagggacgtttcatgagtttgtagatctcttgcttaagtaaagttatcactttaaagcacctccgaatcaatgttctggtcttccagaaccgccaacaatgaactttctaaatcaccttgtgtctccgtgattcgattgattttcagttggtggtcccacaagattttgagtaacgcattgattgaagtagccgaatccaacttcacctttagagcagatgccgtttgctgaacttcatagccgtgctgtttcaaggtacgctgagcaacatgatcgtgatcggtttgaattaacaagaaacgttgattggcggccaatatggcttccgtggtggcgttggcgacgatatgaccctgtttaataataaccacatcatccacgattttctgcagctcacttaagatatgactggaaatcaagaaactgaccccttgcgccttttgttgcaaaattaatttgcgcagtgtcatggttgcttccggatctaagccattcatcggttcatccaaaatcaccaattccggctgattaaggaaggctagcgcaatgcctagcttttgacgcatccccaatgaatattttttggctttgacgtccacaaattgttccagttgaagggctgcgacaatggcatcgacttttgcctttcgatttgtaccgtttgcaaaaagtgtcaactgctcgcgcccggtcagataaggataaagaccgggatattcaatcaacgcgcctacgtttaccaaaggcttatgttcattcatggatattggcgcatcattcaagctgatgtggccagcaaatgacgaaatgcccaagattgctttcataatcgttgttttaccggcaccatttgccccaatcaagcccaaaatatgtccgggttttatttcaaacgaaattttatgtaaaacttggtgtcgtccaaaccatttatctaactgttcgacttttagcatacttaacctcacaaacttttcgacaggagttgaggtaaagttatcacagatcagttaaaaagccgcaacttttgacgaaagaaaaaaattaacgatataatcgagtgagtttcgactttaagaaaaatgaggtgacagtctatgccgatccatactacaggccaattattcaaagaaattcgccttgaacgcggtcttaccttgaccgatgtcgccggtgatctgagcatcagtactgtctcaaaatttgaaaatgggcactccgagatttccgcagagaagttgatgctgttgcttcaaaagcttggcatggatgctacggagtttttcgaaatccttagttcaaaacaaagtagcaaaagttctcccgtaacactttcgcaaagggcttttgataaacatctgatgaagcttgctcttgaacaagacgttgatggtctaacacacttccgcaagcaatttactaactactttcaacaatcaggaatcaggctctacaaattgcgcgaaataatcgtttctgcagttttgattgatacgcgagacactcatactttactgacacaggcagattcaaagtttgttaacgactatttaatggcaagagatgtttggtacgaactagagtacagtctttatggtgactgtgtctcttttctacaaccccaggactttgatcagttgtacactaaatttttaaccattcatttctcgttccgtcaacggcgagattacatcaatctctttttccagtcgttttataatactgctgtcgcgctattctaccgacaagaatataagaaggcaattcaaactcttaatcatcttcaagatcagcagttgccagacaacctcttctttatccgtttgcaattaaggcttcttaagacagtatgccaatacaagctcaccaacagtaccgaaacggccgatgaattatcagagctcgtaaaagtaattttcaaaatcagtcccgcattcgggcgtcgctggaaatcagaatttcaatttcacgaacctgtaagtgaccatacttaatcaatataagccaacaaaaaaggacagttccggtattcccccgctttctagagaaataccgaaactgcccttttattttttcttaatccaattacctttccttgtcgcgaatagccttttgctgatgagccggcttggcaaagatcatgcgtcctgccgctgtttgtaaagcactggtgacaattacttccagcggtttgttcatgtagaatttaccgtcttccaccacgaccatggtgccgtcgtctaagtaagcaacaccttgctgtcgttcggagccggatttaatcacggtcacggtcatgttttcgccggggatgacgtctggtttgagtgcgtttgccaaggcgttgatgttgagaaccgggacattttgaaattgggcgactttgttgagattaaagtcattggtcatgacaatcccatccagtagttttgccagtttaagcagcttgctgtcgacttcggtcatatcgtcaaaatcgccttcgtacatctcaatatgaatgtccttgtctttttgcatggcatttagaatgtctaagccgcggcggccgcgcattcttttcattgagtcagccgagtccgagatcagttgcagttcatgcaagacaaaattcggtactaacatggttccttcgatgaagccggttttggcaatggcttgaacccggccatcgataatcacactggtgtctagcaatttgtatttgcgaaaatgatcgccaactttgcgctcgagcacctgatcattttccgtttccgtattccgccggttgcgaaagctcagaagccggcgccattcttcgctgcgtgtcgtacccacccgaaaacccaagtaaccgaataatagcatgatgatgagtggtaggaagatattcagcggcgcgatgaagccataaaacggaatggaaataatagcggccaggatcaacccgataatcgtcgacaaactgccaaacagtagatagcttggcgatttagtgtttaacgttttttccaataccttcaagcgcttaagaatccagttcacactgagactcgccaagagcaagaagataatggcaccgattaagccgtcaatgagcaagttatttaagaagtgattggcgctccaaccaataagatcccaaagtgatggtaatgcgcccatgccgacgccgatcccaatgagaccaaagatcaaataaataattcgtttcttcatgatatacctcctttctaagtttaattaaaaaccttatgcagcgcttcggcaatgcttgtgacgccaataacctgaatatctttaggtgcacgccagccttgcaggttatttcgcggcacaaaaattcgtttaaaccctaacttagccgcctctttcacccggtcttcaatgcgattcacccgccgcacttcaccggttaagccaatttcaccgacaaaacaatcagtcggcgggatttccttgtcgcggtatgacgaggcaattgccactgccattgccaagtcaatcgccggctcatccagcttaacgccccccgttgctttcaagtaagcgtcctgattttgcaacatcaaattggcacgtttttccagcacggccataatcaggctgacgcggttgtgatccaagccgctgctcgtacgtttggcattgccatacatggtcggactgataagcgcttgaatttcaaccagaatcggacgggtaccctccatcgaaaccaccaccgctgatcctgtcgcgccggccagtcgctcttctaagaaaatttccgagggattggcgacttcctgtaagccattttgatgcatttcaaaaatgccgatttcgttagtagagccgaaccgattcttgaccgaccttaaaatgcgataagtatgatgcatatcgccttcaaaataaagcacggtgtccaccatatgctcaagaatcttgggcccggcaatggcgccttccttcgtcacgtggccaacgataaaaatcgtcacgccttttgacttggcaatgcgcatcaattcggcggtgacttcccgaatctgggcaaccgagccgactgccgaattcatgtccggtacattcatggtttgaaccgagtcaatcaccacataatccggttgcatctggtcaatcacgttttcgatgctgggcatgtcggtttcgggatataaatacatgccagagttggcaacccctaaccgccctgcccgcattttaatctggctggcgctttcttcacctgaaacatacaacaccgtaccgcctgtgctagctagttggccagacacctgcagcagcaaggttgatttgccaatcccgggatcgccgccaatcagaaccaacgagcccggaaccacaccgccaccaagcacgcgattcaactcggccaagcctgttttaacccgggtttctttggtcaccgtgacctcatccatgcgtgtgggcttaaccttgctaccggtgcgcgtttgtcgcggcgccgatttagtggaactaacggtttcttcgacgagcgtattccacccgccgcagtttggacaacggcctaaataagtcgccgaaatataaccgcaattttgacatacatattgtgtttttgctttcgccatactatcccttcaatatctgctagtgatcggttgagccaaaaccgctttgtcgttgcgccaagccgccttggtcaccgtctgccaatagaaatggcataaaaataccctgaccgatgcgatcaccttttttgatcatcacatcccgcgggaagaaattcaggagctgaatatagatttcgccttcatttgccggattgttatagtagtcggcatcaatgaccccaataccgttgggcagcgtcaggccgtgcttaagcggactgctggaacgattggccaaaatcaacacttcattaggctgcatataggctttaatgccagtgggaaccaagtaaggctttaaaatcttcttcgcccgttcaaagtccttattcgtcagcgggtgctcatttttaatcaaccgaaaaagccgaatgaagtcataacgccaaatactccgcaacagaaaatcttcgcgcgcataaaaatcatacccagccgcctgcttagtctggcgggtcggcaaggttaagttgtcatcttgatactttgaaacaatttcaaatccgcgggtcttcatgaaaatagcctccaaaaaaagtgtgagcgtgaaccagcccggttagaaaccggagtgtaagtggccttgggcgtgatggccgctctttggccattgcgaccaaggtccttacacgcaggtttctgggctggcgaacgcgttatggtgagcgcgagccggcgcgtttagaagtcggagtgtaagtggccacagacgtgatggccgggctttggccattgcggctgtggtccttacacgcagacttctgcgccggggagcgcgttatagaaagtgagcgtgaaccagcccgcttagaaaccggagtgtaagcggcctcgagcgtgatggcccgggtttggccattgcgttcgaggtccttacacgcaggtttctgggctggtgaacgcgttatgacgagcgcaaaccagcttgtgcgccagaaagcacgccaacacgtccaaagtatcataccacgcggagacaatcgaaggccacggtgtaagggcttcccttcttgtaattataccgttttcctgataaatttggcttataaaagtcattcatgaattgggttaacgacggatgggtcatcagacgaactgtgccagttacgcgccttgattcttaataggatgaccatcattcaatttgccaaggaggctgctatggaatttcaacgtgaaccaggacgaatttttaatacggattgggacggccgactgatggcggaagtcactttccaatcaatcgatgacggtcaggcgtgggcagtggatcacacctttgtcgatgaaagccttcgcggtcaaggcattgccgctcagctcatcgaagccgtagttgcagcagcgcgcaaagaaggcaaaaccatcgagccgctatgttcctatgccgtgcatgcattccataatcatccggaatatgcagacgttttgcgaccagttaaagatcagtaaaaatcctccgcaaaagctgccgaaccttggcagcttttttgatgcctttatagtcttggctccttttttaataaaacgccaacttttacccaaaagctttccagtttcatctttaaatctaaattaaattggggtaaggtttctttaatgcaatttgaaaaggaggacgttatgtcagaaattacatttgatcaaattaaagcctttcaagatcagcttgatcagcatccggcatcgggtgcacttggccgagctgtccaaaatgtcgggccacaagccgcaagccgtgaaaccatggacggcgaagatatgaagccggttttctcaattgatctggacaccggcagcgttgccaaccagaagaaaagcggtcggtgctggctctttgcgacattgaatacagtccgccacgggattgcggatgaatttggcatcaaggatttcgaattctcacaaaactacaatgccttctttgatcgcttggaaaaagccaatttattttatgaaaatattctggcaaccgcggacaaacccctggatgaccgagaagtcgccacttacttaagcggtccagatgaagatggtggccactacgatcaagcggccgccttaattgaaaagtacgggttggtgcctaagtcggtcatgccggaaacttataacagcgacaaaaccgctgaactcaacagtgtgttgaacgagaagttacgtaaagatgccaaggtgttgcggaccctcaagcaagataacgccagcgaagaagccatcgccaagcaaaaacgcgaatttctcagtgttgtttatcgcattttggcttacacctttggcaatccgccgacaacgtttgatttcgagtaccgtgatgacaagaagcaataccatcgcgatactaacttgaccccgcagtcattcttcaaaaagtacgtcaaatggcatttcgacgattacgtggtgattgccggcgatcccgaaccaaccaaaaagtatcagcaattgtataccatcaattcagccaacacagttgttgaaggccatccgctgacaattttaaatctccctccggaacgcttgaagcagctggcattagcgcaactgcaagcaggtgaagctgtctggtttggcaatgatgtactagccgacatggatcggaaatccggcacgcttaaaggcggattgttcaattacagtgatttgtttggtgtcgatttccatgtgaacaaaaccgaccgtatcgtgaccaccgaagcagaaatgtcccacgccatgaccctaaccggcgccgatgtcgttgatggcacggtcaccaaatggaaagtcgaaaattcatggggcaaggaaaatggccacgatggttattttgtggccgatgccagctggtttgaccagtacgtttatgaagtcgtggttcgcaaggatcttttaactgacgcggaacaagcgctccttcaaaccgagccgatcaacttgcctgtatgggattttctaaattaagattaactgatatgctaaactaagtgagtcacaaaacggtgtcggcttatgacgaaatcttcgccgccttttcgaacgaccatgattttcattaccagccgcatggtgactcagctcatgcacataaaaaggagtgtttatttaatgtctgcagaaattacttcaggcgatttggatcagttcaaacaggatcttcaagccacacctggcgccaacgccttacaaaaagcggtcatgaacaatggtattaatgcaaccgccgagaatacggacagcaaagttgccatgacaccaacgttctcaattgaacttgataccggtgctgtgtcaaaccaaaagcaaagcggtcgttgctggatgttcgccgccttgaatactatgcgtcatggcattcaggcacaatttaagatcaaggattttgaactgtcccaaaactacaccttcttctgggacaagtttgaaaagtccaactatttttatgaaaatgtcttaaaaaccgccgatcaaccactcgacagccgtaaagttgcctttcttttggctaccccgcaacaagatggcggccaatgggatatgctgtcagccttaatcgaaaagtatggtattgtgccgaagtcagtaatgcctgaaacctacagttctagcaagagtaacgaattaaacggcttgctcaacttgaaactgcgtaaagacgccgtcaccctacgtaagttagttgctgacaaagctagcgatgccgacattgaagcagccaagcaaaaaatgctggctgaagactatcgcatcttggcatacacgttaggcaacccgccaaccaaatttgactttgaataccgcgatgatgataagaattatcacattgatcgcgaattgacgccgcaaaccttcttcaagaagtatgtcggctggaatctcgatgactatcaaagtatcatcaacgccccaaccgctgacaagccttacaagcacctttacaccgttgaaatgctgggcaatgtcgtaggtggtcgtgaagttcgccacttgaatcttgacattgataccttcaaagacttggcaatcaagcaactcaaggccggcgaatcagtttggttcggttccgatgttggtcaaagctccgatcgtcaacttggcattttggacaccaacatttacaagaaagatgacctgttcaacaccgacttcaccatgactaaagctgaacgccttgactatggcgaaagcttgatgactcacgcaatggtcttgaccggcgttgatcttgtagacggcaagccaaccaagtggaaagttgaaaactcttggggtgaaaaagtcggcgaaaaaggctactttgtcgcaagtgatgcgtggtttgaccaattcgtctaccaagttgttatttccaagaagtatctcccagctgaactacaggatgtcatcaagaacgaatacgacaagccaaccgttcttgcaccttgggatccaatgggtgctttggcatcaagataagcttgatctgaaaacactaagataactggaaaagtctcgtaattttgatctaaagttacgaggctttttgtataccgccgtaagcgattcaaaccaatgcggctgactgagtgacttaacgctcataacgcgttttccagcgcagaagtctttgagtctgataaaattgtggtattctggttgcaactggattaaatcaaatgaggagatcgggccatggggacacaattagcttttgattggcgccaaatcattcattcacgcaaaaacattgccttattggggttgttctttgcggcattcatcatcgcattcttcgcactagtctggacgcaccgccttgatattcaacagacttccgaggccactgccaatgccgccgtggctaactatgcagaatataacttggacacactgagcaagacgcaaaaaccgctattggcgaatctagatgaccaaaattcggcgactggtgttattgacttgggcatccagcttgatcaacccgatacgacccgtaacgggctgcttagtttgcgcactgctcaacttgaaatgcggcaacggcattataaagcacttaacaccatgccgctgccgccgctgcaccaacttaaaggtgacgttctagcgcttactacgttaaaaaagcagcaaaaacctgccgtcacagcggtttccactagcgtggcgtatctcgtcaccatcctgccttatctcagctggttaaccggcgcggctgccgtgctgctagcctgtgatagctgggttgaacgacgacgccaccaaacgctgattagcgcgcgtcctttatctgtcggcgttgcgggtagcagtcgcttgctcactttaattggtttttacatattgatccttgttgcgggtggcgcggctgcagtcggcttacctgcgctattaaaaggctttggtgacttcgactaccccatggccatcatgggacaaacattactgccattgtgggaatatttactcattttcatggctctcacattactggccggcatttggatcattagctttagtatgctgattaacacgtggataaccaatgcttacctcacgacctttattgtgaccgccactgctttattgccgcttatactgccgcagcttttccggtttgtgtggtttctgccattctcctatctcgacgttgccgcaatgatgcgtggaacattaattgatcgactgaatcagcccttagccagtatttggatcggtacaggcgctttattcatctggtcggtgcttaatctgggactctttggttatcgggccagaaaggaggcagcatgatgcgatatttccgatttcaactccatcaactgcttaccaatcgtaaaaacttggctgtcattggcatcgcactcgttgccttgatttgccagttcgtcttttttccgccaaatcaggtgccacctgaacttccgacaagtacggtgttgacacgtgatcgcgataaaaatgtggcatttatcaatgagccacatggaccgcatacagcgatgtgggtccctgtcacccgtcaactcgtcaaaattgaaaaccgcatgttaacggcgcaaaagcagcagcattcgcaggcctatgtgcaggcaactttggattatctggcttttgtacgaaaaaatgccgccaatcctgaggctcaaagtagcccattccactatccgctaacatattattttgaaaatcggcaataccctgatgccgatgctgcttttgccaatatcaccctgacgcgctcgctgatgactttagccgatcagcgcgatcccgacatgactgcggttcatcagcaaactttctggcagacgcttttccgtggcgcgttaggcgggtggctcactgcgctactgctgatcacgatcttatttgctaatgatttgctgacgagcgaacaacgccatcgcagcatcgttcggtcatcgcctctaagtccctggcatgccatcaacaccaaaaccttgaccgtgctaacagccttagccggtgtacttctgctatcagcgcttgttgttgccggcttcgtcatccctactcacggactaggatcgctaacaactgcgatcgcctactttgccaaagatgggatgacagttaccgttgatccgatcgcgctcagcattgctctccccatcatcctcggcttgacaatcctactgatgtggctctttattcggttaaatctactgtgtcagttacttttccacaacgaactggttggactggtactcagtgcactcttgctattcggcgaaccactctacttcatgcatggcctggctttttcggttccgcaaaccgcgtactacctgcccgggtacatgaatccggcggcgattgtcagcaggttgcaaaactttcgctatgataccagccgcatgagtccgctcgctgctttgattgtggtcggcagtgtgattatcgtgcttgaagtgatcctattcatcatcacgcatcgacgccgggcagcaatcgttaaataaaggaggccccatgatggaattacaattacaaaatctcgttttgggtttcaaaaataaacccaatgtcattcatgatatcagcctaacgatgacgagcggctcaattgtcggcattgtggcgcccaatggtactggtaaaacaaccttgctgcgattgattcttaatgatctcaaaccacaatccggcaaagtggtattagatggacaaacatacggcagccaaaagcataccctcgccatgcatcggcaaatgtgccttttcccggttcaagatgatctttatcctgacttatcgggcaaggcgcacctggcatattacgcccgactttggcataaccaaacgaaaagtgttaagcaaattatcagcgcactcgacatgcaggattatgtcaatcagccggtgcgaacttattcaatgggcatgaagcagcgtctttgctttggcatggtgatggcggccaacaccccgattatgctattagatgaattcatgaacggtttggacacgatcaacgttgcgcgcatgtcgcagattctgcgcggattgcgggcagaaggcaaattgattattacagtgtcgcatctattgaataatctgcaaggatatgctgatttcatctacttcatgcgcgatggcaaaatcatcaaaacgattgatcagcatgaacaacaacctttgtatattcaagtggcagccgaagaagccaaccggttaccgcgcatgccttggcagcactatcccaatggcatgttggtattgccaattaacaacctccccggcgaacattttaaccagttgctgctaggactggctgcgcatcacattgtgtttaaattagcaccactggatcttgaaacttacttcaatgaattttatgatgccgattaatcaccaaggccactcaaagtcgcttgaacagcagctttttatgaaagtttttctggatgcaagatattgggcaaaataaattaagagccttcccttacaatgacactcggttctgctacaatgacgttattacttttcaggaggcacaaatatggcgtcaggcttgactgctaataaaaaactgcggcataagattaccgcggcggctttactcgtaacccttggtgttgtctatggcgatatcgggacatcaccactttacgttatgaagtcaattatcgctggaaatggcgggatgggacatttcgataccgattttctagtcgggtcggtttcgctgatcttctggacgttgctgattatcacgaccctcaaatatgttctcattgcgttgcgagcggataacaacggtgaaggtggtatctttgcactttacaccttggttcggcagcgggcgcggtggcttgtactgccagcgatgattggcggtgcggcgttattagctgacgggatgttgacgccagccgtgacggtcacaaccgcaattgaaggtttaaaaggggtccatattaacggcaacattttgatcgacaatcaacaacaggttatttgggtcacgattttgatcattaccttcctgttcttcatccagcgttttgggactgacctcattggcaaggcgtttgggccgatcatgtttgtgtggtttaccttcttaggcgttgccggctttattgctttatcaaaagactggtccatgttgcgtgctttgaacccttactatgcattgcgtttgctggtcagtccggataacaaaatgggtctctttattctagggagtattttcctggcaacgactggggcggaagcgttgtattcggatatgggccatgtgggacgtggcaatatttacgtcagctggccatacgttaacctatgcttagtgttgaattattttggtcaggcagtctggcttgatcgccatgctaatgtgagtgcttataatcagattagcgatttcaacccattcttccaaatgttaccggaaagcattcgcctaggcgcaattattctagcgacattggctgcgattattgcctcgcaggcgttgatctccggttcttacacgctggtttctgaagcaattaaactgcgctttttgccgcggctgcacattgtctatccgacacggcttaaaggacagctctacatccccatggtgaacacgattttgtggctcgcctgcttggctattattgcttacttcaaaaccagtgccgaaatggaaggcgcttacggtctagccattaccatcacgatgttaatgacgaccttgttgctttatcaatatctgcgcgctcgccacgccccaaccttgatcgccttgggtaccttgatcttctttagcgcgatcgaaaccgtcttcttcatttccagcgccgtcaagtttctccatggcggctatgtcacggccatgatcgcgtttgtcattctggccattatgtacgtttggcaatacggcggccggattcgcgatgataacacctaccgcgctgaaatggcctcactgtttgcgtataaaaagcagctatccgaacttcgcagtgatccggaatatccaacctacaccaccaacttggtttatatgacgcagattgccgatgatcactacattaaaaaagaaatcctgtactccattttggataaacgaccaaagcgcgcccgtgtctactggtttgtcaccgttaacgtcacggatgaaccatacacggcacaatatacaactgatacgtatggcactgattatatggtcaacgtgcagctgtatctaggctttcggatggagcagcaggtcaatgttttcctccgccagattgtgaatgacatgatgcgcgaaggtgaattgccaacccaaccgcaaaaatacaccaccattccggatcgacaggttggtgattggacgtttgtcttgctgcatgaagaattgtcaccgcaaactcagatcaaaggttttcagaagacgattatccaggcgcggctatggcttcagcgcgtgacagttacacctgctcaatggttcggtttggaatatgctgacaccttggacgaaaccgtcccgcttgtacttggtaagattccgatcaccaagttaacccgcctaagtcgttcgcaagttgatgcccaagccgaggatgaagacgactagctattttagtcagatcacaacacattcactagcttaggcggtggcgcacacataatgcgctccccggcgccggctcgcgctcacagaaaaaagtgtcccaaaagtcatgcatgtcttcatcgactgctgactttttgggacactttttaagtacaggtattgttgaaaatacagcctcacactgcttgacggctcacaccaaatctgtccgtctgcaatctaggcaccggctttaacttttttcatggcgcgcaaggctgcttgagccgctgcgagtcgggcaaccggcacccggtaaggcgagcaggagacgtagctgatgccaatttgatcaaagaacgccactgaatccggatcgccgccaacttcgccgcagactccgatcggcagttgcggatttgtttgacgaccgtttgtaatcgccatggccatcaatgcgcctacgccttctgtatcaactgtttggaaaggatcattcggaagaattttctgctccagatatgcgggtaagaaggatcccacatcgtcacgcgaatagccaaaagttaactgggtaagatcgttcgtcccgaaactgaagaagtcggcggcgtgagcaattttgtccgcggagacgcaagcgcgcggggtttcgatcatggtaccaacttcatagctcacctgcatcccttttgcggcggccagctgttcaatttgccgaacaaccaattgccgcacccaacgcaactcggtttccgaattggtcaaaggaatcatgatgtgcggtgtcacctgcatcccttcgtcggctaaccggaataccgcatgcatcagcgcccgcacttgcatggcgtaaatatccggataggtcacggctaggcgatccccgcgatggcctagcatcggattgacttctttcaaggctgccatccgttcgcgtaactgattttgctccaaccccagctcatgcgcgacttgcccgatttcacgctggtcatgtggcaaaaattcatgcagcggtggatcaagcagacgaatcgtgacggttttaccagctgccaagcgatatagctcgtaaaagtcctgctcctgcattttctctaatgcggccaagggtgccttgcgtccggctgcatcttttgcgagaatcaaccgacgcatttgtaacaatcgttctggttggaaaaacatgtgctcggtgcgcgtcaagccgatgccatcagcgccaaaagccaaggcctgctgcagatccttaggtgtgtcggcattcgtaaacacgcccatgcggctggcttcctttgcccatgctaacagtgtcgccagactatccttgaccaaggcagcagtggtcgggatttggccgcgatacaaattgccggttgtcccatcaacggatacccaatcgccttcatgcagcaccgtatcgccaacagtcgcggttttggcatgttcatcaacggttaaggcatgcatccccacgacaccggttgcccccatgccgcgcgcgaccacagctgcatgtgacgtcatcccgccgcgcgcagtcacaatggcctgactgacaatcatcccttcaatgtcttccggcgaagtgtcttgacgcatcaaaatcacttgatggcccgcttcatgagccgctttggcttctgccgccgtaaaataaacctccccagttgccgcccctggtgatgccggtaaaccggtagccaaaatcgtatgtgcctgcaacgcctgcggatcaaactccggatgcaacatgtcactcaatgattgcggttcaatacgcaacaacgcggtctggcgatcaatcaagccttcgttaaccaaatctatcgcaattttaacagcggccgccggtgtccgtttaccattacgcgcttgtaggagataaagttggccatgttcaatcgtgaattcaagatcctgcatgtcgcgataatgctgctccaacgtggtcgcgatcgctgccagctgattataaacttcaggcatttgatcgtgtaaaaccgcgactgactgaggcgtccgcactcctgacaccacatcttcaccttgggcattcaaaagatattcgccaaacagcgcgcgttccccagtcgccggatcacgggtgaaggccacgccggttccggaatcagcgccagcattaccaaaaaccatcgtctgaacgttcaccgcggttcccaagtcttcgggaatgcgattttcgcgtcgataaacgactgcccgccgattattccatgattcaaatactgccgtcactgccgccagcatttgcgctttgggcgattgtggaaatgacttgcctgcttcaatataaagctgcttaaatgccagaatgatttgctgcaggtcagcggttgtcaacgccaagtcagagtcatacccattttggcgtttcacggtggttaaaatgtcatcgaatcctttttccgacaagccgtaaaccacgttaccaaacatcgccagtaagcggcgataactgtcatacgcaaaccggggatcggcagtttcccgggcgagtgcctgaacggtttgatcatttaagccgatgttcaaaatggtatccatcatgcctggcattgaaatcggtgcaccggaacgaaccgacaccagtaatggcgcaaccggatcatcgaatcgtttcccggtcgctttttctaacgcctgtatgtgttgatccagctcggttaacaacgcttctgaaagcccgtgatgctgttgataatcgtggcacgcagcagttgtgagcgtaaaacccggaggcaccggcaggccaagattggtcatttcggccagattggcacctttgccacccaataatgcccgcatctccatattaccttccgcaaacgcatagatttgtttcatgataaagccttcccttcgctaaatatgacgttatatatgttcgctatataatgtattatttagcccgcgaaaatgcaagcgtttacacttagaaattggtctaattcggaaaaagttcaatttcataacgctatataatacacaaaaatctttttgcaagtgcggcgatgcgcggttaatataacaacccatgtcacaacaagaaacttgcctataaggaatgtaaaaaggtgtcctatttctcgccaaaatcgagaaataggacacctttaatttgaagctgcaaatgaaagcccagcctcatggtgcaagtgtttcaattaagtatttaaagatccggtttttagtgatcttgccaatcacatgagtgtccccatgtttttggatcacagggagtgaatcgacattgtgtttcaacaacaacttgctggccgccataatggtcgtatccgccgtcaccgtcacgacattgggcatccgcgtcatgacaatgctggccggtaaagtggtgtcacgatctgtaaagctggcgcgcaataagtcctttcgcgagatgaggccgaccaaggcgccatcatcatctaacacgtataaggagccgacatccgccaagaacagcttggttaccgcttcttccatcgaggttgtcagcttaatttcagtcggcggcaataatattttggcaatcggggtattaaacagcgcatcgttatcgactgataaaacactcgctccttggtaggcatatccaactttaggccgggcatctaaaattccaaccgttgtcagcaagcgtaagtcagcgcgaatcgtggccaaactaatctttaattgcgtcgccagcatttccccagtcatcggactttttgcttttagtaactgaacaattttttgttgacgtttagtaagttgcgtaagcgctcctcctcatgattgctaatcaacagtataacattttcagggaaatatgacgtgatatttaatcgttaatcacaacttaatcccaaatcttggtaaaataaatccggcatgtagctaaactaccttgccggaaagtcttcacagtgtttgtttattgagaatggttaaatgctgatcaagcgtgtagacgataggttgggcattgccaatttcaactttgttaatatcagcatcgctaatagcttccatgtacttgactaatgcccgtaacgttgagccgtgcgccacgataagctgattcttgccggccatcaaccgcggcgccagttcggcactccaatacggcaacaggcgctcactcgcatcggcaagactttcaccgcgcggaataatcgtcgccgggtacgcgtgatagcgccgtgaacgactgggatgtgccaacaacggcggatgcgcataaaagcttcgccgccagctggcaacttgatccgggccaaaaagtttccgggtcagatctttgttaattccgcgtaaggcgccataatgccgttcgttcagacgccaacttttagtgatcggcaggtaattctggccgattgcgtcctgaacgatgtaggcagtcataatggcccgcgataacacgctggtatgcacatgctcaaataagatcccggtcgccgcaatctttttgccggcagctgctgcttgagctttcccttgcgccgttaatccgacatcggaccagccagtataagtattttgttgattagcaatgctttcgccatgtcttaaaaggactaatttgaccacatcacggcctccttaacccaactagtataacaatctcaacgggtttagggtagtctgctcggcaggtcttttttgctgccaaggcgtgaaaatgataggctactattattgaactaagcaaggcacactgccttagcttatagaaagaaggatgctcatggccaagtcgcatcaatctgtcaccatggtcgagcttttctatgatttgatttttgcctatgccgttgggcgaatggcgcagactctggcagtgccggtgcatgggatgatcgcgccacaagtactggttgaatttctattgatgctgctggttttctggaccatctggacttttcagacagtcttaatcgatcgtttttcacatcatgaagtgacccacaacctgtttacgttgttcaacatgttttgggtgattgtcttaagcaccgcgattaaccctgattttgctaaaactaagtggccatttcaattaagtgctgcgattctcttcttgagtcttgcgagccaatacggtctgctttggcggcgaaaacactcgcaactcgccaaaacatttggcatcacgctggcagcttgcagttttgtgattttaatttcgctatttataaagccatacaccctttcatttgcggtcttctttggcggtgttttagccgctggattgatgccattgctattgcggaacgtactcaaagccacgccagccgacttaggcaatctcagcacccgttattctctattggttttactgatatttggcgaatcgatcattggtgtggcggaaaccatttatgctggtctatctttgcaagcaggtcttttcttcttggtagtcatcttattgtttattgcctaccaacttgtttatgacaacggtctcgatcgccggcaaaaaaccgcgggcttggctgttatctatttacaacttccattactggcggccattctcagtctcagtacgttcattcactcgtggctggccgggctgcttgatcctcaatggtttgcgcttgccatcacggtgacgttggcagtttattattttagcttaatcggatatcttagcgcctaccctgtcaagcacattgacatcggcttcaagcgctggttttaccttggtttttccgtgttgatttttggtatttttagcttcatgacaaccattatgccattacccttcatgttcggactcaccgcttatctattagccaatacgctttatctttggcaatttattctccatcccaatgacgcgatgtataataaacttggttaaatgaaaggggagctccacatgacaacttatgatgtcacattcaacactgtcgatggcaagtcactcatcaagcgcaacgtccaaagcgatcacgaaaatgctcgggtttgggaggacgcggttgaacgttttgatgccgaccacctttacatcaaaatgaatgacaaaacaatggtcagcctgttgcggcgtgccgttgttcgcattgatatgaccgaactgccaagcgatgttgaaaaacgggcaaatcgccgcgacgagttccgcaatgccatgtacacgctgagccagattggcctgtagcaatcctgttacgggtatcaaaatggatcagcacatttaggacatcagcctctaacccacgtcatcaaaatcctatcgattcatacatatcgtagtttcttgatgtcaatacggtcatgctgatgtacagaatctatgtatcaaaaaagaatcccttcagccttaaaaactgacagggattcttttttcggtcgaatcatgtgtctgtacaacaaacaccgagtttaattcatcaatgctgcaacttagtcagcgtagttaaagtgggttaacggtgcatgcttaacatcttcaatcgtcttggtgccggccagctgcatgataatttccaactcgtgatcaatctgttcgaacacgctttgaacaccttgtgcaccacctaaagccaagccatagataaccgggcggccaaacgcaaccaaatctgcaccggctgccaatgctttgaagacatgactgccacgacgaatgccggagtcaaagatgatcggaacctgcttgttaacggccttggcaatggcaggcaaaacatcaaatgatgctgggccaccgtttaactgacggccaccatggttagaaacatagattgccgcagcaccggcgccaattgcccgcaatgcgtcttcaggagactgaatacctttaacaataaccggcaagtcggtatattcagcaatccggcgaacgtcatcttcattaatcttttgagcagcagaagcataaatttcgccgatgcctttacccttgccatcgccttcagaatacttttccaggttcggcattggaatcgggaattggaagttgttgataatatcttcttctcgataaccatcaacagtggcatcaacggtcagaataatccccttgacgccagcctttttagcttcgtcaagcaagctcttattgaagtcccaatccttgctcatgtacagctggaacaattgcggtgctccgttgccggccgcagcagtatccgcgattgaggttgagctatacgtgctctgcgccatcaaaccaccgactgctgccaagccgcgagcggtatccttttcaccttggctgtgggccaatccctgagccgcagttggcgccatcataaccggcgtcttcagatcaatgcccaaaaagttggtcgacaagtctggagaatcaatgttcgacaaggccttgggaacaatctgtgcgtggttaaatgccttggtattctcggcaagcgtccattcatcttcggatccgccaacgatatagccaaatccacctgttggaataatcttcttggcttcaccttctaatgacggcaagttcaaaatatccaatttcttctctgcatcgctttgttcgtaaccattaacaactgtcatgtgtcaaaagcctcctgaattgcttacttattagaacacttataagtgtagcacttataaatagtaagtaaaggcattttgctaattttttgtaagcaaaaaggagaacctgcaaaacgaggccctcctttgttagccaaacaccgaatcaccattggcggtttagcgttctttcttctccttggacttgtcaaccacgtcattgaacttctccgcgattttgtccttggcatcactgagcttttccttagcattgccgaccatctgttcagccttgccttttgcttcggttgattcatcgccggtaagtttgcctgcgccttcttttaccttgccgctgaccttatccttagttgcatcaaaatctgccatacgatcatgcctccttatttttgcttaacttaaggataccaagttgacggttcgtatcaccagcaataagctcatataaatacaattaattttatgatttatgatctctaatcaggtgatcacacaactataatttgctaagaaagcttgcgccaatattttgctttgattttaaattaaagttttcaagaacagttgctccaaggtcactgaaggtctctcttatcccaagatctccattagtaaggtttggagaataagcaatcagcggcacatactcacgcgtgtggtcgtgcccacaaaatgttgggtcatttccatgatcagccgttataagtaatagatcagattcagatatttttgctatcacgctttgaagtaaatgatctacccgttctaattctttaccataacctcttggatcacgccgatgcccatactgtgaatcaaaatcaacgaggttagcaaaaataaacctatacttcttgtcttcgagaatattaataacttggtatagcccatcctgattacttgttgtgtgaattttacgatcaatgcctcgacccgagaaaatatcgttaaccttaccaataccacaaacagaaatattattcgtgcttagtatgtctaacaccgtttcgtggcctggtactatagtataatcgcgacgatttgctgtacgacgaaaactcccggagtccattcttataaatggtcgtgcaataactctaccgatttgccacccgctatcatccagagtaaatcgaataaatcgacaaatgcgatatagctcttcaactgggaccacggtttcacatgcggccacttgcagaactgaatcacctgatgtgtaaacgatcagagcgccctctgcgatttgttcttcaccgtaatcttcaattgcccgagttccagaataaacctgatttaaaatgacccgtcgatttgagaattgttctatttgttcaactaaccgttgtggaaagccgttcgggaaagtgtctaaagcagaatcaacaggaacacccatcatttcccaatgtccgtctaaactgtctttcccagcagaaacttctctcatctttccaactgcgctagatgtaccgctctttgctttaattccctttagcggtgttgctcgcagaatccgacctattcccaaatcttccagttgaggtattgctagttttccattccaataagaacaaagatgcccgagcgtgtctgccccttggtcgttgaagcttttagcatccggagcttcaccaatgccaactgagtccaatacaattgtaatgattcgctcaaatcttttcattcaacaacacgcccttgactatcagagtttctccgttttactgggttggggattagattaactatgactaatgatattaagtaaaaggatcctaaaaccaacaacgccactgaaaagcccttctcatcgataatatagccaattaaaattggcgacagtccaccaatcgcacgaccggtattaaatattgcattatttgctaagctccgtatttctgttgggtaaaagctgctgatgagcgcaccgtagcctgcattcataccgttagcaaaaaagccaacaatcgcgccgataattaacatcagaaaagcactgtgtacgaacgcatagagagttaccgacatgccagacatgattaaaaagacagaataggtcaatcgagagccaaatttatcaaacaatttaccaaacgacaacatccctagtgacataccgataatagtcgaaatcatccacaaagacgacccggagacagacagaccttgctgcttttcaagtaacgatggtaaccagttcatcagtccatagtagcctgcaacctgaattgctgacataattgttaatcctacagtaatcaatgcgatcttgggttgattgaatagcagactaattcgaggatggtcggatttttctgcacctgatttatgtgctagctgccaacttttagtttcgggaagatgtcggcgcacaaagtaagccaaaaaaactggaataaccccaaaaataaacgctgcacgccagccagctaaagggatcactgttgccgcaatcaatgcagcaatcagcgttcccatttgaccaccgactgtaatccaagaagacatctgccctcttcgttcttttggaaatgcctctgcaaccaaagccatcccaataccatactcaccaccagcacctaaaccgaccacaaacctcaatatatatatttcccctatgctgcgtgcaaacgccatcaacagcgttgcaatagcaaaaataaaaatagtataggtgaaaattttaatcctgcctttcttgtccgcccagtacccaaaaatcacaccgccaaccaacattccaatgttcgtgactgacggtaaaactccgcccgcagcagatgaaatatgaaattcattgataattgagcttaatgcaaatgacagcagcaagatatccataccttcaagtcctaatcccagcatagaagatactaatatctttttccgatatgactcggcttcttgcatcttatcattcctccctacagcttatctttaccctaaaactgattctagaactgactcggcagatctttgatgaatacgattatagtcttcgggcttttcccacttatatgttgcacgactaaggtggacaaccaaacagtttgccacgggaatattgtaaagagagcccagcaaaaacaaaaccgcagactccatttcagcattgataatgccacggtcttgccagaacttcatttttgccccatcaactttgagagctgtctccgagatgtccggttgccggtattggccaaaaaaatacgtctcagttgttaaccctataccggtataaaccctaaacccattttttaccgctcctgtataaatcttgtttactaaaagcggatcagctacggccggataactatcgggaacataatcgcccattaatcctgatgttcgcgccattgcacgattaataatgatatcaccggggttaatatcatctcgccatgctccacagccaccacatcgaataatttgtttcgcaccgttctcgataagttctacaacacaaatctcagtcgatccaactcccatccccgtcgaacagacagaaacatgatggccccgaaacataccaactaccaggacgaattctcgactatcttctatttttcgtttagactcccaatctttagaaatcaacgcaaccctatcaggatcaccaacaattaaagttacttcaccaagatcccctttttggatatgtgctaaatgctcactactcataagaatcacccttctttaccttcaatgtcaaaactgttaataatgagataatataaagaaccgataagaagctcatggttataaccaaagacgagtgatccaataaaaagcctatgatcactgatgaaaatccgcctattgcccgacccacattgaagatcagattgtttgctgaggcacgaattcttgtttcataaagattggcgacgatagcaccgtaccccgcattcattccgttagcaaaaaatcccactattgctccaccaaccaataatgtaatctgtgtgtccgcaaaactatacatgaaaaccgaaatggccgaggcaatcaagaaaaaagaataggcaactttactgccaattctatccataatttgtccaaagacaagcatgccaagcgacatacccaaaattgtagcaatcatccatatagacgatccagaaacagacaaacccgatttttgttgtaagatcgacggaagccaattcatcagaccaaaatatcccgctatttgtacagtcgccataatgatcaatttaattgtattactggctcgaccgtctcgaaataaatctagcagggttatcttcgaatttctttgatttattagctcattttttgactctaaccactgtttcgattcaggcatcttgaagtaaacatagaatcccaaaagaatcggtagagcaccaaaaacaaaaagacctcgccatcccaaaatcggaataataattgcggcagctaatgccgcaataatactgccaatttggcctaatattgttacataagaagtaattcgaccacgttgatcgtttctgaaaacatcagcaaccattgacataatggcgccataaacaccacctccgcccacgcccactagaaatctaaatagatataccatttgaatattttttgctattgccatcagccctgttgcactcgcgtaaataatagtggttaccgcaaaaatcttcatacgaccatttcgatctgccataggtccaaatatcagcccacctgccaacatcccaatattggttattgttgagataaaaccaccagcagccccattgacatgaaagcttgtcatcatacttgctaggacaaatgacaaaagcattgtgcttgctgattgagaaaacaatccgctaccactgacaaatagagccttgcgctgttcgcggctaaaacttctcgcgctttgttccatcagaagaacctcctccaaactatttaatagttgaagcctatcacatatgtaaacgtttgcttttgtggtatactacaaaaacgatttttttaatttgtccttcatcacaaaaaagggggtcctcaatcatgatttatctcgaatcagttttaaaaacgcaatctcgccgactcaagcctgttaattcagcaaatctttccggtcacgttgttagcgcaattacgattatggataacacaaatgttcggcagtggctacggggtggcgaaattgtgctttcaggatcgcacactttgccaaccgagcagaatcagttacaggaactcttatctcaactaaaaatcagccaggcttgctgcttgattattaaatgtgttacttccccaatttcatcacaaaaattttcaaatattcttttagaagaggatgttcttccaatttttaaaatgtcatcaaacatcacatatttagaattgatgaatgacgttaatatgatgctttttaaagaccgtcaagttaatcgtttggctgaactagaccttgaacatctcctaagaacagacaaaccacgcgatagtgattttgactacatttcaagcgtaaaaagtattgatttatataagcaaaatgcttgtgttattcaaatcactctcacatctcagacaaatcttaatcatcgaattcatgatttatttacactaagtcggcaactccacgccatctttagcagttttattactaatcgaatactttcgagctattttgttcttgagaattcagacggtgcgactatgatattatttacaggctcaaaacttgaatcggacgtttctttgttgcatcacttacaactgtcatctcaagtaaagatctcaaatcaggcgctgtatattggaatctcaacccttcacccagctagagaacttcacaaatgctatcaggaggctgtatttagtatcaaaatggctcaaattttcaactacaaaaataccgttacaaaatttaatgatgtagctgtttggtcacttattgaaggtatacaagaatcagcttctttagaactaacaacacaacgattgaaagaagttttaaaaaaccaagatctattcaaaacattgaagctgttttttcagaataatgagtcaatcaaaaaaacaagccagcaaatgttcacgcatccaaatactattagatatcgtttaaaggagattaaatcgcaaacggggcttgattatcaaaaaactgatgataaattcaggttatatattgcggttatcactcaaacattagcgcatgcgaacaattaactaaaagagtcaatacatcgtcaaagatacttatgtactcttgtccatcatgtcgctaatcaacattttcaaccacccaatatcatgtcatctcatttgcggatgccaatatggatactgcagttcatacaaaaggacccctaaacaccgaaatgttcggcattcaagggtccttcttttaatgactaatgatgcgcctttagtgccgtgcaccgggacgtttttcctcaggcgctggcggaataaccgctttgccgccttttttaatatgcttgtagttcacaactgtcttattcttcatatcttcaaccattgacgcatcttcgggtgaaaaactgtcaatcgtcaacatggctgcattggcataaagcttttcgaccgtgcctttgaagctcaatggcacatctttggtctttcgtaccgagaccttatcgcctacaacgatttcttgtgacacacaaaaacctccttcaacgcatcttccgccacattcccgtcaccatcgtaacacgagccgtcatcatcggaaaatgaaggcgcgttatgacaattattgaaacggaatcgtgacgcactgcatttcgactgggatagacgcactatctttgcgctgttgccaacgccattttcatcaatagttaagagcttacttggcgacctggactttaaccttaatcggtgcattcaggtcaaccgaatcactgtaatgttgcaacaaataccgctgcatcgcatcacgcgcttctttcttggtcatctggtgacagacccgcgaagaatcgtgccggtgtccccacttatccgtatattgaccaacgacttcataatcacgaagatgtgctgcaaataacatgattcctcttaaccacctttactaattgtaccatgacttggcacttgtttttgtatcacaagaagcatttatacacccttattggtcccgtttcaaccacacgagcaaaaaaaggtatcagaacttcccagactaacgttcattcccggcatatcaacgctaaagctttctcaccgtttcaacacttaccattgatatgttagccaacatctctttgcattggctgatcaaagtcagactcaagccggtcacggttactctgcttcatccgcttaaacgcaatcaccgtccggcccaccaagtcctgaacattaaacttatctcgggggtcataatccaaaatcgtcaccaaagctgaattctcataacatttctcgatccggacaataaaatcatattccatattgccattagcctggcacaaaacagtcattcctgattttgcatgtttcatcaccaaaacctccttgtatagtgagcgtgagcagggccgcttagaaaccggagtgtaagtggcctcaggcgtgatggcccgggtttggccattgcgactgaggtccttacacgcaggtttctggccctgcgaacgcgttatggagcgtgagcagggctgcttagaaaccggagtgtaagtggtcttaagcgtaatggcccgagtttgaccattgcaccaaggtccttacacacaggtttctcgccctgtgaacgcgtctcggaaagcgcaacccagcacaaccaatattccacctgctcctgctgggttgatattagattatcaaggtgaatattttatcgtcaacataaacgatcaattatacaaattttctaatattttgttcataatgcccactcctgcaagctcgttcgttccctgtctccagactaaaaattgcgccaacccaaacgccatttatactttctatgattttaagaattcctagtcattaatatttctattgacatcattctaagaaagactaacgcttaagaagcatttaagtctcaaggcaaggtgatgatcaaatgaaccgacacgttttcgcagcaaccttttcttcgctgcgttcaaagaactttcgtcgattttggacgggccaatgtatttccgttatgggaacctggattcagcgaacaacgcaaacctggcttgtctatcaaatgacaaaatccgcttttctagttggtttgctagcggcggcacagtttgttccgatcatggcgctgactttggtcgccggaacattgattgatcgctaccccaagcgacaaattcttttgtttacccaattcggctttttactgttgggtgctacgatgacgttgatcacctatttgaagatcgtccagtattggcagattctcgcgattgccttgggctatggcatccttcagagtttcgatacgccaacgcggcaatcatatgttattgaacttgtaggcaaaaaagatttaattaatggcatttcgctaaactcatccattttcaatttggctaaaattgccggtccgtcactggcaggtatcttaatggtgacgctgggcgtggcaccgtgttttctgattgatacgcttagttatgtggcgattattgccggtttgttaatgattcaccaagatcatcctattgccagtcatcgttcacgccacatcttattagatattcgggaagggttaagttatatcttgcatcatgcagacgtgaaactcagtgctgaattgatgctggtcatctgtacattaaacttcaacaataacgtcatcatcccgatctatgccgaggaggttttgcaccgcggcgctcaaggttatgctagccttttgtctgctactggtgtcggctcactggtagcagcttttctcatgagttatcttgccagcttcggcctgcgccgggatctttatttggccgtagcagttggcacggccttgattcagtcgtccatgctgttcattcatgtctactggcttgccatgctgctcatggttctcatcggcttttgtaacatggttttcctgaaccagtccaacgcctcgtttcaatttggcattcccaatcaactgcgcgggcggattatgagtgtttacgttttgctcaatcaaggatcaaccccgattggcagtctatacgccggcagtgtcatggatgctgctggcggtttatggggatttcctgcatgtggcgtgttagccctcatgttaacgatggtcatcttcggttttcaccagtctacgataaaaaagtgggtatcgcggtaacaccaaaaaacgcaggcaagcacgttgaaaagacactgtgcttgcctgcgttttcgctaatttttgaactaaccttcgcgtacctgtccgttacccagcacctgatacttaatcgtcgtcaacgccgctaaccccattggtccgcgtgcgtgtaatttttgcgtactaataccgatctccgcgccgaaaccaaactcgaagccgtctgtaaaccgagttgaggcattcacatagacaacagccgcatctacctgttggaggaattgctgactattttggtagttatctgtaatgatggcctcgctgtgcttcgtgttgtgtgcgttgatatgcgcaatcgcttcttcctcggaatccaccaccttgaccgccataattaagtcgttatattcggtatcccagtcttcttccgtggcgacctgcatgttcggcacaattgcccgcgcccgttcatcaccgcgcaattcgacaccatgcgcttgcagtgccgcagcaattaaaggcagctgctcgtttgcaacatcagcgtggattaaaagtttctcggccgcattgcaaacagacggccgctgaactttggcgttgacaacaatgtcgattgccatctgggcttgcgcatgcgcatcaacataaatgtgacaattgcccgccccggtttcaatgaccggtacggtggcctgttcaacgactgctttaattaacccccggccaccacgcggaatcagtacatcaatatagccattcaggtgcatcatctgattcgcgacttctcgcttcgggtccgtgattaattgaatcgcgtcttttggcaatccttgtgcggtcaatgcagcctgtaaaacagtcgccaaggccaaattgctgtgcagcgcctctttaccgccacggagaatgaccgcattgccacttttaaaagttaacgcagcagcatcaacggttacatttggccgagcctcataaatcatcccgaccacccctaaaggtacccgtttttgcgcaatattcagtcctgcgtgattcacccaggccttatccgtctgggcggttggatcaggtaaggcggcaacttggcgaacccctgctgccatgtcagcaattcgctcggcggtcagcaccagtcgatccgtgaacttagccggcaagcttgctgccgcttttagatcttcatgattagcttccaaaattgtttccgtatgcgtttcaagagccgtagccatggccaacaacccggcatttttctgtgcggtcgtcaactggctcaagacagtcgccgcggcctttgctgctcggcccatttgttccagatcaatcgtggtgacatccatttttaatcgtcctccttgtaccctgacaggcgcaaccgttcattttttaaagactgttcgttcagcaacctcgttaaacatcagttagccgcgtgaacttcagatggcacaggctcaagttctgccccgaaccatgtccccactgactcgccggcaacgactcgcaaaataatgcgtgggtcacgcccactcgttaaaaccatgtgcttccctgctcgcatcatcacttgcgccgccttaagcttcgtcaccattcccccggttccaaaccgggttgaactgccccctgcaccagccaaaattttagcggacacatgagtgatttccgggatcaaggcggcgtttgcatggcgattaggatcgcgatcataaagcccgtcaatatcggaaagcaccaccagtaagtctgctccgatttgcttcgcgaccaaggcggaaagttggtcattgtcgccaaaagtcgtacgatgatccaattcatcaaccgcgacgctatcattttcattaatgattggaatcacctgccgcttcagcaaagcatcgatggtatccaaaacatgctgccgagtttgcggataatcaaaaacgtcatgtgttaacaacaactggccaattttagcgccataatcgctaaacctttgcgtatacaacgtcattaactctgattgaccaatcgccgccaacgcctgctgctgagcaatttcggcaggccgcaccgtcacaccaagcttggccatgcccaccccaatcgcaccagacgtgactaaaaccagctcatagccttgattcgtcaaagccgccaacgtatacgccagccgatctatggtctgcaaattaaccttgccattttgatgaatcaaactactcgtccctattttgacaactaaccgtttacaatgcagcatccgcttcaccatcgctacctccacttaccgccgattaccagaatattaaaaaagcaccgccttgatcgagacacccgttaaggcggtaccattctcgttcaaagccgtgctttgcgcttttttactatttaatttcgtcaatcttcagttcaagcttggattcgcgagccattcagaactttcagcaaacgtcctgatctctgtgagccgctactatgacttgatgaagtgattgtatgcggggtgtcgggaaaagtcaagcgggttattcggttctggtaacatctatacagggtgtatttttaaacaagtctgcccattcatcagatgttggcaatgcgcggagaacaatggcatcatcaacaatttttacaaagagctctctcgtttcgtcaaggttaagttgtctacgcattttaattggtatgacaagccgatgtttaattactgactcttaactttaagcagcgtgcttatgtttacgctttgctttgcgtgtgacgaacaaccattctccgaggaaggagccacagacaccgccaacgtaaatccaccacttaaaaggaatgttcgataacttggcaaggataaatcccacactcattgctcctgcaagagcggttgcgaagttacggtgttgtttcatgtcgcttcaacttctttcaatatttagtctttgttgaacccgtaatttgaatagatgtcattctttctactggttaaccaaatagctttccaaagaagctacaatgatgcctattccaagctgcctacgcggtgcttaccttgccgcgtgaccaccacagttcttgaacaattatcgttgcacgctttctaacagccgctatagcatcatcgtgtccccagacttcaagaccgcatcaattgttagcttaaaaaagatacgcttctcgaatacggctttgctccgcgtttatcaattgttttataaaatgctatctaagcctttgttgatgcagattatacatgattcgcattttgtgtcaaaaagcatgcacggaatttttgccaaatacagattacataacgtttgatatataacgaaaataagaacccggactcattcatcaaaacaaacagtgagaaaaatagaacgcctgtaaggaatcagaacgttttttcaatttctgatatatttagcgatcaaaaatgcgttgcactgcttcccctcgtaaattccgctcaacaaataccttattgcctctccaccgccacccgtaaggcatagattcgcggcaatgctctattttggcccaccggttgaccgttaacagtaacatgtccctgattgacgtgaactttaaccggcagcggcaatttgactgcgtatctttctggcagacgcagccgttcactgtaaaaatgcccatttgtcagctttcccgttacgccaaccacacccaaatgatcggcttgcgcaagataaacgcccttagttgtcagcggattgccaataagccgccactgcccatttttcatgcgatattgcttccgtccccgtatgtcaaaacggtaaaaagcaaaaacgccgccagcaagtgggcgttggctgccatccggaaagacggccatttgttgaaataatgcgatggtcttctgtgccgcgtgtgtttgaattgtttgccgagctgaaagcgacatcgtttttggcttaacctgacctcttggcagtcccactactgctgtcatcgcaagactcgcaatcagaatcttcataatcagttgttttacccgcatccccatgcctccaaatattactttttaaatatcgtcacaataagtttatcatttcaactaagatgactgctaacaatacacatgttattaaaatggagacaattagttttgcaaaagctttaaagaaatacaatcaactaagcatttatagtcattaaaccatttttattctgtagccaaccaaaaatccgccaactaatcggcgtactacctgataattggcggaagcttatgcacagcgttcataatcacgagcgataagtattcctgttcctcaaatgtatccattaaaaggcaccggtttacgatcaaatcgaacccatccaagacaatggacaacttagatctttctcgcaatcaatagactggtctcatttatttttgtttaatagactacaaaagagaaatacaactgaaactagtaaatactggataattaacgttgaggtgatggcacttatatttggattaaccctaattatagagccttcttcaattaccgcctgccaaggaaatatcatagaaaatggaagactaataatagtgcttgttgctgcaactacaaaagtgttaaaaaatgaaaacttgtcgttgtaatgaaataacacacgtcctcccaaaaaggccattaggactaaggggattaagatgactaaaaaaaccagcatcactaaacttagcgaatcgcgcagtaagaatgtggccagcatctcgatcaaagtcaatgccaatataaaccaatcactttttctcatttcatttacagcaaggttaatagcttaataatcgcttaccttgccctccttttagttttaagagctcatcctagatcctatttttttatccgacaaatagctctcattgcaacccgcgccatcaacctaaatgaaaatccgtaaataaatcaaagtacaatttttattcaattctgcatcttcccaatcattaaagaatttacattacgccaacggttgccacggatactattgaattttctactttggtaaaattaatagctcgttacctcaatagatctaacacattcttttttgaagctgacatagccggaaaaaaggtgaaaatcatcccgataatattgggtattagcaccgctactaacatgttattccaagtaatgataatggggatgcccaacgatcgccccaacattaaactagcggctttaactaatacaacagagataatggatgcggtgatcgtcataagcaacccttccgccatgaattggtttctgatatcttttcgcttggctccaaaagcacgtcgaaggccgatttcattttttcgttcggcaatagaagaatacgttgaacccatgatgccaaaccccgcaacgattagcgatataccggcaacccctgcaatcaaatctgtagccaaagaagtatttctatttaactgactgactatttgttgcacattcaatagctgatatcttcccatcgaactgttgtcaccgtatttgttcaaataattcataaccgccctttcagtccttaatctactggagcgataagtgaccttaatccggtttgactgatctttcaatcctctagtcattaaatacgcttgtcgcgacatcaaaacatctggagtctccacaacgccttcataaatcgatgcgatatcataatttgttccgtttacgctaacttgttttccgagtatatttccagcgtgcatgagcttactggctagctccttttttatggcaattgttctcacgccatttttagtcaaagatgttaattttcgccccgcaattaatgaaatatccttagttgtacttagagttttttctgaaatctgatcatacgtgatttgctcgtgcttaccagtaccattaaatttcaaaatggcatcgttgaccgtagcatcgttcttcaacgagacctttttgacagaagtaagcccttccagtcgttcttgatctttttccgtgaatccataaccatcttgctttgaaatgaagctgacgatgaaccctttttctcctccagtcacatcagcaatctgcctagatattgaatcctgaacgccatttcccagaccgagcacaagcaatatgctcatgattccaatcatcagcgatcccattgtcaataaagtttgccgtttatttgcacataaggaatttactagttccttcagtaaaaacttgattttcacatttctaccctcatatttccgtcagtacaccgtcaacaatcttgacttgacgactggcaaaactggcagcttctggtgaatgggtgaccataataacagttcttccctggccactgacttttaacagtatctgcaatatttttttggacatggtggtatccaaagctcctgttggctcatcggctatgataaggctagggttcaaaatgagtgatcgcgctattgccactctttgctgctgcccaccggatagactagctggatactcgtcaattttatcctggagtccaaccatctccagaagttctaaaacgtgattatctggatcatcgcgatcttttccataaagtaaaggcagcttgatattttcgccaacagtatatctggcaagcagttcaaagttttggaaaataaaaccaacccgatgattacgaatttcggaaacaatatcgtcactcagatcgccgatgatttgtttgttaaattgataagtgccggtgtattcattatccaacatgccaataattcgtagcagtgtcgatttaccggaaccggacggaccaactatggctaaaaattcaccgtcatcaacgtccagattgatatttcgaagtacttgttgtcctcgaccttttttcttcaaaaaatatgtcttattgatattctgaagtgaaatcattttgcgacctccttcaaaacggatccaaccggcacctccgcgattgaagcatattttagtcccatcgttcttatgatattgatctttcgctttttgaaggctttggaattggatttcttgatgaggatttgccccttatcttcgaattttccagggatcaagacgctgctataaggaatattgatatccatgtgtacgccaacattaactccttgaatgggtacctgaagtcgatacttggtgatgctttcttcacttgacggtaaaacgtcaactttttttacgacacaatcatactttttagacccatcaatgttggccacttttacctgcataccttgcaaaattaagtggcggtctagctcggttacggaggcatcgatatacttcgcgtcacttgcaacagcatatgagccatcttccttaacgataaatgtgccagaaattggcgtagtataccctgtttggtaaatcacttgtccttttgtaatatgctccccatttttgatcttcacattttcggggcttgtcgagtccaagaccttgatttcctctgctctaacaacgccgcttaacaccaaatccttttgcctgacaactttatattcttttgctgtcgcttttgccgttgttgttgtcgccgattgataactagttaacaaagcatacaagccgacaaaacttaacaaaattgatcccaaaataaccagtctttttctcatcttaccctctccacaaaacttacgatatcaaaaatccggaggcacaagttaagcagcccctgcacactccggattttgtttagacttcaattaaggcaataggattttgtagattcaaccaagatttcttatgggccaaaaatcaatccaccaaaagcgttattcgttaaacctgttgacttcctcccacatcaagatagcagatgaactcgctcatttgcccaataaaaaattaacgtcgcaaatcgcttaaaaaccgttagttattttttaagattgacgattatttgcattttcacgacgtttacattcgaccgggttgcactgattaagcttaggcacataatgctcataaatgttttcaacaatgtcgtacctacattcatatatctgagctcattgcttgcctttttatgtacgtttatcaccccttcaccaagacaatttgcaaccggatagttagcaactcttagttgtttgcaagctctgccaacccgatacatcccccttgctcgaaacacaaaaaagcccgccgtccacagaactatccctgcacaacggcgaacttccttatttctaacattctcttttctgattacgcccgcggccggcgaagatagcgccgagccagatagaaactcagcaatgccagtcccagcactccgacgacaaccgcgatacttaaccacaagcgccagtgatcagcagactcggcggcgtgctcaagtgattcggtataaggtacccgtttgccggtcactagtatgcggtgggagttgatcatatacggggtacaggtcattaacgtggccaaatcgcgtcccggttcaatgcgtaggctctgggtttcatccggccgcacggttttgatccgaaagacctgatacgccatctttttgccgttgacttggaggaagaacttctgcccccgtttcaacttgtttagatcggtgaaaaagcgtttagtgggtaagccgccgtgtgccgaaacaactgtatgcgtgttcttgcctccccgcggatagctagtacctggtaacaccactgccccttgatctaacaacgtgttgttggtggtgtcaaaaaggggcaggtccaccgctaatttcgggataaccactcgcccgatcagatgccgtttcacataggcttggttaaacttttgcctgctttgaaacggatcctgtcccgggcgcaaaccagtctgggcaagtgcacggttctcctctgcccgttgctcatcttggacagcggcattttgcttggcttcttgctgtgctgctgctcggcgactggttagtagcaattcattaatcgccgttgccgcgaacggatagcagaaacacgcggcccccgcagtgaaaagtaagatgacgaaccagcgtaacaatcggcttgtccccgacgctttttttgtcataggctattagactttcttgctggtctttttcttcattaggtgaccgccacccattaagatggccccgatcatcaggaaggcgaagagtccgattccgcctgtcattggcaataattgattcaccggcgtgttggcgatgcgaatcgttttcgtaccccaagtaccggcaatgacttcaaaatctgttgtcggatcgagaatttcatagccttctggtgccgcggtttcaaccaaggtatatcgccctggcaacagcccttgaatggttaagttggctgtctcggctccactggtcttgagtttcgttgccgcgtcttgattcgttgtccaggtaatcttggtcggttggtaggttccgaccataccgttaacgccttcaagaactgcatattcgcgcacattgccgttcattcgctgtaagatgaaagtcgcgttggccaaactcttggaagatccggcttcgtgtttgaagaaccgaatcccgccagtctggatttccggaccatcgacggtaatcttgctgttaggatcaaagctcacttcagccgtgttactgactttttggtctgggaccattttctcattgacgattccggtgtaggcaacggtcacgcgtttgccggcatattgggtcaacaggtttcgtaccgcatcgggatcgaccccgcctagaaagtccagttcaaacccgaatggatagttgtgtgtgtgttgccaagctgcatcattggaagtcatgaaggccatttttccggttaatgcctttaaaatgtcctgaccgtcaaccgtgattgccgtcaatgccttaaaagtaaggccttccttggtcatataatccagcactttaaattggttgtacttaaaagtgtcttgactgtgatcagccagcgcgccaatatcatgcggaatctggaactgaacctgatacgtgagcacatcgccaaccgcgacatcatggagatcttttgttgccaccgcttgttcattgatttccgtcagatttttggtaacaagactgtctttaggataaagatgaatgttggtcagatctgtcccgtcatcatgccgcactggcagactcacgatcatatctgctgctttttgatacggttgcggggtcacggcttcgtgaaatgcgtacacgctatgccggccattggttttggcggctaatcctttgaatgccgccaagccgtctgcatcagtcgtgacagctgcggcattaggatcctggagattcacatattgacccaggttttgcgatatcatgctcgcagcggttgtcttatcatgattttccaataattggtaaaaagcatccgtcacgttgaaaattttaaattgggcgccttgcaccggtttgcgtccggtcagtccaaggtcgtgcccggtattttgaatctgttcgtcactggtttgttcgattttgtgcagcgtgaaatccacagttgttgtcgcggcatgtacggttttgccggcactgagcagcggcagaaggaagctcatgagcatcagtgctgccaagagactgtgcccgatctttttaaacgttacttgcatgcgtggtgcctcgctttcttatttttaatgaagaagtaagtggccagtagtagtaacagactccctaaaaggacaaagcgtaaattgcgccaatcggacatagccggtaaataaccggattgacgcttagacggatgcgttccggtgccgttcgtatcctgcccgtgattgccaagctgggtcgttgatggccccgcggtttgatcaccggttgtcggcgcctgcttatcggcatagttataaactcgtgggtagccgctactgatcatttccggtgtcaccaccccgccaaagttttcctgcatcggctggccgtcaattaacacaaagcgccggttgccctcttcgtcttcccatgaatcaggaatctcgattttgatcgcgcggcttttagcatccacttcatagccgggaacgccttgcaattcttcaaagaaatattctccggcgggtaaaaagcgttcgcctgtattgactagcccatcttgatcggaaacaaatttgttcacgcggtcatcatgcaacggatcagtagtgctcacccatttgttgcgcaagtcggttactggcgacatatcgagataaagcttcttaccattctcaattcggtaaatagcaaagatcgcaccggctaaccgtttactcgtaccatcagggtgcacgccgaacttgaagaaatacggatcgcggacataaccgacatttttcggatacagatgaacagtccggagcgggttgtcactgataggatctgtgacgggaaaaacaactaacatcggcgaacttttgcgctctaagtccacattgagttcggttgaaggatccggtgccacctcgatcatcagataagctttagtcggtgcctgttgatcgacagaaacggttattcggctgatcccatcttcaccgagtgttggatcggtttttgtattcatcaggccgatgcctttgttcccttgaccggctaatttcaggttggcccgggcaaatttcagtgcttgcttacgcgtcatattctgataacgatcaactaaagcccgaattgcttcaggggtcatattcggtttcaataaggagctggcatcatagacctcaaagttagcgccattcagcccgctggttttgcttaataatttgtagccatctttatccgggttattcgggtcaatccgatgaccgtcattttcataccaaacgtcttccggttggcgaatatcccgataaattcgcttatggatcacaatctcggcagtttgatcagccgcgtgaacccattgtggtgtgttgccaagcacgataccaatcaatagaagcaacggggcaagccaccaataaaatcgtcgcatcttaatgggcctcctttcgcttcaaatacaggtaaagcagccagccgccgccacacgcactgattgcgaccatgacaaacagtaagataccgctacccccggtttttggtaggagtgtttccaacgaatggttcgtcagtgtgaagcgaatccgattcaacttgtcccctgcatcagggataaattcaaacccatactcatcactgctcaaatcgctgccactatacgcaagatctaccattgtgccatgcgcgttaatcttgaaggtaaacgatccgttcagccgatcaaatccggcaggcgctttggtttccgttaagcgataagttcccggggtcaactgatgtgtgaatcgcagctggccattttcatcggtcgttccttgtgcaacaggggtggtttgattgccgcggtataaggcaaaacttgcattggcgagtttgtttttacctttttcaattttgatcaactcaagttcggtgggtttcagttggttgatcaccgtggtgtctggccaaatctcgccgttgcggccgactgtcacagtaccgtcagctgccacttttaaatcaaattcggtctgtaactcgtgaccggcagcggcgatttcgcttacctgatagtcgccgggttttagcgttccaaatgagactttcccctgcgaatcggcagttgctgtttgcagttgagtgtctccttgcttcaagacaaaccgactacccggcaccactgcgccatactggtttttcttggtaaattcagctggaaacctgcctgccggatcaagatgaacctgcaccgcgttggtttccttgctgtaacgttcctcagtgtcgaaaaatttaacggtcgcttgattgaccagcgtaagccgttttgtcagtgtgtccggatcctttgttggccgcaccttcaatcgaagcgagaaaaagccgctatgaaaatgaattttctgcacatcctcacgtccgattgtcagcgtgattcgctgccgatcgccttcttgcgtcacgacaaaatccgacacgtcctcagtcagcgccattttccgatcttggctaaccgcatccggatcagttgcattaaagagctggaacgctttttgataagttgggggactgttgttattgtccggaatcaactcgacatgctccggtagcaggtccgtcacaacaattttggtcggcttcaccacgtaatcgcccatactgtagacttcctggttaatgtagtagtaaaatggctcgccgttgtaatgctgattgaccacctgatcgtctaaatcatttgcggtccagatggtgccggtcttatcttcctcggccccgccaccggcttcggcatttgcgctcacgcttttgttgttggtgacatttgggtcaatcaactcgatttgtccactcccattggcaacccaagtgccgccgccgttggaataagtgccgcgtctaaaggtgtggctggtaccgtttaaagtaaacgcaacggcaccacgcccaaatgttggcgcacctagtcgatcttcccattccgtcatattctcgtgatcaattggatcgacccagtttccccaggtctgtgaggtatagccgcgctgttcatctccgcgagcgcccagtttttgggtttcaaatgtcgctttatctgaggtgatccaggttccttcctcaaattgccaatccgtgataaaccgatcgtcataagtgggcgtcatccccgcctgctccgtccagacaaactcaccaggattcaacgaggtaaacgtcagggtcgaattttgattggcctcactttgcgggataaagttcaaccgctgtctagttgccttgtcataaaaaatcacgcgccagtcatagtacaaaacattggcaaatgacatcccggaaaagaagttgttggaaaagtcgatgccgacgtcctgaggagtatccctccattcgactggacggacgcgaatacctgttagttcaacataagcaccaatctcaaagcggttcccatcaagatcgcttgctgagccgacatgatcaatatccactttgatcttggcatctagcaggttagaggggccattggaattttgaaccgcatctttaaaaataatggcggtggcatcagaacgcgacacataatctgatgaaacgccattctccatcgcccaacgtgatccgtattttgaacgagtactactactctgtttgcgataaatttgcgcctcttcatccgatagtgcggcgccatcagctttggttgcgtgaattttaatcgtcccaagtgcagacggcggtaaaatcagactgtgcgcatctttgctgagtgcagccggttcctgcacatcatcgttaaccagacgcgcaggcagctgcaagtcgacatcaagcgctaatacctgagcagcgtcattaaatccatccagactgagtttcacactagctgcttgctgcttcgtatctggcagctttttggttaaaaggtactcacctttttctgccgttttctctgcaagccggcgcgttatttcaccgttagtatgtgcaggctgggacgtgaatccttgggcattagcgaacttgacgacttgctgccccgtttgatcctgtggcttggctaaaatcaacttaacctgaatttcagaccgttgaacgtcaaagttgtaagttaacgtgtgaccatcgccatgccaggattttcctgcttctagctggatgtgctgccgatcttttgtagtcgcttgcttggcggccgcgctggttgatggcgcactagccgctgcttccaaatcaaactcagcagcttcggatgcggcagaacgagtgctcggctgcactgacgcatcccggacatcgtgcttcggattagtctgagcgctttcagctaccgggaccgcggtactgccaatttgcgtgaccagcatcagcagtatcatcagcatatgaatccatttcctaggcaatcgggtgcctcctttcatgttacgtttttcacttgttgctgaattaagcgtaacaagatgaactgcgtaaacggaactataataattgttattttataaataaagttttctccggtatattacttcttaaatgataattattagcgaatatatgaacgaccattcagtaattgctagggattggaatttacaccacaaaaaatcccgatctgactaagctggaaacgctcagacagatcgggaacaacctacgttattaaattatattttgctactaagcgcggacaattttacccacggcaattggcaatgttacgtgtgcatcatagttcatgacggttcctttaaccgtatctggaagttccaaactgtccggaaccccatgaatgtaaacaacccgtttatccaattgcaaatcttcactaccaaatgctgccttgaacgccttctgcagctcttttaaatccacgagcttgtcataagcatagtgcccgtcagcatcggctactggatagctgtcattgggtacgtgcattttagcaggctcggcatcaaacgggaccatcgttgtaccggaaaccggttccgtttcaggtaaatcaacaaagccgtcaccattagcatcttgggccgcggtggctatttcagccggcttgccatccggaaaaccatggaagtgttcccaatgctggacgtttgcaggtgtatcaaacatctcaatatgaatacgcaactgcgccccgtcaacagtgaactcggcagtaccatgggccttagtaccgatcttctctgcattcaatggcacaatttctgctgtatacttttcagccatgtcaaccactcctattttgagatttgaaccacctttagaataacgtaaagtctttaattgctcaattagtttaataattatttttatagccttttccacgttctcctagcgatggcgccaacggtttcattcagtatttaagcagttacatatctctccgaagcgactttattctcttcctaaatcatgcgcttgaagtagtcgctgccgtaacgccggatctgcagcatataaatacaagccatacttagcccgtttcagcaaaatattaatagcattcatgacaatcgcaattttagcggcttgcgtatccgctaaatcagggcgttttttgaatgcttctttgtcctgatattggctaaggttgacggtcaaacgatccttctctgcattgtagccaagactcggccctaaaataaccccggcataattcaaatcgaacccttgaatcgtgtaaatcgagccaacttcatgtaaggtctccggtcgttgtgcccatggccgatcggtaaaattaattttatcccacggcagccgcaatgaaccagccgtgacataccaggtcttcttatccagcaccgtaaacggataatcagctgttgcaatcaatcgtgacaacccaacttccgcatcacgttgctggattaggcgatacattggctgaccatcggcgaaaacccgaaaatcaaacttctccggatgcggcagcggggtgatgcgcccgcgaacaaactgatcaatccaattattgaccgcagcatcccccacccgcatttgttcagttagttgaaaatgcgccaccgaatagccgctggtgattcgcttcagcaaagcctgcgtccaaaagcttttaagtttaactagttgatgaaaatcaaacaccagcacaaccaatcgcgccaattgtaaaatgtcagtcaattgattagcatcccgaaaattgttgtacgggtctggcgctgtcagcaacaagtgtccttcgtcaataaaaacaatatcggcacgcttgccggcttttcgataggcattaataaaaggtgtcggcttcataaagtcctttttgcgaaaataggacttggcaccggctatttctttgtaaatcttcaacatttcattatggttcacaagcagtttattatcagtgcctgccagcggtccgactcctgcacgcgcggcttgttgcagttgtgcaaaggccgcgtctaacaccacgcttttcccggaaccggcatcgcctgaaacgatgagcaaatgcgttttgtcggcttgataattagccatgataaaattatgaattttttgcttcaatgctgcttgtgcgatggtcaatgtcgcgtcttgcggcaaaatgaatgttgactgagctagatctggcatgtcgacacctccgtcatcaatatagcatgatcaaagctagtgaccatacgcagcttagttagttaactataacaactttaaaaataaccttaaaaaaaccaaagtcaatgcaaattacatacgttattcacgtaaaccggttacacttaggatagtgactaaaaatgttattcaagaactaggagtattgccatgccttcaattgctgattacccgcaacgcctcaatttagcgccttttcaacagacacgattaactgagttggatgccggtctttttgcacaactgggttatttgaattttaactacctcatcggccaaccttacgcgcgttttgctgatctgaatgatagcagccgactgaacaaggcaactttaacgacttgggcaattccgacgcatcaagcaatgttacaagcgatgcggcaaagtgcacggtttgcgcgggtgacttggaccaattggcttgagacctgcagtcaccgtaatgaagaagattttggtgccatcaccttcaccttggcgccgcatgtttactgcgtgagttttcgcggaaccaccaacaagttagtcggctggaaggaagatcttaacatgagcttcatgcccaccattcctgcccagcgccgtgctctgagctacttgacccggcaaattagccgccatcccggcacctactatctgaccggacattctaaaggcggcagtctcgccatttacgcttttgacaacttgccgcaaccgcttgctgatcaaatcgcgcatgtatacagcttcgatgggccaagtggcgtcccactcgatcccaaccaccgtgatcgcgtcaccaaactcgttccccaaagttcactcattggggtcagtctcgatccggcaactaactttgaagttgttaaaagtcacgtcaaacttttcggccagcatgacgtcctcacctggaatatcgctgaccatactttcgcccggctgccaacgaccacttggatatcgcgctattttcagaaaacttttgcgctatggttggcgggtttggacaccaaagcgaccgccatcaccgttgacgccttatacaccatgcttcgaagcggcaacgccatcaccttagacgatttagccaaaaccaaaaaccactggcgccactatctacatgcctttcacgaattagacaagcatcatcgccagcagctaggcaaatcgttccgctgtttgctcggagcgatggcaggatcgctggtaaaaacgcattaaaaatttccatgtcaacttgggcttgttagcaataaacttcaaaatgtctcttttaactcgaagcgagaacggcaaaaacctgccgaactcacttcgagttttttgcactactgtgacaaaaagttcaaactaacctacatgccgtcagttcgcggcccacaaaaagacaaactagcatccgcccagaatcccgtcatatcaacaactctacgaatcttagagtcttcctgagtaaaaaatccttgtacctttttagatctgctttaacaatgagaacaggtggtgaagagaaaatgcaatttagtgacaaactgaaacaggctcgccagcaacatcatttaacccagatgcaggttggtacgcaattacatgtttcagccaaaaccatttccagctgggagaatgggcgtagttttcctgatattagcaccttggttagtatcagtgatttatatcaaatttcgttggatcaattacttagggaggatcaagatatcgtgcaacattatgagaccatcagcaaacaagcacagcgttaccaaaagtacttccaaattacatactttttgaatatcttactgattttggccatttgggcagtacagatcacatcgagcaattctaagactattggatggctatttttggcactattaattaatttagtcgtgatggcaacgcattatcctgattaccatacttggatcaaaggtacggcacaccgactgctattaattctgttagctgttggattaagcacagttttactcgtcttgagtttcgatggtgcagcgtcattaaacaccgccagagcagcatcaaaccgatctgttgtttctttaatcggcttttatataggtctgctcataaaaccactaactgaggcgttcagcattatctttgccatctttggttttgccgaactaaaagaacagccgtaagctcttttgactcatcatcccgctaagtcagccatttgcgctggcttttttaaaatctgataacttgctttacaaggtacaggctgctgggtatactatgcttaacaaggtatcaaaaggaggccagtgcatgcaaccttcatcccaaatgctcaagggcatcctcgaaggcgccattttacggatcattcagcaaggtgacatttacggctacggcttgcatgaaaaactgggcacattgggctttggcaacatcccggaaggcaccatctacccgttattgcttaaactacaaaaaaacaagctcatcgttggcgttcgccgtcctaccggcaatggccccgatcgcaaatattatcacctcactgatgccggtcaagacgctttggctgactttcagcaacagtggcaacaacttgcccaagcaatggcacagcttaaccaaggaggtaccgaatcatgaaaaaattaaatcggctgcgaacggcaaatgaccaactgctgaaaaatattcacggcactgattacacttacacggaaactgttatccaatatttacgcggtgctttgttcaaggatccatacgccattgaacacgccattagtgacttacttgcaaccctaatcgatgcgcaacaggccggccatcgcgttgccagcttcttcagtgacgatccccaaacagcagcggataacatcttagccgagttgccacgcgtctcttggtggtacttgtttgatcaatactggccgatcctcatgtttcttttttcctccagtatttttacgatgttagtcagtcaagacaatcagttatctttaagtaataccattgcgccgcttactgttgtcttcgcctttttagggttgccatttgcacgcggcgcctcattcaataagctctcggccaaaacaatctttggtctgctgctggttgtcacccttcttgttatcgtccctttaatactgggttacttaaccgtcagtcattctgaatttgccttttcgcatacgaccctcaccatcatttgcggcagttgtgccgtgctcaacttggcggtggctttgagttttcggcaaatcgctaaactatttttaggttggtcaacgatttggctactggcacttgccggactacttttgccaatttcagcattcacggtcggcattgccatcgccggcgttgtcctcgcagcactcttattgttctatcatcccgaaccccgctccggattaatcgcctaaggccgcgattgatcacaaaccatacacaggagaagcattcgccatgaaaaagttaatgaaactgcgtgccgctaatgaccaactgcttaagcaaatccacggtctcgatcataactacacggaaacggttgttcaatatttacgcggtgctttgtccaaagacccttacgcagttgaacatgccatcagcgatctgctgacaacgctcattgatgcctaccaagctggtcatcgcgtttccagtttcttcagcgacgatccccaaactgctgcagataacattttaaaagaactaccgcgcgcttcggtgagttatcatttcgccatcttctggccgttgatcatgttcctgttgattgaaagtatttttctcatgtttatcagccaagatcgtcagcttacggccggcaacattgcattagccggcgcgaatgtctttattatgattcctatttcttacggacgtggcatcttctttaacaagatagcacgtaaaactgttttaacttggctcgcagctctagtcgccatcttctttgcgcctgcgctgatcgattatttttcacacggtctgctagacttggctatctctcggccatcacttctgggattcagcctcgtcttaggtgccttcaatctagggatggcgctgtggtttcggtatgctgcccttgtgtatctagcatggaccggcatctggctgatagccgcactcggactttccctccccgtctctcagataacggtcatctttggcatcatcggaatcgtgggggccgttgcatcgtcgttttttcgtttcgagccacctgaagtatgacgccaaagatgccgttgacgcgttgctttatctaaacagctgaccaaagaacgttgcttccccaaaataacgatcgccggttgccccaatcgttgtgtacaattggcttaacgcggcaggtgactgtaagtgattgagtaacacataccgggaaatggtccgtctgagtttgagggccaccatttgataagggacatcacggtttaggtctttggccgcctctaaaagctgttgccgaatttctggatgtttcgccatttctggatcgttataagctatatcaatcgcctgaaataattgttgggttttcttactcatctcttcacctcatccatccttctactagctggtatatactcaactcagtcattattatcaacgtagaaagtaactaacacgagtcgtccgaacactgacacgctttttgtgctgtgctagactattcatgcagtataccgatcttgtgctcatcctaatatccgtgaaccgggagccaaagatcaattttctatttgcagcttatcatgtcacttatgaaaggatctttcaattgaaatatcgtttattgggcaaaaccggctacaaaattagtgaagtttcgcttggcacctggcaactagggggcaaatggggtgcgccattcgatgcaaatgtcgcccgcgaaaccttggacgaagcctatgatcgtggcgttaacttctttgataccgctgatggctatcaaggcggtgaaagcgaaaagatggtaggagcattcgttaaagagcatcccgatgtgcatttcaccactaagattggccgcaaagaagagccattgaccgccgagcattttgatccggatcatattcgccgttatgttgacgaatcgcgccagaatatgggcttagacagtcttgatgttgtcttgttacactgcccgcccatgcaagtctactatcagcctgaaactttctttacactggatgccttgcaaaaagccggtaagattcggcattatggcgtcagcattgaacgggccgaagaaggcattaaagcgctcgactatgacactgcggttgttgaagtgattttcaatatgttccgcctgcgcccggccgacaccttcttcccgctggctaaacaacacaatgtcggcattctcgcgcgggtacccttggcaagcggcctcctgaccggaaagttcgatgaaaagacccaatttgcccccacagatcagcgcgccaacaaccgccatggcgaacacttcagcaaaggcgaaactttctccggcgttgactatttaaccggcgtcaaagcagcccgcgaactaaaagagcggttaggatctgacaatctggccgcaacggcactacggtttattctaatgtacgatgccgtttcagcggtcattcccggtgccagcaacccgacccagatcgaacgtaacaccgacgcagccgaaatgcctgccttaacccctgatcagatggcagtcgttaaagatgtttacgagcgcatgatcaagaatccggttggttacgagtggtagtcaactaataatcagtgagcggttgtcaaatgaaccccctcaccgatttatctaagtgtaagctgactgtacaagccatctgagtgtgatgacgatcacgcttgccaagttggtttgatgcttgcgttaactcgttgctgccggcagctttcttctgcaacagcgctgttgctacataacaactaacgagttcaccaaaaagcacccacacttccagttgacgattcaagtcataaccatcacaaaaccccactccgatttgaagtggggttatttgtgttgctaaaaagtcatattaattaatcactttgccgccagcgagaatccataatcaagcgagcggtaaacaagcccagcggtaaaaacataatgataagtgcggcacgcgtcatccattcggcaccgacgccaatattattcaatccaatattgtaaactgcccggtaaatatacaagccaggcaccatgatgacgattgatggcactgttagcgaaatccgcggatagccatcaacgcgattaatcgccgatgcaatcagcccagccaccagtgcgccgataaatgccgccgcagcagggggaatcgtattgagatccaccaattcaagccgcaacgtattcgccactgccccaatcaacccggcctggattgccattcggcgggggctgttaaacatcaccgagaatccgaagaccccacaaaagctggcaatgaggcgataaatcaaaagaaggaccggactcaagcctaagtcgacaaagttttccgggcgtaaatggacaaccatcgcgaccagccaaccaaccagcgaagccacaatggtaatcatcaacgcatacagtagtcgttccattcccgagcgcatatcctgcttcgaaatatccagcatactggtgataaacgggaagcccggaatcacaaacaacatggcgccgatataccccgcttcatgccgcgctgcaatgcccagtcccatttccaatccgcgaaaagcgataaaataaaccaaacaggcaaccgccacactgacaccgatacaagccagcagtgtccagttacgccgaatcatgatttcacgcagccaattaccgatccctgcaccaacaaaacaacaaaccatttcgataggaccgccgcctaacaaaaagacgaaagcgcaacacgccaaggctgctgccaatccggcgcgcaacggatcgtaattgccagacattttttgaatttgatcaagtcgatggtgaatatcccggacggtttgagtcgcatactctttgtcaaaatgacgcacaaaacgttccaacgcatccaacttatcagtattcacaccgctttttggcagtgaaagcacctcagaataggcatggttattgctaaagcaggtatacgataaggaaattaggccaatatctgctgaacatgacatccgcaatgctcgagcaacggtgttcatcgcctcacgcacgcgccacgccccggtaccacacgccagcaacatgatcccgactcggccgacgagtgacgcgcgctcttcaagggtggcatgatccgcttgccgctcttcgctgacaatcacgtcataccacggaatctgcatatgatgtttttctgaaagcggttggtctccccgatccgcttggttatcttttgccttcataactcgtgctaatccttcttcttatagggattgtcttttccaaaaaaattgaaaataaacattcactattctagcacaattcataacagggtgtatttttgactttttgaaactaacggatttgaccgccttattcatgacaagcacgcacaaactagcaatcatttctcggtctcaacttattgcatatgatgttggaatcgctgcgccagaaaatgccggattcgcaaaaagcgacggggatcttccttcttctgtccattggcgatccttcgtagctcatcaatcgcatctcgtccttcttgactcaaccgtacactttcagtcgtgaggataaaatcaattcttagtatcatccgaaaaacatgccgtcgtaattcatagccatggaaaccatcgcggataatctcttccttggttctttccacaacttcttcaatattcgtttggcggatgagctgcggttgttcatgtaattcatgcaacaggcagtcgatatagccttttgtttctaattcttcctcgtaatccatacgccgatcaccgcctttcatttgattaacttgatccgtatcgttttttatggtcattttcttaaataatgggcatcgccttttcgctactaaacgacaaaagcggtaaataccgatttatcgatggttaaacatcttatctgcaaagtaatcccaataagtctttgtgccggtgataacagatgcttggccggctaatccataataaagggactgccgctgcgatttagataatttcacccgcgccttgaccgtaaagaagttaccaactttcggatcgcgtgttggggcgacgtcaatcgcataaacccggccatctaatatggtaggggtcggcacattctcagcaattcgcaggcgtactttctgcccacgcttgatgctcatgatctctgtcggcgaaacgcctaattttatgtcagcaaccgtttgttccgttaaatccggcagaattcgtgccaacacgcttcctgaagggacgtattgattccctgccaaggcagtttctaaatgcaaaacgccactggcacttgctttgacatgatagttttgagtttcatcattcaaggtagctaacttagcctcgtctgcttggacctgttgctgaaccttcgtctgttccgcaacggctgtttgctgcaaccgactttgtaatgcggttagattagcctgagtctctcccgctttttgagccgatacatctgcttgtttttgaccggcccgttgctgctctaaagacgtcaaattggtttgttcctcatccaactgtgtctgtaattgagcaaggtactggcgtttaaggttcgcctgtgcctccgcgtcggtattttttatctcactttcatattgttgataaaggtagtgataggcgtggcgactggccaagggtttgttcgcctgaatcgccgcttttgcctcggagatagcggccatttttgcttggctcgtttggatactggcgcttagtaaccgatcaatctctttgtttttttcactagcgacggtttgggttgcctgctcagcctctgctgtcagtgtcagcactcgccgttgactcagataatcttgcacctgttgttgatagccgaatcggtctgcctttgaaaaaagatctttgttttcggtaacactttgtttcaaaacatccaattgctgctgttgctcttttagcgttgccagttgctgcttgagtaatttgatttgtgttggattggcgacatcgtggtaaacaagtaaggtctcgcctttcttcacgcgcttgccttctttcatgcggttcgagacgatccgattggcggccgtcgcctgaactgtcacggctgcctttaccggttcaatttcggcagctgtcagcacagttacctcgcgccgagcaaagatcagaaacaatagcaagcctaagaaaagaatcgtactaggcataataatcatcgttgaaaaattgcgaaagcggtgctggtaatattcggtcgttgcaagttttttgggatccatcatctaaagctcacctcactcatgaaccaggcgcgcgtaataaccgtcttgggctaacaacgttgcatggtcaccttgttccacaattttgccatgatccatcaccacaatttgttcggttttagccgcaatagttaagcgatgggcaacaaaaataatggtccgatccgtcattgccagcaagcgatcgacaatttttcgctctgtaatggtatccagactgctggtcgattcgtcaaaaatcagtacttttgccggtgacaacaaggcccgtgcaatcgccagccgctgcttctgaccgcctgataaaatgctgccgctttctgacaatttggtctgccactgctgcggtaagtttgcgatgtctgcggcaatttccgcagccaaacacgcctgcgtcaaatcttgttccgaaacatccgaacggctacctaacgtcaaattctccaacaccgtgcccgaaaaaataaacggatcctgaggtacatattcaatatattgccgtaatgttgtcaggttaatgtctttgaccggaatgccattaaacgtaatggttcctttatcggcatcaaccgggtaaaagccaactaataattttgctaatgtcgacttaccagaaccgctcataccgacaatggtatatttagcattttccggcacttcaaggttgatgttttttaacacatcttggccaaaaccatatttaaacgagacatcccgaacgcgtatcggaccttcgattaaatgccgctccgtcaagtgccgctgttctttgaattccgattcgaccagataaacttcattcaggcgattgttagcaacccgcgccatttgtaactttggctgtaggttgatgatgctttcaagcggattcgtaaagtatgacagcagcgcattaaaggtcagcatctgccccaaactcattcgattggcaatcaccaaacttgccccaatccacaacaccacaacgttcaacgccagcttcaacaggcctttaatcgcttgctgtaactgatctgccttggtgtaactaaacgacctcttcaaataggttagaaattcccgatcaacccgttcatagctaactcgttcgccggtcaaggacttgatggtttcaatgccattcaaatcttcaataatcgatgaactcaagattgcgttactttccatcgtctcttggttcaaccgatcaaacggccgctgaaatgcaaaaacaatcaccaaataacacggcacggcaatcaatgacactaaaaacaaagtcccattttggatccctagaacaatgcctaatattaggacaatccagacatccaaaaacaacgtcataatcgtattcgccagcgcgtcaataattttattggcatccgcaaaccgcgacacaatctctccggtccgccgagttgaaaaaaacgacatcggcaattcatataagtggcgcacataccctaaaatgacatcaatcgcaagccgctgccccaacaccgccatcaaaaaattctggccataagtcaacacagcttgcagcaagtaagccaccaaaaggccactagcaatcatccccatcgtcgtccgcatggcattcggtatatagtggatggtgaaaaactataaaagtactttcatgataggctttgacaatagttaagtgtataataagtgtaagcctagcactaacaagaataggtcttcatggcctttatggtctagtcgtcagggtgttgcacttgaattgtaaactggggaaaaaagttgcaagtgagacgctgtatttttcaagttcttgatattcaaaatagtaatgtcactgtccggactcattttggttaccttttttgactcatgtcaggcgcatcaaatgattggccagtggaacgatggcgggcgcttgcctgtttcgataaggtagatcgcgaccaacaagatggtaagaaaattgcttaattggtatactttttaatctacttgtcagactagcttacattaaacgttgacgctttttggaacacgcatatactaagaacgtaaatattggtatatgaaagggagttcacaatgcgtatcgaggaagattgtattggcaagctggcagtagatgaggatgttttatatgggatccacacgacccgcgcactggcgaattttccaattagtcatgaacggaccgatgctttgctttttaaaagtctgattatcattaaaaaggcggcggcacaagtgaatgcagctggcgggacattgtcagccgctaaagcgaaagcaattgttgcggcatgtaacagcttgttgatgggtgaacatcgtgatgcactggtggcgccggcgattcaaggaagtgccgggacttcggttaatatgaatgttaacgaggtcattgccaacttggccagtcagcataccgctgagccggtgcacccgaatgacgatgtgaatcagagtcagtcaacgaatgatacttatcccacagccgggaaaatggcggctttgcaagctttgccgccattgcagcaagccttgacctttttaattaagtcgttgttggtcaaagcagacgagtttgcggacgtggttaaagtcgggcgcacacaattgcaggatgcagtgccaactacatttggtcatagttttcatgcgtatgccagtttgttccagcgcgaccaaaaacggttgacgcgagcggcggaagatttacgccaggtcaatttaggggggacggcaatcggtaccgggttgaacgcgactccttattatcgcgcgcacattgtgtcccaggttaaccggctcattgacttaaagcttgagtcagctgatgatttgatcgatgccactcagaattgtgatgtcttagttgccttttccggagcaatgaaggggttggcgacggatttatctaagtttgctaacgatttgcggttgctgagcagtggtccgcaagctggtttgaatgaacttcatttaccggcgaaacaggcagggtcttcgattatgccggggaaggtgaatccggtcatccctgaggtcgtcaatcagattgcttttcaggttatcgggcaggatttaacgattagtatggcagcagaagcagggcagttggaactaaatgcctttgaaccgattattttccgtgacttgttgcaaggcgagcgctatttagcccgaggcattgacaccttgacaacgaattgcgtgactggattaaccgtcaacgaagcgcagtctgatgaaaatgtgcaacactcggcgattagcgcaacgattcttagtccgtaccttggctatgaagcgacaaccaaactcgttaagaccagtcttaaaacccacattgccattcctgaacttcttcgccggcagcaccaactgccagatgagttgatcaagcgactgttctcaccagcagtcatgacaaaccaagagccaattcctaaagcggctgcagtcggtaagaattgatgtgatttcctaccaagtgacacaactgttccacatgaaacaagcatcttcggtttaggtgtttcatgtggaactttttgtcatcaacaataggtttcacgtggaacgtacaagctttctataatctaattcactcaaaaaagcacccgcggattttccgtgagtgcttttttgatgaagcatggtaacttttggagaactgtactgctaactatccggcaattgagacgtgtgttggttggtgctcaataatcggcatccactgcgacacaatgttttccgggctaaagtggctggcacgttccaaactttgatgggcgtagtgctggcgcaaatcggtttggttaatcattttcttgaggttagcaacaaaatccgggacatcctgcgctttggtcagcaggccatagtcgttgttgccaaggtattcgcgggaaccggtattttccatggcaacaaccggtaaacctgaggccatagcttcgccgataaccagcggcatgccttcccaacgcgacgtggatacgaagattgaagcggcacggtaatgatcacgcaaagccttatcttttagcggtccttgataaataagcttgtcactgacgttaaaatagtcgatcaggtcatagaagtttttcatgtcttcatcggttccagcgccggcaattgcgatcttccagtcgtccggaagtgaagcggcggcctcaagcaaaaaatcgattcctttgtgggcgatggcgattcggccggtgaaggcgatgcggtgggcgtttagatcagcttcaccagtaggaacaagggtgagcggattgtagattttaacggtacgcggattgaaacgcttataggaattcaaatcgctttcggttaacgtaacgagtgtatcgacagcttgcaagccgccttcaaactcagcttgcatctggacatagtaatcttccatgtaagtagcgtagttgttgtgcatccagccaatgagattaacgtctggcaaagcccgtttaatcagcggagcaaaactcgttgttaaaccggctggtaagataactgtttgaaagtgctgatcccgaattgtcgtgatcaaatccgcaatttggtcatgatagtgggtgtatgggtcactaccaaaaaagtttaaaagtttaggatcggttgggcgcggtgcgatgagcagaggtgcgtccaactcaaagtaggcaggggcatctgctaaagtataaaaactaacatcgtagtgcttgacgaggtcgttacctaaaacggttgaagcgcgtttaacgccatccatgacgatattttctagaacgatcataactttcataagtgttcgccgctaagatcagcggctccccccctttcttctgagtacgttacgagctgactgcagcgtccagtcgaagtggcacaactactaaaaaaatagtagcggggtcataacagtttttggttcttctgagaaactgtttatattatcatacgcgctttttattagtaagtgcaagttttttctcgcaaccgttgatttatcaagggttgtgagtgcttgtttcatttagaaaaaagggattatgataagtggctgaattgtttgcgttctgtttcacgtgtaactgcaacttaagctaagacgttgcttatctatcttataacctaaactgaaaattcacaagaaaattttttgcttttcgactgtaaccggcaatttagtgagcgcgagccagcccggttagaaaccggagcataggtggccttgggcgtgatgaccgggcttttatgctgattttcctaaatggcgcaaaggaatggatgagctgggtttcgtggcgaaaaagattaaaccgagtgttccacgtgaaacaacctcgcgctatgatttatgcttttttgagcgctgccaccaataacgatcatgtacaagttgcttagtgagtgctttccaatgaggtcgcaatatggctgtgttaaccggcagattgccaaaaactgtttcttcataagccttggttaagttaaacatatacgcttgctggcctaatcgtttatcgatggcctgagcataatcatcaagcgactggttcacgggtcgtttcttgacccaacgtaacgcccgaagaagtatgcgataacgcgccgaaaagtttgtcgatcccagtccgattcctaatatcagcatgacgagcgctggtaactgccagacacttatcaacagtagagctaataagatgatgaacaatgatttttttagccaactcaggcggttgagagacggccgagattgtcgtttcgtttgtttggacactgtactggcggacacacgcgaactggacgaggatgaattgctagtgctggacggctgaacgctttcagtgccgctgctactgggacttggaggcgaaacattttcatcgggagttgccgggtcactgaagcctggtgttggttcaaacggcagccagcctaagttatcgaagtaaacttccggccatgaatgggcattgctgttgcgaatcacgtatcttttctgatttccggaaccaccgagcaatgtgccagtgttgaatcccttagcccagcgcgctggcaagccgatactgcgacatagtacaaccattgccgaggagaagttatcacagtaaccgatgggcgaatcaaaaagaaaataatccacatagtcccgggttggcggggtgcggcgtgcatcggtttttgaatacgtgaagcgtggatctgatttgagataattttggacagccagtaccttttcgtatggggtcgtggccttggcggtgattcttttggcaagtgttctgatcctttttggcagggtgcgtggcaattgtagataacgggacgcaaccttttgacgggaactggtcgccgcggccaattgtgctgctgagatctgttttggttgcacctgaatgtccaatcgctgaaaacgtgcttggtcggttgtttgcatgcggcgggtttccggattgagcaaaaaatcggtcgtgggatcgggttggccgccggtgaaggtcaattgaccataaggaagcggtaaataggttttaccaccgttgaaagttaaggccgtacttgtggcaggcccgtaatcgatagtagccgccgagtcgcgcatggtggcaccgtctaatggcatactctggttttgatcagcaccagcctgccaaccagtaccggtatattctgcatcaacggcaacgcgataataactggctttagcactggttgccgtgaaaaccggagtggggtcatcgtagaccggtcctcccaaaacgcggctattttcagtaaagcccgttcgtccggggccgttgatataagtctcaataccggcataaaaaccacgctgatttaaccggtcacgaaaaggaatcgacacatttgccagctgatcatttagtggggtcgccgatgaaagccaagcgaggccaagcgttagtccgcttatgaagacacatcccagtaagaacgggcgccaatgatcagcataaagatggagcatcgccatcaaaccggttaccaaagccaactggataaattgaatggttaattcgctgccgttaaaaatgtgcacagccaccagataactaagaacgatggcaatagcgccaggatagaaacgaaccacaaccgttaacagcaacagaaaagctaccaacgtgatcaccagcgtcatgctgaggacggttggaacatcgacgccgccagcctgcacgaattttccggttgcactggtaaaggtgtgtaaatacgccgtgaaccacgaaacgccaaatggctgcttcagcggcagtacgccccaaagcccaccgattgtcgtgccgcagcccaatagcagccaccatggccattggcgcggtagtagcacggccaaaaagtcaatcagactcatcatcaggatatagacgattaatgcgcgtgggtgggcgattggattgatagtagcaaaaggttctaagaaaagcgcaagtagccaccatgataacaaaactgctaaaagtcgttgcagccacttaggcatggtcgccacctcctgacagtgttgccacggttgtcacagccggagcaagtacttgttgaaacgggacggcggttgcagtgttggcagcgagaattaggtaggcgcgttggtgacccggggcggataagtcatgcagccattcgacattggcgctgcccttaggttcaaaccctgcaagcaaagcatcttgttgaccacgaaaaacacgcgtgagccgctgatccagcaaaaagccatccccactaaagattccggtatccattaagcttgcaaacaaacttagtcccgcctcaacagacagtgaaggactgatgatgagcagcaaggtccaagcggtctggctttcatgttcatcatcgtgcacgattaatgaatcagcgtgggcactgattttccaggcgatttgctgaatgttatcacccgggaaataatcacggaaatttttgatccgatcacttggcagacctgcttccgaagcggccattttttgaacaaaatggtcggccatccgcgcagcagcttcaggctgacgggtagggcccacggttagcggcgtcgtgagctgtaagggtagtgttttgcggaaccaaccaaaccaatcggtcacggtcacgctgaaaggaagttggcgataaacaccgcggggtaattgtaacgtgattctggctgttcgctgaccgctgggaaggtgccaagtgctggttttagcagcatctaataaaattaaattaggcagccatttgccgtgcgtcagcgtaaagaaacgccgagctggccggttggcaattaaagtggggttgtcagcggtaaacttaaggcgccgtcgcaatggtagtaataagggaagaacgaggagcagcaacaacacgaacacaaactcgctgacaaaccaactcgtcggcgaattaaacgccatgccaaaacagattaggcagccaaaaatggcgacaagggcactgttcagaaaaacgttacgccaatgcatgggttcacctccgaattggagcggcggtatgctgaagaatctcggttaacagatcggctgattttacagtcgggtctttaagaatcaagcgatggccaaagacgggaatgaccaaatgctgaatgtcagagggcttgacgaaggatcgtccgttgagcagggcaaacgcttttgctgctgacactaaggcaatcccaccacgcggactgatgcctagtcgaattcgctgatcggcgcgggtggcttgaaccagtttcaggacataatcggcaatggcgtcagtgactgtgatggttggcacgatttgtttacttgcagccaagctagccgcatcaaggacgggtttcaaatttgcaatcatggtttgccgatcaggactgacaaggagacttttttctgcggccgcatcgggataccccagggataggcgtaacatgaaacggtctaattgcgcttctggtaacggataggtgccggcgtaatcggtgggattttccgttgccatgacgaaaaagtcaggcggaagcggataagtgcggccatcgacagtaactcggccttcacccatggcttccagtaacgctgcttgggttcttggtgtggcgcgattgatctcatcggccagcaaaacgcttgtgaagattggcccgcgttgaaattcaaatgcattggtggcccgattgaagattgaggtacctagaacatcgctaggcagcatatcaggcgaaaactgaattcgggaaaagggtatgtccaaggttttggcgatggtttgaacgagggtggttttaccaaccccgggaatatcttcaaataagacatggccgccagctaataaagcggtaaatgccagcaaaatcggcatcggtttaccaacgacgacttgttcgacctgtttgcgcgctgcgttaaaagttgcttgtgcttcgctgatttccatcacgatcacgacacctccatgcggccattattcagtaaaattgtggaaacagcaagtcacaagctgaggccgtcagtggcaacctttttgcttcttcctgcagtgttggcaatcagtcaaactcatgctgatgttgttggcggtaatcttctcaatagcgccttatttcagcgtagggtatactatagcctgaccccataagcagactgattggaggggaccatatgaaaaaacggttgacgtatcacttggatattatcgggcattatttgttggtaggctggctcttgtttattgcgattaccattatggtgagcttacttacctacattgtgatggatgcgaatccgacatttattcaccaaattgtgaccggattgtcagacaaatttgcagaaccaaaagacaatctccatgctttttggatgatcttgcttaataatgaacgcgttgctttggggctgatgctaataagtatgatcccgattccatttctttattggctttcgtatgtggtgacatgtgcgtcagtcggcttagtcatgggcgtttatgcagccaagatgggtctcagcggagcactagccgcatttgctttgggaattctaccacacggcattcttgaaatgagcgctttgattatcggtgtgaccctagcagcacaagtcaatcgcgcactgcgtcattcaatcaagcgtttcttttctgatgctcattatgaaaagtcaccgctggatgtcaaagccattgccttacaatatgtttgcatcgtcgtacccatgattgcagtggcagcgttgattgaaggttttgtgaccccggtacttttgcgactgattgttcattgatagctgatggatgtttgtcttgaaccgagtgtcaatctttttttggcaacataaactaaagcgaatgagttctcctaaagtttaaggagactcattcgctttttaaatgattcgtgggccacttttcaataagtgcccgttttgaaaaataagcgcttaatgtttctcgtggaacattaagaccattctgaccgaagcaaggagtaggtgtttacgtcaagaaagtcgccattgtgatgcggatcttcctgacgtaaaatgccgtccaaatgaaacccggctttttcggcgacgtgattgctggcatcgttggtgacggctgcattcagtgtcagcttattaagatcgtaatcatgaaaagcaatatcagccatggcttcgactgacttatgcatgatacccttgccacgcgcagatgatgtcagccagtaaccgatatcggccttatgatgaagggtgtgatcgatggtattgagactgataataccaaccggggcatcagcttggtgaatgaccaaatgcagcgcgcgttgttcaccgaagcttttcaaggtggcagctaagaaattgatttcatcatcggcagttaacgtggtagcaacccatggtaaaaaagcggccaatgaatcgcgactagtttcgatttgctcgaataaaagcgggccatcaatttccggacgaggtagtgctagtttcaggtcataatcaattaggtagctaaacatggcttcatcccattttcttattagtttctcttagtataaaacaatcttcttctcagtgcgcatggacaagctttcagaaaatcggtagacttggtagctgtgaatacggcaaaatgttttttgggctcagtcataaagggccactgccggatcacgatggttgatttgtcgtggtgttaagtaaatatgagaaagatggtgttttcatgaaacgggtttggaagtggtgcgtagctggggtggctgcgttgatactgacactgagtatggcgatgccggtatcaacgcacgcggcgaagaaaacatatgtgattggaacggatgtcacttatgccccgtttgagtttgccgataaacataatcagtatgtcgggatcgatattgatctcatgcaggcaattgccaaagcggaaggatttcgtgtcgacattaagccattaggattcaacgcagcggtgcaggcattagaagcccatcagattgacggggtgattgccggcatgcagatcacgccggaacgtaagcagaagtttgcgatgagtgatccatattataaaacggccgtcgcaatggcagtcgcgaaaaacagtggggttaaccagcttaaagatttgcgcggtaaacgcgttgctttgaagactggtaccgcagccgcggactttgcgatgagcttgaagtctaaatatggcttcagcacagtgacatttgatgattccaataatatgtatcaagacgtcatcaccggcaattcagtggcctgttttgatgataagccggtgttgcaatatgccattgcgactggtttgaagctcaaacttgccggacctgaaagtaaggccagctattacggctttgccactcaaaaagggcgcagtgacgaacttgatcaaaagtttaacgccggcttgaaaaaggtcaaggctgatggtacttatgccaagattgttgccaagtatcttggcaatggtacacaagcagcgcaaaagcagacaagcgccaagacccaagacactgatcggagttttctaggtttattgcgggaaaactggggcaccttgatgaacgggctgcgggaaactatggtcgtgaccattgtggctattttctttgcgactgccgttgggatcttggttgggttgttaggtgttttaccgaatcggtttgctcgcggggtggcgacgacatttatttatattttccgcggtttaccgttgctggtgctagcgctgttcatttacaccggcgtaccaagtttaatcggttccaagataccggcgtttgttgccgggatcatcacgctgacgctgaatgaaggggcgtacacggcagcttttgtcaaaggtggtattcaggcagtggatgtcggccaaatggaagcagcccgcagcttaggcttaccatttggaaaagcgatgcggaaagtcatcctgccacaagggatcaagattatgattccgagtttcatcaatcaattcattattacgctcaaggatacttcgattctgtctattattggtattctggaattgacgcaaaccgggaagattatcattgcccgcaacatggaagggttcaagatttggaccatggttgcgctgatttatctgattatcatcaccgtgctgacatggcttagcaactgggtacaacgacgcatggaggtctaggccggctacgtaaaataatgtgacaaatgtaaggaaagctaacatcaacgctggacagcaactatttagttccgctagcataggatagtaagtttaaaaatcgaactagtgcgaggagatgagctgcgcttggccgcatacttaaacaagtaggtggcagaaccagactcgggcagcaatgtactgagtgacggtggttggcgcacaaccagttatttttaaactggcgcatgcaataacggcctaatgggctggtaatcattagaaagcgtggtgtttgggttgaagcggaaatggctgctaagtctgctagtcgccttacctttaatgctcggggcattaatccccggcaagacggtggcggcagcacagaaaacatatacgattggaacggatgtcacttttgcaccgtttgaatttgccaatcaggataacaagtatgtcgggattgaccttgatttgattaaggccattgccaaagaggaaggattcaaggtcgaaatcaaaccgctggggttcaatgcagcggtgcaggcgcttgaagcaaaacagattgacggtgtgattgccggtatgtccatcacaccagaacgtaagcaaaagtttttgatgagtgatccgtactataaatccggcgtagtcatggccgttgccaagaagagtaagatcaagtcgttaaaagatttacgcggcaaacgcgttgccatcaagaccggaacggattcggccgattatgccaatagcattaaacaaaaatacggctttacgaccgtcacttttgatgactcgaacaacatgtatcaggatgtcattacgggtaattcggcggcgtgttttgaagatcagccagtcatgcaatacggtatcaataacggcatggcactgaagcttgtcggtaaaccggcacgtgaaggttcttacgggtttgcagcttctaagaataatcaggcattgatcagcaagtttaataccggcctcaagaagctgcgggccaatgggcaatacgataagatcatcgagcactaccttggcaatggcagtgccgaatcgcaaaagaccgccgctggcaacagtcagaccactgatcggtcatttatcggcttactgaaagccaactggtcgaccttgatggatggcctgcgtgagaccatggtcttgaccattgtcgccattttctttgctactttggtcggcattttgattggcttcttaggggtcattccaaataagttgtgccaaggcatcgcaacgacatttatttatattttccgcggactgccgttgatggttctggcactcttcatttataccggggtgccaagtctcatcggatcaaaagtaccggcattcatcgccgggattgtaaccttgaccctaaacgaaggggcgtacacggcggcgtttgttaaaggcggcatccaagccgtcgatcccggacagatggaagcggcgcgcagtttagggttgccttttgggaaagcgatgcgcaaagtgattctgccacaagggattaagatcatgatcccgagtttcatcaaccagtttattattaccttgaaggatacgtctattctgtccatcatcggcttacttgaactgacgcaaaccgggaaaatcatcattgcccggaacatggaagggttcaagatttggacaatggtcgcgttgatttacttaattatcattaccctattaacctggctgagtaactgggttcagaagaaggtgaaagcatgagtcagtatcgagttgaaatgaaaaatgtccacaagagcttcggcgataacgatgtggtcaaaggcgttaatttaaacgttgcaaacaatgaagttgttgtcatgatcggggcgtctggtgccgggaaaagtaccgttttgcggatgatcaatggtcttgaaacggtgacaagcggcgagatcttgattgacggtgaagacattgcccataaaggaacgaatatcaataaagttcgcgaaaaaatcggcatggtcttccagcattttaacctgttcccgaacatgtcggtcatgggtaatattacgttggctccgattgaactaggcattgccagcaaagaagaagcaacccaacaagctaaggagatgcttgaagtggttggcttgaccgataaggcagatgcgatgccggcacagctttccggtggccaacaacagcgggtggcaattgcccgggcattggccatgcatccggatattatgctgttcgatgagccgaccagtgctttggatccggaaatggttggcgatgtcttgggcgttatgcgccgactcgctaaacaagggatgacgatggtgatcgttacccacgaaatgggctttgctaaagaagttgccgatcgggtggtcttctttgacaacggtacaatccttgaacaagggacaccgacagacattttcgagcatccaaaagaggagcgtactaagagtttcttgaataaggttttgaatgcctgaggttgttcaaatttaagcatagatatactaaaaaatcggttcgggatatgatcctgaaccgatttttgagtggtattttcgaaattgctgccacatttcccgggaaataatccggatgcttagcaggaaatgggagtctcatgccaaaccgtggtctaagatgcggtccatgacggcggcgacactgccagcatagcccatgccgaacttatcaaggtgaaccatcagataatacagccggtagaattcgagcctgaactgatagccgggatcaaggggataaacttcctgatagcccgtgtagaagtcttgggtgaagccgccgaaaacggtcgtcacgccgatatcgagttcgcggtcgccatacaaagcggccggatcaattaacgccggctgaccgtctgctgtgaacatatagttgccaccccataagtcgccgtgcaataaggacgcctcactatgatgctgattaagcgttttttgaatgatggttcgaacctgttgaaaagttgtctgatcggctgcttgccacaagcctttttgacgcagatgggcggagagcttgtcgaggcgttgatggatgaataagtcagcccaggagtcggtccagtcattggcaaacgaaacgctggtgccggcatatggatagtcgaagccaaagcggccagagggttcgtggtgttgatgtaagtgggcaaccaagtgaccgagatcacgctgcgagccactgccgctggtcaggaagctaagcagcaggtagccatcaccttcaatggtgtcattagcaatcacccgtggagccagaatgtctgcctgctcaaatgcctctaacccggcaatttcgccggcatagaaactggccggatagcctggttgaacgagtagaaaataaggcttttccgcggtgtcaacccgatatgcttgattgacatcgcctccgcctactggtgtgatcgcggtaatgtgttgcaacggtaattgcttagtccaagctgctgttagcatacaacttctcctttcatggatgcgttttggcatcggatttccctttgataaacaatgtcagctacttgtcaccttcagcttaaaacacttttagcgatcatgccaatcgcttagtcgttgagcaggtgatagacgaaacgttgcgggtcatctaagaagttacgcagaaaagtgatatggtcgatttgatcatagtgaacgggtgccaaggtgtcgcctaatgcgagcagttgggcgtcaggataagccatcaggataggggaatgggtactgatgataaactgtgcaccatttgcgactgcggcatgaatcagggctaacaggctgagctgattttccggcgtcaagggggattctggctcgtctaataaatataaagcgttggcatgcaatcgcgcccgaaataaggccagaaacgcccggccgtgggataaagtgtctaaatctacctgatacaaatgtttgattgcgcttagggtattgagatagggcaggcgctccaaactttgcggggcgagatgttcaagttgcgtttgcgcgtacttgatgtggccgcgggtggcgcgaatgaatgaaatgaaatcatcggcgcgaaagaaaaagccggctttggtccgatatgtccacgttagcttaaggtggcgggccaaggcgcggctattgtcatactcagggtcgtcttccaaagcggcaccactcatgaggatggcattgtaattggcagcgatcgcattgagcaacgttgattttccactaccattgtcgccggttaaaatggtcaccggacgggtcaggattaattcgtgaaaatcggcttgccaaggcaaattaaacgggtaatcgctgtgatgacgtggtggtgcgtattcgatcttggtgagtagcaaaggaaagactcctgacttttaaagtgactgattaaggcaatggttggtaccagctcatgatgcgtttagctaaatcggctttcatgtaccgtgaactgacactctgatcgttattgcctttgcggatgtgaatttccagatgtgccatttttcgcggtttcatccacagcgactgtttgaaactcatggcttgaatatccttcttgcgcacaaaataacgttgctttgtccaagtctcacccacttggatgacgagctgatcgggggcggcgatgccgattgccgcattagccccggcgtattggccttgtaaagccacgatgacaagccacagcaagccaaccggcaagagccacagccaccagctaagatgcagccataaggtactggctaagatagccggcaagacgatcaggccaaaattacctagcacgatgtttcgcacatagtaccagcgatgacgagtcggtatcggctctaattcaggggcggcggttggtaaccagctaatgaatgtttgcatggtcgttaacgcctgtcgttgcctgatgacgggcatcagaaccaaatcatcgtttttttcatcatcggcagcacttgacgccagaagtgcctgaaccgtgctgagatgaaaccactgccgtaacacgctttgtttgaagcgtacggcttggacgcgggacagttgggcactgacggtgttggtctggaaaaagccacgactggtttgcaattcgttaccggttcgatcaagcgtgaagtggtaatagcgctgcaaaatgttcaggtaagaaatggcaaagccgagcactaagacgataaccgttaaggcaataatcagataaatggccagtccggttagcgcgtgttcagcttgcttataccagctatcgggaaggtattcttgaaccttttgtaccagccagagaatcccggtaatgatgggaatgaacccaagcgaagtgagcgcatattgattgagatcatgtgcattgattttgtaggcagcgtctggggtttttgccgccggtgttacttcggtttgcgcgccctcagtcgtagggtcactagccgaagttgttggtgtatcagtaagcccttgccgataacgattgatggcatccgctaccgttgtcggaacggcggccagcatcccttcagccttcttggattccttcccggccgtttcaatagagacctgctccaggccaagcggttttaaaaagaaccactgccggcgctgaacggtttgaatacggccgtatgggatatgattgatttttcgaatgaagactccgctattgatggtcaagccgtctggtgcgactaagtaggtaaagcgcaaataatgcacgatggaccaaagcagcgttaataccaaaatgcctaataccagactgatccagaacaaaaattcttggggcttcatatcattcttcaagattgaaaagccgccactgacaaatagcggccaccaagcaataaatgacatcagccaatgaatggggatggcaatgggtgcaaggcgtttgggtttgtcattcattgcgcgcctcctgggccagttgtagaatctgatttcgcagttgatctgcaaccggtcgagtaacaccgtcgataacatgtgccgtgctggccgtttcgatattgacttgctgaagttcctgccattgcagcagcggcccggcttctaaggtcacattttgaatgcgggcaatcggaatggcttcatttttttgaaagaagaagcctttttgtaggaaaacggctgtgggggtaatgttgtaccgccagaaacggtagcgatagggcactaaagcaagacggaaaatcaattgtaaaatggcaaatcccatggcgcctattgctaaccacagcgaccaatgccaaaaatgccacgccgcaatcaaaagtaagccggcaattagaatgaccaaagcccagattgcggcactggcacgccagattcgttgaatggtggccggtaaagcctgtcctgtttgttccatgttgttcgtcgcctccgttttcgtcaggatagcagaaaattggtctaaacgaaaccgtttacgcttcaaaagtgttggaataacggaggttttttaacgaatgccagtcgaaaccgggtgcactcttgtgagataataaccacaacgcgttcgccaaccataacgcgttcaccggcgcaggaatctgcgtgtaaggacctttgtcgcaatggccaaaaccgggccatcacgcccaagaccgcttacactccgatccctaagcgcgccggttcacgctccataacgcgttcaccggcgcaggaatctgcatgtaaggacctttgtcgcaatggccaaaaccgggccatcacgcccaaggccacttacactccgatccctaagcgcgccggttcacgctcaccatataaaaaaatcctcctgtcattggtagcatacgttgcttaccgacaggcggacttgtaaggatgaagcaccgtgatgttaaactaagggcgcataaacgaattcgattaactgttttttcatggcgatgttgataccggtgatgggctgctcgagaatcttttgatattcttcgagaacatcataaggcagtggcgtcagtaaattgagatcatcaatcacgtcactgacgcggtcggtggtgctgagatcaacgaaaatgtcgatcttgttgaggcagtcgattaataagtctgtcatgccagcatcaggcttgccactttgatcggtgacgacaacctgtaaatgattgactggtgcatgatcgatctggacaaattttaaagccgaataaatattcattggcacacctcgtcttagctagctaaataacattggaactcgttactccaattctaggcatttcgataaacttttacaagccagttgtatcctggcgacaatggattcataatggggaaaacagggattatgatactaaaaggggcggaatatggagcttaatatatctgcacaggcagcagctcggttggcgccgctattacgcgcggatcgggtcttgattttagatttaaatgatggcatcggcccttattcacggtcgtatcacgatccaacgcaagctaaattcagtctgctgatattgccgcgccgtaatgtgccagatgtatttgatgcgcaccttgattccccagtcggaccggtgttgattaagagttacacctgtggactttttgataccaagaccgagttgaccgttaatggggatgaatttactttgttgcgcggaaaaccgcaacttaatccaaaggtgccgctaaaattcgtctagaatggtcgctttctgttatgatagccccagcggtgacaacatgtatcgtcgttagaagggggcattatcgatggatcggacagcattaaaagatcaagctaaggcggagttgaatcccaatttcagctattatttacttattagtttaccggcgttgcttttgacagggttggcggcaattgtcccgtttccaacgattcgagaagcacatcacggtgaatggcaaatactggttaaaagtcgcctcgatacagtcacaggtagtcatatgaatgaatacttgaatatgtggcaatcaattctcatctttgtctcgcttttaggattactcttgatgattggcgtcggctttgccatgatagatgggctgcgcggccgctcggatcatcattttggttggcggcagatgttcaaaatatttgaacgaggcgagtattttctaggcagcctgcttattggtttattgcagtgggtctgggtcttcctgtggacattgctactcattgttccgggaatcgtcaaagccttggcatattcgcaggcacagtggctttatcgtgatgccattgaccgcgggcaaccgattggctataccgaagcgattacccaaagccggcagctgatggacggttacaaatgggaatttttcgtcttgatcctgagttttctcggttggtggctgctcgaactgattacatttggcttagcggctatttgggtcatgccgtatcgaaccatgacttttgcgaatttctatctcaagttgaaggacaaacaagcagcataacacagcataacttggtaaaagaaagcgggattgattctcggctttctttttttgtgagcgcgagccggcgcggttagggaccggagtgtaagtggccttggtcgtgatggcccggtcttggccattgcgaccaaggtccttacatgcaggtccctgcgccggggagcgcgttatagaaagtgagcgtgagccggcgcgattagaagtcggagtgtaagcggccttaagcgtgatggccgggctttggccattgcgcttaaggtccttacacgcagacttttgcgccggggagcgcgttatgggcgtaaaccagaacataagcggcctcagacgtgatgatcgggatttgaccattgcgaccaaggtccttacacgtagatttctgcgctggcgaacgcgttatgataaaacaaaatcccctagctgccgtgagtattggtatactgtatgtggtttctagatgattggtagccggacggggccggtaagttagcgggcctgtccatgacacaacgcaatgatggagggaatcatgatgaagagacgttggttacttggtattgcgaccggattgatggcattggcgctgaccgcttgcagcagcggtggcagttcaacatccaaaagctctaagggtccggttaccattacgttttggcatcgcatgaccggtaattacaacaaggcactggaaagttatatcaagactttcaacagtagccagaagcagtataaagttgttgcaacttcgcaaggttcatatgataatctgcaaaagaaatacttagcatcggccaaatccagaacgttaccgacgattgggcaagtgacggacacgattattccggaatacgttcatgacgggatgttggtcaatattgatcagcaggtgaaggatcagttttcttctgctgaattgaagtcaatttatcccgggatcgccaccaacctgaaataccatggcagctattatcagattccgtttgctactggcactcggatcatgttttacaataaagacattttagacaagtatcatctcagtgtacctaagacttggtcagaactcgaaaagatcgggcagcagctcaaaggtgacggtatcaccggcgttgcctttaataagagctatgactttgagtttgaaacgctggcttatgatgccggcaaccgcctgattacccctaagtatcaggccaagattgatacgccggccagcattaaagcgatgacggcgattaccagcatgttgcaagacaagacggccgtcaccgctgggttggataactactttaatgtgccatttgtccaaggcaagatttttgccggcttcggttccagtgccacgattcagcagattgcaagtactgcacctaaagacatgcactggggcaccgcggttatgccgagttttgaaggcaaagccagttcggttctaggcaacaacggcatttccgtattcaaaggggcgtcggcagcacagattaaaggtgccgttaagtttatgaaattcttgatgagtaagaagattcagacgcaatgggccaaggcgagcgggtacgtgccagttgtttccaccgcaacaaagtcgagtgcttatcaggcatatctgaaggccaacccaccatatcaagctgcgatcaaggcttatgacgacgccttttcatcaacgccattcattggctataacacctatcgtaataaccttctggatgctgttgaccagaccgtttccaagaaggcggccccgaagacggttttgacccagttacaaaagcaggcagaaaccattttgaaagataatcgttaacgaaccgatagaaagtaggccgtgtccatgacaacattcaaacggatattaaaacgcaccctgatttatacgctgctggtcttgggcctagccgtactgatgacgtttggctatgtcggctatcaagacgttacggctggaaaagggtacctggcgctgcgttatcttgttttgacggcagagtcagtcgtgggcggcttttttctatttttaatcgttgtcagtttagacacatggcgggaacatcgggaaaagaagcgtgagcagacggcttcaaaatcaaataagccggtcaaacggtgaatctgtcacggttatacttgaatactaaccggcaccaaaaacgcgaccccggaaattcagggtcgcgtttttgtatgcctttttcaattaagaactgcgcgcacttgaatcatcatacccgattcaaataacgcttcaggaattccttggtcgcttgttgttgcggattgccgaagatttgatccggtgtgccggattcggcaatgacgccattattcatgaagacgacgcgatcggaaacttcgcgcgcgaaggccatttcgtgggtcacgatgatcatcgtcagcccggtatgcgccaaggccgtcatggtgtttaacacatcatcgaccatttccggatcaagcgcactggttggctcatcaaacaagaggacttcaggatccatcgcctcggcccgcgcaatcgccacccgctgttcctgccccccggaaagctgatccggtttagcagcaacaaacgggtccatgccgacttgtttcaacaattccaaggcatgcgttttggcggcagcagcgtcacgcttcaaaacggtttgctgcggcaccataacattttgcaagacggtcatgttgttgaacaggttgaaactctgaaacaccatcccaaccttggcacgataggtactcagcttgacatcatctcccagaatacttttgccatgaaaaagtatgtcgccgccagtgggagtttccaaaagattaatgttccgcagcagcgttgatttaccggatccgctacgaccaataatggaaacgacttcgcccgcttgaacatcaagattgatatcggttagaacttcgtggttaccaaaagcctttttaaggttcttgacttggattaaaggttcgtttgccatcagttagtcctcctttgccgtgctgattttgggtgtttcgacctgcatttgattgttcatcacattgtaatcttttggaccatcgagatgcttttcgatgagacggaataatcggctgatggtgaaggtcatgatgaggtagatgccactcacaatcagatacgtgtggaagaactggaagctttgtccggcaatcgtttcgccgctgaagaacagttcggaaaccgagatgacggataacactgaagtatccttaatgttaacgataaattcgttggtgaccgcgggcagggagttgcgtaccgcttgcggtagaatcaccttcatcatggtttgcagatgggtcatgccaagcgcattggctgcttcaaactgaccttcatcaacggagataataccgccacggataatttcggaaatataagcacccgtgttaattgagacgatcaataacgccgcggttgtccgatccatgttcagatgccaggcttgagccgcaccatagtacaaaaccgctgcctgaacgatcattggcgtaccacggaagacttcaatataaacggacagcagccagttgatcacggcccgtaacccacgctgacccagtttctttggctttggcgtggttcgaataataccgaccagcaaaccgatgataaagccaacaagtgtcccgaccaaagaaatcagcagcgtcatgccggtaccgcgcaatagcatgggaccatactgtttcataatcgccatgaaccagttgccgcttttttcggttgacggctgattatcaacggcttcgttcatcaaccgtgcccgttcttttgtagagatcgtagcaagcaactcattaatcttggccttattaggatcattttttcgcaggccgatcgctaagttagtatcactggcatcggttttaaaaccctgacccttggcaaaatggatatacatcagattcggattcgcacgttcggcagtaatcccttctggtacttcggaaacatagccatcaatcgtgccggattccaaggccacgcgcatggctggaaaatcgttcatcgccggttccttgacaacgcctttgatttgattaatcgcctgatagtgataggtgctcagttgggcagtaatcttggcgcctttgaaatcggcaatacttttggctttggcatatttactatctttgcggacgaccatcgtcaggttggaaatatagtacggattactgaaatcgatggttttgcgacgatctggcgttggcgacatgccggcaataatggcatcgattttgccagaagttaatgcaggcggcagaccatcccatgatgttttgaccaccacaaccttcttgtgcaacgccttggcaactttgcgggcaatttgaacatcgtacccgtttgcgtattcttggctgccttgaatcttaaccgcattgttggcactcgttgtttgcgtccagttgaacggtgcatagccggcctccattccgactttaaacgtgttgtcatcgctggcagcactgacaggtgttgcggcaaaactgccaagcaggaggctcaatgcgaaccctagcacgcctaaacgcgcaacccaatgttttctcataagtgacatttctcccttcttgtagtgggaaatagagctggaaccaaaaaatcgacctttattgataccgcaataaaggtcgattccatcgattttagtcatgaaccagaatcatagcgccccgaagcaaccagcttcgacagtccatgggttatgcgcccatggcccaatgcgaatcgtccgaatacgattcaacatttcggcggcggcacttacgactggttcaacatgactcggcactccccagttttcgttgcccaccgcaacctctatttcttggtggtgtatttaaatgtcaaaaacgagtgtagcggaacgggaacggaatgtcaatttttgtggagtaatcgtaatcgctaacttggtttttgtgcgatcagaagtttatttaagaaaagtttggacaaaaagaagtctccgcagtagaattaaatcgaacgtgtgttctgtttaattcgatgacagacgtgtcaccttaaaatttgtaaaagagatttttaaaatggcagatgaagcggtactagccgttcaaaaatggcttaataaaacgtatagcagtgtttctggtttcacgacagcgcccgagaacggacaaactggatggcccactatttatagtttgcggatggggctacaacatgaaattggtattagcgctattggtgaaggatttggcgatgcaaccaagacagcattagcttcggtggtaggcagtttgaagcccggttataagggcaatatcgcccagctcattcaaggcgccttctggtgtaaaggcatcaatcctggtagcgactttaatcaggacttttctgatgcaacagagcaagctttcaaaacactacagcagaatgcgggtattaccgcaaatggcgtagttacagttaatcttatggcggcattgttcgatatggctgcatttaccttggttactgggggatcggagaaggttcggtcaatgcagcaatatcttaatggacggttcagtaataacattggcattctaccttgcgatggcatctatcaacgtgacactaacacagctttgatttatgcattgcaaagagctgaagggatggctgctgatgttgcaaatggtatctatgggcagaagacaattgacaattgccctgttttatctgagggatcaacagatactgacgccgttcgcatcctacaatacggtctgttagtaaatggtttcacagacattccgactaatggccaattcaccagtgcagttggcgatgcagtggctgcctttagcacaatgatgaacctggaaccaaccacaggaagaatcgctggtaatcgggttattaagggcctattaactagcaatggtgatacaacacgcgattcaatcgcttgtgacacatctaagcaactgacgagttctgatgttgcattgttacgtaaatatggtttcagcattgtcgggcgatacctaaagggggcagtagggaatgcttttactcctaagaatttgactgcgtctgagattaaatcaattaccgatggcggtatgagcatttttccaatctatcaagatggcggcgccgacattaaatatttcaccgaaactcaaggtgtgcttgatgcaatgacggttgcttcaactgcacgagttcttggctttcctaatagcactattatctactttgcttgtgatgttgacattctggaaggcgatattgaggcaactgtggtcgcttatatgcggggtgtcaattcagggcttgccaaatcaggctttcgtgctggaatctatggcacgcgaaatgtttgtgcacatgtcttaaaagcgggatatgcggtgcgctgtttcgtatccgatatgtcaacgggctattcaggtaatttaggttatgcaatgccgttaaactggagcttcgatcaatttattgagtacagcattggtgacattccaattgatcaggttgcaacggatgtcaaaattagtgatccgggcacgaagacattcacgcctggtgccttaccggactcagcaaaagtagttgttgctaatgacttgatgaatggcttgattgacgatttggtaaatttctcagcaggcaaagattacatgtttccaatgccgagcccaggtgtaatcgctacttggtcagtagattttacggctgggaacggccctattggtattaaagatggcaaactggatagtgtagcattgcagaaaaaattcgagtcgaattttggaaacattaaagatgcaaccagttatcaagctgtaattgatcagtcgaaggtaatacaagtgggggcaaagatttcgcaagggtcaatcgactactcaattaaaacagaccaaattgggacagtagagttagatatcaccgtaaacgttatcaaagctaaaaagctttcaaatgttgatgtgaatattgcggttaactggaagatcaaatttatgcctatctattggcagaatcatcctgaggttaaggtcgccgagcgtccagtgttttcaacaggtttttccttagatttagctggaaatatgggaacaaactatctttcggcggcaacaagtttggtcgcgacagcggtgattgttggcggggcgcttattttagtgtttgcctaacaaaagataggttggtgtgatacgggaagttgaaagaggagaataatttactgaattgaaaaacatgaaaatgcaaaaaagcattgctagtagaaataataatccgactatgttggcctgatttcggcggatgcttgcacttggtttagcagaatcaaagaaatcacaaaattttagtttgtatttctgttgatgatacgccttaatttggcgtatcattttttgctgatcagttagctgggctaggatcaaactgatgattccaattaacatgaaacaaatggtaatggcaattaagcctagattaatttggtttgagaaattattcaggtttttgaaaaagagaaataagccaataaaatagcaaccaatccctataaacgtggtgaatttaaacgcttgtgataagcgggcaatttgatcatcttcggtttctaggaatctatacggattatggaggggatcaccaaatgctttcgtcaatagtctgtcatggagcttaaacttgtgccggataaagagtgaataaaaggcacagcaaaagcttgcgatgagaaacagtatggcataaataacccaactatatagtgaaaacatagaaacgtcactacctttcgagcgatatcaaaaaataacgggaagcaattttctgatggtaacaaagtctgcttttaccattcaaagagtcttttggagtatgtcaattgtcagcatctgtaactttaatgaagacaatgatttaaaattaagaacgtcagggaagcttaaaggccgaaccaaaatcaagagaatacaccaggcggacagtgtcaggaataatattgatccaaactaatactgtgaagaaatcctctagaaatgtctaaataacaagaatagattgccatactcaaaggaagtttgacagttcgtagcagtgaactcaattcaccgtgaaaaaattacccaacattttggtggatagttttaacgggatagaggctgcgttagatcaataaagaggcagaaaaaggaaactatcaagagggccgaactggtcattcccagagtaaacagtctcatgctaatcaaaggctgttttgatccgaagaaatccttaatcggagcagttagtgactctttcgctttaagatgttggtactccataatttggagtatcaacttttttttgctagtcgattgaagaagaatatcaaataccaacgttaaagacacagcacataaggcgaagggagcggttcttattaaaggattccggttaatgagttccaaaaaaattgaaagaaagagggccaagctaatgaggtaaccgagtccaataataaccagcatcattctttgcaaatacgccaatttgcctattttagaattattttgttctctgaatcgaaaataactatcatcggaacttttgaaagccttttttatactaatatgattaatcctaaactttttccttaagtatccagaataaactgaaagacagatactgagaaatagggggaaaatcgccattattaaccaatttactgaaaaggacaagagcatatcactcgctttcaagttggtcctcgagaagacaggggtgcggaagcaacactagcatgcagtggtgttgttgtcgatcataacacatcgtcactcaatacaagtactaagccagaaaaagtaagtgtaaatgcagagttaatgaaggttagggattgctagaagcataacagtcgcaaaaatagcgctccatagacaaactaggttgataatgcttaggctaaggatacgaaaaccgacagacggcgcttgactgtcaaaaaaactttgaatcggcatcgcgaaggttaccttatgttttatttgttgataatgctttatctgtaatgtcatttttttctgagcgatgacgttaaaaagaatccctagtccaacagtaaaggaagtcacaatgatggttggccaaggatcatcaattgaattattggaaatgacctctgtgatggtcataattaaaagaacgaatgtagcaatatcggtaagtataaaaagaagcagcgtcacctttgaccaagttattaactggcgtatcttagaattgctttgttttccaaattgaaagggattagttggtgaattactaaaggcctttttcagactgtacggattgtagtgaaacttacgacgcaaataaaacgtataaacggaaagactcccacttcctaagagtagcaaccagataaacggaaaccagttttctacaaggcccaaaattatcacacccctctacgcgatttcttaatgtaaatgagcacaagttgttgataaagtgaataacggtggtgctaatcatagcacgtatagcgttagttagaatgttagaggcgaagtattttaacttttctctatacatgaaggtgacagctggcaaggctgagacattgttaaccgataattaaaagttcaagttggcagagttaaggtgctagagttaaggtgctttattacaatgctatagcttctgctaaagccatgacgcatcgctgcgaagcttaaccaacatttgaagagtcatagccagagtttaagtctgggcagcaatcgcttttacatatatgcgactaagagcctgagcgaaagtagtaaaaaagttcccaacgctgaaacaaaagcttgtacgagccacctctttttggacttaaaaaggcttaccaaggttcctttctttgcataggagatagttgcaacaacattagcaacaaagaccacgatgcacataaagataattgcggaaaaagtccataatgtttcaccggtgatgaacaagctcataaaagcgctatacgggccggcaaatagacaagtctttatgaaacagtatgccaagggacgcatcttgagggcggggtttctggtgcttaaaaaagaaatccaggtttgcgattcgctcatggctattctccttcgttttattggtgtaaacggtgtcacacttgattaaaacatatcatcaggaagatacaagcaaaaagatattttgaaaaaatggcaaaacgtgttaaatttgtttaataaagttctcataaaagggtcgggtgctgatgacggaggaagctatcaaaatcggggcctatttacgtactttgcgtctcgaggaaaatgattcattagaagaaatagcggctgggatcacaacggccgctactttgtcacggtttgaacgcggcgagacacagcttagtgccgctgtggttttgaaactgttgactcgatttgaccaagacgtggcctcgattcagcaagggtatcgggcgctcaatcaggagaacttttttcaagaagtggaacgggcaacggtggccggcaagtcggcactgcaggcgttggcgcagaaacagtaccagctttggcggcaaacgggatttatcttttatcgcctgaatcagatcaatattttggcccataatgaattttccgatccgagctttcagaccaccacgaagatgaagcatgatgtgatcaagtatttaaagcggattcggcattggggcttgtatgaactggatctttttgcggctaccttgatgctttatgacagtgagcagttggttaatttggtgaccggaatggttttggacttgcctgatactaaaagtcatccggtgcgggatcagtatttgtgggctattttgacgaatagtattgccttgttgattcatcgccgtgagtttgcggatgcgacccgtctgtggcatattgcgatgaacttggcaataccgccggacgatctttattcgcggttgatgctgagttaccagcatcaactgctgatgtatcatcgtggtcagcatcgggcagccaaagccgagatcgaaaagttgttgacgacattggcgttattagattcgcctttttttgcgcaattgttgaccaaaagttggcagcggtttcttgaagaggaggtgcgttcgaattgacaattggcaaacagtttaagttgatgcgaaaggaacgtaaacttacgctaaaagaggccgctggcgatattttatcggtgtcaagtctgtcaaaatttgaaaatgacacgtctcagttggccgctgatcggtttttcctgttgctggatcgcttgaacttggattgggatacctttacccagccacagtccgataataagcggccgtttttacaccgttatttagtagctgttcgacacggggatgtgcagacgctggccggaatcttgcggcaattgccattagcgaacacgaatcagcggctgcttttgcacctgactctgcacaacctggcaccggagcgattttcgattctggctcgtgaacaaatgcaggcaaagacgttattgttaaaaacggcggcctggtcattgttattacgcttgattgctctgcagctagctgcggtggttcctttaagtgatttagcgcagttgacgcatgcattttcggttcaggtgcaaagcccgaataccccgcaagatcacttgaatctggctaaccggacttttttgaccgcaatgctgcgttatattgacgcgggacggcgaaaagaagcacaacagacactggccttcattagacaggcaacggttggtgatttaggggttgaatttcagattgcgtgcaccaaacgcttattgatgattgatgcccctgatcgccgagtttcgatgcgcggccaacaggaacttgacgcgttaattgccatgctgcagaagattgcaacgccggaatggacctcatcctggctgccggcgctggaagcactggcagaagcaaaacgctgtggcaaggatgcttaaagctgcgttatgaaacagtgtttagatcaagcgtgacgtgtcagtatcaaagtgagtgtttacagttgaaaaggacgtactgccgagaggatggcgagtgcgtcctttttggtgtgatattgtgttccacgtgaaacgttgtcaagaaaacggggcttttgggtgttaaccactgctcacagaaaaagtgcgctactttcaggatctgcaatgttttgatgaataaattttaataaataacgcaaccatcgttcctgccgcggttgatccaaaatgtgttccaaactaatggcttgctggcacaattcaaaaccggcagctgtttggccggcgacggcttgataccagccacgaaggaataaaagcagtgctgaattggctagatcattggcgtcatacaaaagccgttctgcagtggtaagtgcttttttggcatccggcagctggcgggcattgatgaagaccgtaaaggctgaaaagagggttttgacacgcaaagttccgatttgattgaacgcgcgatatttttcggagcgcttgatcgccagcggtaaaagattatggatcgtcttactaggcaaagcgaccatcagatgacgaaaccaatacagttcaaagtaattccagacttcaaccgtgtacaagtagctgaccacgggtttggcaagcgcttgcaactgggccatcgcatcttcaacatttgtaaatggcgatggctgttcaggcggcttaacccgatcaatcatggtcaagcgaaaaattcgaatggtgataaattcgaactgggtttggcgattgtgatcctgagcgtaacgttgctgccagattttctcttgcttaagtaaatagcgatagtcggccaatgttggttcttcagagctaaagcgatcctgaaaagcaagtaccgcttcaaaatcgcgatgaattaacgtgttgtacgtgaactccgaatccttgagcggcgggacaattccggcttgaagatcgcgaatgaaaagaaactcttccactgacatattgatacggaagagcaggtgactgagccgggaaaagctgatattggatttgccttgttcaaatttactaataaacgcaatggaattctgatcgtctgctacttgtgccaaggtttggtggtgattaagacgcaattggcgaaaaacggcgccatcagttggatcgattttttctaccatagtggaatttcacctcgatgttattctaagccgcctacactcaaagtacaaacaagttcatcacgcagtacaaaaaggagtgtggtcgtcatgcatgaatacatgaacaatcatggctatcgggccatcttaaacgccagtctattaagtggcattggtgatagcctatacaatatcgttttcattatctacgccgctacaatgccattcaaaagtttggcggttaccttagccgccatggcgacaagtttgccgacgatgctgtcaatgatcaccggcagtctcgctgatcggacgcaagccaaaacccgccatatggtagccgcgcggatcgggcagatgttgcttttctgtggtctggccgggatgatcgtgttgcctgcaagcctaccgttattcttagggttacttgccatcaacatcatatccgatacgttggggcaatatggtaacggtttaaccttgccaatcttgcaccgcttgattccggctaaggaactgaatacggcgattagttttcagagtgcaacagggacgaccgtgcaaatggtctttcaggcagtgggcgccagtctgattgttctgctggatcacaactatgcactgtttggggccatcaatgccgtgacttttttactggcagcggttgtcttgatccggcaaaataaacgactcaagcaagccgaaccgcctgttgcaacccacgttcatcaaccgatttttaaaaacatccgcaacgtgatccgatttctgacaacgaatcacttcttgttggcagtgattatctttgcgatgctggttaacacactgggctcatccgttgacggtttgatgtcagtcacgctggttcaacaaccgatgatgtggctgcgcaatttcgggacaactgttgcgatcatgaacattatcttttcagtgggactgattctgggggcgctatttgcaaaagacggcctgcagcggctgagcacctttaagctgttagggttgttgatggcggccatgatcggtttaagttgcagcttctttcttctgcggtcactttgggcagcgatgatctttagttttgcaaccgcctatcttatgggcaaaatcaatccacggctttcaacagtgatgatgcgactcgttccggagcggcagatggggacgacagccggggtcattaatctcgtcgcgctactcgggatgccagtgggacaagtggtattcttcacaattgccaatgtcgtgagcgccgcagttagctggatggtcatggcagggttatcacttatacagtgtttagcacttttggtgatgggtaaccgcattgccgatccgatatttaccgattttgaaagcgatccctctaaggcctagggaacctttgcgataattggtatctaccaattagaccgattttaaaaaaatcttttttgaagcgtacttgcaatgtatacgcttcttttttaggtttgtttttgagtgaaaatgcttgcatagctgtgcccgggacgtcatactaagctattgggaagccttgttttttaaattatttttgtttttagcagatattattttcgaggcaaccacaaatttttaggaggcgtaaaaatggtcggaatcattcttgctagtcacggccaattcgctgctggcatcaagcaatccggtcaaatgatcttcggtgagcaagaaaaagtcgaagctgtgaccttcatgcccgatgaaggaccagatgacttgcacaagcatctcgaagacgcgatcgctaagttcgacccagatgacgaagtattgtttttaatcgatctatggggcggatcaccgtttaaccaggcaaactcgatttacgaggagcacaaggataaatgggcgattgtgaccgggcttaacttgccgatgttgattgaagcatatggctcgcgactttcgatggattctgcacaagacatcgctgcgcatttgctcgatgccggacgtgacggaatcaagatcaagccggaagcactggataaagtgaagaaaccagctgctcaggctgctgcaccaagtacggctaatgctggtcaaccgggttcattccaatacgttttggcgcgggttgattcacgtttgctgcatggtcaggttgcaacgacctggaccaagacaacgaacccaacacggattatcgttgtttctgattcagttgccaaagacgaactgcggaagaacctgattaaggaagcagctccgtctggcgttaaggcgcatgttgtgccaattgatcagatgattaagctggccaaagatgataaacactttggcggccagcgcgcattgctattatttgaaacaccggaagacgcccttcgcgcaatcgaaggcggcgttccaatcaaggaactcaacattggttcaatgtcacattcagtgggtaaagttcaacctaacaaagtgctagcatttgatcagaaggatatcgataccttccataagctggctgatgatggtgtgaagtttgacgttcgcaaggtgccatctgatcatccggatgacatgaatgcaattttgaagaaagcacaagacgaactgaatgcgcagaagtaatttttgaaacggaggaagaagactcatgactttgaattttattcaaatcattctggtcctcatcgtgtcattccttgctggtatggaaggtattttggatgaattccacttccatcagccagttattgcgtgcacgttgatcggacttgtgaccggcaatctggccccatgtttggtactgggtggccaattacaaatgatcgctttaggctgggctaacattggcgcggccgttgcaccagatgctgcattggcctcagttgcatcagctattattctagttcttggcggtcagggtactaaaggtgttagttcagcgattgcgattgcggttccgctggcggttgccggtttgttgctgaccaccttagtacgtaccttggcaactgcgatcgttcatatcatggaccgtgctgctgaagaaggtagtttcggtaaaattgatttctggcaatgggtcgcgatctgcatgcagggcttgcggattgcgattcctgcaggcttaattcttgctgttggtgccggcccagtgcgggcattgcttgaacagatgcctgattggttaacgactggtcttggcattggcgggggcatggttgttgctgtcgggtacgctatggttattaacatgatggcgactcgtgaagtatggccattctttgcgattgggtttgtgctggcaacagttaaagaaattaccctgatcggccttggtgctatcggtatttcactggcactgatttacttggcattgtccaagcaaggcggcggctcaggtaatggcggttcgaatagtggtgccggtgatcctgtcggcgacattattgataattattgaaaaggaggttgacaaacatggctgaagaagttcatatcacaaaaggcgaccgaattaaggtttggtggcggtcaaccttccttcaaggttcttggaactacgaacgtatgcaaaatggtggctgggcttataccttaattccagcactgaagcgtttgtatcatactaaggaagatcgttccgctgctttgaagcggcacttggaattctttaacacccacccatatctggcttcaccgattctgggtgttacgatggcactggaagaagaacgtgctaatggtgccccaattgacgataaagccattcagggtgtcaaagtcgggatgatgggtccgctggctggtgtcggcgatccagtgttctggttcacggttaagccaattatcggtgcgttagccgcatccatggcgatggccggcaatctcttagggccaattttgtactttgttttatggaatgcgattcgtatggccttcctatggtacacgcaggaatttggctataaagcaggtagtaagattactgaagacttgtcaggtggcttgcttggtgaagttacgaagggtgccacaatccttggtatgtttatcctaggatcactggttaaccgctgggtatccgtcaagttcaccccggttgtttcaaatgttccaaaccaaaaaggtgcttacattgactggagttcattaccaagcggaaaagctggagttcaaaaggctttagaattacaatctcaaggcttgtcactgactaaaaacaaggttacgaccttacaggataacttggatagcttaattccaggtttgatgggcttactgcttaccttgttctgcatgtggttgctgaagaagaaagtttctccaatcattatcattcttggtctgttcgtcgtcggggttgtcttccacgtcatcggcttgatgtaagatcaaccaccaaaagtcgaaccaagacttcaaaagctcagacacaaagtctgggcttttgttttataatggagagcgtgagcaggagcgtttagcaatcggagtgtaagtggcctcaagtctaaatggctgggctttggccatttagacttgaggtccttacacgtagattgctgcgactgcgactgcgaacgcgttttggagggtaagtttaaacttcgccacaaacgcattttggcgaaagtctctccaaaaccaataaacccaacaagcaaggcacatcagcaagcacagtcaacttcagtttaaaaggatggcaaaaaatggttcaatcaatcaacaccaaatccgagttagtgattgaaggtacggcctttatgggaatgccggcctatggcaagatcatgatcggtgataaaggattcgaatttttcaatgaaaaaaacgtacgtgacttctatcagattccgtggaatgaagtggactgggtcattgcttccgtcatcttcaaaggtaagtggatcccgcgctttgccattaaaaccaaaaagaatgggacgtatacgtttgcagcgaaagatcctaagcgggttttacgtgccattcgggtgcacattcccgccgagcgaattgttaagtcgttaactttctggcaagtcgtaaagcgcgcctttacacgcaagaagtagcaacgatcccaggcgtataagacaaaaaacagctcacaggacttcttttttgaaggctgtgagctgttttttatggagcggtttattttcactgctggaaatcagcaagcgtcggttactttgttttgaagtttttgaacaactcattgatcgattcgtattctgcatcccgtagatcgacatcgagcgctttagcattactagcggcttgttctggcaggcgggcaccggggatgacaacggcaatgtcggggttcttcatgtaccaagcgagcataatctgcgcaattgttgcttggtgtgcatccgcaatgccgtcaacttcgcgaagtgcggctaaaatttctttgaattcatcggcagaaaagcgcttcttgaatttgtcagcatcatcaggcccatatttaccggttaacaagcccgaggcaagggggaagtatgggacaaagctgatctgatgctcttttagataagggaaaagcgtcgtttcggcatcgcggtggacaaggctgtaatgatcttccacgacatcaacttgatcgtcttggttggcttctttaatttgatcaagtgagaagttggaaaccccgatagcgcgaactttcccggccttacgcgcattggcaactgcattgaccgcctccgccttatcggttttgtcatccggaaaatgaatgtagaagatatcgagatagtcggttttaaggcgcaacaaggcgtcgtcaattgcctgcgttaagaacttaggatcgttattcggttttaaatcttgatggggatcttgcgcggctttggttgccaaaataatttttgcgcggtcatagccttggatggcctgaccgattaacgtttcggattggccaagaccgtacatataagccgtatcgagcatctcaataccatgatccagcgccgttttcacaaccgcaagtccgtcttcatcatgtagattcggaaaaaggttgtggccgccaactttattggtgcctaaaccaagtttgccggtgacgacatgactttttccaattgttgttgtgattgccattttgtggcctcctcttgttgtcattcaatgtcagtttaaggaatacgcattaatcgtgcaagcgctaccgatgatcactgggggcgaaaatactgtgtttggcgttaatgataagtccggcaccaaacatgaatagggtcaaccctactgtgatccataataacagattccatgagccggtggttgtttgaataaaaccataaagcacagggccaactgcagcaaagagataaccgagactttgcgcaaagccggatagactggctgtttcgtacgcatcggcggttttcttctggaagaagacgatacagatcgcaaaagccgccccggaagccacgcccattagtaaggagaagaccacattcaacccgaagttggcccccgggatgagcacgcccaaagcccctaatacaaaaccgagcataattccccaaacgctataggccatgccatgacgccgctctgcgataaacggaatcgacagggttgccggcatgccgctcaactgaaaaattgttgccaggttgcccgcagccagttgcgaaaaaccagccgcatgccaaagactaggaagccatgtcagtaatgagtaatagagaaaactttgtaagccgaaaaataaagcaatccaccaggctaatagcgaacgggacacgcgcacatttcgccgaccggtcgcggcctgattttttatcggtgccaggcgacgaaaggcaagggcccagaccactaagccggccacgccaactaaggagaaggcagccatggtgaacttcatatgaaattgttggttcaacagtcctgccagtccggttcccagcgatgcgactagccccatggtaacggtgtagaggctggttttggcgccaatcgactgcgggaactgatctttgatgatcgccggcagcaagacattgccgcctgaaatgccaaagccgatgagcagcgtaccgatcactaaggcgatgagactagggatgatccgcagtaagctgccaagtaataaaataatgagcgcaataagcaagctccactcattaccgcgccgatttcccattttggcgatgagtggcgatgctaatgcgaacatcaacagcggaatggtggtcaacatgccagccatcgaagccggtaaccccaaagtgcgttcaatggtgggtagcagcggcgggatcatggtaatcggcaggcgcagattcgcacccaccaaaagtatgccccatgtgagcaaagttgttgaatggttcttttccatgcgtctttttcctcctcaaaaatgtgcccagtgattttatgctatcacttttttcagtgaaggggaaaagatgccggggtgaagacggttcgtcagttcttcttgtgcgcctgccaaggtttgatggtgagcgcgatggcaatggcaccaaggagcgctaatccggccgcaacgagcatcgcaatctgtaagccgaccatgaaaaattccgggtggttggtgggataggtcgtgacccggcgcgctgccaagtgactcatggtgccaaataagaccgtggttgctaccgcggtgccgcttaccatgccgagattgcgggctaaggcgttaaaactgccggcaatgccaagttgcgcttttggcaccaccgacatgaccacgtcgccaatgggggattgaaacaagccgcttccgatgccgatcaaaagcgtgctgatgatatagatagttaacggggcgttgagtttgagcgtggcacccagcagactgccgattgcaatgagtagactacctaatagcgcgacagcaggaacctgccatttgtccgccagccatccgcctaatggagcaaagaagaccatcatcaacgggtacagcgacaacagcgccccagccgcacccggtgtgagcctgcgcgcgtcttcaaggtaaaacggcatcaagacggtactaaagaactgaaccatgaagatgaagaaaacagtcaaaacgccgagtgtaaagatgcggacgcgaaagatactcatgggtagtagcggggctgactgatgacgctcaaagccaagaaatgccattaagctgataaccgccaacgctaacgtggcaagaacgaggggatcaccaaaaccgctttgttgcgctaagttaagtccccagaacccgctggcaatggcggttgcttgcaacaccatgccgacgccgtcataagcgccgggttggggccgaccattgtccattgaccacaaggagatgcctagcgcgatcaaaccaatgggcacattaatcagaaaaatcatcggccagctaaagtgtgccagaataagtccgccaagactaggcccggcaaccccccccagtgcgacaaaggtgctcacgacgcccattgcccgaccgcgttccgccaaagcaaaggtggaagtcacgatgccataagtgttcgctaacgtcatcgccccacccagcgcctgcaccatgcggcccaacatcaaaaagttaaaacccagattaatccctgccattaaagagccaagcacaaaagtccctgtgccccatttgaaaatccggcgtttaccaatgcgatccccgagtttaccaaaaggcagcagcaaggcacttaaaacaatcagatataacgacacagtccattccatccggctagcggagacatgaaggttcttggccatcagcgggattgcaatgttaacgattgaaccgtcaagattcgtcataaacgcaaaaaagcccagcgcaatcagtaaccaccagcgtttagacgtggttgtaagatgttgcatatgaaatacctccgcgacccacccattatttatgtgggaacgatattttgactgatctggttagaacaaggcgtatgcgaaaagagaaatcggccttagagacatatttcgtctctaagaccgattcaacctgcaaatccttgtagcaccttaaactaagcgcccagattgatgaagtcgcctgattcaagcatcaatttaacaaagtccgggacggtctcggttcgattccagtcacgctgccactcgcaagctaactgggcattcgtggtcaactgggcaccggcttgttcgatgcggcgcaatgcagtttcgtgcgcaatcgttgatgtgccaccgactgcatcaacaacaggaaagacatggaagccttctgctaaagcatcaagggttggaaaagtcagacaggcttcggtccataaagctgccataaccagattcttgcggcccgttgctttgactgcttcaacaaagtcctgatcctgccacgcattaatcgatgttcgatcaatactcggcagatcaccaaggacttttttcagatcaggaatcgtgtccttattccgaccgcttttgacgttaacagttgaaaggatgatcggcactttgtagacttgagccaacttggccgtcatcaccacattttgaatgagcgtatggtgattcatcgagccaatcgactcaacttgggtcggttggtaatcaattaaaatcaaagcagaattttccggggttaacagctgatctgtcacgggatcgcgacgtggataacttgtcatgaaaaacactccttagtgggcgtcaactgcgaaaacgacagccaacaggtaggcgatttaaaccctcagcccaatatgctgttcggtccttacttgctagctgccgtaccagttaacgcagtctcatgaatgccaatacttaccaagaacatcattacgccatcattctagtccgaaacagacgaaagcagtaatattttgccctgaggaggttatacaacgtctttaaaccaaaattccgaagtgggctaaggtttcagtcggaatagcgcgcttgatcagagtttcgcttgttaagatcggccagtattcgactgacgacagtgtcttgtgattgatcagcctgaatcaagtgctcattggggacacccagatagtcatgcggtcgaaaccaccgatgcatagcctctgcgccaaaagcggctgctttcgggcggtgggcgtggcgtcggagagtttcgtcaaacgatagatcaaagtagtaaaccagactttgatcggcagtgttcatgagcgctttaagcatttggccatagcgagccgcacttaagataccctcaacaatcacgatttgttgatgagaaaacccaaaacgggcaatcagatcaatcaattcaatgttaggactattgggcttatccttctcggctaacatgtcgcgacgaacaacatcttgagaaattagcagcgagttagtcaaatgcttacgtaaggcctttgcggtggttgtttttccactacctgaattacctcggaggataataagttgtttcatcaatcgaagtaccccgtttcgccagcaataaaatgggccaatgcggcacgatgctgctgattaaaaagccgcggtgcctcgcttggcgcaaagtattgcaactgttcagtttcgtcgttatcggcactaagctcgccgcctaattgtttcacgagaaacaccggacaaagccattgcgcaacatcgccattgggataagtaagggtgaggtcaccatcaaccccgagcaaagaaacaaccttgaccgttaagttcgtttcttctttaaactcacgaatcatggtctgtgccggcgtttcaccatactcaatggtgccactgataagaccccattgacctttaaaatcgctacgttgctgaaacaaaacccgtcccgcttcgtcagtcaaaataccaataaccccagccataatcagtggcgtatggccaacttttgcacgaatctgtttaatataatctgccaagggaaaacctcctaaaaaaagtaagcgcgaaccgacgcggttagaaaccggagcataagtggccttggtcgtaatggcccggttttggccattacgaccaaggtccttatgtgcaggtttctgcgccggtgagcgcgttatgggcgtaaaccagaacataagcgggcataagcgagctgcccggttttggccattacgaccaaggtccttatgtgcaggtttctgcgccggtgagcgcgttatgggcataaaccggaacatgagcggccttaagcgtgacaaccgggttttggccattgcgcttaaggtccttacacgcaggtttctgcgccggtgagcgagcaccacctgcagcacccaaaacacaaatcaccaaacctagctacagcatacgccaaccagcctacaggttaaatatggtctaacaccagcaccaaataagtgtcatactaaaatttagattaacatagatacaacttggattatttcccgggcaataattgtggtatgttgttaacaaacataaaagaggagtgctgaggcatgacagtaacgctaaaacattttcaaaccgaggatcttgaaacgttgtggaaagttgccttttccgatcccgatgcagaatggcacaaatggaatggaccttactttaacgataaagttccgacactggaagagatgcaggagaatcaggctaatcaaacagggtaccaatgggtggcgaatccttttgtcaatggtatttgggtcgatggcattctggttggggatgtatctgcgcactacgaagatggcgacttgcaacggtggctggatttaggcattgtgatttacgatgaaacttattggagtaaaggtattggcaagcaggcattagatcagtggattgatcgtattttcggactcattgatttgccacatctggggatcacaacttggtccggcaacgaacgcatgatcggccttgccaagtctgtaggaatgaaacaagaagcccgcgtgcggcaggttcgctactatcaggatcggtattgggattccgtgaagtacggcatcttacgtgaggaatggcaagcacagcgtcaatcaaagtaaaataaagcaagcaaagaggcgacttcaagcgagtcgtctttttgcttgctttgaatttctggaggtatcgatatatcggaaattagacacaacaaataagcctttgcaggtgactacggtgtgttgtcaggcctctttttcggctaaccgtttgtacagtgcgacaatttctccggctaggtcgcggaaggtaatggcattcattaaatgatcctgactgtgaaccatgagcagggtgactttggcgtggtcaccttgcgcttcagccgtgagcatgccggtctggacgttatgcgcttcggtgaggaaatgatccgattcttttagtttatcgtcagccagcttgaaatcaccggccttagcagcgtgaatggcttcaaaggctgaacttttggcattgccgccattcatgatcaagcccataacggtttcaagattttggtcgtcttctggcattaggcttctgctcctttgctgtcatcaatggctttaagtgaagcttttaacactttttcaccgttcatcaatccgtagtcctgcatgttgatgacactaaccggaatatcgaggtcgcgtttgaactgactttcaagataacggacttgcgggcccaacattaagacatctggtttttcgctttcaagcttgttgtctgcatcagaggcagctgtagcaaaaatatgaaccgaaagtccatctttttcggcggccttttgcatccgcgttactaacatactggttgacataccagctgcacaaactaacatgatctttttttctgccataaaaatcggctccttttttaaaaaaatgtaatcgttttccgtttcatgtgctattataattcgtaggtacaaattttacaagcgctttcagaacattgtaccgtgctcattaacttgtcaggctgcggatcatgccgttagcgcgcaatggcaactgcccgtggctgataggtttgaaaataaatgaacactttaagtttggaggaggactttgatgtatcacgatattgccgaacaactcattcaagatattctggctggtcagtatccggttaagctaccgactgaacaggtgttgatggatcgttatcaagccagccgcaatacgattcggaaggcactggatgtggtatttgcccatgggttggttcgccgggttcaaggtagcgggtactatgtcattgatcattcggctcaatccgatgctgtcctcaatatgtcgataggctttgatcagacagccatggtgaaaggcggaccgctgacttccaaagtggttaagtttgcgcttatcccagcgacagcagccttggcgcaacgaggaaatgtcagccgcggcgatatggtctatcaagtcgtgcggttgcgctatttaaaagggcagttgtacgacttggaagaatcgtattttccgcaagcaattgtgccacatctttcagctgagattgcggcgggttcgatcttcacctatttgcgtaacacctatgccatggttggaagcacaacggaaaattatatccaatcgcgaccattaccagccgagtatgccgagttgatggcgatgtcggcacagactgatcacctgtgcttagacgggatcaactatctagctagtggcaaagtcttcaacttttcccgaacttattttgtttatccgggtctaacgttgtactaccatacgaccaatatcgatttgaaccggtagttaaaaccgaagttggttcaaatgaaatcattatgcgctggtgtgccaagaagcggccggcgtgcttaaaactcaaggagagtgtacaagatgaacggacttatcaattggctcaataaacatgttgtcccaatcgcagcgcgtatcggatcaatccggtggctggtggccttacgtgatgcttttattgcgatcatgccagccatgatggcaggggcggtttccaccgtgctgaacgctttgattcgggatattccgactcaatttggctggaccggtttcgttaactcaatgcagtggcttatcggcattaacgctgttgtctggaccggaaccttagctattcttggtttaatcttctcattcacgtttggctatcagctcgcggtgcagtacaaggttgaacctgtgacggcaggaatcgtcaccttgggcaccttcattatgagcttgccgcaaaacttcaccatgacgttgaaggccgggctggcaaaaggtgccgtaaaaacattgaccgatgccggaacggttgtttccggtaaagatgtcagcatgtggggattcttcaactttggcaagttcttcggggcgtatggtttcttcaccgttatgctgatgggcgcgattgccgcaactatttacatctggttgatgaagaaacatatcaccattaaaatgccggattcggttccaccggctgttgctaatgcgtttaccgggattgtaccggcggcggttgccttgtacggcgtgggtattatcaactatctgtttactcaatttggtacgaccgtgattgaatttatcgctaaagttttacaagaacctttgttaagtttgagtcaaggttatggttccgtgctgattatgacgattttggttcaagtcttctggttcttcggcatccacgggaccaatgtattaggaccggtgcttgatagtatttggttaacggcgcagttggcgaatatcaatgcctttcacaaaggccaagcactgccgtatctgtggactcgcaattcatttgacttatatgcgtggattggtggcgccggctcaactttgctgctgctgattgcgattctgatgttctcaaagcgcgatgatcagcgtgcagttgcaaagctgtcgattgcgccagggttcttcaatgtcaatgaaccggttatgtttgggatgccgattgtgcttgatcccatttacttcattccgtttattttggcgccggtagtgatggtttccattgcttatggcgcggtagtgagtggcttggtttcaccgatcaagaatcagattgtatggtcgatgccgccatttttaaatgctttagttgcaaccatggactggcgagcagctgtgttacaggcggtgaatatgatcatcggcttcttaatctatgtaccatttgttaaggcggccaatcgaattaaaccagcccagcttgctgattaacggttataggaaaaattgttttagaaaggcggttttcagttgaaaattcagatgacactcaaggttccggcggcgttcatgtatgggcaactgattcgctcggctcaggcggacatcaaggcgcacactgggcgagaagttctggtgggcagtcttgatgggttcacgtaccagaagaagtgggcgaatggcatgacggggaagctgacgattacgcatgccattgccaatcagcgttacgcgtatgaactagacactgaccgcgatcattatcatgtggattatcaattacgcgatctcggtgatcagcagatgcagctggattacactgaaatcattgaaggcaaaaccgcaaaaggcaaagctaataatcgcacggccgggtttttattaaactggcaacgcaaacatcgctttaagaagatgtcacggcaaatggcagcacagtattttaactaagaagggattcttgtgaaatgaaacgattaggtatctcgctttatccggatcaaagcagtttcgaggagaacaaagcctatcttgatctggcacatcggtatggttacacccgcattttcacctcactcttgcaactgctgggagaagatggtgaagatctgttggctaagtttcgccagacaatcgattatgccaatcagcttgggtttaagacgatcgttgatattaatccggcgttgttcaaggagctgaagattagctatgacgatctgagtttttttgaaacgcttcatgtttggggactgcgactggatgaaggcttcaccggcgcagaagaagcgcggatgacccgcaatccatatggcttaaaaatcgaattgaatatgagccatggaaccaattatcttgcaagcatcatggcttatgaccctaaccgcgataacctaatcggctgtcataacttctatccgcaggcgttcacaggtctgagtgaggctatctttaccgaatactcccagcagtaccgagagtatggattgcataccgccgcatttgtgtcgtcatccagcggtaaaatcgggccttggccgctgcatgatgggttgccgacaatggagtctgatcgccatcgcaacattgccagtcaaacaacgcatttgtgtctgaccggcttgattgatgatgtgatcatcggtaatgcttttgcgactgaagcggaacttaaagccgttgccgatacttttctggcgccatacccgatcttgcatgccgaaatgttggcaagtatcacgccgcttgaagaaaaaatagcatttgccgcgccgcatttatatcgtggggatgcatcggcgtatttactgcgggatacccagcctcgtatcacgtatagcacggccagtattcccgcccacgaccatggccaacccttcaaacgcggcgatattgtggtcgtcaacgatgcgtatggccgctataaaggcgagttccaaatcgttttgacaccatttagcgatgatggccagcggaatttaattggccatgttgcggctgatgacgcagatctgttaacgctaatcaaaccgtggtcaacgtttagtttgcaaaaacgcacaagataatgattgaagtcgttgtgtccttgttgattcaaatgtcgtaaggaaagcaaaatcggtcttagagcgtcttgccactctaagaccgattttattttgtcgtgatgcacaacttcaaatatcgttgctttacttacatggaaggtgccgcgttttcatgatcggcaatgattttctcatcgcgggtaacttctttcaaaacgttgctaaccgctgtgccgccaagggaggtacggcgattgaccgctgcttttgaggtgagttctgcgtaaacgtctgcttggatttgcggtgcggcttcctgaagttcgcttaatggcatttcctgaagcgccgtgccggttttgatgccttttagtaccagctcgccgacaattgcgtgggcttggcggaaaggaacgccctttgttgccaagtagtctgccagctcggttgcattgctgaagtcatgcgttgtggcggcggccatgcgctgttcatgcaccgtgagatcactaagcatgccggtgaaaatatgcaaggagccaaggatcgtgttataagcatcaaaaatcggttccttatcctcttgcatatccttgttgtacgccagcggaatggccttcatggtggtgagcagccccatcagcgcaccatacacgcgcccggttttgccccgaatcagctcggcaaaatccgggtttttcttttgaggcataatcgagctgccagtggaaaagtcatcaccgagttcgatgtaattaaactcaaatgttgaccacaaaatcaattcttcggccatgcgacttaaatgctgcatcaaaatcgcactgttactgagaaattccagtgcaaagtcgcgatctgatacggcgtccagactgttgtgatacagctgatcgaagcctaattcttgggccaccagttcgcgatcaatcgggaaagtcgtgccagccagtgcagccgcgcctaatggcaagatgtcggtgtgcttttgggtaaagtcgaaacgttcccagtcgcgctggaacatttcgaaatacgccaacaaataatggccataggtgattggctgggcgtgctgcatgtgggtgtaaccaggcatgatcgtggcggcgtgggcttttgcctgaccaacgagaacggtttgcaggttcgtcaaggcctctttaatagcaggtaggcgatgtttgagccatagatggaggtcggtcgctacctgatcattgcgggaacgagccgtgtgcagcttgccggcgactggcccgatttcggctgtcagtaaggcttccatgttgagatgaatatcttcattttcaacggtaaaatgcaatttgcctgctgccagttcttttttcaggtgatgtaagccagcggtgatcgtgtcggcgtcggcttgcgggatgatgccggttttgcctagcattttgacatgggctagcgatccttcaagatcctctttggccatttgttgatcaaaaccgatggatgcgccgaatgcatcaacccagtgcgcggctttttcggtgaaccggccgccccatagcttatcagtcatgttgcttttcctcggagtgaacatggttgacttgctcaaagacagtggtcggcagcgtccaaagcttgatgaagcccgcggccgcttcctgatcaaaggaatcggcactggtgtaggttgccaggtcttcatcgtaaagtgagttgtgagtggactgacgcgcgactgggacggcactgcctttgtaaagcttcatcttgacggtaccgttgacgacggcttgggttttatcgatgaaagccatcaaagcatcgaataaaggtgagatccattgggcttcgtaaatcatattcgtcaatttattctcaatggttggcttgaagtgttggacatcgcgttcgagcgtgaggttttccagatcgtggtgcgccgtcatgaggactgctgcagccggtgcttcgtagacttcacgcgatttaatgccaacgagacgattttcgattttatcaatccgaccaatgccatttgcaccggcgatttgattaagctgtttgatcatggcagccagcggcatggggttgccatttaatgctactggaaccccttgttgaaaggtcagatcaagaaaagtcggcttgtccggcgctgcttcaggggcaacggtcatcccccatgcgtcatccggcgcctgattccaaggattttcgagaattccggcttcgttagcacggccccagagattggcgtcgattgagtacggtgactttttgccgattgggactggcacatgatgttctttggcgtaatcaatttcttcttctcgtgaccagtgaaaatcacgaatcggtgcttcgattttcatttcgggatccaaggcgtgaattgcggcttcaaagcgaacctgatcgttgcctttacccgtcgaaccgtgcgcaattgcggtggcattttgggcgtgggcgattttaaccagatgctcgatgattaatgggcgtgacaacgctgatactaacggatagtcgccttcgtataacgcattggccttgatgaccggcgcaacatagtgatcggcgaactcgtcttgggcgtcaacgacaatcgaatcaatggcaccgactttaagtgctttttgttgaatcgcgtcaaaatccgcatccggttgaccgacattcaagacgaccgcaatcacttcataacccttgtccatgagccaaggaatcgcaacggatgtatcaagaccacctgagtaagctagtacaattttttctgtcatgaaaatatatcctcctttaataaatgtgagcgcgttatggcaggcgtgctaaagcaaatgttaattaaaccgtttttcaatcaggcgtagtagtcgtgatagggtaaacgtcatgatgaagtaaagaatggcgacaacgaccagtggcaggaatggcttgaacgaggccccttgcacaacggtaccttcaaacattaattcggtggcaccgataacggacaagaccgaactttccttaatatcggtgacgaactcattgcctaatgccggccagatgttcttcatcgcttgtggcaaaatgacgtatcgcattgcctggctttggtgcagacccaaagaccgagccgcctcggtttgaccgacagggacggaattgatcccgccacgaatgatttctgcaacgtatgcgccggagttgatggccatggcgatcgcgccggcaacaaacgcgctgagatctaaaccgagaatctgcgtaccgaagaagacaatgaatgcttgaaccaacaacggcgtgccccgaataaactcgatgtagatgttagccaccactttagccagccaattgcgactgagtttcatcaaggcaagcagcgtgccgatgatagttccgaataagactgttaagaccgcgaagaccaaagtataaatagcgccgcggataaagtagttaccgtacttagcccagaagccttgatcctgatcctgtagtttgtaggcggcttgcagataactcttgtatttggcacctttaaccttgctgatcgtcttattgacttgttttaacaaggcaggcgattgcttgctgacggcgatggcggttggggctttgtcagtcgcaaaatgcgggtcaatcacggttaaactcggtgtccgggcaacataggagtcggcaatggtactagccaaaaccccggcatccaatttgttgtacgaaatttgtgcaaccacatcatttgctttatccaggctcgtgacttttgcaccgggcagttgagtcttggcaagctgttcctgcgtcgtttgcttttgtgcccctactcgttttccggaaaagtcggcaatcgatttatacttggctttatcggccttgcgaatgaccatgacttgcgtttcatacaggtaaggcgttgaaaagttaacctctttttcccgttcaggtgttttggacataccggagacgatcaaatcaatcttgccggtttttaaagccccgatcagcgccgtgaagttcatttctttgatttgtagtttcacgcccatgtccttagcgatttgcttggacatggaaatatctgcgccgacgattgtgtcagcaccgttaatcgtggcgtggaactccaatggggcgtagtcggcggacagaccaacgactaaatagccgcgtttttgaatcgccgctaagtctttgctggcagctgccgttggaaccggctgataactggtgaagccgacgatcatagcgatcagcgcaatgatcgcgaccgcccaatgtttgattccccgcatatagttcactcctcattaatgattatggattgaatatatactcattggagtgaatatgcaagtaaaatgttaaatatacaaaaataattcattttaatcgaccgcttgcagtccggccagaaacggtctgataaggtgccaaagcttgtggttgtcgcgaatatatgagttgtggttttcgccggggagaatatgcaattcggcattttgaatcgaactggcaatcgtaaaagtttctttacgtgtaatcaagtcgcggctgcccgctagcactaaggttggcacggtgatcctatgcagcatttgcggggtgatttgcggttcatggagcatcatggctaacttaggagacggccgatgaccagcggcaatacgaaaaagaatgcgcgaataccagcgtaaaccttgaggcgtcagattcgccccggcaacaatcaaagcgccgacttgttcgggatgccgaattgccagcagcaaagcaataatgccaccatcagaaaagccgagtatgatcggccgggctaactccaattcagtgattaaagctgaaacgtcggacgtcattgcatcataactaagccggtccgtagccgaactttgaccgtgatcacgactgtccaaggcaatcacagtataatgcggggcgagatacgtgattaagtcggcgaagagtgtatgatcctcaccgttgccatgtagcaatataatcgccggtccgtggccgcttttttgatagtagagcttcagatgatcgtggtggaaaaacataaaataacctccaaaaattcatgcgtggggtgttaacttacggtaagtagcggcgggaagggtaccttgtttcgggatctgggacggaaagtaagagctggcggagcggggggctgcatctatcaccgcggagtcggatcgaagcagcggaagtcacttaaagcgtagaccgaggaagggatgacactttcctaaacgcgctcgcagtcgcagcaatctacgtgtaaggacctcaagcctaaatggccaaagcccagccatttaggcttaaggccgcttacactccgattgctaaccgctcctgctcgcgctcttgctttaaaaccgttatactatagaagtgtatcttaaaccaaggagggccgatgatggcgaaaaaaatcttggtcgttgacgatgagaagcctatctctgatatcgtcaagtttaatttggataaagaaggctatgatgtcgtcactgcatatgatggcgaagaagccttgaagaaagtcgaatcagaatcacctgatttgattttacttgatttgatgttaccgaaaattgatgggcttgaagttgcccgacaaattcgtaaagaacatgacacgccgattattatgctgacggcgaaggattccgaaattgataaagtgttaggactggagcttggggcagatgattatgttaccaagccgttttccaatcgagaacttgttgcgcgggtgaaagctaacttgcgccgtacctcatcagccaatgctgccggcagtgaggaagacgaagccaatcgtgaattggaagttggcgatttaacgattcatccggacgcatatacggtatccaaacgcggtgagaatatcgaattaacccaccgcgagtttgaattgctgcattaccttgcccgccacttgggacaggttatgacccgcgaacatctgctacagacagtttggggctatgactactttggcgatgtccggactgtggatgtgacggttcgccgcctccgcgaaaagatcgaagacaatccgtcccatcctgagtggttggtgacccgacgcggcgtaggctattatttgcgaaatcctgacgctgaataattaggagcaccactgttgaataaaaagattcgcttctttcagtcaattcactttaaaatcgcgatcgtctttattcttttgctggtcgtgacactggaaatgatcggggcttattttgttaagaccttagagcagcaaaacattgaacagttcaagacgagtgttaacgtggacagctatattcaagataagctggccgcggatttgttgcgcaccgataccgacaatgccaatgacgatattaaaagcaccttgagtcaggcagatattgccaattcggctgatctacaagtgattgacgcaaaaggaacgattcgcggtgacagtgatattaatgcccagactaatgttggccaaaagtcagctaattccaacattaaaaacacgttgtactctggccaacaatacgaaggatatgaatatcgggagcgtacagggtcgacttattacaaagttgtgccgattaagaatccgaacgcaaccggcgacaataattcggtcattggcgcaattgccatttcagcatcaatggagcaagcctacgatagtattaataaaatcgttggtatttttctgatttccagtttagtcgctggcttattgggtacgttactttccattgtcattagtcgcgcgattacccggccgattgacgaaatgaaaaaacaggcgattcggatggctcgtggtgactattccggccaggttcgaatttacgggcaggatgaacttgggcagcttgcagtcgccgtcaataatctaagcgtgcgtgttgaagaagcccaagaagcctccgaagcggaacggcgccggttggatagcgtgttggcgcatatgaccgatggcgtgattgctactgatcgtcgcggtaatgtcatcattattaatcagaccgcgttgagtttcctcaataccaagaatgaggatgttattggtgtttcgattttgaagttactcaatatcgccaaggattataccttgcgtgacttacttgagcaccagactgaattgttgttggatttttcggagcagcttgatcatgatctgattttgcgggttgattttagcttgatccaacgcgaaaccggctttatttcgggactggtcgcggttttgcatgacgtaacggagcagcaaaagattgatcgcgatcgtaaggaatttgtttccaatgtgtcacatgaattgcgcacaccgttgacttcagtgcgcagttatattgaagcgttaagtgatggtgcgtggaaagatcctaagctggcaccgcagtttctaaatgttacgcaagaggaaactgaccggatgattcgaatgattaacgacttgctgagtctgtcgcgtttagattccggtaccagtaagttcaaccttgaaaccgtcaatttaaatgagttcttcaactatgtgttggatcggtttgacatgatgctcaagacggataacgaacacaccggtgaggcgcggactgcacaaccgttgccacagccggatggccaaaagaagcgttattcgattaagcgggaaattacccacgaagatctttgggttgaaatcgatacagacaagttcatgcaagtgatcgataacatcatgaataacgcaattaagtatagtccggatggcggcgtaatcaccgcgcgcctattccagacgcatgaccacgtgattttgtccatcagcgatcaagggttaggaattccgcgtcaggatctgggtaaaattttcgatcgcttctatcgcgttgataaggcacgctcccgcaaacaaggcggaaccggtctaggcttggcgatttcaaaagaagtcgttgaagccttacatggccgcatttgggtcgattcacaagaaggccgtggcagcacattctatatctcactgccatacgaaccgattaccgatggaggagatgactgggatgaagcttagtagttggattttgcgcgtgagtctgatcgccatggttattttaagcctcgtctttacgtcattgatttggcgaaatccatcgcggctggagcgccgaagtacatcgaacgtgcaggtaacaaccgaaaatgatccgaatgttaaaaaaatggaaggcaacgtttacctgcctaaccaagtttattacacgcatcgtggtcaaaagcagctgctatttaaagccaatgccaatatcggccatgaagttcaacaagcaatggcggattggcatatgacgcaggttaaagcggtgggcaaagtctcgccggctaattatgaaacttaccttgaacaagatggcaacttgcaacttatctatcaagacgtcatgagttttaaacagtttgaacagtggttttttagcaagcaagatcaaatcaaagcctctgattttcattttaatcgggttttggtgaacttagacggtgcggttaaaaaactgaccttaataaacgatgccacgcgcagggtttacgaagccaagttagccaacgtctcacaggatcagctccaaaagcttgtgacgactcaggttacccgcgcttttccgattgaagaaaagcggttaggcaatcacgaagttgcgttctttacgcagccaatcaaactgccgccatatgcttatctgatggatcaacaaagtgccaattattatgtctccctgctaatgccatcgaaaaccgccagcaatgtcgatgcacgtgaaattggtgatatcacgctttatactgcgggttcaactcgacgaatgaccgctgattcgggaactggtgcgattgaatttgaaaactatacggcaacatttcctgacagtggcttaactaatttcctgcacgcaaccttcaaaggacttagcgatttacagatgacaaacctggctagtatgcggtattttcaatatgatgccagccgtggtgaagtggtttataaaacctatgcgcaagggttcccgatctttaatgtggatcaaaaaggcgacgttactgttcggtatacgcagacgtcacaggagattaatttctctaataccaatctgacagtgccgattcctacaaatcaaccggcacaaaccttaccggcaactgctaccgtggtgaatcagttagtggctgcgggctatcgtgccagtcagattacggatatcctgattggttaccagtggaccggtagcagcaatgatcagcaagtggtcgatttgcagccgacttattatgttgagatgaaaggcgaatatcgggattatcaaagctggctgaatcatagtagcgatgcgtctgccaatgccgctagtggccagactgcgacgccgagcaatgatgatagtagtgcgagcgaatctgagccaacgcaataacggatctttaactaactgacaagctaataaactgcttgctgagggaggcgattttgtggattttcgacggattgaatggatctttctagttgtgtttgtcggcctgaatattttcctgggaattagctattttcaggcgcagcaggttgacttggcaacgattaaaagtggcgatgcggcaaccatcacggacattacgcgcgatcaaattaagctgccacgtttaagcaaaaagacacccaaaggcgattatcttgcaagtcaagccaactcagcattaaccgcggcacacacgaacctggtgaagcagcaggtttccattagcgaaggcgattatcaggaattgcaggccaatctggatgtgcccataacgttaaagaagaatcaggaactgcgccagatgaagacttttgttaaaaacaatgtctaccatggcaaggagtatgagtatgcaccggcgctctctaatgacgaacgcgtggtgtttgcccagcatccccaagccggactgatttacgatcggcgtgcggcagtgacattgcatgtatccgataatcgtctggttagttatacacagacttatctgaccaaattaaacattttgcgggatcatttaagcttgatgagtgaacaggatgctgtcattgctttatatcgtgacaatgatatccctaataattcggcgattgtgtccacacagttggcttatagttacctgcttgatgcaaaaggcagtacggtttatgtcccggcttggtacattggcgtcaagaatcgttcgaccggaaatgtcacggtaaaacgtgtcaatgcgatcactcgaacagttatgaaaaaccgtaatgacagttaagtggtagaatggacggcagtgagagccgattgcttagatcaggcagttgactaaatggtaaaaagtttggagatggtgatcgtgggcgaagattttgggatgcgtgtcagtgtccttgccagcagcagctcaggtaacgcaacctatattgaaacgcctggtcacaaggtgttagtggatgccggtttgtcaggcaagaaaatagaagcactgatgaagagcatcggtcgagatctaaccgatgttgacagtgtttttatcacgcatgaacatagcgatcatgtgcgtggtgtaggcgtgttggcgcgacgttatccgcagctcaacgtttatgcgaatgccaagacgtttgcagctttaccaaaaagtgtgggcaaaatccctgaagcacagctgcggttgtttgatatggggacaactttgacgttaggtgacttggatgtggaaagttttggcgtttcgcatgatgctgccgcgcctcagttttaccaatttcatcatgacggcaaggccttcactatcctaaccgacacgggctacgtttcagatcgggttgccgggacgattcgcgatgccgatgcgtatgtgatggaatgcaatcacgaccttgaaatgttgcggacgggtccgtatccgtggccgttgaagcaacggattttaagcgatcaagggcacctgtccaatgaggatggtgcggatgccttgatggatgtcatcggtttgcggacgaagcggatttatctggggcatttatcaccgcataacaacaataagccactggcgcatttaaccgtggcgtcgttgttggcacagcaaggtctggcggtggatcatgactttcatatttatgacactgacccggcagttgccgacccgttgtttgttgtgtgaagcggtttgaaagcagttttagcagtgtggaaaagcggacgacttagatggaagcatgtaagctggccggtttttttgtgggttggggaggatgcgcgtggcagtttgcgctcgttgtaacgcgtttactggtgtgggagtcggagtgtaagggccttggtcgcaatgggtaagctcgggtcattacgtccgaggccactaatgttctgatttacgcccataacgcgctcaccggcgcagggatctgcgtgtaaggacctcagtcgcaatgaccaagcctgggtcatcacgcctgaggccacttacactccgatccctaaacgcgccggttcgcgctcacgaaaaaataccgatgttgttcatagtttcgtcaaaatcgtcacttacaataatctttgtaaacagggtgagttagaatgcccgtaaggaggaaaccgttatggataacggaagtcataactttcaggagacgccacaggatcagaagccgcaacggtcggcggaaaaaccgaagaagaatggtttgaagcagactgcaattgttgctgttgtggctgccttgattggtggcggtgttggtggtggtactgcctattgggcgatcaaccatacgacaagccttggcgtgaccgacacctctggtaaagccggaacgaccaagatttccaatgtttcagtcaatcaaagcagtgcttcagagcaggcttttgcaaaggttaaaggcgcagtcgtctcagttgttaacatgcaaaaggctgaaagtaacagcgatgggctggatacttttggcgggcttgaaggcatttttggccaggataaccaaaataacagtagttcgagcagtagttcatcaagtcttgaagaggccagcgaaggttctggtgttatttatcaaaagaaagatggcaaggcttatattgtcaccaataaccatgtggtgagcggttcggataagcttgaagttattttgagcgatggaaccaaactgacagccagtttagtcggaaccgattcaacgtctgacttggcggttttgacaattgatggcagtaaggttaacacagttgccagctttggcgactctagcaagattgaagccgggcaaactgtcttggcaatcgggtcgccgctgggctcacaatatgctaccagtgtgacgcaagggattgtcagtgcgaagagtcgtaccgttgatgtgaccgatagcagtggtaacaccaccggacaggcaacggttattcaaacggatgccgcgatcaactcagggaactcaggtggcccgttgatcaatctgtcaggtcaggttatcggaattaattcaatgaagctatccggaagctcgagcagcagttctgaaggagcaacgattgaagggatgggcttcgcgattccaagtgatgaagtcgtttcgatcatcaatcaactggtcgaaaatggtaaagttgttcggccagcgctaggcattgaagtgcgcgacttgtccaccgtttctgctagtcagcaaaaatccgttttgaagctacctgaaagtgttaccggtggggtcgttgtcggcggctttaccagtggtagcagtgctaaggcggcaggattgaaacagtatgatgtcatcactgcgctggatggtgtcagcgtctccaataccgctgcgctacacacgcaactgtataagcataaagtcggcgataccgtcaaactgaccttgtatcgtaaaggtgagcagcaaaccgtttctataaaactttcacagacaacaagtgatttgaagaattaaatgatgagagcctcgattaaaagattcgtcttttgatcgaggctcttttgctctttcagcgaaattagtcgaaagcggtttcttcagaatttcacgaaagttttagcgctaatctgtggaaaagttcaagtaaaagatttgtcaagagtgggtaacttttgcgtaaaaagatgccctagcctgtggataactctgtggatactgttcataactaagatttccgggtgtgagtaagttgtccaccaaactggggataacttgtggataaacttttttgacttgtgacaaaacgtttgttcccggctgctggagcgggattaagcggctgaactttgtgaaatcgaacaattaaaaactgtggatgaacgttgtcgaaaaattttttacttgaattttttgaatcgtctatttagtgtcaatggacatacttaatactatattttgggcctttagttttgaacatgtggataaccggtgtggacaacctgttgtttgctgcgaaaaacttaacatttgacttcggttgcggaagtggttacgatgaaataggtaaaagaattgtgcacaatgtatttgaaaggatggtccgtcatgaaaatcacgattaaaccagctgcagtgacgtacttgaacgagcacgttgcaaaggatcaacatttgtttctggcattagatgatggctcaagtaagtattcgaaactaggcggctcctgtgctattggcaataagtaccaaattgttgtgaccaatcaggacgaccaagactatgcactgccactggaaaatgatgcgggcttgaagctgaccacaggcgatccggaaaccgattatttcggaagcggcctgacgcttgattttaaaaatgcttcgttagccttgcgtgatgatagtggtattttagacggtgccgttacccttaatcaggtaacttcaacgccgcaaaacgatgacaaacgccgtgaggaaatgaaatcgctaggcggcaagatttgttaatgtacgatcataatccgctgaacctgtaaaacgacaaacaatcaaaatagcagaaaattcaaattagcactctaacatgacgagtgctaatttttgtgttatactaaagatgttcggaagaggaagtcgtaaccttcaaaatgaaaggaagttttcgatgatggctaatgatcttatgcggcggaatgattggttgaatgatccattcttcaatgatttgggacggcatatttttgacagctttacgccaactcgtggggttgacaacagtcgcctgctgaaaacggatattcaggaaaatgacgagtcatatgttgtgaaggttgatgtgcctggaatcgagaagcaaaatatcaatttaagctatgaccatgatgttctcagcattgcagttaaacatgaggaacaggctgatcattcagacaaggaaggcaatatgctaatgtctgaacgcagctatggccgcatgagccgcagctatcggttgccaagcgttgatgaaggtaagattagtgctaaagtcagtgatggcgttttgaccattgatttaccaaagatggcagctgagcagcaggaagggcatcagattacgatcgattgaatcggatctgtttgtctagtatgaataccttgaggagccggatcgggaaactgatccggctctttttcgagcgtgagcaggggcgcttagcaacaactagctaccggtcattcgatcctgacgaagaaagtaacagcagtagcagcttcttcagagcagatgaggtcactgaaaacaggaaataagttcaaattaatgattcgtttcgctgtaaaagcgtataatagaaggtaaacatttaggataaccgaaaagagaattgtctaggtgaaggcctagaaaacagctccgagctaacacttgccatccttatcgtttactgagttagcctagactgaattatatcggttacaggatttgaacgtccagattatattcgttctaaaaagggttgcgtttttaaattgtaatggttataattggggtacttaggaaaagggagtggcaacaatgaagaagaactggcagcttatgatggtgcttgttgtgagtgctgtggcgctggtctttgcgttcatattaaaacagccattgattgctcagggactgattacagtcatggggtcaattattgctttgattatgttcggcggcatggtcaagaccattcgttcaggtaatttcggggttgatttgttagcaattacggcggtagtcgccactttggcagtcagtcagtattgggcagcgatgattgttttgctgatgctgactggtggggacgccttggaaagttatgctgcgacaaaagccagcagtgaactgaagcagttattagaaaacgcaccaacgacagctcatcggttggttgatggccacgttgaagatgttgacgttgatgccgttcaagtgggcgagacgattttggttaagcctcaagaagttgttccagtcgatggtacggttttggaaggcgagagtttggtggatgaagccagtttgaccggtgaatccaaaccagttgccaaaaacgcaggtagtgacatcatgtctgggacgatcaacggggattcggcattaaccgttaaagttacgcagcgagcagaagacagtcaatatcagggaatcattaaacttgttaaggaatccgaagctcgtccggctcatttcgtccggatggcagaccggtatgcggtaccatttacgttagttgcttatgtcattgccggcttgggttgggtcttatctggcgacccggttcggtttgcacaggtactggttgtcgcatcgccttgtccattgattctggcggcaccgattgccatggtttcgggtatgagtcgcaatagccgtaacgggattattgtgaagtcggggaccacccttgaaaaattgagtgacgctcggactttcgcttttgataaaaccggaaccgtcacccgtggtattttgaaagtcgcgacagttttaccgcaggccggtttttcccaagatgagcttttgaatctagctgccagtgcagaaggccaatcgacccatatcttggcgcgctcgttgacagacgcagtgccagcagcagatcggctgccggcaagcgaagtcagtgaagcaactagtttcggtgtttatgcaaccgttgacgggcataaggttaaagtcggcaaggctgagttcgccggtgcaaaagagactttggatacaacggcggtttatgtcaatgtcgatggccaatatgccggtgccattaccttttccgaccaaattcggcctgaagcaaaagaaaccatgaccaaattgcacgaattaaacgatgccaacttgatcatgatctctggtgaccaacaatccattgccgataaggtcgctcgagaagtcggtattgaccaagtgtatgctgagcaattgccgcagcaaaagattgaagtgctggacaatgtgcctaaggatgatcgtcccgttgtcatggtgggtgacggggtcaacgatgcaccatcgctggcgattgccgatgttgggattgccatgggtgcacatggcgcaacggctgccagtgaatcagcagacgcggtggtgttacgcgatgatctagcaaaagtggcagcagcaaccttgattgccaaagaaaccatggtcattgccaagcagtcagtgctgatcgggattgcgatttgtaccggattgatgctcattgccagcttcggcgtgattccaacgattattggcgccatgttgcaagaagtcgtcgatacggtcaccattttatacgcgctgcgggcacgtaatggcttgcatcggcaggcgttggttgatccggttcgcgcagaagcacgtgcttaattaacaatttaagatcaagagatttcagggtccaatcagatacgcgcgatataagcgcatctgattgaacctttttttgtacataggatgttaaacagtgaacaacagtaacgagtgcaatggttgcagaaactagtttattggaagcggttactgcaagcgctacaatctttttgtaattaaggttttaatatatcagttcacaaaagtttcaagacacctcatgacaacgggtgttcaagcaattattgaaagcagaagtttaagtaagttacatgaaagaaggagttgtgtatgtcaaaagacacctttgttatttctagaaaaacggatgttcataccgataatatggcaaatccggttttaaaaaacgctgtggatattttacaaagagatattcaaaaagcaaccactggcgaggcagatgcgaatcaaattactttggtattgaaaaaagatgccgatcaaaaagttcctgatacgttcacgatgcattatgttagcccacggaaagttgaaattgttgcagcaacgacccgtggcttgatgtatggtgccttagctgtttctcgtgaagtgcttggaattgatgacttctggtactttatggatacgcctattaagaagcaatcgacagttagttggaccgacttcagtcaacatttacccgatttccagacaaagtatcgtggttggttcgttaacgatgaattgctggttgcagcttggcaggatcacgattccaaagattacgtttgggatcgcatctacgaaaccttacttcgggttggcggtaatcttgtcgttccggggaccgataaagaaagccgttatcatcgtaatggagctcgtgacatgggtcttatcatcgcccatcaccacgctgaaccacttggatcggaaatgtttgcccgtgtttatcctacccttgaagcttcttacttgaaatatcctgaactctttaaaaagctttggcgcgatagcattttagaacagcgtgggcatgaagtggtttatggattagggttccggggtcagggcgatcgaccgttttggttggatgatgcgtcacatcagtggactgatgaggaaaaagcgaaagtcattaatgataccatcaaacttcaatacgatatggttcaagaacttgatccaggtgcgcaatgctcagttagcatttacggtgaattgacgggtttgttcaataaaggcttgcttaaattgccacaagacgtgattgagatctgggctgacaatggctatggcaagatggtctctcggcggcaatgggatgatgatccgcgttcaccagttttgaccattcctaataaggcacaccgcgctcggggtatctactatcatgtcaccttccattatttacaggcatccagtttcctgacattattgccaaacagtccgcattttgtggctgaagagcttgaaaaagttcgcaaagctaagatggatactttggaattaatcaacgtcggcaatgttaaaccgcatatcttatttattcgcgaagttgcccgttcatggcgccgagactatcaggtacatagtgaagaagcgatcattaaggactatgtatcacattactattccgaagctcaaaaagaaattacaacgatctacgaagattatttcaaggcacccatccagtatggcccacacgatgaccaaaaagccggcgatgagttcgctacttatctaatccggaaagttgtcaaagcttggatgggtcattacccacaacttgaagaaatgaaatggttgacaggcgatgtttcactcgatgatcagcttaccaaggttacagagttgattgatacaaaatacgcggaatgggatcgcctgtatcgccgagccgttcaagtttacgcagatattatgggtcaacaaccgcagcggcttttctataacgacatgttgttgggaattgctgtccacgcatgttcactccatgccttacgtgctagcattcaggcctaccgtcattatcagcaggcagaaattgtccatgccttccttggtgcagatgaggctgtgcgtgccaatgatgaaattatccgtttgcggcgggacaatccatcaccaaaatgggtggactttttccataatgatgcctattcaaacatcgaattgaatgcaatcaagttacggcgcttgcgttcttatctgcgcgtcttaggcgacgggtcagatgaggatgtatgggaacgtaaatatctgatggagccagcagatgcccgggttatgttactttctaacacccacttggcactttcggatgatcaaattgctaagaagttacgtgaacaactcattgacgaaaagtagttaattgacaagtaagttctcggcatccacattttgccgttaactgtacaaactttataaaagaggaaaaaaacaatgcaaaataaaaaaggcgttgtccacgacggttgggacgaatacgcttctaagagtatttaccatgctcgtggtaagaagatcggaattggccgatcattaggattcggtgtcttttcaatgttcagtatttccatgcaaggtttggttggtgcgtggttgctgttcttctacaccacattttgtggcttgtcagctggtcaaggtgcgactatcttcctgattggccgggttgccgatgcaattgcttcactggtcatgggcaatatctctgataatatttacaagtataagatcggccggatgtttggccgtcgccacatcttcattttggcagctgcaccatctgtcctgtttgcaatcactttatgggttgccgggatgagttactggtactatctgatcacctacgtcatcacgactgtcttgatgtcagtgttacagattccttgggaaacactgccaaatgaaatgaccaaggattacaacgaacggacgaccctgtcaacaacgcggatggtgattgccggtttgggtaacatgttagctcaatttgtgccagcccaactgttccgcttctatccgaaaacgtccccgatgccatatctgattatgcagatcatgttctcagttgtcactttcttcttgattctgattacctataagacaacatgggaacacttcgtaaccaagaatgaagctaagaagttagcagctcaagcgcttgaagataacggcggtaagaagagttcactgaagtcagaactacgcaactacttctctaccttcaagattaagagtttccgtacgcacatgggaatttatctgagttcttacttcgcttcgattctatggtccaccacatttgtttactacattgtcttcgtacttggtaaatcaacaagtgtatccggtatgttgcaatcgttaagtattgtatctgtaccagttaccattttagctggttacattgtgactaagatttcaccacgttccttgtacctgtttggctattccttgattttaatcagtgctattgactgggtcttcattggtttaactaagccagccggcattatgatctggctgattgttggcacgttgctttatgaaattggtttgtacatcctttactttgttccgtggaatgtctttccgttcattcctgatgtggataccttggttactggtaagaaccgtgctggcttgtttgcgtcagtcatggtcttcatcaaccagatcagtcaaggcctggcctcagttgttgctggatacctgcttgatgtttccggtttccgccagtccacaagcggtgcggttagccagcctgcaagtgccacaaatatgattctgtttatcgtttctggcggcgtgggcattatgatcctgatcgcgatgttctttgcgagccggttccacctcagtaagaagacctttaatgtcttagccgctgagttaacccgtttacaaaaaggcggcagcatgaaggacgttaagcctgataccaaacgcgtttgtgaacaattgacaggggtaccatacgattcaattgaattctggcgcagaaacgatcagaagactagcacacctgctgacacgtcaactaaataagcgtttgtcagtcacaaatacctaatttaaggaggtgatgctaccccgaaaaagccattcttttcacgcttatgaattcgcttagatcatcataaatgcctagcaacgtctactcccagggttgctaggtttttttgaatagtcatagttgatagtcggaacaaacttaaaagaacggcaagattgtgttcgatttaaaaaagttaaaaagaacgtgattattaaaaaatcgattctgacagtagtatttaagcaactttcatactgtctggatcgatttttgcttagctgcagagtaatcaaacgttgacagaccttgaaccaaagcgacaccggctttgtcacgaacgtaattgatggacaactgtgcgaaattgccctggtgtcaagttttcctggcgtttaaatgcacgaatcatataagtttcggagttaaatcctgcttgtaaagcgacttgcaataatggtagatcaggttgttcgatcagcaattgttttgccttaataatccgatagatcgttagaagacgccgcggtgttgtttgatataactcatgaaaagtttgcaacatatattgcacactataatttgtcatttccgcaagctggtcattggttaggtcttcttcaaaatgctgctgtaataaagttagagtctgttcagctagtttttgcttggtaggatcagcctttaaacgtgcggtataaggttttagcttggttaagaaatcttggatgatagatgaggcatgttcgtcttggtaatgatgttcatgacgatggcgcatttgggtatggataaaacccaacacttctgagccaaggactggaaagaagattgaatttgaagtgtgaatacccgggatcattgcgtcaatgatcgtaccgccaaaactaagataactggtctgccaaagggatgtaaccgggtgataagcgtaactagtgtgaagattaatgaggatgccttgacccggtcgcaaatgaatttgttggtcgccaatggtcagctccccttcgccaatgtcactttgcagccattggtaataagcactgccttcaggtcttgccactgctgattgcgtccagtgatggcccattttatgaatcataaatgcctgtttactagcgtggtaggtcacagcggctttagtatctttatcagtggggttatcaatactgtaaccgctgatcgttacatgattaccgtcactcccatagcgtcgacgcgacttatcataccagtcaccgtgaatgcccattgcttcaatcaatagttgataatggtcgggttgctcagtgggtgaacggaaacagaccgtctcctcggtcaggatactgtaaaagtctgtataaacttgagatctgatatgcccttctttatcacgaagcgtcattttagcaaaaccgccttggggactggtctgtccggtgatcgtaatattggtgccataaaaagaaagggttacgctagcatcacttgtctggccagtccatgccaaggaattaaaagtcatcggttgggcatcttgttcataccaatcccatcttggccaataatgaggaattgataactcagtaccgttgaccgttaatggtaaccagacatgggtgctgttgttcaggtaagggtaagtgtggcgatcacctaaatataaaggaaccgttccctttgcagtcgtgatgagtgtgacaaaagcggtttgcgagttgtaagtcaatgttcctgatgggcaaaatgggccgtgtggtgtccaaggcccgtttaaacggtcagcggtaaaataaatattatcgttatgatcccagctggttttttgtgatgccagaaagaaataatgatcgttgaagtgaaacattgcaggagcctcggtgccaggagcaatattactaatgactttagcttcagctgtttttccatcagcagctaggcgatagatgtcaccttcatgcgttaacagataattagtaccatcatcgtctgtaaaactaccgatatgccacatgcggattgtttggttctcataacgtagcgggccttgaaactcaaacgtatcggttaaatgatcggctgtagcatacgccacaaccggatcaaatgtacgttcatcatcggtgtgcatcagcatgatatactgcccggttttggcttgaatcactttgacacggtcaccaattcgatgcggacctaaaagaccagacggctgaggagaaagtgcgagaccggtatctttccaatgttctaagtcggttgacacgtaccgtgagaatccggcaaaggtaattgaatcaggttgatgatattcaccgaataaataatagttaccattttcttgaatcaaacagccgccagaagcattaacgacttgttgatgctgatcataccagggaacgccattgaaaatgcttggcacgatactacctcctcgtcttagctgaagcgcgatccttacattggcgaacgcgttattcagaatctaaacatccgaaatcataacaaatttaattgctatcttaagcatacgggaaaaatagtataaataaaacaacagaaccattaatccctcgtcagtactgataattgatagatccagacaaaagaaaaatgccgtcatccaagtcagatgacagcatttttatgaaaacgaatgatcaattaatttgcttgactagaagcttgattggcattggaacttggtgaagaagcagcacgactggaactgcttgaagtaccggtactgctactttcatcgctaccgctacttgaggcactactgctgctagcttgactgccgctatcaccgtttggcccccaagtccactggtaagagccatcactcatggtgactgacttgacggtcatgtcgtcaacagatttgccttgaaccttaatagcggcgacagcatcatcgtaagttttgtaaaggccgccactaagcacggttgtcaggggttcaatgctacccgttgaagcaggggttgatgatgactggccttgatcatcagaagctgaagtgctgctgccagccgggttacttgaggacggctggcttgattcagatggagtttggctggagctgctagatggcgtcttttgacttgaagctgcagctgttgttcctacgccactagctggttcgacaccactagcagacgtttgctggtccgtctgtttgctctggctgcttgcactgttttggcccatcgcaatgtttgagtcgttactttcttgggaatttctcgctacttgaactaggggaagaacgtttttggcaaaatcctgattctcaacattttcgacggcattgacggcaagatcaatgctgtcgctgctgaggtttgcctttggatgttgcatattctgatcttggtataatttttgaatttgggcaatggctagcgacttcttgtaaagctgattgacttgttgttggtagtcagccgcaaattcaggtttggtattcgcgattgctttgtaagctgcgttggcacgggaaccgtcttcagcagtctgagccagattaccgttttgtgtttttacggtttcttcaatcgtcagcatatgactggcagcgtcagcgtcctgtttatctttgaggacaactttcttctgatcgcgatcatccacattctgagctaattgctcaagcttggattgcgtagatgtcactgcattcttagataggtttttggctggaaaggcgcgtttcgtggatgtgtatagttggttagtttgttccgttgccgcttggacggcatgttgtgtaaatgaggtatcgatcgtattccgcatcccatagaaaacggtcaagtaccctgcaatcaaggtgccgaccaagacttggaaaatatgttttcgcttcattgatgccacctccaatatcctaatggtacgggctggacttaacaagaccattgcaaacaggtcacgaaatggttcttttttgttacacattaatatagttgtaatataaggggtttactagttgaatgcaagtttggtaaggtgaagcaaaacttgcgagcccttgactttattaacgttgtctaaatttaaaaaaattttttcaatattttgttgtctggcgctttagcttaaaaagtttgtcaagctttttagttaaatatcgcttgacaaataacctgacaaacggttagagttgcaagtaatcaaataaccgttcatgcaaacctttgaagtggagatcaagctgatggtgcacgcacagagagccggcgttgctgagagtccggccgaacgcaagtcagtaaatggaccactgagggttcccccgaaagcaccgcaagtacggggaaacgtgttggcatacgtcagttgtcgccggggtgttggccccgggctaagcgtgatcagaaactgccaaatgacacaatacctaggcgcagtctcatgatcaaactaaggtggcaccgcgggaaaccgtccttaacaagaagtttgttatggacggtttttttgtgtgagcgcgagccagcgcggttagggatcggagtgtaagcggcctcgggcgtgatggcccgcccttggccattgcggctgaggtccttacacgcagacttctgcgctggcgagcgcgttatagaacgcaagccccaaccaaccaagtgcccaaaatagaactccccctcgtacacgcggtccactttaccgcaaccaaacgaaaggcctctatatcaaaaagcacccagctaccccaagcctcaccatccgcactccccctccttcgcctgtaccaaattccaccaccaaaaatactttcacgaggtgtacaaaatgaagaagcagctctcactaggtcttagtctcctaggcgtcaccatccttttagccgcatgcggccagtcagcaaaagcagcaaccaaccggcgaacgctcaacgttgcagtcagctaccgatgcatggcgtaacagcctagaccactatcaagaattcgttatcatcgttgcacttgacttgaaaattgaggcttgcaactttttttccgagtgcaaaaagacgctgccgtcaagaacgcttctagcttcttgacggcagcgtctaccacttaagaacccttgcgatggcaatcatccctacttcactctttatggattattgttttccaaaactatatataacttttccaaactattaaatgacataaagttggacaaatccaaggaaccatcatgcttaacagtgactttctcagaaacgatgccacacaggacgttatcgagagcacgctgcgtaaacatcttttcttcctgaagactttgtatgccgagaacaagtgccttcagtcgcttgttttttctatgaatgactacaaagcaaattaaagggccaatagataaaactgctacaatcaggaaaaccgcaattaagtgattcatatccgaacaactcgcttctataagattaaaaccagacaatccaggaacggcagcactgccgaaacctgagtcttacttttccatcttcattgtctaccgtgcaggcttttttaaattcttggaaaatataacaactaggaaaacaagtataaacaaagcgaaaagtattcgtaatcctttaaaagtaaataattctccatcttcaaagagttgataaagattaataaactcaaacataaaaagtaaacccagcggcccaaaaaccgctcgcctttttcgtttcatttcactgtgcgcgaatccatcttgagatttaaccttatgatcatcactgagtgccacacttatccctccctacaggtataagcataacaaaggcggtcatcatttgatccaacaacatttaaacgtagggatttcggcatttaacgttcatttcagctataactacgccgacaaattcttttttcacctaatgtcttaattcttatagataacgccaagcaaaaagcccccgtacgcaatcgtcatcgaccttgtaaggaagcttctaaattgatttctaggctttcgctgttgcttttgctgcgtcccgaacgctttctgctaccacttcagcaacatccccgtcaaacgcattagcaatgatattcgtggttgacaattcatcatccggaatcaagctggcaattcctttagccgcggcaatctgcatgtcaattgtaattttgcgtgccctagcatccagagcgccgcggaaaatgcctgggaaagcgagcacattgttgatctggtttgcaaaatcactgcgcccagttccgacaatatacgcaccagccgccaacgcttcatccgggaaaatctccggttccggattggccatggcgaaaataatcggtttgggcgccattgttttgatccacgccggattgagaatgtgcggcgccgataccccaataaagacgtccgcacctttcaaggcatcttctaacgtcccggtgcggttttcgcgattcgttatcttagcaatcgccgcatgatgtggtggcagttgatcagcgttcttttcagctaaaatgcccaccttatccaccactatgatgtgtttgaccccggctgccaagaatcgccgggcaacggatagccccgccgagccgccgccattaaccaccacgcgaatgtcttcaatctttttatccgctactttcaaggcattgtacaaagcggcgagcaccacaatcgcagtgccgtgttgatcatcatggaacacggggatattgagttcatcaatgagccgtgtttcgatttcaaaacaccgcggcgcactgatatcctcaagattgatcccgccaaatgttggtgcaatggctttaaccgcagcaatgattgcttcagtgtcttgcgtatccaacacaatcggcacggcatcaaccttagcaaaccgtttgaacaaagcggcttttccttccatcaccggcatcgcagcttcggcaccgatattgcctaaccctaaaaccgccgaaccgtcactgacaactgcaaccgtatttttcttagtggttaagtcataaacgagcgactgatccttggcaatagcagaagaaactgccccgacgcctggagtatacgcaatactcaaatcatcgcgcgtctcaattggtactttcggttccacactcaattttccgccatttatttttgcttgatctagcgcaagttgattaaaatccttctttgccatgtgaatcatcctccttaagtttcgaaactagtcgatttaaaagatcatccgcaaaatcgccgtcattgaaataaccgtaatcgcgccacccaagcgtgttgccacctgagcaaatggcatcaggttcatccgattcgccgtactgagaatagccacgtcgccagtaccgcccatcccgctctggcaagccgtcacaatagccgtttcaaccggattcatgttcaggaaccgcgctacgaagaaaccggtggaaaccacagtgagcaccacactgataacaatgataaaatattgccaactcaacatgccaacaacatcttttagcggaatgtatagtaaacccaatcccgccatcaacggaaacgtaaaattactggaaataaacttgtataactgtttggcgcctcgttgggtttcacccggaatgacattgacatatttcagaatcgccgcggcaacaatcatcaaaaccggccctggaaagccagtcacggattgcaacaacatccctaaaatgaacaaggtacatgccgtgaggacgcctgcacccatcatttttagatcaagcggtcccgtatcgtctttcaacgcgtctgccaagtcatcttctgccccattcagtcgaaccaactgtccctgccccgataactccggacgcttctctcccaaccgattcaataaacctgaacacataatggcaaagaagttaccgataatcgttgccggaattaactgagccacaagcgcgccgctggtcgtccctgtgatcgtgctgtatcctagagacagcggcaagatgccttccccgatgccgccagccaaaaccggcgtcacaatgaagaacaacgtatgcttccactccagacccaataacacgccaaccaaagtgcccacacccatcgccagaatcatgccaagcatcatgggaataatcatccgcatcaacccttgaatcaggatcttgcggttcatccccaaaatgctcccacagactagacatgcaatatagaaataaagaaagtttgcttgcttcatcaacatgtcagttgcttttaacacgttcggattcagggcgttataaaacacaaggatcgatgggactaacaacgacagtatggctggcccgccgaaattcttaaccaccggaatgttggcaccaattgtccctaacaaccagcccatcgtcagaatcactgcaaagccaccaagcatattgaccggcagctgctgcatcgcgccggcaaggatgatcaccatggccatcaccagataaactggcaacggcacggaaccaatcctgatcgccatccacttactttgtgaactctccggtgcgctaggtgttcccgttttactcgccattttcttttccccccttaggactcttactatccgcagcataatgtaagcgctttaaagagtgaagattatttaacttttttaagcatcaaagcatttatttaagccattattgagtgattcacaaacaataacttctgacggaggaaggtgaaaggcttgaaaataaaaggatggcgcctctggagttggctgtcactcatcttcacctcaactttattagtgacggttttcacagtctatggcttcaccttattggaaaatcgccagcagttcgagacgcgtgaaagtcaacttttactgtcagtcggccgccaattggctcaagaaccacgtgtcatttctgcgcttaaggccaataaggctgatccggcaacgcgcgcttacgccaattctgttgccaaaaacttcaaactcgactttgttgtcatcatgaacatgcaagcgattcgcctcacccatcctgatccaaagcagattaaccgccattttcgaggtggggatgaggttcgcgccttgcagggacacgcctatgtttccgtgcaacgcggaaccctagggcgctccttacgtgggtttgttcctgtgtaccaaaaccacaaacaaattggggtagtggcactcggcattaaagtcacggccttacaaatgctcattcataactcccaaaacggctttcgcttggcattactagtcggcatcgttatgggcatcctcatcgcctttttggtggcttattacattaagcggcaactacacgatcttgagcctaaagaaattgctcggttgcttgaggaacgtaatgccatgctggaagaaaccaaagatccggtaattgttgtggatctcaaccagacgattgtgctagttaatagagctgccagcaaactgcagcgccacctcattcatgaacaagcatttattggccggccgttaaccactttaattgcccatccggaacgcattaagctgacggtcaagaccgagcagttttatcagcaagatggtcaggattatttgttctcagccgcaccaattatcgtgaagaagcaaaaaatcggttacgttatctttttacgcaacgccactgaggctattttcgttgccgatcagctggcgaacaccacagcttatgccaacgcactgcaaagccaatcccatgagtttatgaacaagctgcatgttatttacggattggtttcgatcaaacagtacgatgaattggcgatttatttacaagaccttttgaaaccggaacaagaatttgctaatcgcctcgcattgttagtaaaaaatccgctcgtagctgggttcatgattggcgaacgcgagaaatttgcggaacgtaaaacaacgctcaactttgaaatcgtgccagaactgcctgccaatcccaatgttagcgaaactaaatcacttttaaccctcagccgttatctgcactttggtcttttacagcaagatttgcctgcgaccattctgattcagctcgattatgctcaggaccaactgaccatcacctatcatctagcacaaccgcttagccgtaacgcgttgttgtcagtgattcatcaagattacttccaacaattactttctgatttgcatggcacagccaccctaagtccagccgaaccacttgtgttgactttggtggtggactaccacgaggaggcaaaaaatgaccaacattctcatcgttgaagacgatcccatggtgcaatttattcatcgcaactatctggaaaagcttggtacttttgagacgatttactcgtcggagaccattgccgaggccaaaaaactgctggcaagccgttcgattcaactcattcttctggatattcgcctgaaagatggtaatgggatcgactttttaaccgaactacgccgcaccaagcaaatggttgatgttattttaatcaccgcagccaatgaagtcgaaatcgtaaatgacgccttacatctgggtgtcattgattaccttatcaaacctttcacgatggaacgcttcgaaaaaagcatccagcgttttaaaacgaaaaatcaagcgctggtcagtcagcaattgaatcaaagtcaactcgatgcttatttagaaccacacacgcacgcttcttccattcgcgacttggataaaggtctaagcaaagcaactttgaaaatgattcaagccgcaattcaacaattgccatcatcttttacggtcgcacaattaaccgctgaaactggcttatcgcacgtctcggttcgaaagtatctaaactttttggaggatcatcgctttctgaaaagtgatacgatttaccgcaagaccggccgtccattcaagacttatcaggtgatagcgccattgccgatgcggtcgtaaattaatccggaaatcttcagtacggctaattggaggttagcgcagtgcctttctataacgtggccacataaaaaacgttaacgtcaatcaaactaactagttgatcgcgttaacgcttttgatattggccgaggtgcttcttgacttatttttggccactgacgatgcttgctgacttactgattagtgacccgtgaccatgttagtgaagacccgtgatgtgatgaccggatcgtccttagtcttctgtgattgtgccgatgcccgccaatgataacgatctaacggttgcacctgaatctggtgcgtttgtggatgcttcttctgcatccctttcaacgtgcgataccagctatgttcacctgttttcagatcgattaatgcatagcctttaccatttatgccagactttcgaaaatcatagttatgatcttcttttgacttcacaaccaacattcggcgattccagcccgctgcctgcacatgataaagcagcgtgttggcatcagtggtcgtttggcgtttttgtgggatccgttcgattagaaaaggcccaacgccggattttgtgatttcaaaatgccgaggcagtttgattgaaaagccctctgcatcggccccaggatcacgcttattctttggaccataaaggctcatcgcaatcgagctgactgtcaacaaaacacttaatccaatcatcgctgatattgccaccaaattcctctttttcaagtgtttcctcccgtttgatctagctaagtcgtacaatcaagatatgttgatttcagtataatatctcttttcagtgatccaccgctatcagtttgaaagttatagaaatttcaggattttccaaaaatgatttcatggcagtttcacgtgaaacacactcaccgtgaaagtactagatcgatatcaaggaagtatttatacgagggagttttatagatgataaagattgttttactcgatggctatgcattgaaccgcgatttagattggagtgctttaaagaagctcggggaatgtcatttttacgatcgcacaccggtcaacgatacgcagaaaatcctagctagaattggtgatgcagagatcgttttaacgcacaagacacctttgactaaagcgattattggcaaggcgcccaatcttagatatattggtgtcatgggagacggttatgatgtgattgatgttgaggcagcaagtgccagaggaattcctgtgaccaatgtccctatctacgcaaccgatgccgtcgctcaattcacttttgccctcatcctagagataaccagtcatgtcgggcttcacaatcgacttgttcatgaaggccgttgggaagcgagtcccgactttactttctgggcaaaaaagctgaccttattagcggggaaaacccttggattagttggctatggccgaatcgctcaaaaagtagcttccattgcccatgcattttcaatgaaggtagttttctatgatcggcggcccaaaacgcatgacaatcaaatgagccagcaagttagtctaaaggaattactcactaccgctgatatcattagtttgcacgtccggcaagcaccggaaacccttaatctgattcgacgtgaaacaattgaacaaatgcgtccaggggtgatcatcattaacaccgcccgcggtaaactcatcaatgaaaatgaccttgcattggcattaaaccagggaaaaattgctgctgccggactggacgtctcacaacaggaacccattcaaccggacaatcccctcttaaccgctaaaaattgttatataacaccacatatcgcttgggctccctatgaaaccagagagaaattattggcactcacgattgctaatctaacggcctttctcaaaggcacaccgcaaaatgtcgtcaacgtgcaagcatttcactaaaagcgaagaacaccctttacagtgatgacaagtaaagtttgggatcagttgttttaaatctcggtatgcagaaacactctcctgagcactaagctatagtgaagctggcaaggctattgacattaataaatgcactcaaaccttcaattttttcgaatgacactttaaaatgataggagagaaaacctttgcttaatacgaaggctctaaaactgtacttgttttcttcagctatgggtgtattcatgtggttaaggcattcattaccgttccaatctattggggtcgcagtttctctgaatttaggttacattttctttctattcggtggcatatttcaaaaacccgagttagtcgcggccagttccttcctcatcatctatggaaatttggggtttgttaagcaagtaaatggcgatacaggttattccttctcaaaagttgcctctcttttaatcatcattctttgccttataacgttttatctgctgaaaacaaacactttgtcgttccttatacccttggtgtcactaataataaatggagctttagtcagtataaaaacccacgatcagaattgatgagctctcttaagccgaacggtcaaaatgaaatggccggggctttttatttttttgatttagaaaaagggttcttttacacctgtttgaacataaaccgtttgcaagtgcggaactggtcaacgtcacgatcaggaacttttataccaaggattcactttaagcattgatacaaccaaaaaagagaccccctttgcgtgaaagagttgtcccttttgcgatatatcatgattattccgaagcttttggcagcgccgtcttcttgttagtaatatcgataaatttcgcttcgccgtcaactgaatcaaccgctttttgcaagcgtttcatggccgccgtggcgattggcaagtcgacaaattccttggtcgcgttgtctaattcgacttcatcagcaaccgagtctttgagtggccgcggattgctttcgtctagcgcccggagtacgactggcttaagtggtcccatctgtaacaattcgagcgtggtttcatagtcaatgccgtatgcatcagctaaatccaaggtttcgcgaataccggcttcggctgccataatcgcaacattggtgatcaactttagcttagcgccgttgccttggtcaccaacatacctgatcttgccaaaggtctccaaaaccggcgcaactgtctctaccacttgcttgtcaccagctgcaatcagcaccagactggcttcacgagcatatttcaccccgccgatcatcggcacatctagcaaagtcgcatgtgctggcatggcactttgaatcgcggtgatttttcgaggatccaatgttgaagtgacaatcagcgtgctgcccggctgtaaataattgacaattcccgggtcatctaccgtcccgatatgcaatgctggcacatcagctgacatgaccgacgtgataatgattttagaagcggtcaccgcatcttccagtgaggtcgccgcccgaacatggtccccagtcagtgccgtcattttagccggttctttgtcccaaatcacgacatcataaccagcctgggccaaatgcggcacgatctgactacccatatcgccaacaccgataaatgttattttcatggctgttttcctttcaatttaaggctaagctcccaacaaaattattaaagggttgtaataacttccagcaataaaaagataaaacatttgtgcataatcatcacgcaaccgggcgaatcattttccgctgtatcatcttcaaattagcatgattaaaagccgatttcaaaaacaaagctcacttgctggctttaattttgccaagacgcaaaaaacgctgcctcgcgccgattcgttatttttaaaatccacttatttggcgatccttattttttcgcaactaaagatcggcgtccgtatcagccagattactctggtgccttgcctgacacgcgcgtcagactcacggtcaaaacattgtccttggtcgtgttatagtcagccaaaattcctttcacaacaccttgcgaaggtccatgtgttcgggttgtttcttcataattttgaatccacgtactgaccgcattgaagccgaattcaaacccttcaaacacctgcatgtaaaccgatgagcgcggattggtcgcgatgatcgtaatcttcttgacgcggccattttcaatttgcatggtcaagttgatgagctcgtcagcaattaaagtcacggttccattttcagcagttcgcggtaatttataagccgccaagcgcatattagcgttatacacccgctgaacataagcataactccccaggtcttcgtgcatgattttcactgcccttcacttgtgtcagtcaacagctggcctacgcattctgatctgctgcgccccgttatttaatagtgtacaatttatctttaaaaaggagaagtaaacagctcggtagtcaatccttaaagaaaaagccgcctcttcactgagacgactctttcaagttctattttgttggcgtagttatgaaatccagcatacggaagatggctaagcggttagcctctggtggatcgacgcgcataatttctgcggccgtttgatgtaaagcgttatcgtctaaagcataagccgcatcgttaattgctatttcgcgaacatcatcagcttgcggttccagatgaaactgtaaaccaattacatgatcaccaagtaaatagccttggttttttaacaattcattactgaataacaacgtcgcttcatccggaacttgaaacatttcttcgtgccaatgcaaagccagcaacgaatctggtaaaccgggaatcatatgcgtttgtagatgtacaggcgcccaaccaacctctttagccggtgctttgctaacttgatagcccatcgtctttacgatttgttgcgcgccataacaagcaccaaagattggtttatgctggctcaacagtgtcttaataagacgacgctccgccttaatccaatcaatatcgtcatttgggctcatcggtcctcctaaaacaaccaacaaatctgtttcagaagcggttggtaatgtgccgtcaaattgataaggatggtaaacgtaaagctcatgtccgtaaaaatctgcccaagtcttaatagcccccggaccttcattgggagtgtgttgcaaaacgttaattcgcattttaaatcctttcacatctccggcaatgtttgatttgggtttcgcctgcaattacccaagatgctttatcttaacacttactcaggaaattttatatctcaaaaagcaagtgacgagttacgcttacatctttgcagccagtacggtaatcttttttccatcacacaagctactgtgattagcgattaatcgaccgcgccatccgctgaatcgtatgccgttccccacgaattgctttgctgacggcgtataaattattgaccggcgactcaaagccccaagcggaatcgccgacatgttgcatatcgacaccgcagattttgttgcgaattgccattgcctgcaacacccgactgccgctgccttcctgactagtaccgatcgcactcatgaccaagccgcctaactgatgaaccactttcacgacttcggttaaatcggcttcgtcaaatcccggcactgagccaactgctggcgccaaaatcacatcggctcctgcttcgataaagtctttggccgtttctgctgtcatgatccgttcatcaactccggaagcatgcattttacccgcaataatcaagccgctgaagtattgcttggccacggtaatgctatggataatcgcttcattagtgacccccgtgcccggattcccggttagaaccatgaactgaaaacccattgcttctgcttttttgatgacagcctcacttgcggtacagccgggtaaaatcgcaatctgttgttccatcatgttaggatgatcgccaatcggttcaagattaatccccactggccgcccaaccaatttcttcaatcggtcaatgctcgctttgccatcatgcttaggcgcagcagcaagatgccgttcacccggataaagaccgaaaattttcggatcattcacatccaaccggttacacaaaatcatatccgccccaaaagcagccgcaatttctgccgtcgtaatgctatccagattctcttgcgtcacgatattttcactcacaattattcggccttcgctggctttgatgctttcttttaactgctgcccattaaactgcatgacttcactggtactggcactcaacaatcgtttcaccatgactgtaaacctccaaatttattaaaaagttagttcaacctttgatatcatcattatacttccgccgctgcttcgatttcgtcttcgtcaaacattgactcatcgacactccagaagaaaaatccagtagtgtcaccgactaaatgcaaaaatgtttattcacttcagcaacaaaaaaaatcacgacccgcaagcatattttatacttacaaatcgtgatttttttatctattctgggtggtcaggggatcgaaccctggacccacggattaagagtccgttgctctgccagctgagctaaccacccatttatttatgtctgtcgcgcttcacgacttaaatataatatcatgtaccccttactggcgcaagtgttttgcgaacttttttgcgaaaaatcgttcaatttggtattttgacgccttcgacagacttttctatggcgtattgccgacttgctttgagccatgctgacatgcaaaaagacggccgcggccgccttttaaaagttgttagaataaaacgtgaatggactgattgctgttgatcaacttgatggccttgcctagcatcgggccaacagaaatttgatcgagtccttcgaattgatgcttgggatcgagttgaatcgtgtcagtgatgacaaccttcttcaatcctagatgtttgatccgatcaacggccccgcgtgaaaagacgccgtgagtagcagctgcataaacatctagtgcaccagctgcacttaaggctttgtaggagtcaacgattcgatcacctgtatcaatcaggtcatcaatcacaatggcgtgcatcccttcaacgttaccgatcacgccgatgtgttcctgatcacgtttgtcgacaatcgcaattggcgtatgtaattcttctgccaatgcccgcgcctgtttggttccgctatgatcaggggcgatgacgaccacattatcgccaagattcagctttctgaagtagtcgccgattaaccggtgggctttcagatggtcaactggaatgtcaaagaatccctgaatctggtcggcatgcagttcaaccgccacaatccgatcgactccatccatttccaacatattggcgaccagttttgcagtaatcggttcgcgtgatcgtgctttgcggtcagcacgcgcatagccatagtatgaaatgaccacgttaatatggtgtgcacttgcgcggcgcaatgcatccaccatgatcatgagctccatgaagttttcattcactggatcagagaccgattggatgacataaacatcagcaccacgaacactttccggcagctcgatttgaacttctccatcggcaaaatgattcactcgagcgggcgataacggtaaacccacttcggccgcaatcttttccgcgagtggtcgattgccattgagactgaataattttaattcgtgcatcgatttctccctttttcacatttaacggtttgcaatgttattatacgagataaatcgagaaattgcgactggttatgcaatgagttaaagtaataacagaatatttgcagattcataagcaaggcttcggcaatcgtccgctttagcatttgccatgctttgatccaactgcaagactaggaaatgggaggctctttatcatgaaacaaagccatttgatcggccttgcaaccccactgttgttgtcagcgggcactttagcaactgctgagcgtttttaccaatatgcatttcggcgaatcaattacattcctgatgcccgtagctccatgcaaaaatacgcctcatcatattaccgtcatgtccactgggttgaaagtcagcggcatattgaagcctggcatatgacagctccggataatcagcggcttgaagcactttggctgccgcatcccggtagtcaaaaagcggtgattatcggtcatggttataagggcaccgggattaccatgagtaactttgcccacatgttttacgacttgggcttcaatgtgttgttgcctgacgatcgtggccatggtgaatctgatggcgagtacatcagttttggctggttggatcggcttgattaccttggctggctgcaacgcattcttgaccggcttggcaacgatgcccagttattgctgtttggcacgagcatgggtggcgccacggtttcattggtcgcaggcgagccgagtttgccgaaacaggtcaaggccgtaattgaagattgcgggtacacggatgttgaaacggaactggcttatcttttaaagaagcaattccaccttccaccgttgccactggtaccattagccagcttcatcaattatcggcgcttaggttatcctctccgcgtggtcaacgtccgtcaggctttaacgcgaaaccgcctgccattactagtcatccacggcgctgaagatgtttatgtgccaaccaaaatgggccgcgaaaattacgctgcctccgctggtcccaaagcgctctggattgtcccgggtgcggcccacgccgaaagttactggattaaccccgcggcctatcaagcgcacgtgaagcgatttttggatattttcttttagcgctagcagtcccaataatagccatcatgtggtagctaagtttcgttgccgtttcctccgcgtagccttcaaactgcgcggtttttttaatctaaaaagactcagatcgcctctgagtctttttagatcgccggatgagtggctgctatgactgccacttccgcagactattcaaattcgttttcttcagcttgatcttgctgcttgcttaacgcatcaaacgtccgcagcatctccaagttcgtctcaatactttccggccattcccaatgttgaacattaaacacatgcttaaggtgcggccccgcacttgccggccatagcttcgttgtataggtgacgtgattagcatcgaacaccttcaacaaggcttggctttgcaagtaaaagctgtcattttgcccgccaatcagcataaacggcggcaggtccaagcctttgacaacctgcgagaaattcaggtgatcggccagtgcctgatcgccgccgcttaacttgtccagataaaacgcggccatatcgctcatgtcaccggctgcttcgggaagcttacttggttcggcgactggacaaaccagcgccaccagggtgaagttgaaattaacccgactcacaccaaagagttcctgtaactccgcactctgctggatgcaggcaaccaaggacgccaggtggccgccagctgaatccccggtcaaaagcacatggtcaaggtcaaatccgcgttgagggccaaaatgcgataaccagcgcagactagcaaagatgtcttgaatctggccgcgtaaatcaacatccggtaacaaccgatagcccatacccatcactgcgtatccttgactagccaaatagcggcaataattacgattcaaattacgatcaccataaaaccacccgccaccatgaatatcgatgacggtcggcatggttgcgttgcgtcttttggccggatagtacaggttcagggtttgctgcggatcagccgactgttcgtaccgatattccgtctcccaatgaacatcttccggtacccgttcatccgcgtaccgtgccttatcccgagcagccgtttgcgcccagctcgcttgaacttttgccaacattgcctcttcatctgccattaacgaatgcctccatttcctcgtgttaaaaggttattcctatattaacgcaaaaagactgccggtgcgtcacccgacagtctaatcgtttgattttaagcccgttttttaacgatccttggatttaacacttgcttcaacttcatcaatcaaagcagcatcttttaacccggttacttctttaatgacgtctaccaatggctgatccttgagcatcgcctgaagtttaacggcttcggcatcattaggttcaacataatggaacatcatgccaaccgtatccatcaagacgctgtaatccaaaccgcgttccttcagttcccgaatcggtcggatgaagcgttcgttgtagccaagcttacgaattggcgtccgggcaactcgcgaaatatcatcggaaatatacgggttctggaaccgttgcaagacccgattttgataagtctcaagttccttttcatcaaagttcttgaattcagctaaaagcagcgagcgggtttcggcaagtgcacccttggcctgattgaagactttaggatccttgatggcttcaccgatcgtgctgtagcccaagtacttgccggtgtaagccgtggttgcgtggccagtgttgactgagaagagcttgcgttcaatgtatggttcgagatcaggcacataatcgacggtcttaagcttcagatcatggttcttcatctggctttcgtcaacaacccattctttgaagtcttcaacactaaccgctaatggatcatcatgtttttgctgcgggacaatgcgatcaaccgctgcattagggaagccaacgtacgtatcagcaaaggtcttgccggcgtcatcaagatgttcataaacgctcttcttcagcgactgtgatccgccaatcatgttctcacacgcaatcacatctaatggttggtggttgttagcggccgcgcgtgcttgcaaaccttgagcaatcagcggcgcaatgatcgggagaatcttcgggccaatcgccgtcgtaaccaagtcggcttgggcaatagctttcacaactgcctcaggatccttggcgttattcaacccgtcaacattgtccacatgaattttcttttcacccggggcggccaaagtgatggtgtattccccgcgctgatttaacgcattgataatcgtctcgttaacatcgacaaaattgattttgaatccattagcggcaagcgtttcaccgataaagccgcgaccaatattacctgcaccaaaatgtactgcttccatcatgatttattcaacttccttcagtaaattgacgatttcttccggcgtttgtgcgtcggccagtttttgaacattttcaacatcgctacaataaagcgcaatttgtgagagtagtttgagatgctcgccgtttaatccggcaatgccgaacacaacggtgacgagattctcatcagccggatcatccgaccaatcaactccccacggatattgaacgaccgaaataccggtctttttaatatatttcatgccgtcttcagtgccatggggaatcgcaataaagttacccatatacactgaaacgtcacgattacgatcaatcattgaatcaatataacccggttcaacgttgccattgtcgaccaagagttggccggcctgacgaatggcttcttccctggtcttggcttcttgaccaagtttgatcgtctttacgtcaagtcctttcatcatgtcaccttcgatcaattttttgaatttcgtgcataaaaacttctgtcatcacttgatataactgactatagtggcctttttcaaaaagctgtatgtccgctggtgaggcaactagcttggcgctaactgcactcaggagggtcaatgtttcttgtggaacaggattcggcgtcagcaacaggagaatccgctgcagttggatcgtgcccatgtccattgccgctaaaggtatcgctgttttgagatcaaacgccccgatatatggggttgtgacaccgcgactactcgtgtgaatcattgctaaacctgtattcgggatgccaaccggcgctaactccaatctttttaacagtgcttctttgacaattggcggttcaacgacaacggtcggtaaccgagcaagcatcgcatcgatagcagcagcaatcgtggtgaccggctcattcaagtcgttgacggcaaagtgttgtagtaacccatctgctgccatcaccatggtttttaggctctcaaaggcggtaactgtttggtccagtgacggttgattcaacggccgcacttgtttaggtgtggcgcgctgaacaagccggcgcacttccgctatttcctcgcgtcccaatatcggagtaatcaccaagtactgatgcttaaaccccggcagcggcatggtagcaaggaccagatcgtaatgttcaagttgttgttccggtaaatcactcacctgaacaatcttaatcttacggatttccggtacctgcacacgcaactttccagcaatcaagctgccggttccgggtccatcactagtaaccaatagcaccgcaacgggcttttctgctggcgcgtgatccaaaaccgaagcgaagtataaaaccagataggcaagcgcgtcgccagtgaaggctccttggccgaaaacatggtcagccgccttttgaaccgcttggtaaagttcagaataatcatcttgcaaatgagcaagtacgggattggtcattgtgacaccagacagccaatcccctccagccgttcgttggacatgagccagtaatgaggaataaagctgtgggttcccggaaaatttcccgggaaatgatcgggctacttcccgaataagatcctgaacttcaaggttgatggttaaatcaaattgatcaaccggttcgcctgccaacccgccgcgaatattactcagttcgatggcaaggaattgataatcaccgacacgtactttttcgcggattgtcgaatccatctcggctaggaattgtagcgccagttgttgatcctgaaacagtcgttcctgatcaaaatgctgctgcggtttaacgtgatggtcctcacgcaatcttcgtgtattaattgcaaccgttagtagcactgctttacgttgattgtcatttagatccgctaaagctttaatctgagacagtgcggtgttagcagcaagtaattcttcttgcggtaaccgttcaatgaaatagttcgccaccggatcaaagtcttgctgcggatcgtttaggaagcgaaagaacacatacggattaatttcagcattcaagacgccgaccagaacccggcgaatatcaccttcttgtccttcgatccagataccagctgctttttgccgattcagcttaagatgatattcatttaacgccggttcgagaatatccagatcttgcttaatcgtcgtaatgctgacatctaccgcatcagctaaggctgtcatcgtcaaagtttcatccgttgtcagcaacatcagtgttagcgcactctgccgctgactgggatcaaaggtgagatcttgccgttgatgtgacaaggctgcagatagactggctaaatcagcagctgctcccacaatccggtacgagctgccattgcctttgtccaatttcaaattcaccgttgcgatatcatgttccagttgcgaaagctcacggtaaatggtccggcggctgacacccagctgtcgctccagctcgtcgcggcttatgccggcgggctggctcatcatcagtctgatcatttcctgttcacgattcgttagtaacatgtttttcgccccagacggccgcaactcgacctcgcttatttcaatttctcaataagtttatcatagttcgtcgcgttcaaaagaccatccacggtatagacttgaacattggcaaattgtaatttaacacgccgggcagtttctttcgatgcgatgattaagacatgatccttatcatcaatctcaccgatcgcaacattacgaaccttgacgtctttgttgagttttcgcaactcagagcggaatgtcgcttgtgccatagttgccgagccgatattttgatcgtgatgcaggaagtctacttctgtaatcttatcgaagtcgatatcgttaagctcgtcttctggcgtttcctgcttagcttttggcgtttctttagttgcggtttcatctgtcccgccaactgcttcagccttcaaactagcaatgatctcatcatacttaggactattcaagaagttctcaacagcgacgtgtgctgcatcaggcgtttgtttcttagcccgatcagccaattcttcttgcgtcacaactaagagtcccggcttatcctgcaagttgctaatggccgtgttggtaaccgacagatccaaaccagccttcttgactttatcacgaagaatcgaagcacccatggcactggagcccatgccggcatcgcaagcaaagataatttgcttaatgcctttagcctggctcatgacatctttagcagcagccacatcctgacctttagcttcagctttcatcgacttcatcttcgcttcactggctgccaactcatcgccagtacccttatcgcggcgcaagatgaatgccgaaatcaggaaggaaacggcagtggcaccagtaaccccaacgattaagccgatatagtttccgatattaaccggtgacatcgcgagcaacgataggatggagccgggagatggcgaactctttaagccaacattgaagattgagaacaaggtcgtcccagtcacaccaccagccataactgacaggaacaatgccggtttcattagaacatatgggaagtaaatttcgtgaatcccacctaagaaatgaatgatgatggctgaaggtgcagaacctttggccgcacccttaccgaataaggcaaatgcaagcaggacaccaagccccggacccggatcaggttcaagcaggaacaggatggacttaccatgttcagctgctgcctgaatcccaagcggtgttaagatcccttgattgatcgcattatttagaaacaggatcttagctggttcaatgaaaatatttgctaaccataacagaccatgattgataatccaatcaacgccggctgccattgcgttagtcaagccggaaatgatcggtcccattaagaagaagccaacaattgctaatagcatcccgataatgccggcactgaagttattgaccagcatttcaaaaccttggcgaatcttgtcttggacccgatcgtcccatttcttaatacaccagccgcctagtgggcccatcaccattgccccaatgaacattgggacattggttccgacaataacccccattgcagcaatggcgccaacaacgccgccacggtgacctgctaccattgaaccgccggaaaaagcgatgagcaatggtaataggtaagtgaccattggcgtgatcatttttgctagttgcgcatttggcagccagccacctttaaggaagatggcagtaatgaggccccaagcaataaaggcgccgatgttaggtaacaccatgccggaaagcttggtcccgaatgattgcataccggccttcagattgaatttcttcttctctgttgccggcgtgtttgctgatttagcttccaaagcaaacactctcctttcccttgtttacgaagattattgtaaccgctttatgtaatcgctgacaaaagctactttggcacagttagttgtgccaaatattcagcatcaatcgcgtcagcactatttgtgggtcaaaatcatacgtgtcagatagtaacagtgttcgttatctgtttcacaagttatctaaatctagacgctgttgctcgccttcaattaagccctgtggattgctttttgaaaaagaaaaatcagtttcttctatctaagtcaggaacatctcagtgctatttcaactgccagcgttaatcataaagccgcgctcattcgtgatctggtttacaatgcgatggcgatttagccacagcgccggatttttaaaagaatgcaaattaggtatagaccattgttgacagcggcattttatggtgttatattggactagaccagataagggggatatcaatcatggatgttaaagtttttgataatgatacagaagcaggaaaatacgcatttgaattgattaagcaaggcatggacaacggtgccaaggtgcttggcttggctactggcagcacaccggtcaccatgtatcaggcaatggtaaacagtgacgttgatttcagtaacatgacctcggttaacttggatgaatacgtgggtatgtcaccggacaatgatcaaagttaccattacttcatgaagagccatctttttgacaagaaaccgtttaaggaaaccttcgtgccaaacggtcttgccaaggatccagaagaagaaaccaagcgttataacaaagtgattgccgatcacccaattgacattcaagtcttgggtattggccgcaatggtcacattggcttcaacgaaccaggctcaccatttgatgccgaaacccggaaggtacctttaacccaaagcaccattgacgccaacgcccgcttctttgaaaacgaaaacgacgtaccacgctatgcttactccatgggcattggttccattatgaagagcaaaaagatcttgcttttggcatttggcgaaaataaggccgatgccgtgcaaaagatgatcgaaggccctgttaccaacgacgtgccagcatctattttgcaaaagcatccagatgttgtcgttatcttggacaaggctgccgcaagtaagttaagccacaaataatcagccattcagcaccatttaatggcgtgagcggccacattagtttgcgcaggtgaacattaaaaattcgaccctggagaattttatctggggtcgaattttgtttctgcttctttaataggaagttgctgattctcaacgtcctaaatcaccgcgctgaattgtctgtctgcgcggcttttgtgtaagcggtttgtttgtttacccgccacggctcacacctaggcagatccatggtagaatgaggccatcatcttaatttatatatggaggaaactatgtacaaagctgttgtcttttttgatttagacaaaaccctgctgaatgatgaaaaacaggtcccgccggaaaatgttgctgcactaaaagcgctcgaagccaaccatgtcttgcctgtcattgctactggccgcaactactacgaactcgatgacatcatggccgttaccggtgttcgaagcgccattgcagcaaatggtggtgatattttcctggaaggcgagcatattttccaaagcgtgatcggtgagccgcaactgacacggtttcttaatgctagtgctgcccgcaatattcaggtcgcgatgtatacaagtgaccaatcagccttaacgggacacaatgagttgaccactgataattacgctcaggtgcggcaaaccccgccgccgattaagcccgatttttacaaacatgaagccgtctgcatgctactaatgtttgtaccttggaccgatgccggcgatcaagtcggacaacaattcattaaggattttccggaaatgaccttctaccgtaactcacattacacctttgatgtcgttaatcgcggcatttctaaaggtactggcatgaacatcttgctgaatcaacccgcattgcgcgatattcctacctacgcattcggtgacgggtataacgacattccccttttgcaggcagccgataccgggatcgcgatgggtaatgcttatcctaaagttgctgccgttgctgactatcaaaccgatgactaccgtagtcatggcattcccaatgcactcgcgcatttcaacttgatttaattcggttttaacctcatcggccacatgcggtgaggttttttggttcttctcagccatcatttaaccaaatttcaggttgactattcgaacaaatgttcccataataaaaactggtattcagtcgtgaaaatatttttatttttgacggcagatcattgatatatcaacatttctgcaacttcctataacgtgttcacggggtaaagtcaagaccgcaactgcgcgatttttctgctatactcaaagcatgttgcacgttatttgggcgtggtcgtatcaccgatcagtaacgctgcaacatcgataaatctgctgatggaggggtctcgttatgttagaacaatcgacaatgcatcctgtggtttggatcaatcaacatacttatatcagtatcgttaagaatgcggactacaatttagaagtttgggagattaccgccgaaaatcggcagcatcggatggctcggatgaactacaaatatcatcgcgataatttcgccgggtttatctatcggctctttccgcagatcgatctcattcaaattcacaatattcaaaagaagcttaatccctattttgatttagaagtttagaggtgttcacatggatagtctggttttgcaactgttaatcatggtcgtagtcgccttggtcatgacgttaacgattattattgcggaatggcgcactaagacgttcaaaacatggcagattagcgttcaatccgtggttgcggtgttgttattagccatcggtatcagtttgctgacggttcgctgatttagaaaacctgattgcgatgctgccaagtatggcattacgatctgcttggtatctatcgaatgtcacaacgcccagtgatattttgacaacctagccaagctaccgactgccactgaaaagcacgctaagaaagaaaccagcattaataagctatgtacatcctgctaagctaatcggctttcgagaagacgtatcttgtcactcgaaggtcgattttcatattcatgccctatttaggtgcttactttaaaaaatagtcgttatttgcggtaacatttaaacttctatgataaaattaagcaaaaatcacagagggggcgtttgtatgcatcatttggaaatccctgcttcgatcgcacaacagttggttgatggtttaatgggcggctataaggattaccttgctgagcgtaagcagaaacagcagtctttgactattagcggtgcgtttgcctggacccggagcaatttcatcgactctaagattagcgaactagtcagtaaggaaccttcaattagtagtcaacccgataaggccggatacgcttgggaatacattcaatttatccacgaacaaagcaatcatcgctcattgatcattgttaaaaatgcgcggcagctaaagcgtcgattcaataatacgaatacgactgtagacaaaaataattatctttatcaattagccggcatcaataatgagttgagtgcagccggcttactaagcagtcggcaaactaatggcgtcattcagctggaactagctttgcctgataccaacaatgctgttgtaagtctcatgaatcaaacagctcaaaaatcatcaccgttctcaaaattctacattgtgacttacgcggtagataacgacagcaaaatgatcaagcatattgaactaacgatgccgaatcaaaccgaaatgactttgaaacccattcaagacttaacccctttaatcaaacacagtccattccagatcagccttgaggaagttgagccgattcagtctgatcaggtgcccgacgcagcatatgaacaaaacaccctgtttggctacgaaattaatgctgatccggaaacagaaatggaggcagacgctgaatagcggcaattaatatgtttattggttcaaaactccaggccctacgagaattaaacggctatacacgtaaagaattaagtgatgtcattggcgtcacccagcaggctgtctggcaatacgaaaacgacaatgtcatgccgaaaatagaaattctaaacacatttcaaaaaatttttaacgtcgaaatgctctttttaataagcggaagcgccccgaaacacgttgtccatgaagaaaaaatagccttcagaacatctgaccattcaagtcgcaaaaagactaaattagaagcacgctacttagactttgccgatgacctgacaagttattttgaacagttcgtccgcaccagccccaccggatttgatcagcttcaaaaactggtccatcagttggtactaaatcagcatgagccttcaccgattcgcaaagtggcaaaagtagcacgaaattttttaaaacttcaggataatcatgacttaatggccaagcttgaacaaataggcatttatattgttgaaaaagatctcggtagtgatattgatgcctattcaacgattgctgacagcggccgtgcctggattgtattgggttccatcaagaaatcagcagttcggcgtaattttgatcttgcccacgaattaggtcatttactgctccacaagacgcttgatttcgatgaattaaccccctccgaatataagcaaattgagcacgaagcccacacatttgctgctgaattacttctgccacttgaagactttacacatgatttcaaggcgctgtatcgccgttcaaatcctgattactaccttgacttaaaacgtaaatatcaggtttcaattgttgctatggcaatgcacgcctatgatcttgggctgatgagttatcaagaacagcgctatttctttgggcaacgcaataaaaaaggataccgattaatggaacctctagatgatcagttgatccccgtacgccccggcaaattgcgtgctttgatcacactgttgtttaatcagcacatactaacgctcaatgatctttatcaaagactacatgtccgacctacatttgttacccgcctttttgctctggatagtaacttttttgagaaatatcagccacagcatcagtatgtgaatcaccataatattattgcgttcccgcagtctttcaatagaaattcaagcatttaatctgctatgtttgggttattgtcatcatccctaaccaattaaaaacgagtgagtctctggagaataaaaaacggagattcactcgtttttggtttcacgtggaactttttcaaaaaatcttaacatccggtttttggtgaaatctgttatttcaaccatcaacttgacgccaagactcaattggcatagtcgaactggtgacagtgtttgcccctgtatattcttatgattttataaacgtttttatcatcacgagctagtttcttaatcaaccaaacatcatgaacttcacaaagtttatggttggacgttaaccaattcaatccgtatactgacaccaacagcacggtgacgaaatacgttttcacggaggcagcatgatgaaaaacagacagaacaagcataaaggcatctcacaacgactggtcattatcggaatcggcgttttggcagtcatcgttgttacgattatctttttcgtaactcagcagaagcaaacaaaaccgacaactgcgccggctaccctcacgacttatcaggtcaaacgccatgagttgcggttatccggccaggtacaagctgtccgttcgcaaaagatcgatattccagaaggcaccgtccaaaatctcaccgtcaaaaacggggacacggtcgcggaaggccaacagttattgacggtctatcatcccgatgtccagcaaaagattgccactgccacgcaatcactcgcaaaacagcaacgcagccaaaagcaattggatgaccaaattaaccaactgaaaacatcgctgaatcaactggctgcagacgatccacaaaaatccgagattcagtcacaacttacggaagcccaaaacaatcgccaggatgcagctgcaagtgttgaccaagccacacaggagctgaatcaattgcaacaggatctaaacaccgccgttaaagcgccttttgccggccgcttatatatcgactatcaatcaaatggcagtcaaagcatcacggaaacctcttcagacatggaggcagtcggcgaagtgtccgaatttgattacaatgatgtcaaagtgggacaaagcgcaaccgtccaggcactttcaacgaagacgaaacaaacaacggcgattgattttattagtagtgatcccgccaaatccagtaagccgaatctggctaaatatgaagtgacggccaaactggatcaaggcttcctcaatggtcagtctgtcagcatcatcttgccattaggcggcctcgagatccctaaaaccgctgtccgtcaaggtgctgtctataaagtcgtcaatggtcgtgctgtccggactaagatcacttataccaaaaaagacaacatgtatgaagttactgaaggtctcgacagcggcgatcgcatcctccaaagtccgaccaagtcaatcaaaaacggagcgaaggtgactgtcgatgattgaccttcaaaatgtcaataagagttacggccaaggtgataccgcttttcacgttctcaaggatattaatctgcacatcgaccaaggcgagtttgtcgcgatcatggggccttccggatccggaaagacaacgctgatcaacatcattggatttcttgatacggcatttgagggcaaatatctttttgaagacgaaaatgtcgccaacttcaatgccacaaccgcctcacatatgcgcaatcgtaatgtcggctttgtttttcaaaacttcagtctgatccataatctgaatatatttgaaaatgtcctcattcctctaagttatggtggtaagcgccgatcagaagttaaaggacgaatcgccgagctgctcgattcggttggccttccgggagtcgaagataagctgccgcgcaatttatccggtggccagcagcaacgtgtggccattgcccgcgcgctggcgaattcgccgcaatttctgattgccgatgaaccgaccggcgctttagacagccatacttcagaagatattatgcaacttttcaaaaaactgcaccgacaaggcggtacgatcattatggtcacccatgatgaacatgtggcgctggaaagtgaccgtatgatcaaggtcctggatggccagatcatcagtgacacggaggtggcccatgcgactaactgagctgattcgaatttcttttcgcgcattggcagctaacaagcggcgcagtttcctgaccatgctggggattatcatcggtattgcctcagtggtgaccatcctgtcgttaggtaacggcatcaaagccgcgaccgtcaaaaacctgcaagcagatacacagggacaacaaaccgccgaaatcacctttaatcccaacagcagcggtgacgccgatgcgggctttaaggaaagcgatgtcgcccttgccaagcaaaccgcaccggataaaatccaaaaagtcgtcatcaaacatgaaaaagaacgtctgcaagtcatggggcaattagcaaatgccgacaccaccatgtcagtgactttagtgaataaaaccaaacccaacgtttcgcttatcgccggatccggttttaatcaggattccttacaagcagacggtcaggacgccttgatttccaagaatctggccaagaagattttccatggtaattctgccgccttacactcttcactaatcctaggcactaaaagttacaatatcgctggggttttcagcccacccaagtctaattattcggcattagacgtcgaagttctggttccggaaaaagcctatcgcgccggtcagctttcacaagaaggacgcaaacttgccatcacctacaaacgcggcagtgatgtcggccaactgaccaaaaatgtcgtgaagcagttaaagaaatccggcagtgaacatcgcagtggcagctatgaatacttcgattacggcgaactgcttaagggaatcggtaacgtcatcagcggcttaaccttgtttgtcagcgccattgccggaatttcccttttgattgccggtgtcggcgtcatgaacatgatgtacatctcggcctcagaacgttcgcaggaaatcgggatcagaatggcagtcggtgccacaccggccgaaattatgaaacagtttctgctagagtccgtcatgttaacactaaccggtggcatcatcggtctacttgtcggggccatggatgcgtggctcatcgccatgttcctacccttcaaaccggttgtcacggttggctcgattgtcggaacctttgcaatttccagcatcgtcgggatcgtcttcggcttgctaccggcaaaaagtgcggctaacaagaatttgattgatattttgaaatcgtagtgtttagatggccgctagaaacttaccaatatccgtccttgcgaatgtgcgactttggattgccactgcgcttcccgaatcttttcaaatggataaaccgtttggatatgcgctgttaacgttccatcggctaacatcatgagtaattgtcggtagccattaatccctatcgtgccattggtaaatcgaaatgtttggccggctttacgtaactgaaagtcaggcactgacaaggacaataatgcaaactggtcaaacatttcagcaagtaagtgcaacaattgcggttgccctacagtgtcaataatcttatttggaggcgtcacccgatgcagttgcgctgccaagtcatgttcataattcacaacgatatctgcgccaagagaagcgacaaagtcatgattgatcgtactagcaagtgcgatcacccgggcttgtcgttttttcaataactgaatcagatatgttcctacccctcctgaagcgcctgttactaaaactgtatctcccgcttcaaccgctgccgtctggactgctaacatcgcagcatcggcaccgccaataagcgtggctgccgcttgcaaagttgttgctgctggcacaggaaaaagaaacggtggcaatcgtgaatcaagatacgtttgattggcgccgcttggttgcacgccgatcacattttgtcctaccaaatgtcggtcgcgtaacagacccactgcctgaaccacgcccgcaaacgcatagcctacagtcaatggtagtttgaccggacgcatttgttttagcttgccttcttctgtcatccaatcatatggcaaaacaggtgtatacttcacttgaaccaaagcactcaatggtgaaactgcaggtttaggcttgtcgacaattttcaagccatcaataccactgtaattcgtttgaataatctgtttcattttaaggactccctcgtatattgatacgccaagtctagcgagtccgtcaggcaagatataataagaatactaatatttccgattcgtctattagtaagcacagatggttcgttcgctgcttgcaatatgcggctgtttgccaacacgtcaaaggaggacaacttgtgacaaccactatcggtagcatcctgaaacaaacccgcaaagctcaaaaactaacgcagaagactgttgctactgggatctgttcacaagccatgctttccgcaatcgaacatgacaagtacatccctaacgtagcgctgacactagctttatgccggcgccttggtctgagtcttgaaaccttaagtttggcggaaaattacgcgattagtcagaccgctgatttgaatgctaagttggatcgcttatgtaatgctcatgaatatgaggcgttattagctttcttgcaatcacccactacttcagcagccattgcaactgccgcgcaaaccgaagcttactattactacttgagtatcgctgaatatcaaacccatcatcaatcagcactgatgcatattcaactggctttagcacagcacagtgccggtacaccattgacagtgctagatcgcttaagttttgcgacaaaggccgttatagaagcgactgccggtcagaaaaaagcagccgaccgcgatttttcaaccgcctttgaagaacttgaaacaaccgcttatgcaccaaatctaaatagtttattctaccttcatgcatacactgcatataaagcaggcgactatcttgcatgtgccaaccaactgcaggcagggatcgattttgcaactgcacacggctctcattatatgttggccaacgattactacctacttgcatctgctgcacaaaagctcaagaatgctgacacgcaacgtgaagcaagtcagcgagcggcgatttttaaagagctttttggggatacgattttccacgacttctaaaatatcagcattcttatttttataaagtcccttctctgcttattctcaaagtatcaaaagaagggagctccatgatgatgaaaaacttatttaccaatgttatcgccgttcacgcaaatgcaaccgaggtcaaggctatgcttgccgatccaacgcaaatgcttaagtggattccggaaatcgatacagtcactgaagaccaaaatcaatttcagattattcgtcaaacaaccgcacttaatcagtccgaaatgatcactgtcacaacagccgctgacagtatcacttaccatagtactgaaggccgtcttgcctatgacttgacgtttacattcaccaccgctgacgatcaaacggttgtgacggaaaccttggctgtacctgaatcaactgatacccatctgccactaaaattacttgctccgattgccaaacacgcattttacgaaaatctaaccaactttgctaccttggtcgaacgcctagcctacgaaacaaaatgaaaactgcataacgaaaccgtcgcgcaaaagtcgcgacggtttttgctatcatgaccaagatagctcatggcagataacgatgtgggttataatcagaacacgtccaacctaaaggagatatccatggcgctttatctttttctcagcttattaattatcgtgttactgatcctgacattgctacagtatctcaacaccaatcgcatcgttgatcaacagctcacacagcacaaaatgatgtttcccaatcaaattcgcagggctcgcagtgtttacatgcgcggtatttttcgcgctaaccatcgacagcgcaacttacgcactactgccattgtctcggatatcctcgctgccatctgcttagtcaacgccgtcgttgttcactttcaacctgattcaacggttagcttgggaaattcgttacttcgcggtcaagcgctccatgtttcttcacagctcaatacaaccattcaaaacacttctttgttgatcggcatgttgctggcactggtgagtcgagtcgtttggttgtacctgtcacggtggcgttaccagaaactagttaaagcagacagcgaacacgccagcggccccactgaccttttctggacgcccgctgtgttacttcaaaatcagtatcatttacagctcggtattcaagcagtgctcatcgtcggtatcatctttcttgccttaaccggtctattcgactggcttccaacgccaaacaacgcaacatcacaaccacagtctcaatcggttcctgcatcccccagctcaagtcgtacctcggctccatcagtaaacaccgagtcaaatacaagcaatgcaagctccggttcaacaccgcaaaccacgcagccaacctacccgattgatgacatgaaaaaggcaccacttgccccggctgtcgcattggcaaacctgaccgatgccgaccgagctgccctacttttcacgatgtactggaccatgaacgggttgcaaacttatcaagtggctgaatatgccaacagtaccgatgaaacatacagctatcatctagtatctggcgccagtggacaattaatcgtcttttccgagacgattccgtctgtgaatcaatccgattatatgttctacgcctttattcagggtgaaaccgttaaactctacaacatgtatcagtccaagcaagctatcaccagtctcgccagccagtacaatcttactgtgacaggcacaaccattacgccaaacatgccggagattcaggatagtaacatcaatatgcggcaactcatcagtgctttcctaacagacccggcttttgccaaaatcaaatcagggttaacccaaggcgtagcggtaccactgtaagcttttgcgcctagtttttgccataacaaaagatcccaccacatgagtagaactcatcgtgataggatctttttaatcactacatttttaacaaaacggttaacggtgcgctttccgtttccggccagctaatccgaataagccgctcatcgttgccagcaacaatcccatgaggcttagtgtttgtgactgagtatcgcctgtttgtggaagtcgatgtttcgttccattatgcgtggagatctcggactgttgggtgccagtgcctgtattcggcaagtgatgatcaggcgttcccggcgttgtcccagtatccgttccggtatccggcaagtgatgacccggcgtatccggcgttgttccggtcccaggatcaggacttggcaaggcaacaatctcaaaaatagcctgctgcgtgttaacatttttcaacagattatttggcaacaacgccttgattcgttgcaggccagatgtgctgagagctaccgcatagcttcccggattaacaggagcttgaccgtctacaaagatcagatcgccggcttgaagctgaatttcagttccgtcacccaaaactaaccgataatagtcgtcattcaaagcgcctggctggccatcgtaagttttcttttgacgaccactgagcgttgcagatataggcgctggtgtaatggtgatggttccgctgaacgtttgatcagtaacctgataattaggaccaatcgctacggccaatttagccagcccgcttgctgtcaaatgatacgtgtacgtcccgacattgacgctgtcgttttcaactgcaatatctgtgttcgtcaaggcgatcttttgagacttttctggcagttggacagttatcgctaatccgcctgcttgacttgcacgagtgacaccgttgtattggaactgaccatgattaactgtggcattcaccgttagcggcgtaatcgtaatggtgccggtcaatcccgccaattcatcttgatctaactcgtagttcttgccaacagccttctgtaacttggcgataccggtttggctcaaccgataacgatacgtacctgctgctgtgccgtcatttgtcacaaggatatcttcccgagtcagttgtatcgttgttttggcctcggcttgcggcaggtaaaggcttgcctgtaatcccgcggcggcacttgctttagtatgaccatcataaacaaaagacgtgtcattaaccgtcaccgcaccggtaaccggtttgattgtaatcgtaccagtcaatcccgccaagactttggcatcaaattggtaattatcacctgatgcctgacgtaatttagcgattccgttagcatccaatttgtattggtactgacctacgcccacaccatcatcggttacaagaatgtctgtggcgttcagatgtaccgaaacaaccttagtaccaagtttgatgttggcagttaagtcgtgtgcctgactcgccttagtttgtccatcataactaaatgaaacatcattcagatcagctaatgccgtagctggcgtgatcgtgaccgtgccgccaagtttgattaagtcctcctttttaaattgataattatttcctgttgcctggcgtagctttgtcataccagcagcacttaacttatagccgtactggccagcattgaccccgtcattgacgacaacaatgtcagccgcggttagcgcaacggtttttgcgttttcgcctagtttgactgtggcctgaatgccctgagcttcactggccttggttttgccatcatattcgaacgaaacatcattgctatcaactgaggtggtagctggcgtgatcgtgatggttcccgtgactttagccagatcgtctaccgttagctggtagttatttccggttgctgctatcagcttagctttaccagcatcgctcagctgatagctgtacttgccagcatctacatcatcattctcaacaacaatatcagctgacatcagctcaaccgtttttttagtttcgcctagtgttaccgtggcttgaatacctttggcttcactggccttggtcttaccgtcatattcgaatgaaacgtcattgctatctgctgtggtaacggctggcgtgatcgtgatggttcccgtgactttagccagatcgtctgcagttagctgatagttatttccggttgctgctatcagcttagctttgccgctgtcgctcagactgtaagtgtatttgccaacggttgctccgtcattggcaacgataatgtcggctgatgttaagtcaacggtcttttcgctttcgcctggcttgactacggcttggatacctttagcttcactggccttggtcttgccatcatattcgaatgatacgtcattgctgtttgctgtggcaatggctggtgtgatcgttacggttcccgtgactttagccagatcgtctgccgttagctggtagttatttccagttgcggtttgcaacttagctttgccgctgctactcagactgtaagtgtatttgccaacggttactccgtcattagcaacgataatgtcggctgatgttaagtcaacggtcttttcgctttcgcctagtttaactgtagcttggatacctttagcttcactggccttggtcttgccatcatattcgaatgatacgtcattgctatcaactgtggtgatagctggcgtaatcgtgatggtccccacgactttagccagatcgtctgcagttagctggtagttatttccggttgcggcccgcaatttagttttaccagcatcacttagctgatagctgtactgaccagcgtttacgtcatcgttggcaacaataatgtcagctgacgtcaggtcaaccgttttttcagtttcgtctagtgctatcgtggcttgaatatctttggcttcactggctttcgtcttgccgtcatattcgaacgaaacgtcattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtgctatcgtggcttgaatatctttggcttcactggctttcgtcttgccgtcatattcgaacgaaacgtcattgctgtctgctgtgacagcggctggcgtgatcgtgatggttcccgtgactttagctaaatcgtctgccgtaagctggtagttatttccggttgcggcttgtagcttagctttaccagcatcactcagctgatagctgtacttgcctgcacctacaccatcattcacaacaacaacatcagccgatgttagagcaacaacttgtccagactcacccagcataaccgtggcttgaataccttcagcttcactggccttggtcttgccattatattcaaatgaaacgtcattactatctgctgtggcaatggctggcgtgatcgtgatagttcccgtgacttcagccaagtcgtctgcggttagctgatgatcgctccctgcttccctctgtaacttagctttaccagcatcgctcagtcgataactgtacttgcctgcatctacgccatcctccgcaacaacaatgtcccccgaggtcaggtcaatattcttttcagtcccgtcaatggtcaaaatcgcttgaatgcctttagcttcactgactttcgtttttccatcgtactcaaagtgagcatccttgcctgttgcgattgctccagcaggggtgattgtaatgcttcctgaaaccttatccaaagcctctgtcgttaactgataattacttcctgttgccgcctgtaatttagatttgccgctgtcgctcagactataagtgtatttgccaacgattactccgtcattggcaacgataatgtcagctgacgataggtcaaccgttttttcaatttcgcctaatttgattgtggcttgaatacccttggcttcactggccttggtcttaccatcgtattcaaatgaaacgtcattgctatccgctgtagtggtagctggcgtgattgtgattgttccagcaaccttagccaaatcgtctgcagtcaactgatagttatttccagttgcggcttgcagcttagccttaccagcatcacttagctgatagctgtactgaccggcgtttacgtcatcgttggcaacaacaatgtcagctgacgtcaggtcaaccgttttttcagtttcgcctagtgctatcgtggcttgaatatctttggcttcactggctttcgtcttgccgtcatattcgaacgaaacgtcattgctgtctgctgtgacagcggctggcgtgatcgtgatggttcccatgactttagctaaatcgtctgccgtgagctggtagttatttccggttgcggcctgtagcttggccttaccagcatcactcaactgataactgtatttgcctgcatctacaccatcattctcaacaacaatgtcagctgacgtcaggtcaactgttttttcagtctcgcctagtgttactgtggcttgaatacctttggcttcactggctttcgtcttgccgtcatattcgaacgaaacgtcattgctatctgctgtggcaacggctggcgtgatcgtgatagctcccgcgactttagccagatcttctgtagttagctgatagttatttccgattgcggcctgcaatttagctttaccagcatcactcaactgataactgtatttgcctgcatctacaccatcattctcaacaacaatatcatctgacgtcaggtcaaccgttttttcagtttcgcctagtttgactgtagcttgaatactcttagcctcactggccttggttttgccgttatattcaaatgaaacgtcattgccgtttgccgtggcaacggctggcgtgatcgtaatggttcccgtgactttagccagatcatctgccgttagctggtagttatttccggttgctgcctgtagcttagccttaccagcatcactcagattatagctgtactgacctgcatttacaccatcattcacaacaataatatcagccgatgttagagcaacaacttgttcagactcacccagcttaaccatggcttgaatacctgcagcttcactggcctttgtcttgccgtcatactcaaatgaaacgtcattgctggccgctgtggcaacggctggcgtgatcgtaatgattcccgtgactttagccagatcgtctgcagttagctgatggtcgttccctgctaccgactgtaacttagccttgccagtgtcactcagtttgtacccgtactgacctgcatctacaccatcatccgcaacaacaatgtcccccgaggtcaggtcaacggtcttttcagtcccgtcaatagtcaaaatcgcttgaatgcccttagcttcactggctttcgtttttccatcgtactcaaagtgagcgtccttgcctgttgctattgctccagcaggggtgattgtgatgcttcctgaaaccttatccaaaacctctgtcgttaactgatagttccctcctgttgccgcttgtaacttagctttaccgctgtcgctcagactgtaagtgtatttaccaacggttactccgtcattggcaacaacaatatcagccgatgtcaggccaacctttttttcagtttcacctagcgttaccgtggcttgaatacctttggcttcactggctttcgtcttgccgtcatattcgaatgaaacgtcattgctggccactgtggcaacggccggcgttatcgtgatggttcccgtgaccttagctagatcgtctgccgttagctggtagttatttccggttgctgactgtaacttggctttgccagtatcactcagctgataattgtactgacctgcatctacaccatcattctcaacaacaatgtcagctgacgtcaggtaaacggtcttttcgccttcgcctagtttgattatggcttgaattcctttggcttcactggccttggtcttaccatcgtattcgaatgaaacgtcattgctatcaactgtggtggtagctggcgtgatcgtgatagttccagcaaccttggccaaatcgtctgcagtcaactgataattatttccagttactgcttgtaacttggctttaccagcgtcactcagctgataactgtacttgcctgcatctacaccatcattcacaacaacaatatcagccgatgttagagcaacaacttgtccaaactcacccagcttaaccgtggcttgaatacctttagcttcactggcttttgtcttaccatcgtactcaaacgaaacgtcattgctatctgctgtggcaacggctggcgtaatcgtaatgttacccgctaagtcagtcgtgcttaactgatagttagttcccgctgcttgttgcaacttagcgataccagtctcacttaacttgtagctatactgaccagcattgacaccgtcattattaacaacaatatctgctagagacagagctaccctttgctctgtgtctccaagtttcaatgcggcttgaatacctttagccccactcgctttggtttgtccatcataaacaaaggtgacatcgttgcccgtggctgtggccgctgctggtgtaatcgtaacagtgcctgacaaatcggttgtgtctaccagatagttagatcctgctgcttgttgtaacttagcaataccggcgtcacttagcttatagctatattgtccagcgtttaatccgtcattattgacaacaatatcgcttgaggctaatgccactgatcgactcgaatttccaagtttaagcgttgcctgaatccccttagcgtcactggccttagtttgaccgtcataaacaaaggagacattgcttcctctggctgtagcttcggccggtgtaatcgtgatcgtaccagaaacttgattaatttcagtttggtcaattgtgacagtttctccgaggagatcttgcaaccgtgctaaaccgacactgttgagcaaatagtgatacgtaccggcatttgccgaatttttttcgaccagtgtaatatctgcagctgtcaagttcatcgtttgttgcgtaccatcactcaagaccaccgtgactgctaaatcattagcctgactggccagtgttgtcccatcatatacaaatccgccattaccaagcttgccggttgctgtcagaccaataatcaactgtgccgtacttgtacccgtaaagttaaaattagccgcagactgaccgtcgtcattagtcagtttagcaatgcgatcccaagcggcttgtgaaagctaaacggtgcaaacaccagttgccgtcagcgcatcagcggcaacttgattaccattggcgtcaaagaaattaagatcactcagctgaagtgtcccagcatcaaagccttcacccaaacttaatgaaaattgcttggtatcaactgtaattggctggcctgttgccgttgtggtttgagtcccgaccaacgcataagaagctgccagacgctgattgtaatagattttcgccgaaccgctttcagcgccgtaagtgtatgtcaccgtatacgttgtcggctgcgtattatccacgtcaccggtaacaataccgttcttatctttctccgaaacaatcttcccgttttcatccgtgaccgtccatgtcagttcgcttaaaggaacactggtgccatcttgtttgactgcatctataaaattcaattccggcttccaaacctggccggtgaaaagactgatatcatgggcacgaatcaccggatcatcaagatgaacattgtaatgacctgtatatgtgaccccatcgtttcctttcaaagaccagtcaaaactgaatccctgcgtttgcgctggcatcttaaatgacttgcttgccgtatcgaaggtcactttgaccccattcgaacctttgatgtttgaaacaacgatgtcttggtgagtaacaccagaaatggcgacatcaaagaagtcacttaggcttacgtgggctgagtctgtataagcatctgcactttgattgagcgcatctggtgtagctggctgcgcagtgcttgcttgtaaaaccgtgatccggttcgttgagaaagcttccttaccgatgaccggtgcgcctgcaatgatcactttaggcatcaaattaacgttgaaagcttttgccccaatggtcgtgacgctgctcggaattgtcagcgcatttaaaatgacattggcttcaaaggcttcttgaccaatcgtttttaacccgttacctaatgtcaggttgctgatagagttgtaaacaaacgcgtacttcccgatatcagtcacgctatctggtacaaccagctcattttgaatctgattgtatccaaaagccgtgtccccaattgtttgcaaaccgttatttaatttcaatgccggaattcgattgccaacaaacgctgcattgccaattgagaccagttttgccggaaatgcaattgcattattgatagtattgtatgcaaaggcactatctccaattgtctcaagtgccgttgctcggctaaagtcagcattccctagtgggccaaattcagcaaaggccagattaccaattgactgcaatttgggtccaaacgctactttcacaagcttcccgccataaaaagcctggtcaccaatctgctctaatgaatcaggcatatccattgaagttacagttgcaaaggcaaaggcttgatacccaagcgtcgttagctgactgtcaggtgccactgtaattaccgtaattttagcagcataaaaagctgcattcgtgattgtcttaatattagccgagagattaagtgagtcaatttgatttttcggattatcttttccgtcaatttgcggtaattccttagtattttcaataaactgaaacgccccatccgtgatcacgcgaacatcatcaccaaatgttaactgatcagtataaagatggaaaaacgcctgctgatcaatagttgctgcgttgatcgtcacctgaccaattctcgacatggcaaaggcttgattgccaaaagtcgttgccgcgccattcagtgatagtgatgccgcatacacttgataaaaagccttctcaccaagtgcaacgttatctggcacattgatagcgtctgttaccttagcaaactgaaaagcattatcaccaatcgtatttgcgcctgtaatattaacagaacctgtgatttgggcgtatataaacgctccctcaccaatatcggtttgtccatttatagtgagcgcttgcgccttgaggctagcaaatgcatttttatcaatcgtctgtgcattattaacggtaacatccccagcaatattggcagactcaaaagcagactcgctaatatcggcttgaccatcaatttttaaagatgaagctgtaagaccaaagaatgcctgtgtctcgatagtcttagcatcagcaatggttataccaccactcaagtttgcataagcgaaggtctttgttccaatattggcagtgccattaagagtgacagaaaccgcctttacactagcgaaagctgcactaccaacatcaatagcattttcaattgtaatattgcctgtgaattgactgtatgcaaaagcattttcgccaatggacgtgacggtatcagccacattaacattacccaaattattaagcgttgcaaaagcgccattgttaatcgccgtcactttaaaagtttggccattataggtaacagacgcgccaatgttaatatcggtgacgttggcgttggcgcggccggtaaccgttgctgtaccgtttgccgtatcaagactgtaggtatagtcgccaatggtctgcgtactttcagcagctgttgcattggccggagcttgcgtgttggcctgagttgttgttgccgattgtgctgctaaggatgcttgtgacgatgcagatgaagccgtcgatgatgctgcggccgaagttgtctgaacagctgcggatgcaagtgagcggtcttcttgggtcaccgtttgcggtttaactgctgccgaacctgtcgctagcgacttcgaatcggttgcatcactcgtgcttgctgctgaatcgccggttgacgctacagctgaactagcgatgcttgatgcagatgactgagttgcagaactagcagcgttgacagccgcactacttgaagcagccgctgtattttgcgttgttgtgccggctggctgtgtgttaccagtcgctgtttttgcagtcgtttctgctgtagcaccggactgactggtaacggctgtcgtttgtggggatttgctgtcagcgtgaacctcctgccccggctgaaaaagtgcaggcatcaataataatgccgtgcctgcaattagccagcgcttctttgccttgtacattcgaaagcgaacatgcactgtttgttttgttcgcaaagcagccaccgtccgtttagacccgaacttcacgatatgacccctcctagttatttaccacattaaaatacaaaaaaaggcataaatcctaatattgtagaatcatagtacttaccatttattttatatcattttcataacaaatgggtcacattttcaccgttcatcattttattaatagattgcattccccgataccgcctcggtttactggcagtatcgaaaataacattaacatttaaagcaaataaaaaagacacttgatcaactagttgaccaggcacctttccttaacgttttaaaataaccccaaccttccaatccgttccgccgcttcctgcaacctctgcggactcgtgagcaagccgatccggacataaccttctccatggcgaccgaatccgttaccagccgcaactgccacatccgcctgatcgagcaataactcggtgaacgtctgactggtgtatccagctggtaccggcatccatgcgtaaaaagtccccggtgaacttttaccgtgccaaccaatcgcggtggtggcagaaaaccaggcatcgcgccgttgctgatacaagtcgaccagtgccgggactgacgtttgatcaccgaggagtgcttcaatccctgcttcctgaatcgccggaaaaaccgagacgaacagatgatcctgaatcagattaatcgcttcaatcatgtcggcattgccagcagcaaaggccaaccgccatcccgccatattgtaggtcttggacagcgtgtatagctcaatgccgacatctttggcaccaggctgctgcagaaaactcaccggacgctggccatcaaatccaagcgcgccgtaagcaaaatcactgacaatcccaatctgctgggccttggcaaaggcgatcgtctcgtcataaaattccggggtagccaccgcggttgtcggattattaggataattcagatacagcagtttggcagccgcggccacttccggtttaattttcgtataatcaggcagccaattattttcggcggtcaacgtcattaagactaatttcacgcgcgctaacgtcacccccgatagataatccgggtagcccgggtccggcaaaagaatcgtttccccgggattcatgagtgcaagcggtaattcgaccaagccgattttggaaccgcccaaaaccgctatctccttctccggatccaacgtaacgccatattcccgcgcatagaactcggccgctgcttgcttaaatgtcggcagtccgcgaaaaagcgaatatttatggttcccgggccgcgctactgcttgctgcgtcgcgtgaacaatattttcgggtgtcggctgatccggattgccttgacccaaattaatcacgtcatgaccagccgcaatccgttcattgacatgcttgactaaactggcaaaaaattgcttcggcagtgcctgaagcacctctgattctgaaaatgtcactggataagcccctttttaataaattagcattaacgattgcccaacgatgcgacctttactgacggcttaataaagttccggccggcgatctgtgaaaaccgggatctgctggcgcgcggctgcaatgcgatcaaggtcaattgtcacaatccttacctgtggctgatcgtctaacttcaacagccgttcaccaaaaggatcaaccacctggctttgtccgccaaatgcattgttcggatcgttaccgacacgattcaccgcgaccacatatgcctgattctcaatggcgcgtgcggctagcaaggcattaaattgcggcaatcttggtgttggccattctgccgggagaaagaacagctgggtgccatcgctggccatgcgccggaaccactcgggaaagcgcaagtcataacaaattgccacactggccggaacaccgagggtaaaatgatctgccgttgctccggctgtgataaacttttcttcattcattaagcgaaaccgatgcaccttatcgtacttggcaagttgccgaccacgctgatcaaccgtcaaactccggttataaaagtgcccattttcggctgctgcaactgacccgccaacaattgccagatgatactgctgggcgagcgcactcaagaacgccttcgtccgcaacccatccggattcgcggtggtggtcagatgttcgagatcatagccggtattccacatttccggcaatacaacgacctctgcgccttgttgtgccgcttcagccacggcattggcaaccgtctgaaaattcttctccggttgaccaaatgcaatgtctatttgggctaatgcgattgttaattgcgccatttcaatccctcttttggttgattgcttcactaaaatgccgggacaatggaacccttaaatttcttagcgatgtaatctttaatcgtttgactttgataatattttttgatttgcttaatcactttatcgttacggtgtttggtctggacaacaaaataatttggatacgggttgttcgtcgtcttttcatggtaaattgcatcttgattgattgtgaggccggcatcaaatgcaaaattcgtattgattgcagcggcggtcacatcctgtaagtgggtcggtaactgtgatgcttccagttcttcaattttcagccccaacggattggagacgacatcggccttagttgccttctgactgataccagccttgagcttaataacgcccgcagcctcaaaaagttgcagcgctcgtaactcgttagacgggtcgtttggtaccgcaatcgaatcgccttttttgagcgccttcaaatccttaatcttcttggaataaacgcccatcggaaacgcaacggtcttgaaaacctgcgtaatcttaaagttcttggacttaatctgttcctttaaaaaaggtagggtctgatagctgtttgcgcctaaatcgccatcgtttaacgccacattcggactgttatagtcggtaaactgcttcaatttgatcgtcaaaccgtctttttgagccaattttgcgacctgtttcataatcagttcgtgcgggccggctgtgacacccaccgtaattgttttgtccgacaattgatcagtggcagacttgctactggcttgacttgtgccacatgccgttagaatcaccacaagactgagcgcaacgaccgctgaaaaccctaacttcacccatttcttcattaaaaatgcctccttgttgtcatgcgttttatgtgcgcatgggtgtgtttgcgttactgataagagtgatggacgggatgagcggattaagaaaacgaaaaagataacatggtcactagggtcggctggtgctcaagccataacgcgttcgccagcccagaaacctgcacataaggaccttggtcgcaatggccaaagcccggccatcacgaccaaggccacttatgctccggtttctaagcgggctggctcacgcttaacaaaaaaaggccctgctgaatcaaaaaattgattcagcagggccgacaatgtcggggtaccaccctggttcgttaccgtgtaacctctacgatgcctgttgacaccgagaccgtttaacgcaggcctaatgcgtacccgactcatcgccgaatccattccgcggtcattttcatcagacgcctgcatcgatttccacctgccatcgactctctaaagctgcgttgctgattactctccacttcatgatgtttcatcattttatcagttatttttaaagttgaaagcagtttatctgcgtcgctgggaaatgtcaagcattttgttttttctgttcctacagcaactgtgacacttgctttaagaaactttccaagtaaaacattttctggaaatattgtttaggcaggtcaagattttgagctcgctggttgattttatcgagtatctgattagccgtcattgggcaataacctccaaaacttctgaaagcgtcgattttggatacagttctctctccagagtcagcagctcttgataatttctgtcttttcgttgcatataacgctttgccgcatcatttttaacataaagctgagtattcggagaattccaggcatccagcagtgctcgttcaacagagtagatcgaaattttattcttatcagctgttaactttgtcgtgatgcctgctgaatagtaacgaccagttcggtattgtgcgtgaatatgattgtctttcaaagcattaggggctgcgtgatagcctcttgggaacgtcatcgtatatcgccaaggcatttcgtcacttaaatcataaaaagcaagtgctgtttcttgtgaaaatacccctcgtgaaaaacgctgagatataatactcatctcgtcttctagatatcctgagaccacatacgttcctatactcagttttgttaaaacaccttgggaaatactcttctctagttgatacgcactgacgttgtatcttctggcagttccaaacgtgaatgaagtgtaatcattcattaatttagctaagttggcactaattcgactcatatactaacctccaccacattagttagtatatcactttaaaaacaattcgataagcgaaaatgtctacacccctttctccctcaatactgagaaactttcaacttttaaaaattaaggttgacttcattgataacatcgcgtatgttaacaattatcacattaaatgagatttacatgagaggggttttgtcgatgaagctggatttagaattgcgtcccggcgctaatcggtttgtcagtgaagcgggggcacttgcatacttggatacgatcttaaaggattttaccaacccagtcgtcattactggcgagaaaagtttcgcagccttcaccaaggcttatcctggcaagttgaacttaccgatttatcattatgatggctctgccagtgacgagaacggtcatgccttggctgacgaaatcggtcaagccgatgccgtggtgggtattggtgccggccgcttgatcgacaccgcgaaagtcgcggccgaaactttgggcgctgaactcgtcagtatccctaccctcgcctctaactgtgcacccttcacgcccttggccgccatttatcatgcgcagggccacaccttcagttacgtagaatattttaaaaaatcagcctacatcaccttggtcgattacaacctgctgcttagcacaccgcacgactttttcgttgccgggattggcgacacgcttgccaagtggtacgaaatggacggcatcacccgccacaaagtcgatcaactgaatgcttacggtcaattgagtcgcgcctccgccaagaccattcaggcaattctgtttaaaaacgccgagcaagccttagctgatcttgacgccggtcgtgatacgccagcgtttgaagcagttgctgacaccatcatcggccttgctggtgaagtcggtggttttggcggtattgacggtcgtgctgcaggtgcccacgcgacgcataacggactttcatatttgccggaaacccacgctgttttacatggctccaaagtcgcctatggtatcttagttcagctggccgaaaccggtgacgatgacgagatccgatcattattgcctttctatgaaaagattggcctgccgacaaaccttgaagatttacacgttaccgaaaatgttgctgaaaaaatccttcaagtagccgaatttgcagccaagccagaagaaaccttcatcttagtcgacaagtcattgacgccgcaaaaagttgcggctgcaatggaaaaagtcgaagcagttacgagtgaagcggctgcataatcaaccgatatgttcagcgggttagtgatgttgaaaagccttagtggggaaatgctcactaaggcttttttaatcctccgtataacatctgcggctagatttgatttgttcgtttcattactgagagtctggctcacctttttgaaactagtaaagatctgggagtacatcatcacatgcttgaatttttccttaaattaacgtagagaaaactcgatttaacgtttatttgttccaaaaaatgacggttattccggaaaacccaacgttaaaatatttttgccccgttaccgatctgttgttctatattatgcgtaaggaaaccgatgctttaatgacaggaacgcaacgtcatgaattgatcgatgggggaaatgtacatgaagaacgctactattgtgaaggcagccaaacgacaaaccattaaccacgttggtgcgcgaaagtacctcaccagtgccactgtcgcaggatcaggtgcaaaatccaaaaatccggaagttattgagagattggatcatttggatggtgtcggaggcgcagcttttgatgtttagcaaacctgtttttgagcttgtcttttgggtgattctcgccttggccaatattggtctcggaatgctgcttggtgcgacattgatgcaatctcttttaaatatattaacaataatcccaataatttggatagttgttacaataatagaaatattgaccaagcgattcgcagacgaagaccagaaatcatgaataggataagcgaagggaacaaaaagaacttgaattgcagtatttggcaaagaattccaaacaattccaacttaaaaagaatcgcagcaaagtgcttcgattcttttttctaatccaaattaatctccttagcagctcgtcacataactttgtcccgtagcatctcgtaatgtcaaagggatcagccgcttacaactaattttttgccactactgtacggttttattttgatccaaataccccaatgtcgccgcagccacagccttagccgcgattagaatggcatcttcgtccagcataaagtcaggactgtggtggggatggtttgagccatcaggcagctggcagccgatgtagaagaagctgctgggaaccttctgcgcaaaataagcaaaatcttcagacggatcctgaacaccggtatccttgatcgccgtgatttggggaattttggctgctttgatcgctgtcatggcttgattcgtcaacgttgcgtcattgattaaaaccggataattatcgtcataatccagcttggtttgtaccccaaacatggcttccaacccgtgattcatcgtcacaatctgctggtgaattgtctgccgggtactttccttcatcacgcgcacgtcgccttttaacaccaccgcctgtttgatggcgttaaatgagccaactccgtcaaacgaaccgatcgtgacgctggccgtatcaaaaggatcgattcgccgcgatacgatcgtttggagcgccgtgaccaaataactgccagccacaatcgcatcgttgctcaaatgcggcatggaagcgtggccgcctttgccgataatcgtatcggtaaaattggcccggccagtttgggttgcgccagtatgatagccgatgagtcccgttggcattgacgacatcacatgaactccgatgacatttgtaaccccagctaagaccccagctgcaatcatgccttttgccccaccaggcgatacttcttctgcaggttgatgaatgatccgaatcgaacctgacaattgggttttaattttgttcaattccttggccaataccaataagtaagccgtgtgcgcatcatggccgcaagcgtgcatgaccccgggattttgcgatttaaacgggagctcattatcttcctgaatcgccaaggcatcaaagtccgcccgtaacgccaatttcggccccggctgcccgccttcaatatcgacgtacatgccataaccgtcaccacatggcacgactgacatatccaacgcagtgtaataggctttgatataagcagccgtttgtttctcgtgaaacgatacttccggatgtgcatgcagatgccggcgaatcgcaatcatttcctgttcatcgtcttccagcgcctgtaacaaggttgccaataaactcatgctgattttcccctccgtgattttgtctgaactttaggtaacttagcaatgaaacgaatcaaaaatgggcgcatggctttgaaaataacctccgccacgacaaacccgactgccaaggccatggcaatcaagatgacattataaatctgctgggctgcactcgcggcttttcccatggtaaaactacgcgcgcctagatacgcaatgccgcctgggacaagtgagactaagcttggtatgtaaatggtattgaccggcacccgatgacggatggcaaaataattacctaacaagccaatcaccaccgttgcggtaaagttaggcaacactaggctatgatcctgaagactaatcagccaatacgcacaccacgacacgccacccgtaatgcctgccggtagcaatgcccgtttaggaatattggtgatcacgccaaaaccaatgcttgataaaacactcacgataaactcaaccaataatcgcacgttaccgtccccctacgacttgggtcaacacaatggcaatgacaacgccagaaccaatcgccccggcaacaaaaaccgcatcaactgttcggacaatgccgctaataatctgacgcgacaagatttcccgaatcgcattggtaatcgccacccccggcaccaacggcatcaaggcactgataataatgttccccgaactggcaccccagccaatattagccagcaactccgctaaaatggccaccacaaacgcacctgttgcttctttaaaataaggcgtcgtcgttttccgggcaaccaactcagccgcaagataaccaaagatcccgacaaaaaaagcccaagccaagtcgccattggtcgctttaaaaagcagcatcggcgccaccgacacccagccagcgccaagtatccgcgcccaccaaggaaaattgatcacttgccgctcaatccgggccacttcttgtttcagggcatcaaacgtaatctgatgcgccacaaactcacgggaaagctgattcaattcatcgactttctgtaaattaaacccacccaaagaggatttgatcaatcgcgtgcggctttcattctccaaactgacaaaaacagctgtaatagttgcataacaagccaccttggcaccggcagcatggccaatatattcaaccgtcgtctcaatgcgggacgtttccgcgcccgcattgagcatgatctccccgaccttgccgcatacctctaagatttcctctgtatcaggctggctcatgatcccttgctccttaccgcgttatcgcatggcgttttactaattgtcggcttttttcgcgtcagtggcaagcaacctgccacgttttttattgaaacgtactaacgaagtcgaaaattagtttcattggtttctagtgttaaccaatgaaaaagtgcctgcctaagcaaacactttttctcagcatacgttatgttcatccaactaaggcgtattaaccgcaaacaataagatgcctaaaatgacataaagtgttgccagcatcagcacgacgatcaacagcgtcagcgcgcatttcaacaggagcgaaaactggcttttcttccaaatagcaaacagccagagtaccaacatcacaaccatcagtagcatgagcccagacaacaagatccggggtaaaaaagcgatcataccggtatacctcacaaatttgtgcctgcgattggtcgccattcatcgcgaatatcgctgaccgctctcaggataccaaggttctgcctccagcacaaaaatcctgcctcagcggctatcggcggcacacaaatgaagattaccgcgggacgaagaagaccgcaattaaaagcagtgcgaccacgtaacatccttgagtaacaagcgcccctctgatccatcccttcatcggctgcaagttaactgcatgttgactggttactaacagataaacaccgggtaaaatgccgaaaataggcacaaaagctaggatcaacaggaaaacaaaccacacagactggactagactttgcttcatcaaactggacaactccttttaaacgcgggcacgaacgacacttgaaaattgactaggtggtatagctaatacagctaccagcataatataaatttatttgttttcatagggcaacttctgctcgtttaatccctagttcagcaatttgttcgcggtttatcttgacaatctcaaaaaaaggggttgactggtaactaatatctttaggagtcgttttcgtccatatactgatacacttccttcaattttgcgactccgctttagcaacgggttttgatagcgtgcaaggagtgattaaaatgaatacatacagaaaaatcaatttgcgttgggtgtcgcatcaattacccgccttattaaaagtcaaacttgtttgctttgcgcttgctagtgccttccagcaactcttgtcaggcttggttttgggccagcttgttgaacttgacttttcggataacctgaagctagctgaattcattttctttgctgttggttcctttgcgatcactgccgttgccgaatattactttgtcaaagccggacaacgagccattaggttacttaaccaagcactaaagaaggactattttgatgatgccctctcgaagtcactttccgagtcatctgaagtatccgacgtcattaaccgtgttgacggtgtagccaaacaagttgaacaaagctactttgagtcgttgctaacagtccttcaaagcagtattactttaattggatcggtgattgtcctactcaaacttaatttcgttttaagtttaatttatctactgttttcattaatatcgctattgccaagcgcttttggcagaaataaactgacgcgccaaaccgagaaatggacacatgccaatgctgatttgatgctcatcattaaggatttatttcgcggcagatttgacatcattaattttggggccggacccgccttttatgctcgctttaacaacaagcttaaccttgaagaagctgagtatgaacgaatgaacacgtaccagtattggattcagtttgtgtcatggtcgtttgccatttttgcttatttatcccctatctttattggcattatctttttaagaaatgggtggtttggggtcactaaaggcattattgtgacgttaactttaaccgcagactccgtaatcagtggtattcgccaactcacgcagattcaaaccaagattgtcagcactgaaaagttacgacgcgtgcctattgtcaaaaatgtctttcttacgcctaacgccaaggaatctcagcccgccgccaaagatccgaaaacattagcaattaataacttatcggttcagcgtgaccagcacgttatattcaaccatctaaacctaactctggctccaggtgaaaaaatcattgtaaccggtccctctggtattggtaaatcgacactgttaaagaccattaccggaagaataaaaccgacaaacggctcgattcgcttccaggggcgcccgattactacaggtgattttgttctggtttcccaagatgtatggttgtttaatgcaactttgcgtgaaaatattacgttgtatcaaaattactcggatgaaacgcttcatcatattttgaatttagtcggcttagatcgcgaactaggtagcaatgcgttggaaacacacatccgcgacaatggctccaatttgtcaggcgggcaggcgcaaagaatcgcgattgctcgaggattattaagacaaagccccatcttcttattcgatgaaatttctgcaaacctagatgatgcgaatgcttataagatcagaaaattaatgtactcactcccttcaattgtcatcgaagtcgctcaccattacgatagcgcgttagccaaagaaaacgggattcacgtaaagaagaacttactgggtgcatcgcttactagctaatcgccatggtgttctgcataggtgtaaagaatctaccgggagcagttttgtattaaaaaaaccgcgatcacactgaccgcggtttttttaatacaaatattcttagtaccttctccagcaacccgttactgtgccaccttactaattcgtccctgttcaatatacacggacaaaatagcgacatcagccggattgacaccactgattcggcttgcttgggcaatggtttccggttgaatcttaaccagcttttgccgtgcctcggttgctaagccattgatcgcttcgtagtcgatgcgcgccggaatctttttgccttcaagccgtttcaacttggccacactagcttcttctttggcgatgtagccggcgtatttgatctggatctcaacctgttcaatcacccgatgatccaaggttggggtttccggtaagaactgcgctagcgtctgataattgatttccggacgcttcaagaagtcactggctaagaccccatctttaagtggggcaaaatgatgagcctcaagccacgggttgacatccttgggcttcaggcgggtgtgctcaaggcgtgctaattcatcggtaatggcttgacgcttagccaaaaagtctgcatagcgttgatcactaatcaggccaagttcatgtcccattggcgttaagcgcagatccgcattgtcatgacgcagtaacaaccgatactcggcgcgactggttaacaaacgataaggttcattcgttccttttgtcacgagatcatctatcatcacgccaatataagcatctgaacgcttcaacgtgaagggtcctttgccttgagcgcggcgggcagcattaatcccggccacaattccctgcccggcagcttcttcataaccactggtaccgttcatttgtccggcggtatacaaattccgcacaaccttagtttccaacgttgccttcaactgccatggctcgataacatcatactcgatggcataaccagcgcgcatgagttcggcatgttccaatcccgccacactgtgcagcattttcaactggatttcctcaggcatggacgttgaaaagtcccccacataatattccgaggtgtcgcggccttcaggttccaagaataattgatgccgcggcttatcagcaaagcgaacaattttatcttcaatggatggacagtaacgcggcccgactcccttaatcacgccggaaaacatcggcgcgcgatccagattctcccgaataatctgatgagtcgtcgcgttggtgtacgtcatccaacaactcaactgatctttgagataaaccgaatccggcgttgtaaaactaaaatgattcggtgttttatcgcctggttgttcttcggttttggaaaagtcaatcgtattgccattaacacgcggcggagttccggttttgaagcggcgcagcttaaagcccagctgctccagattttcagagagcttaatgcttggcagactattgttagggccggaactatacatgagttcgccgataataattttaccgcgggaactggtgccagctgttagcacaatactcttggcgcgataaatggccccggtagcagccacgatgccgactgccttaccatcttcgaccagcacttcggtagcgagtccctgccgtaagtccaaatgcggcgtatcttcaatgacgtgtttcatactgcggtgataggccgctttatctgcttgggcacgtaatgcgcgcactgccggacctttacccgtgttgagcatgcgcatctggatgtaggtccgatcaatattcttccccatttcaccgccgagggcatcaatttcacggaccacaattcctttggccggaccgcctaagctgggattacatggcataaatgccaacatttccaggctgatcgtcagtaataatgtcttttcgcccatgcgtgctgcagccaaggccgcttcacaaccagcgtgaccagcaccgacaacgatgacatcataagtgccggcttcaaatttctttacttcaggcatctgttttcctccaagcatctgtttttcacacgctcatgcgctacttacccagacagaactgactgaatagttgggtaattaattcatctggggcactttcgccggtaatttcgccaagcttgtcccatgccgcggtcatatcaatttgcaccaaatcaattggcatcccggcatgaatcccggccatgaccgcatccaggcttttgctagcttgccgcaataagccgatttggcgcgcgttggagaccatgactgttccctgactattttcaatgccgccaaagaagagtttggcaattcgctcatccagtgcatccatgccatcactagttggaatggcggttttgatgatttcatcggcatcaaccaattgcagcaacgccgccgtgtctaaacgcgcaggcaaatcctgtttgttcaacacgatgatccgtttcttatcagccgttgccgcaagcagctgcttgtcttccgttgtcagcggctcgctttgatccaaaaccagtaaaatcagatctgcctgcgtaatggcctgccgagaacgttccacgccgattttttcgactttatcggtggtgtcgtgaatcccagctgtgtcaacgagcttcaacgggaccccgcgaacattgacgtattcttcaaggacatcgcgcgtcgttccggcaacatcggtcacaatcgctttttcctcgtgcaacatgtgattcagtaacgagcttttcccaacatttggccggccgacaatggcagtggccaagccttcacgcaacacttttccttggctggcagtggttaggagctgctcgatcgcctttttgacggtttgagccttttccaaaagcattttagttgtcatttcgtccgtatcgtactccggatagtcgatattaacttcgacttgagccaacacttcaagaatttcctgccgcagctgtttgattaaatggtgcaggttcccatcaagctgattgacagccacctgcatagcgcgatccgtttttgcccggatcagatccatcaccgattccgcttcagtcaaatcaatgcggccatttaaaaaggcgcgcttggtgaattcccccggctcagccatacgcgccccttcgccaagcaacaactgcaaaatccgattggtcgccacgatcccgccatgacagttaatttccacaacatcttcacgcgtgaacgtctttggtgccagcataacgctgaccatgacttcatcaatcaaatcaccggtttcgggatcgacaatatgaccgtaatgaatggtatgacttttaacttgggtgagatctttgcctttaaaaaccttattggcagtggcaacagccgtttcgccacttaaacgaacaatactaatcgccccttcgccaggtggtgtcgagatggctgcaattgtgtcataagccgtaatagatgtcgccatatgcaaaaactccttttgatgatgtgagaatcgctgtgttggttggaaaatgggtggatgccgcggtgtgagacgtttgaatcctacgctgggtcgcgctcgatcataacgcgctccccggcgcagaagtctgcgtgtaaggacctcagtcgcaatggccaaagaccggccatcacgtctgaggccgcttacactccaacttctaaccgctccggctcgcgctcgatcataacgcgctccccggcgcagggacctgcatgtaaggaccttggtcgcaatggccaaagaccggccatcacgaccaaggccgcttacactccggtccctaaccgctccggctcgcgctcacaaaaaaagcgcagaacccagcctttccctatcgttagaaaaggctggataaagcactttgactacttcatcgtgattaaactgtgatcatcatactgaaatgttgcttacttgtcaaaagttagttatgggcgtttgggggtgacgacgacatagcgccggggatcgacgccttcggaatgggtgtcgacgtattgattgtccgccagtgttgtatggatcgccttgcgttcaaacgatggcattgggtctaagtaaatggctttgccggttgccagaacttcgcgcgcggttcgttcagctaagcgggtcacggttgcttggcggcgttcgcgatagtcgccgacgtccagcatgatggtccacttgcttttaccataatggttaaactcggtttgcgctaagtattgaatcgcattgataatcttgccatgtttgccgattagcaagccttcctcatcggttttgagttggaaggtaacggtattaccttggcgctcgctgctgacttgggttttgatgcccatgccgctagtaatatcttccaaataactttgtaccatcgccagcgccgtttgattatcgcgctttttagtggtgatgtcgttaaatgcgctggcaatctttttaccggcgctatcagttaacgctaccgccagtttgccggcgcttgatttcccggtggcaggttcttttgctttaggatcaggcgcgggatctgccggtggttcgagtggtttcaagttaacaatcgctggcttgcgcatgaatccaaggaagccattcttattttcctgaaccacttggacgctcacggcatcacgcggtaagcccagttgcttgagtccggcctcaatggctctttgaatcgtactgccttgaaaggttggcatcttgcttcctcccgttgttatttacgccgtttggtcgcttttttatacgcttttctaagtgcgcgttctttttccttctcggcccgtgctttttcttcacgttcgcgccgaatcttaaatggattttgaatcaacaattgctgaaccattgaaaaggcgttggtaacaacccaataaatggccagcgcacttggtaaggtaacggagaatacaaaaatcatagccggtgaaatgatcatcatcacccagctgcttgaattgcgggtcggttgggccatcatcgataaaatactggttcccaacgtaaataaggttgccagaatctgcataatccacaatgggtcaggttgtgacaggttcatccatagaaaagtcccggattgcaatgaagaagttcgtaaaatcgcttgatatagtgcgatcaggaacggcatctggatcacaatcggcaaacagcccatcaccgggttaacgccagctgatgcataaagcttttgcgtctcgtcgcggagtttggtttgggtttcggtgtcttttgaactgtattttttctgtagttcttttaactgcggggcgatttcctgctgcttggccatgctcttgatggacagatagctcaacgggaaaatcaaaatccggataattaaggtaaaggcgatgatcccgacaccaggatttccgccaaacaaattggccagccagataacaaattgaccggcagtataaaccacatagcgatcccagaatccggtactgttttctgacaccggcgccgttccacaggcagtcagaagaaagactagactcagcatgctcacaatgacgagcaggcgtttgaattgacgatttttcacaaataatccctctcttaatctcaacatggtcaaatgacctcgatatcttcgttcaggatgcccgccaaccgcatgacatgaatcaggttcttctttgtctcagccatatcaagctgattagcggacttacgcgcgataaccaaaaaatcagtctggggatcaatctcaggctttagctccaacagactctggcgaatatagcgttttatctgattacgcatgacggcagtgtggccgacttttttgcctacagagatgcccacccgaaaatgcggttgatcgcgtttcatgtgatagatcacaaaattacgattggcaaccgaatcaccatggtcaaacacattttgaaattcaacttcttttttgatccgatatgacttgcgcaatgatgctccctcacaatctggttctaagtatacaagatgacaagatgttttcctatatgtatcagcggctaacgacaggtttcttttcagcccgctaaacagcctcataaacgcaaatgaacgacaacgaccaacaatcgggtcattgccgttcattggttgtgacgtgtcagcgcatgggttaaacgcggtgccgggtcattcatggaaaaatgcgggtaagcgtttttgggtgactgcctttgctgtgctaattagtcgcttggtgatgttgcgagtggttcaagaacgtaccgattgattgcagacaacgcgctctctgtaacagagctgcctatcgcaactgttgacggctccgaaacgcgctcaccagcgcagaagtctacgtgtaaggacctgagccgcaatggccaaaacccggccgaccttatcacggctccgaaacgcgctcaccagcgcagaaacctgcgtataaggacctctggacccaatggccaaagcccagccgaccaattacggctctgaaacgcgttcgccggcgcagaagtctacgtataaggacctgagccgcaatggccaaagcccggccgaccaattacggctccgaaacgcgctctccagcgcagaaacctgcgtataaggacctcagaccccaatggccaaaacccggccattggggtctgaagccacttatactccggtttctaaccgcgctggttcgcgctctgctctaaaaaaaaccactgacgcggtcagtggcttaggcagataatactttacgtcctttagcgcgacggcgtgctaaaactttgcggccgttctttgtgctcatccgcttcatgaaaccatgaacacgttcgcgatgacgtttctttggttggaaagtccgcttggttgtcattgacgacacctcctagttaaaaccgatttatcttattaagatgacttgcattatcagacatcatccgagtttacacgaggaagcaagccgcgtcaaggctttttcactgacatcgtacatctttttaggatttgaactgggtcagttgcagcaatcgggtttgtggataacttgtgtgttgttaaaatacaaagcttatttcatgcacaggctgcgcacaagtaatttgcaagttcacatccatgtttacatagttatccacaggctgtaaatcgcctgttcatatcttgtgaaacacttacggctacaaggttttggttccacagacaaattgtgcataacttgcaatttggggattttggctgcaatcatcctcagccttggggataatttgttcgcaccctgtttctttttcgattttttgtttgtggaaaactgtgatttctgtggaaaactcctttctgcaatgctaaacttatttttgcagaacatttttggcactaaccgaaaatccatgatctaactaagctgattcgcctaaataatgccgttatctcgcttgttgcggcgtttgggtaactgattggctttacctaaatcgaaactagtgtacacttatccacctgtcgacaacttttgcggttgccttggctttttgtgcgctaatcattatgtttgactaccatcaatgttggctatcggttttgggacgccgatgccaaccgttattagaggaggggcgtttatgcccaatttagaggagctttgggcttacctgaatgataaattccgtgaagagttgaccccagtcggttacagcacatggattcaaacagccaagccggtcaaattgacccaagataaactcgaaatcgaagtacctgcatctttgcacaaggcttactgggagaaaaatctggttaccaaagtggtggaaggcgtctatgagtttgcccaattagaagtcgatcctgtcatcatgaccaaagacgagttgcagcccgcttccacgcatcagcatcaagtaaccgatgacgatgatgaccaacaactgacctttaaggcaaaaacgcatttaaacccgaaatatacttttgaccgcttcgtgattggtaagggtaaccaaatggctcacgcggcggctttagcagtagctgaggcgcctggtacgacttacaacccgctgtttatttacggcggcgttggcttgggaaaaacgcatttgatgcaggcgatcgggaatctggtcttggaaaataatcccgctgccaacattaaatatgtcaccagcgagaattttgccaatgacttcattaattccatccaaacaaaacagcaagaacaatttcgtcaagagtaccgaaatgttgacttgctgttggttgatgatattcaattcttcggtgacaaagaagccacgcaagaagagttcttccatacatttaatacgttatacgaaaatatgaagcaaatcgtcctaaccagtgatcgcctgcctaatgagattcctaagttgcaggaacgtctggtatctcgcttcaataaaggattatccgttgacgtcaccccgccggatcttgaaacccgtatcgccatcttacgcaataaagccaatgcagaagatctcagtattccggatgacacgctttcatacattgccgggcaaattgaaagtaacgtccgtgatcttgaaggggcgctggttcgggttcaggccttttcaacgatgaagaacgaggacatcacaaccagtttagcggcagatgcactaaaagcccttaagctcgacgatcgcagcggtcaactcaccattccgcagattctcgatgcggtcgccaaatattttcaagtcaccgttcaggatctaaaaggcaaaaagcgggttaaacaaattgttattccccggcaaatcgccatgtacttagcacgagagatgaccgacaatagcttaccgaaaatcggccaggaaattggcggaaaagatcacacgactgtcattcacgcccacgaaaaaatcatggctgccatgaccaccaacgaagatttaaaagcacatgtggtcgaactacgaaatatcctgaaaaatcgtggttaatccacttgtggacaactgccagaaacagaactttttgtccctatcacttatccacaggtgcataacttcatgatttgctgttccgcaaagttatccacagtttgaacacgccctattactattactttaaaagctttatattatatatataaaacgacgtacaggaggctcttatgaaatttacgattacccgatccacattcttgaaaaccttgaatgacgtttcccgggctatttcaaccaaaaccacgatcccgattttgacagggttaaaaatcgtgctcaatgatacagggctagtgctgaccggtagtgatgctgatatttcgattgagtcaaccattaacgctgctgatgaaagtaacgatttacaaatcggcagcactggtgaaattgtattaccagcgcgcttcttcagcgaaatcgttaaacggctgccagaaagcaccatgacagtagaagtaaaggacaattttcaaacggtcattacttcaggggcttccgagtttacgattcgtggagaagatgcgaacaactatccgcgtctaccggaaattaccgcagatgaagccttatctgttccggctgacgtcttgcgccaactgattaaccaaaccgttatcgccgtgtccactcaggaaagtcggccaattctgaccggggtgcatttaacgattaccggcgatcaactcgttgccgttgcgaccgattcgcatcggttatcgcaacgtaccctaactttgccagcagcaagcaatatcgattacgacatcatcattcctggtaaaagtctgacagaactaagtcgcatgttaggtgacgatgtgactaaaatcgaaattcgcattgccgagaaccaggtattatttgtatttggccaaaccgccttttattcgcggttacttgaaggcaattatccagacacgagtcgccttattccaacatccagcaatacgcaagccgagttcgatgcgccggcactgctagcttccattcagcgggccagcttgctgagtcacgaaagcagcaataacgtcgtgcgtttagtcctcaacattggcgagcaaaaagcaaccatctatggtaattcgccagatgtcgggaatgtcgaagaagtcttaagcttcaacaagctgaccggtcaggatctggaaatctccttcaaccctgattacatgaaggacgcgctgcaaggctttggccaaacagcgattgaagttgactttacggcaccgctgcggccattcaccttggttccaaccgaagataaagagaagtttattcagttgattacgccggtgcggacgttctaggcaatagaaaaacgcaaatacagggccaattaaaaaagattctagagtgtgcaaagctctggaatcttttttgatagctttcaacgatatgccgaggatcgatgaaatttaatatttccgcttgccaaaacggtaatagagactcgcagcaaggcaaccaattagcaagctgacaagtattaacggtaaactcaaccaattacggaaatctgccatgatgttaccgtagacatagatagttacagaaaaggccacaaacattccaaaaactgatttcatagtgggcgccataatttcctccttgtatagacggtttccacgtggcaagcaaaaatataaaagttaattggcgactttataattattgtatttaataaatagtttatttactgattttccctgccaaccatggaaatatcaaataatttaaaataaaaatcgtaaagctgaacgacatttttacgatgatattgtataaaagcgcttgcaaatagtcaatttaggcaccgctattttttggatgtcgatggaattaacaaaacttagcttgacgtctaaagactgagcttaactgtcttttggcataaagcgagacctaatccagagaatagacagttattcataagcagaaacggctttaggctaggctaaaaacgataaaactaaaaatttggctgtttttggcctttctaagtgtttttagtctaggggggcgtcttgggcttaaattgcctcagagccgcttaaatgcccgttttgaattgttttttacttggtataagggtataattaatttgtgttcgttagcggcaaatcacggtttctggtggtttgccgatacatttcggattggagggcgacgacgatgacaaccatcaagatcaccaccgcatttttgacattgggccagtttctgaaagaggcaggtttgattgatagcggcggtgcggctaagtggtatttgggtgagcacccggtaaccgtgaacggggcagctgaagaccgtcgtggccggaagctgtatccggatgatcagattaaagttgccgatcagacctatgtgatcgtgagcgcatgaagctggatcatttaacgttaaaaaactatcgcaattacgcaacggttgatacggcattttcacctgagatcaatgttttgatcggtgaaaatgcgcaaggcaagacgaatctgcttgaagcgatttatgtattggcgttagcgcgcagccatcggaccaacaatgataaagagttgattcgctttggtagtgattttgcgcgcgtctccggtcagatcagtcgccaaagtgggacgcatcagctggaattgattattagtcatcaaggtaagcgggcgcggattgatcggatcgaacagtcaaaactgtcgcaatacttagggcattttaatgtcattttgtttgcaccggaagatttggcgattgtcaaaggcagtccggctgggcgacggcggtttatcgacatggaatttggccagatgagtcccaagtatctttataatctgagccaatacaaaacgtttctaaaacagcgaaacgcatacttaaaacagctgaaataccatcaagccaaggatcttgtgtatttagacgttttgactgattcgttggcggcgtttggagccgagctgatcacggcgcgggcaaaattgctgcagaccatgtcggattatgctgctgccattcaacaagacattaccaagggacgcgaaaagttgcagtttgcttatcagactcaggttactgcggatcttcgacaagatagtgagcaggtctatgaagcattaggtgccttgtttgcaaagcagcagtcgcgggaaatcgagcaaggcaccagtttggtcgggccgcatcgcgatgatgttttgtttattgtcaatgataaggatgttgctaatttcggcagccaaggccagcagcgcaccacggctttggcagttaaattagccgaaatcgacttaatgaaggatcagacaggcgaatatccggttttgttactggatgacgttttgtctgaacttgacgctattcgccagacacatttattgaaggccattcaagccaaggttcagacgtttctgacgacgaccagtctggatggcattcaaaaggaaatcatcacggcgcccgctatttttcaggtgcaggatggcgttttgacgaagcaggcgtgagcaactgtaaacgatacgaggaggataaccagtgacggacaagaaagaatcggccgaagaaaagaaagaagaactggcagcagaatatgatgctagtcaaattcaggtgctgtcaggactcgaagcggttcgcaagcgcccaggaatgtacatcggctcaactagcagtcaaggattgcatcatttagtttgggaaatcattgataacgggattgacgaagcgttggctgggtttgcaacgcgaattgaagttgaagtcaacccggataacagtgtgaccgttaccgatgacggccgtgggattccagtcgacattcaggcaaaaaccggtcgtccggcgcttgagacggtttatacggttttgcatgccggtggtaagtttggcggtggcggctataaggtctccggcggtttgcatggtgtcggcgcttcggttgtcaatgcgctatcaacgaatctggacgtgacggttgttcgcggcggcaaacggtattacatcgactttgtgcgtggcaaggttaacacgccgatgaaagaacttggcccggcaccggagcatgagcatggcaccaaggttcattttcagccggatccggatattttcacggaaaccacaacgtttgatgataaagtcctgacaacgcggattcgtgagttggcctttttgaataaggggcttaagctgacgtttactgataagcgtgcggcgactcatgaaaagctggtgtttcattatgaaggcggcttgaaatcttatgttgatttcctgacgaagaagaaagaaaacctgctgcaggaaccgatttatgtggaaggtcaggataaaggcattacggttgaagtcgcgctgcagtatacgaatgactatcacagcacgctgttgacgtttgccaataacattcacacctacgaaggcggtacccacgaaaccgggtttaaaacggccctgacgcgggtgattaatgattatgctcggcgttccggtgcgcttaaagacagcgatgatccgctcagtggggatgacgttcgggaaggcttaaccgcagttgtttcggtcaagcatcctgatccgcagtttgaaggccagaccaagaccaaactggggaactcggatgcccgcacggtggttgatcgtaccttctccgatcacttcaacaaatttcttatggaacatccggctgacggcaagctcattattgacaaggccatgcttgccagcaaagcccgcttagctgctaaacgggcgcgtgaagtaacgcgtaagaagagcggcttggaaatctccaatctgccagggaagttagctgacaacaccagtaaagatccggaaatttccgaattgttcattgtcgaaggggattccgctggcggctcggctaagtcgggacgcagccggttgacccaagcgattttgccaattcgcggtaagattctgaatgttgaaaaagcctccatggaacgtattttggccaatgaagaaatcagaacgttattcacggcgatgggcaccggttttggtcaggactttgacattagcaaggcccgttatcacaagttgatcatcatgaccgatgccgatgtcgatggcgcccatatccggacgttgttgctgacgctgatttatcgctatatgcggccggtgcttgatgctggctacgtgtatatcgcccagccaccgttgtatcgcctgcgtcaaggtaaaatgatgcgctacatcgattccgatgaagagctacaggatattctggggcaactgccgcctagcccaaagccggatattcaacggtataaagggcttggtgaaatggacgccagccagctttgggaaaccaccatggatcctgacacgcgccgacttttacgggtatcgccaaaagatgctgaacaagcagatggcatttttgaaatgctgatgggcgatcatgttgagccgcggcggaagtttatcgaagaaaatgcggtctttgttgatccgaacaacattgacgtatgatagatcgcttttaggatgcagacaggtaaaatgagaacttttgagaggagacttttcgcttaatggatgatcgccaagaaagccggattacgaatgtgaatctcggcgaaacaatgcgtaaatcattccttgaatacgcgatgagtgtcattgtggcgcgggcattgcctgacgtacgtgatggcctcaaaccggttcagcgccggattctgtatggcatgaatgaactcggggtcacaccggagaagccatacaagaagagtgcgcggatcgtcggggatgtcatggggaagtaccatccgcatggtgacagctcgatttatgaagggcttgtgcggatggcgcaggactttagttaccggtatatgctggttgacggccacgggaactttggctcggttgacggtgacggtgcggcggcgatgcgttacaccgaagcccggatgagtaaaattgccgtcgaaatgttacgcgacatcaacaaagacacgattgattttcaggataattacgatggcaccgaaaaagaaccggttgttttgccagcgcgcttcccgaatctgctggtcaacggtgcgaccgggattgcggttgggatgaccaccaatattccgccgcataatctgtcggaaacgatttcggccttgcatgtgctgatggatcatcctgatgccaccaccgccgacttgatgcaggcattgccgggacccgattttccaaccggtggtgttgtcatgggcaagtccggtattcgccacgcatacgaaaccggtcgcggaacgattgtgttgcgtggtaaagtcgacgttcaaactgaaaagtccgggcgcgaacggattgttattaccgaaattccttacatggtcaacaaagccaagatggtggaacggattgctgatttggtccatgaaaagaaaattgacggcattgtcaccttgcgtgatgaatccgatcgtgatgggatgcggattgtcattgatgtccgccgcgatgccagtgcttcagttattttgaataatctctacaaactgacaccgctgcaaaccggtttttccttcaacatggtggcgattgtcaatggtgcgccaaaggtattgagcctgaaacagatcctgcaatattatctggatcaccaggaaaatgtcattcggcggcggacgcaatatgacctgaagaaggccaaggcacgggaacatattctcgaaggcttgcgaattgcgcttgatcatattgatgaaatcattacgattattcgcagttccgaaaccggcgacaaagcaaaagtcatcttaatggacaagttcaatctgtccgataagcaaagtcaggccatcctggacatgcggctggtgcggttgactggtctggaacgcgacaaggttgaaagcgagtataaagatgtggaggcagccattgccgactacaccgatattctggctaaaccggaacgtgttcaccagattatttatgatgaactgcttgatattcaaaagaaattcggtgacaagcgccggactgaactgctggtcggtgaagtgctgagtcttgaagatgaagatctgattgagcaagaagatgtcgtgattaccttgagtcataacggttacgttaagcgcttggcaaccagtgaattcaagacgcaaaatcgcggtggtcgtggtattcaagggatgaacgtgcatgacgatgatttcgtcgaacacctgatctccacttcaacccatgatgttttgctcttcttcaccaacaaaggcaaagtttaccgcagcaagggttatgagattccagaatacagccggacggcaaaaggaatcccgatcattaacctgctaggtgttggtgcgggcgagaagattcagacagtcattaacgttcacgaaggcgacaatgatgaccgctatttattcttcgtcacccaaaacggtgtggttaaacggacaccggtcaaggaatttgccaatatccgcagcaacggtctgattgcgctcaacttgaaggatcaagacgaactgaacaatgtcattttgacgtctggacaggataacatcttgatcggcacgcacttgggttacagtgtggcctttaaggaacaggatgttcggtcaatgggtcggacagccaccggggttcgcggcattcgccttcgtgatcacgattacgtggttggctccgatatccttaagccggattccgaagtctttgttatttccgaaaaaggctacggtaagcgcaccgctgccaaggaatatccaattaagggtcgcggcggtaaaggtatcaagaccgcgaatattactgagaagaatggtccgctggcaggggtcacaacagttgacggcaccgaagatattctggtaatgacggactctggggtcatgattcgcttcaatatccaaaatgtttcgcaaactggtcgggcaacactaggcgttcggttgattcgggtcgacgatgatgccaaggttgcaaccatggctaaggtcgaaccggaaagcgacgatccagacgacagcagcaaaccggatcagccaaccgatccgcaagccggaccaactgatgaacatgcgcaaccggctgacgggcagtatgcaggcaatgccgatgaacaggttaacaaactgttagatcgtgcggagactgataaacctgcacctgacgatggcgatgaagcctaactgaaccaagatgcgttgaagcgtcaatgaaaataccgttcgaatgggtagtttgccagttcgaacggtatttttgtgcctcgtttttcacgcggctcgtagcttgctccccaaaatttttgatcgctaatccatttacgttaaacatcatagttttgacataatgtatagcagacagtgaaaaatagagcgatgagatttgaggggaagagttatcatgttaaacaatgtgagtttaaccggccgtctgacgaaggaaccagaagtgtttaaaactgctgctgatttggaaccagtgcgctttacgttggtagtgtgagcaattttagttgaaaagcacaaaataaatataatgatttttagttattttttcttttaaccatatgataaaacaccgctgcagcgattccacctatcataaggctaacaacgagcgcaacagggtttaaccagttgtttggactgacgaagatgttaccatataaatagatcaggattgaaaataaaataaatataccaataacggaatttttgttttttgcatttttcatagtgtttaatctcccttattagactgtaatatgtattatacagatttttttggaaagaaaagcgtttataatattttattaagatattagattaatacatagtggatggtgaaaaactataaaagtactttcatgataggctttgacaatagttaagtgtataataagtgtaagcctagcactaacaagaataggtcttcatggcctttatggtctagtcgtcagggtgttgcacttgaattgtaaactggggaaccgagaaaaagttgacacttgccgccgcgtcccaatcgttgctcatacgtacaatatgttgtacaatattttcgaaaggtaaggtgccgttatggaagcaacgaattatagtgatttccgccgcaaccttaagcattatatgagtcaagtcaacgaagacgccgaaccgctactggttaccgctaaagatgatgatgacaatgtggtggttatgagcaagcacgattttgacgccatcgaagaaaccctgtatttactcagcaatcccaagctgatggccaaaatcaaacgtggtgatgcccaaattgccgctggaaaggctaaacagcacgagttgttaacggacttcgatcatgattaaaacctggaccgatgatgcttgggcggactacatgtattggcatgatcaaaacgacaagcggacaatcaaacgaattaatcaactcattcaagccattgaccgtgacccttataaaggcatcggaaaacctgagccacttagatatgcgctaaccggaaaatggtcacgtcggattgatcaggaaaatcgcatcatctacagcattgaaaagaaccacattaatattttcgcctgccgcactcactacagttaacaatcatattgaagtttgcggctcattcacaatctttgagtgccaaccatcgttatttcggtccaccatccaatatctctgattcatagccagcaaaaaatggattcaccacttttaacggttgcgaatccattttttgtgtcgttcagggtctaccatctatatatttggttatcagaataatataacaaaattgccttcacccaacactcacgcttttgtcgcatggctcatcgactttgctccgtcctgaccgtaatacgcattggccccatgcttccgataataatgtttatccaataaatactgcggcaagtgcacatcctgatgcgtcaaagtcaatgcatgataatccatttcggcgatcacttccaaaactttggcattataaaccgcctttgcaggagtcgcgccccagctgaatggcccatgctggctgactaaaacagcggggaccgcgttgtgatcaatgccgcgatccttgaaagttttgacgataaccttgcctgtattttcctcgtaagcttcttcaatctcttgttgggtcaaggcttccgaaatgggcacatcaccataaaacgtatccgccgcggtggtattcaaattcggaatatccatgtgcgccgaagcaaatgcaacggcccacggtgaatgggtatggacaattccgccaatgtcaggaaaggcattgtacaaaacggtgtgggttggcgtgtcgcttgaaggattcaactggccttcgacaacttcgccttgaagattcaccaccaccatgtcatcaggtgttaagtcctcgtaatcgaccccggaaggcttgatgacaaacaagccttgctcgcggtcaattcctgagacgttcccccaagtaaaggtaaccagatccaactttggtaactgcatattagcggcataaacttcttgcttcaatttttctaacattgttaaaacaccccttctcaattcatcaaccacgttactgtgatacagcgcggtccgatttaacatgtcgctttaggcaccaccgtttaaaagtaacgataggttttcatttgcaaaatctatgaaagcggttttaaagacaaaaactctgatataatgggacataaccacgtaaagtcggaaaggaagtttacttatgctcaaagccattgcacttgatatggacaacacgttactgaacagcaataaagaaatcagtgtcaccaatcgcgacgtgcttcgttacctgaatcgcaaaggcattcgcgttattctttgttcgggacgcccttttgccacgctgaagcccttcttggacgaattgcatgtgaccaaaaatgatgatgtgtgcgtctgcttcaacggcggtttggttcgcctagttcgtgatcacaccgtcattaaggcaaacaccttgagcaaggaacagatcaagccggtgtatgacctcgttaaggaaaacgggtttaagctcgatattgttgccgaagatgaagtgtattcactcaccgaatttggtaaatcaagctatcagacgatgattcctaagcagatgccgtttatcgataccacgttcagtaaagtgccggccaagcttccgattttcaaagtcgtggttgcaggcgagcctgccatgattgatgccgcatcagacgctgcccagtcactcaagcagctgaccgtcacgcgatcccggcgcacgctgcttgaaatcctgccgccaaatgtcaataagatgaacggtttaaaagccgcactcaacttttaccgcatcccgcgcgaacaactggccgcgtttggcgatgaggaaaatgacaaagacatgctggagtatgccggcatcggggtggccatgggtaacgcgattcctgaaatcaaacaaattgcggacattaccgtgggctcaaatgatgatgacggggttgctaactatttaatcgattacttccagatcagccccactgccattcgcctatagttaaatgaatcgtctaaagccggcaagcaattggcggcttttttcgtgtgcaggtcagcaggtgcttcatgatgggacattggtttttgccaccggctcctgaacaaaaccagcctgcacaaacagcggatcgaaaaagtccttggcctgcttcacttcttggattggatcagcggccttttccgtccacatctcgatcgtaaaggcgccgctgtaatcaaggcgttttagcgttcgcagacaaccggcaaagtccaccacgccagcgccaaacgggacatcgcggaattgccctttgctttttgccgtcaccgcttgggtatccttcaaatgaaccgagacgatgtttgcaatccccagttcaagctcgcgaccgacattgttttccggccaggctgacaagttgccaagatccggatacgcttgcaaccacggactcggaatctcatctttaatcgtcttaattttggaaagtgaattcaaaaacggatcgtccatcgtctcaattgccagcatcacttctttagccgcggcataggccacaccgcgcttcaggttctcgataaaatattctcgtgaagctaaggttttcggctcatagtaaacgtcataaccggctagttgaacattgcgaacgcccagatcactagccaaatcaatcgccttacataacatcgtcagacttttttcacggatcgccgggtctgccgagcctaatggaaaccgacgatggccgcttaacatcaatgtatggatccgcacccctgtttgccaacaagcatcacgcaccttcgcccgtttcgctgccgtccaatccaaccgggccaaccgttcgacactttcatcaaccgataactccaaaaagttgaaacccaaatcccgaaccattttcaaccgttcaacccaagattcggtcctgggcagtgctttttcgtaaattcctagtgaaatcacaaatgttccctccttgtgagcgcgagccggcgcggttagcatcaaactgcctatatcgcccactcatcccctatttttggcaacaaaaagctggcgggcgccttttgtccatgaccgatcaaccgaattgttaggctggatcggctaagctaagggccttcgccagcttgctgtttctgaatagttaattagcaacctgcacaacatcaattccttgacggcgcaagtcacgcactgctttttcattggcaaaattatccgtgatcaacacatcgaccgcagccaaatccgcaacatgataattgctggtaaccccgaccttgcgataatcagccacgcaaatcactttctgtttcgtccgcctgatcatggtggcattcacctgagcctcaaaaatattctgagtcgtgacgccgcctttttcactgataccatcgcagccgatcaacgtgaaatccgactgcatcgtctcaagaatctgaaccgcaaccgtccccaccaacgactctttagggtagcgaatttcgccaccggtcaggatgattgaagtttccggatggcggacacattcggtggctcggatattattggtgatgatcgtcaaaggcatcgttgccaattgattaatcgcccgccagcacagcgaactggaattcacgaataacgtactgtttttgacaatatagctcgggaccgcagccgcaatcgtatccttcaacagttcaatgccggaacgcgaggcatgattggcgggcgttgcaacgttagccttttcaaccagcccgtgatgccagtgaacctgccccatttccgccaaagctttcaagtcgcggcgcaaagtggtaatcgaaacgtcaaactgccgggccaattgttctaccaccaccggctcgccttgatccaccgcttttaggatcttcccccgccgtgcttgaacattcaccatcgagtttttcaccatcatcacctcataaacctagaccgccgcgcttagaagctaacgaacgcgtcatcataaaaatcagttcgtcttacttaccccagatacgaataatttcattctggaaatctgtagccgctttggctggatcaggtgcctgagtgatcgcccggcctgcaatgaacgtataaacatcgacacctgcaaataacttcaacgtgtccacgctcaagccaccggttacggaaacccgaaagcccatatcaaccaacattttcaccttagcaagatccttttcaccccatgagccaccggaaagcaaggcgtcgcggctttggtgataaattgcctgagtgacgccaatgtccaaccaggattgagcatcttctttggtccagttgccatataattcgatctgaatttctttaacctgcttctgggccgcctgaatcgttggaattgttgcggaacagatacacgtcatccaatcagcacccgcatccgccatgtttttggccacagtcgatccggcatcggcacatttcgtatcggcaatcaacactttatccgggaacaacgcccgcaacgcacgtaccgcaatcgttccttcctgcaagatcaaaatggtgcccgcttccacaatgtcgacaatgttgccaactgcgcgaatatcgcctaacgcactttccaacgtattgttatccaaagccacctgtaaatttggtttagccaaaatcgttcctccttgtctgccatgttgctatgactgttctgttaatttgatgattgataaggcgccagctcacggccgactcgcgcctgtcataacgcgctccccggcgcagggatctgcatgtaaggaccttggtcgcaatggccaaacccgggccatcacgtccaaggccgcttacactccgatccctaaccgcgccggctcgcgctcactatttcactaaatccgtatcttcacgcactcgttgttcaacttctttatctctcatcacattcttaacgccaatcacctgaacgcctttttccttggcatctttgaacatatcgacaaagtttgtggtggtgaagaccatgtcatattgtttagccgtgcttttaccttctgccaagttggtgtgttcaatttgggtaattggcagattcaaccgcttaaaggctttctgcacactacgcatcatcatcagactggtccctgaaccatttgcacacgatactaagattttcatgatatttttcctccatattttgcgttagcttggtctcattcactttttacgtcgagacccgagttgaaaagactactgagcttcttttttctttgcgacattttccttatattgctcgtaatccgtgaccattaagaagtagtttttcggatcatgccgatattcgagttggggaatcaagacgaggataaagacaaccaccacgatgccggcaatgcccaagatcttcatcaagaccgtgaagaatggccatacggtatcccagtcgaacatgccgaggtagccgccaaacttcgataacccgatccaggtggcaatgagcgctgcgccaaagacttggatcagaccgctgaagaatggcaggatcatcgccgcctttgccccggctcgccggttagcaaagaccccaaaggctgcattatcaaagaagagcgggataaagccggcaatgataatcgttggcgaatggaacaggagcaaggcgccgattgcgagaaactggcctaatgccccaaacaaaaacccgattgtgacggcgttgggttcgccaaatgcgaaggtcgcagccacgtcaatccccggaaccgaacctggcaacagccggtcggaaatgccggtaaagctttccgtcagttcaccaacgaaggtccgaaccccgagttgcagaatcgtgaggttaaccgcaaatccaagcgatgtggtcatgatataaaacaggaaactgccatttggcgccaaaccagaagccccttttgaagccgtaaacacgccgataaaataatcccggccaagaatcaacataataatgccgaagaaaaatagcatcaggatcccggtggcaaccatgttttcattaaagatcttgagaaagccgggaagttcgatgtcttccagccgccgcgcctttttcttggccttcacttcatgcgccttaaacttgtctgccagccacgatacgaaggcaatcccgaacatttgttgatgcgcgaccgcaaacccgccgccatcggtcaaatcctgggtataacgcacggtcatgttcgaaccaaccgcccagtaaagtcccaagacaacgcccatcacgagtaaaacttcgatccggcccatttgcgggaaacaaaacagcagaatccaaaacgccgtggctgcttgttgcacctgcacattacctgtcgtaaacaccgcgcgcagtttcgtccatttctggaaccgtaccagtaaaatattgaaaacaaacgcaaacaatagtaacaacatgacatcgccaaaagttcggccaaatgtcttgtccaacccttctgtcacggcgttttgcccgaagtacgggtcaatcaccgtcgccgttaagttgaaccgatcttttaacccggtcagaattggtcggaagctgttgaccaagccgccagacccaaccattaagatcatgtagccaatcaccgctttaaggaagccggcgatggattcgtataatggcttacgttccaagatgtacccgagtaagacgataaacccaatcatgtaagcaggttgcgtcaaaatatttgccgcaaaataatcccatacgctcactaagaaatctagaatttgctgcatgatgtgctacctttccccttcagctccccgcgtcaacaatcgccttaaaatcatcaacgctattgacggccaacaattggtcaatcaatccttccgtcattaacaagtcggaaagatctccaatattttgcaaatgctgctccggatcctttgctgctaaggtaaagaacaattgcgcctgtttttccggatcagccggatcgaaaacaactggcgccgggaatttggcaaacccgatcgccgtccccaaaacattttcactttctgccatcgcatgcggcatcgcaacgccaggcacaatcacgatatacggtccgtttttctcaacattgccgataatttcatccacataacccggtaaaatgtattgatgttcaatcagtttaccggctgcttgttgcaaggcatcttgccaatcttttgccggttcgggccgaatatcgaccaaatccttgcccaaaaagtctttcagtaacattgttgatccccacctcacctgttttatagaaatgccgggaatggcgtatcgtttggtaccgagaatgtatcgtggaaaccgcggtcatacatgaattccatccgatccttgtcatccggaaaagtgaattcaccgccgacttgccagataaacggcttgaacttgtattgcagccggtctttccgcattttccatagcgcttcgatttccttcgggtcagccataaagtttgtccagatatcgtaatgaaccggaataacgacttttgtcttcagtgattcagccatgcgtaaaatgtcaattgaagttactttgtcggtaatgccacggggattttcgccgtatgcccctaacgcaacgtcaattttgttttcgttaccatgcttggcaaataggttggagtaatgcgaatctgcggcgtggtataaatttccgcccgtggtttcaaacagatagttgacggcaatcttgttcatatcttgcggcagtttacccgcaagctgaacattcggatcgtcttcggtcactaatgcggtccgatcaaaactttcaagcactttgaccttggtttcgccaattgtcacaacatcccccggtttgacaaccaccgtcttttcagccggaacgccccagccttgccaaatttcacaaactttttccggcccatagaattttgcatccgggcaattggcattaactgctgccgccgtgttgatgtcgagatgatcgctatgaatatgactcacaaacaatgcgtccacattcttaatggcaaatgggtcaatcacaaatggctggttgcgcaggtttggctgcatctgctgtaccccgctcatccgcatcatctggtgacctttgcgcatcatcccgctaccatgtgaccgcttaccagtgccgcaccacatatcaactaaaatgttggttgcttctgccgtcttcaaccagatgccggtacatcccagccaccacattgaaaaagtccctggtttgacctgtttatccgcgatttcttcattcaaccaagtaccccattctggaaaagtgttaagaatccagtcttcacgcgtcacgttattgatcgtcttatctgccatgatgttcctccttaaattcgtttcccgatttcactttttatgttatggaatattgattgcgcttacaacaccgctatatgcaccttttgcggattatatgaccttttatgaactttatatgcatcttagcaaagacgatctgcttctttttatgaatcaaatcatatttcatattggataaatacataaaatacatgttgaaataactgccgacctcaaaatcgatccagaattctcgttggaaaaatttgcgaccatgtctgtaaaaaacatcacaatttagttaaacctgatttaatctataaactttatctacggaaattgcctaatcagtaccgccatcctacgtgcataaatttatccacttttactagtagatttattaaacgctatttgaatttaaattaaacaaattattcggcaaaatagggcgcgaaccgtttctgaatattttgacgattctttaagatttcattactttcgccaccacccaaaagcgcccaggttgctagggaaccatctaccgatcaagtaaaatatgcgtcagttatatcaactcattttcgcttcactattttgggatacctaacttttatttacctatcgcattggttctgattggcagcaatgaaatgcaaacgagaaaacgctactttagccgccactatcaggaaaagttttcactgaccgaaattttcatttggcgcttgacacaggcggcagggggttataagcttgcggttattaagaagaaatgagattattttgtctaaaatgtgatttctttgggtattttggtgttttattttcagattcattttttcttaataccatttaagagggggacgggcgtttatgaacaagaatgcgacgatcgaagcgaaacgtcactataagatgtacaaggccggatctagatggatgacggctgccattatcacatttgggacgagtttagttgttttaggcggtactgccacccagtcggtttcagctgataccaagacaccgactgcagacaaaacgacgcaacctgtcaaccaagctcagacgcagacggcgacatcaacggcaagtagtcaagcgaccactgctgatgccaaggataagacagctgagacacaaccaacaaccaccactacgactaagcaagtaaccgcacagtcgcaggccgcaccatcgacagctaccaaggctcaatcacaggcaagcacaacgaaccaggcgcaaccggcagcagcaactaaagttcaaaccggtacgccgtcatctggtgccaacacgcaaccagctgctaacaccgccacaaccaaaagcgcaacatccacggcatcatctgctgcaacgcaatcggccgcaccggctagcaatgctgcaaccacgaacgccgccaagacccaatctacggccgcaaccacaaccgatccaggaccggccaaccaagacactttgactaagggtaacgttaagggtttatggaatgaaggctatcaaggccagggaatggttgtcgcagtcattgattcaggggttcaggctcacgacgacttacgcctcagtgatgacagcaccgccgccatcaccaaagaaaaagccgaagctgccatttccaaattaggctatgggtcgtacgtcaacagtaagattccatttgcttacgattacgtcaataacgacagcgtcaacaccgggaccacggtggctggctctacccacggcgaacacgttgccggtatcatcgcggctaacggtacgaccgctgacggcgcaaccggcaatgaaaaagccaccacttacgtaaaaggggtggcgcctgaagcacaaattcttgcgatgcaggtcatcgatgaattcgcggatgaaaatgctaatgatatttcgcgcgcaattcgcgatgccgtaacgctcggtgccaacgccattcaaatgtcactaggcatcggcgttaccgagcaggatctcactgacgaagaacaagcagccgtgcagtatgccactgatcacggtgttttcgtctccatttctgctgggaacaatgccaacgcaggcagcattatcggttccaaaacgtccaatgatatctccacggcttactcgccaaaaaatgattcaaccatcggcgatccaggtgcagcggcttctgcaatgacggtcgcagctgaaaagagtgcaaccggtgacaaatcagaaatggacggcttttcatcatgggggccaatggcggactacaccttgaaaccggatatttccgcgcctggtgataacgtcatttccacggcgatcgatccaacgaccaatacccaaacctatgccactgaatcaggaacttccatggctggtccttacaatgccggcgcggctttgcttgtgatgcaaaaaatcaaagcaactcggcctgacctgcaaggagccgaccttgtcaaagcggtcaaactcgcgctcatgaatgccgccgatccaatgaaggatatcaattatcctgatacttacatctctcctcgacgtcaaggagctggccaaatcgacgtctccaaagccggcgatctaaccgttagcgctgaaggcaacaaagacgccggttcggtttcgctaggcaaaattggtcaaaccacaagcttcaccgtgacactgaccaaccatggtaagaccgcgcaaaattacgttgtcgataccaacggcggtccgctcacgcaagttcaagataccagcaatggcaacaccgtccacgataagaccctcatcggtgcaactgtgaatacggacacagccaacttcacgcttgctgctggcgaaaccaagactgtcacctttaagctatccctcgacaatactgtcgcggctaaccagcttgttgaaggcttcctaacctttaaggccggcgatacctcgcaaacaatcagcgtgccgtacttaggttactatggcgatctcaccacagaacaggtagttgatgcgtctgccaacagcggcgagtccatttttaatggcggctatttggttgatggcgccaacacaccactaggggtcaccgactcagcatcactcagcagccttgtgaacacagatacaaccggcaagtatacttggacgctggttccaacctacgtcgacaacaaaaaggtttcattttcacccaatggcgatggtgccagcgacaccgtctatccatatgtattttccaagcagaacctcaagtccgttaccatccagattctagatgcacaaggccatgtggttcgcgtgttggataaggaaaacaacacgaccaagtcctatctgcaaaatgggaatagctacaactctgacttaggactgagcacggatatgcgtctcgatccaaatgccttcacttgggatggcaaagtttacgaccaagcaaccggtaaatatgtcactgccccagacggcaaatatacttatcgtctggtgaccgaacaatacaacaccggcgctcagcaaaatcaggactttgatttaccggtcaccgtagatacggttgcaccgactttgacaggtctgagttatcaaaacggtcgcgtcaccgttaactacaacgatcaaggtgcgggtttcaccaagttcagtgacatcgcgttgaagatcggtggcaaagcttatggcgtcagtctgaacaacaacggccagaataacgatggtaccttgagctttgacctcaccgcagcccaaaaagctgcacttgaaagcagcgatggcagtttaactctgacgctaaccgatgtcgccggtaataaaaccagcaaaacgctgcaggcggtcaccggtacccaccaagcaacaacgccaacagcaacaaccgccaatgtggcaccgcagttcagctggaaagttggcgatggcccatacaaccactggcgtacagatggcttcgttcaagcagtatccgatcaaactagctttacggcctatgctcaagttccagctggcgttgattggattgtctatgccaccgacgccatgactggtaaagtcttctccggtaaagttgacacgaagaccggcaatgtcacctttaacttaaccgcatccgctccatacggcgactttgtgggtaccgtcctcgcgccaacagctgattttggtacctatgaacaagccggccgcgctaacggagatgaaatggtcgtcttcctggatacagatggcaccgcgggatatggccacttcagccagaaggatcctcacgtcgcggtaccgctgcaagataacgctaaagccgcggctaatgtgaaaacaaccagcggcgctccggtattgggtggtcgtgccttttctcaaatcaccacccacgcacaaccaacggaagggctgacgtttgataaattcaacgacaattccttcaccttggtcggcgccgataaagtagctgacatctacaatgccaaaacaggtcaattaaccatcaccggtcatgttgatcagccagccggcaagacgttaaccgtcaccagtgcaaccgagcctgcgaagacggtcacgattggtgcagacggcaagttcagctttaccgtgccattcaaagccgcagaacaacaagcgatcggctatcggctgacctcgaccgccactgatgggtccaaaaagactcaaaccgcgtatggcgagctgcaaatttacctcgacaccattttcccaacgctgaatatgccgcaagctgatacgttgcaggttgatgacaaaggcaattacgaaatcaccacaaccagcgacaccttcaccgtttccggaaccgttaacgacaacatcaatggctaccgcctctacacaaacggcgataacatcgtgcaccagaagaatctagctgggttcaacaaccaccttgatccgctgtcaacgacttccaacccatatggtgcagccgccttcacgcaaacctatcaattagcagacggcgacaattacttcaccatcaccgcggttgatatggtcggcaataaagtcaccaagatcttccacgtgattaagaccaaggcaacaacgccaacgacaccagaaactccgaagacgccaacgccgacgccaaaaccaggcacgggcgatcaaactggcacggaaaatcctaaagggcctaccactactccgaaaacggatgagcaaggcaaaaccaatccgacaccaaaattcgttgatttgacaaacaccaccaagggccaagacaaaaccggtactactgctgcaactggcaagaacaccaaacaaaccgccgcagccaaaaccatgccgcaagctggtgaagcgcaaagtccactggctgttcttggccttgcaatcctaagcatgctcggcttggcaggattcgtatcacgtaaaaagcgcgtctaagccaatcaatcttggttaaggttgaataggaaaggaaggagttgagagtatgcagcccgtcaccattacaaatcttgatcggctcttaacggcgctgattcaagccaaacaacgcggtgacctggagcaaaccgttattgactgtctgccagtcgaacccggcgatgcccatattttcggcgtccgggcagacaacggtgaaatcaagccgctcattcgcttccgctttgatcaacctttgcctgccgattatgctgccgtactcaagcgtcatgggtttcagcttactgttgagcattttaagcaagtgccatgagtgaatggcagcgcattgaggcgtagattcggttgggatgtgttttatctgtaaattaaaacaggcattgtaccagtgttttgggctggtaggatgcctgtttttttcttttgaaacacgtcaggattaagtgaactgagaaaaaattaaccaatcttttgcatatgaactaatttttcataatcaatgcctcacgctttttaacgttccaccagcggcaccaccgccccaactaaattcgcatcgttgcgatacttagccgccacaatctccggaagcttaatcgtcctcgctgcaagtggcgttacctgcagataggtagcaacccgtgcccggatttcgtcgatgacacgtgattggacgctaatcccgccgccgatgacgatcttttccaggtctagaacggtttgtatgttgtagatcatcgccgccacgccttgagtgaaggtggctaggattgcagcggcgggtgtgtcgggcttgagggctttaaagacgcgtgggccaagattgtggccgcgaatgtgttgggcagcagccatagcgttgacggttttgactgctgaaagtccggcggcagtttgcgcgcgggtgatggggttgaggccgttggtaatcataaaactcggctcgccactgacatcatgactgccggtatagagtgtcccgtttaaaaacagtgcggctcctaccccagtccccagcacgatcatggcgctgttgatggtgccggcgagcttgccttgccaatgttcggctagggcagcagcattgccatcatttccgatcacgaccggtatgtttaaatgagcagcatccttaagtcgcgcagccagtggcattgtttctaaaaacgggagggcagcacaggttttgacgatgccttgctgctgattcacaacgccaggcaaggccaacccgacgccagcaatttgtccttgatatcggtggatcagcgccgccatggctgccataaattcagcccgactgttgcgcgcagtcggctgtttatgtttctccgcgagctcgccttgctccgatactaacgcatatttggtcgaggtgccgccgacgtcaattgccaagtactgcttcatggtaatcctctcttccacagtgcgcgattgctacttaatcggcgccttgattcgtttttcatacgcatccagccatgcttgggtgactggcgtaatcgtggtcgtttgattcggatcgggatttgccatgaggatcaccggtttctggctggcagtggcgacgctgaaggtaaattccacattcgttgcgactccccaattgccggcgcggtctaaggcgatgagcgaaaattcacctgctttaccataacggcgctttaacttttcaataaacggataaaccgcttcatcgcaagcttcttgcggcgtgcggccttcacccatgcggcggacgatttcgtaggacagacagcccttcatgatatcttcgcctaacccggttgccgcggcgcccccgatgtcactgtcaacataaaaaccggatccggacagtggcgaatcaccaactcgacccgggcgtttcataaataagcctgatgttgaggtcgccgcggccattgatcctgttggtgccagcgtaatagcgcccaccgtgtcatggccatcgtaaggtttgattttggcgtcagcgagttcggcccggcgcttttcccaacgttttttggctcggtctgttaacatatttcgcatttcgaagccatttaactgggcgtactgggtggcaccttggccgacaagaaagctgttgtaatgatcatggctgagcgcgcgggcgaccgaaactgcatgaagcacctgatgaatgccggcaactgcgccttgggccaaagtgtcgccatccatgaaggccgcatccatttcaacttcgccattttcattaggcaaaccgccatacccgaccgatttgtaataagggtatgcttcaacggttttgatcaatgcttccactgcatccccagctgtgccgtttgcttgcagcagctggctggctttcttcacgccatcgtgggccatgcgccaagtggcaatcacgccccaagttgtttcgttcatttgtccatcgctcctaaccgaatcatcgcattcatatcaatcatcatatttaacttgagatcgtgctcatccatccactcgtccgcgttatgcgcaatgcctttttgaccgggaaaagaaggcccgaatgccacaatgtttggcattttacgtgcataagtcgccccagttgtggtgaccggttgaccctctcgccccgtcacctgttcatacgcttgcgtcaatgctgccagccgcggatcgtttttgtcatgcaggatccccggcatgctgcgaatcacagttatttgagtgcggggaaaagcggctgcagtcagcgcgcgggtgacgtcatgctcttgataagtcacaggatagcggaccgccaaaagcagactgatgaccgagccgactttttgcagctgatagggtgtcacaatcaatcggccacttgcggcatcggcaaaatccatccctagcccttcgccgtggtgttggttcgccagcgtttgcaccaaccatcggcaatagttggcaaactgtccgcggatcgcatgttcgtctagcaattccttggctaaggttgtgatcgcatttctacctaactctggggcattgctgggcgcgcgaatgccgctggctgtatagtgcttgttgttgatcgttgcttgcagatggtcaggcacatgatcgcttgcttggtcgccggtgatggtggctactttgtcgagagaatcatcggtgatgggcgtgcgcaggttaaaattcacaatgccgcgttcgccgtatacaaccggaaatttgcagtctggcgtgaaaccaaactcaggcggggcttccttggcgagatacaaagggacatccgccgaaccgctttcttcatccgagcctaaaatcaaccgaatcgtccgcttaggctgaaaaccggcatccttgagcagcttcatcgcaaataaacaggcaatacttggacctttgttatcaagaattccccgcccgtataagcggccagccttttccgaaaggtcgtatggtggaaaataccacaccgtttcgcccgcgtataccacatccaagtgaccgacgatgccgatataatgctggtcatcgtcaccccactgaatatacgccattgccgaattaacaatcccggttttaaacccataagcctttcccagttctaccgcagtggttaaagccatccgcggaccccggccaaacggcgcatcggcttgttgcggcccgcgaacacttttaatttgcatcatgtgacgcaatgcttggataaaagtcatccgttgcgcctcatataaagctgccagcgtttcatttttcattcgcacttacttccttaaactcacacccgatcccgcgttaacgtggacttaaacgaatatttgtcagcgcgatagtacgaaatgtcgtaaagaatcggcttggcatcggcagtataggtaacggaatggacgagcagtaacggatcgccttttttcccgtggagtagtttgatcatgtccgggtcgatcaacacggcttcgacttcctgatgcgaataggcaatcggcacccgcttttcaattaaggcaaaaagcgagccctcaaagtcgtgtgcttgcaagccttcaatgtattcatggcaaattgcaacatgctcaacggtcatcggttcttcatcccagaaccgccgtcgcacgagcaggtcaacggttttgtttgcctgctgatcccgtcctagtacgcgcgcaatttcttccgggatcggatccagcgggccaaaactcagcacttcggtacgactcttcttgccatatgcgcgcgcggcttcggtaaagccttgtaaccccatgcggccgctttcgactttatcggtatacgacatgacataggtgcctttccccggtgacttcacaagtaattgctgccgaattagtagttcaatcgccttgcgcaccgtgagtcggctgactgcgaactccttagccaaatcatattcagatggtaagcgctggctggtagtgtacatcccgtcacgcacacggcggcttagttcatctgcgacctgttcaaattttgccattcgttttagcctccgttttctttaacaacgcttttcgtaggttcgttgacgttacgttcattttgtcatggttcatggatgaagcagcggctgctttaaggccacttttgccgttcattcagctgcgacgattgcgcgcgctgctgcgattgtatgcccttccattttttgcttgtttttcacgtgctaccagtttatgcttagtatgcactgaatagtatatactacaagttttattttttgaagcgcctttttcccatgtatcatcgcgaaaaatccggtctgctaaattcactcgtcagtggtctttttacgcgtctgctcacaacctcgtcaaaaattaaataaaggaagtgtcatcatgctgtcatctgcccatgttcccgaagacaaacgttcgccgcttctggcgcttggcatcttatcgatctcattcttaatgtcggttagtaacgcggtttccggaactatcccgctgatggaaaaatatttttccgatgtttcgcgggccaacgttgaacttctaatcgtcatccctactggcggcgtcctgcttggaacagtgattagcggcctggtttctaatctgctcgggaaaaagtatacggtcatcgccggcctgacgatttccatgatcttcggcatcatcccggcgtttattttcaactaccctgccattttaatttcccgggcaatgtttggcgtggggatgggggttttcacgccgctcagtgtgtcttacatcacggatctgttccctgaggagacgcggaatcgcctgctggggtggcgtaattcggttggcgcaattggtgatgccatcatgcttttcatcgccggcttcttgatcaacatcagctggcacaccacttacttagtctttcttttcttattggtgccgattattttagtgatgtttctggttcctaagcgctacgactacatcgtctcggaaaacggtaaagaagtcgaagaaactgccaaggtgaagccaacaaccaacggcggcgtcattcagctggccatcgtcttcctatttgtctgcttgttctactcggccatttcgctaaaactcgctagctacatggtggataatcatgtcggtagcgccgccgcagccacccatattttcggctttctggtactgtgctcgatcatttccggcatcgcgtttgaaaaaattgccaaatggtgcggcaagtataccgtggccattttcgatattgtgaccgcccttgcgatgatggcagtgccgtttgtccattcaatcccggccttgttggtactggtgctggcggctggtttttgcaacggaatcatcaatccggccttaaccgcgcgtatggtccactattcgcctaaggggtcgatgaacttcaccacttcgattatcatcatcggcatcaacatcggcttcctcatcgccccttacttcttccaattcttcggcagcatcattggcaatgctgaccctgcaaccatgatcttgtggagcggcattttctatatcctgttagccgtttacgacttggtgatcgttaaaaaagaccgcttaagcatttgatcgcaaagattaggaggcgctacttatgaacgacaatgttacttggtttaaacacgctaaatacggcatgatgattcactggggattatattcgctgctggcaggtgaatatcgcggtgagtcatcgagtgcctacgcagaatggattcagtccaaatttcaaataccaaatgccgaatacggtaaacttgccaccgccttcaacccgttatactttgatgccgatcagatcgtggctcttgccagaaagtgcggcatgcagtatctggtcgttaccaccaaacaccacgacggctttgcgatgtatcactcgcaagttgaccgctacaacgtatacgacgccaccccgttccaccgcgatgtgattgccgaactagcccaagcctgtcatcacgcaggcctcaagttcgggctctattattctcaagacctcgattggcacgaaccggatggcggcggctacaaatcaaacgacctcgaaacagccggcaccacttgggacaacagctgggacttcccggacgaaacacagaagaattttgaccgctgcttcaatcgaaaaatactcccgcaaatcaaagaaatcatgaccaactatggtgacatcgccacagcctggttcgatgtcccgatgaccctatccgaagcccaaagccaaaccatttatgataccgtccgtgccttgcagcccaaatgtctcatcaactcgcgcttaggcaatggcaaatatgatttcgtctcactcggcgacaacgaaatccccaaagacaaagctgccatgacccaaaccgatgtcgactataacgacatcaccggcttcaaaccgtcaccgctggggttatacgaaacggctggcaccatcaatgactcatggggcttttcttatcacgaccagaactggaaaaccccgcgcacactcttccgctacaaacaacacctcaacgattttggcattaactatctgctcaatgtcgggcttgatccactaggtcgcgtgccgatgatggcagaagagaacttgctggcggctaaggcgttggaggatgaagctttaaactaaatacgaccataaaaaatggaacgtctcaggctcacaaataaagacgttccatttttattttcgatctaagcaagcttcttcactaaaaactgatccatcaactgatgctgcgcgttgacaagtgggcgcggtaaatcagtgaaaccaaactcatgataaacatgaacagcagttttaagcgtatggtaagtttcaagataaaccgactgatacccgacttgccgagcgtaatccaaggcatgctgcaacaggcgcttaccaatgccatggccttgcaaatcaccgtgaacatagaacttttgcaattcagcaacaccgtgagtcgggtcatactctgcaatgccaaccccaccgagaacgcgaccattttgcgtggccacaaagtaatgccgctttggctctgccgcataaaactgacttaagtgatccagtccagcatcaaaatacacggtacccgggcggtcaagatcggcggctttcagacactcccgaatgagtgcggcaactggtgcatcgtctgcagctgtcatcggacgaatcacttcttcatgaactggcgttggcatggacatccctgctttcgaaaaggtttaagcaaaatcatagtattttttcagctaattgcaaggcttctctgtgatgttccacggaaactgggcaaatacgaaatgtttcacggggaacactctcatctcggggttattaatgattccttgctatgcactacccgcccttcacaacatctaatcaagccgcgtcatccatcccgcatccgcatgggcagcaaacgccatctcaatatccgccggtaaattacgctgcagtgacaacggtaacgccaacgcctcctcacgggtgaaagtgcggacattttcggtttcgacgcctgtctttaacgtttgcgtcaccggctggcaggcaatgaaaaacttgtatacatcctgcgtgctttgcggtgcatagtcacgcttccggaccgaataaaccgcgagcagttgcgttggtttgaccgtcaagccagcttcttcgcgggtttctttgaccgcaatctcaccagcactataacccaagtccgcccagccgccgggaatcgaccaagtgccacctgcccgctcttgcaccagcaaaaggcgatcctcgataaacgtcactgcccgcacatcaaccttgggtgttacataaccggtatcctgatccacaaataaacgcgcttgctcaggggtcgcatcgctcaattgcagcatcagttgcttggtgatagccgctaattgatcgtaacgttcccgatcaaacacatcttttgtatagtaacgaccagactgcgcaatagcctgcagttggcccaataacaagttcaagtcttcgcttggcatgccctcgcctcctgctatcattgtagcaaaattgcagctaatgccggtttaaagcaaagaaagcttaacttaaaaagattgccgatacacgaccggcaatctttttaagttcatgcttctgacaatcatccgtggcgtctgctgatcaacaagtatatgccttccacaattgcaataatcaaaatgaaaacgaccagcacggctaatgccgctaaacgtgatgccgcggtctcaacatggccggcaccatccacgcgtctcatcaagatcgtgatgccgataccgctgatagcgattgccaaaacgatattcgtgatccagagtcccttatgtttcaaagctattgcccccttatctcaaggttttgaaagtacggcccagtttttgcaaactagcgccgattaagggaagcagtaatgtcatcgcagttgccatgtaaacaagttgcaacccaaacgccatggcgaatagattttgccacgccagactgaacagcacagctgccagaaaaacgcataggccatgtaagacttgcggctttaaccattgctgccaccagcttagtaagagacctcccaaaaagccgagtacaaagtctgtcagcaataacatttccggtcgcgcaacataacccaagcggccaacaatcatgatcgcaagcgccggtcccagaaaagtgactggtcgcgccgaggttttcttggtggctttggatgggactggcctcagcaattcgtcaacggttatttggtaaaaatcagctagctgacaaaccgtttgcaaatctggctgatgtcggccggtttcccacgttgaaacggtttttcgcgaaacgaaaagctggtgggcaacttgcgcttgcgtaagctgtcttgtcagtcgtaacgtctttaagtgattgcctaaaaccgaagtggtcattctgctcccccctaaacatacacggctcctgtacgaaaatcctagctacacttgctagcacacttgatatatcaaggttttaaaccattttacgattattcaggaacgtttaaataacggtcgtggaaatctgtttctatcattagattatcataatatcatttgcatcagaacccttggagccttcgtccgtttctacgcataagcgttaagatcgcaagtgaccacggattgtctgcttctgcttcgactcctaaccacagtcacaaagaaaaaggctggcaccgtgatttgcggtgtcaaccttttattggcctaaatggcaacgtcttaatcgttattcttgtgatgttgacgcaatttgacgtaacctagcagtccgattaaagttgcgccgagaacagctaacaccggttgagcccgatcaccggcattcggcatctgatcgcgattcttagttgacttgtgcgtgtctgccgattcgccgttgaaccccgcatgttgttgtggcgtcttgtcttttggcggtatgcctggttccggatttgatggtgtacttggatctttgcctggccccggcgttggcactggtggattgtgaggatccttacccggctctggcgttggtgccgcctttaccaggtgattgatggcggctttaaggttggcaactgcggcttcaaccttggccaccgatgcttctgaatccttgttaaccgcccgcgcttgggccaaagctgttttcaagtcggcaaaactggcatcagtgtatgccttcgctttaaactccgctgctttggtgatcaggctgacaagctcggttttgtccggttgcttttcaagttgtagcattgccgccattaaggcatcggcctgttttccaacttcggattgagcagcattgggatcactcagaaccaaacgtgccggttttaaagctgtttgcagtttggcataggaacttgcggtatagtcgctagctttcagtttttctgtcgctttgacaagtgcagcgagtgattgtttatcggcccgtggtaccaaagcgtcaatggctccttgaagttgatcggccaacttttgctgtgtcgccgcagacgttgttggatccgttagtgcctttttcgcttcatccaaaacggttgtgagttgggtaaagctgtttggcgtgtagtcggcagcatttagattggccgctactttgacccattgttccagcgtcgtgacttgcggttgctgcttcacttccagtgcaaaccacgcattgctaattgcttggatggccgcttgaatttgcgcttgggttgcatttgcatcggcagagactggcttggctgcagcaacagcatccgtcaattttgcaaagctctctgctgtatactggtcagcttttaacgcttcagccgcttcgattaactttttcaactgatcctgagtcacgccgcggtcagcctcgagttttcccaaagcgtgcttcaggtccgcataagcttgattgagcgcatcaaccgttacgttatcaacgttgagaacttggctcgctttatcgcgttgagctgtaactgcctgccaactagccgcggtgaacaacttcggatcgagcgcgttaacgccatcaattaaggcggttaattgtgctttagcctgatccggcgcgctcgtatccgctggcaaaatggtgatcggtgccggtgcttgcggcaagctttccggaccccattgattggttaacattggatcacttaacgcaaagctgagtgccgcttttgtcatgcgcgttttcgttcgcaacgtgatggtcgctaacttttggtcgcctgacaagcgcttctgctggccttcattggcaaaaatcagatagagatcgcgactgttatcaccgtgcgttcgcgtcttgctgaagttaaccatctgggccgttgcttgggtcggttcgactttgactaactcgacattcggattcgtgagcggtacccgggcaaagagactgttaacgttggctagatccttgccaagcagattcaaggtgatcgtttctccaggcagatacgtttgcttttcagcttcaagcgccaaggttccggctggtgcttgttcatccggcttcgtcaccggtgttttgcctagcttggtcatgacatagttgatgtcaaaagcgtcaatgaccccattgcgattcaggtcgccgttttgaacataaccgttgaaatcactgtcaatgttggccgttaagcccgcgtagttcataagcgacgtttgatcgtcttcattcacccgtccgtcattggtaatatcacccaacaccgctttgcttgagccatcccgtttaaacagcagcaattcccgtcctgaaacaaaatcgccgcggcttgtgcctttagggatcacaaagcggacatattgggctttttcatttttgtcaaaagtaatcgtcttatctttgccatcccacgtccaacctttaccttcacccgcttgatgccagtgaatcccatcaaggctggtttcgactttcaatgctgacaaagtaccgttgccgccgtcttcacgcggaacataagtcacatgatccaagtcgtaaacgccatcaagttctgcggtgatcgtcatcggtgttgctgattgcttaggcggcgtggtgaaccagttgctgtgcgccatcgtagtcagatcctgatcaaaaagatgggccgcgttgtcttttccttgccagataggcacaccggtaatcggcgctgtgacttgcggattgctcattttgacagcaagccgcagcggattatctttggaactgaaagtctgctcgttactccacttagaaaccgctttggccgttgccgcgcgtacttggaatgtatgcttggtttggctcttcaccggcgtcaaaagaaattctggcttggtcagattgcggtagacaacgccatctgccttgacgtcataacttgtcgcgtcattcaccggcttccagtcaatgcccacggttgtatcggtcgtggtctgatcattttgcttaatctcggtcggcaccgctacttcatcgctctcgggtaatgcttcagtcgttggatcatcagtagcattgataccgtccacggtgagcttaatcgcattgcttttgacattggttttttccagcttaacttgtaaaaagttctggtcaatcgacttatctgcaagttgatccaagaaatcattcgtatgatattgtttattaacaaaataaacattttcgccggcagtaaagtctttaaggttatcaacggcggtcagtttaaccgtttgtccgccaacactggccgtaactttggccggcttgccactcgttcgaatggcaaattcagtggttcgatctggatttaagccgctgtaatcacctgtcagcggatcaacgttcacggttaactgatccttttgcaattcgctggtaaccttggtttgggcatgcgcaccttttagatactttttcgaaatgccgtcatcttcgtaaacggtaaaatcatttttgccactcgccgggaaaatctgaaactgccgcttggtttggtcaaatgctttgggcgtattgtgtgcgggcgtggttggaatcacggcgccttttttaacgaaaaccggcagcttccaaatcggcgcttcgaagttgtttaagacctgaccgccacgatattccttgccggtgtaataatcgacccaaacttgctgcttgttagggaggtaaatgccgttacgcacatcgtttcccttctcatcagccgccgtgttttggtaaatcggggcaacaaggaagttatcgccccagaggtattcgtacttgacgagatcggtatacgcctcgggaatgttcggataatcaaggaacagaccgcgcaccattggcttgccatcaaagacactttgcgcagacgccgtatagttgtaaggcatcagcatagtcttttgcttgttgtaggcacgattgatcgccgttgtttgctgatcaaacgagaatggcgttttgggattagcgccccagccatccatgttaagctggatcggcgtgaaggctttccactgaaaatcgcgggtgttgacgatcggattaccgccgccaaaaatcccgtccatatcggaacctacgtatggctgtccggataaaccggtcccgatatacgttggaatatgaaagcgaatatactcccactgaccacccgtttgatcaccagtccatacgccggcataccgctgtgtcccggcccagccatcaagcgtaatcgcaaacgggcgcaacgaatcgcctttgacctgcgtcatcatcgcatcagctttagccaaaccatctaagccaaaagaatacccggacccgacccaggccacgtcagttttcagggctttgacgccaatggcaacttccttggcaaaatcacgatcatccggtttcggattggccggatcaactggcgacaagttttgttgcgtccacagcccggttgcaacgccatgctgatccgcataatccgcaaacgacttaagattttgcaagttgcccgctaaggtatcggtctgtccatagcctgcaccataaccatcgtttggcaaaaaccatcccagcggcatatcatttttctgataccgatcaataacggcgcgggcgctaaattgataattattcagctccccgttcaacgattctttgataccgctttggccagccggaattttccctggctgatattctttataatatttgccgtcttcaaacttaatcgcaccgcttgttccttcagataccggaacccaagtatcacggttataggcattcaagtgtgcttcataaaggccataacgcggcatcatcgccggtgcacccgttaaatcataataatctttcaataggtcatagggtttcgcatcgaaaaagtaaaccgcatcaaatcgattttcctggtgtgtggtctttacttggccgtcatcgctagccccaaagtcatagttacccggtttaaacgtgttccgcaccacgccatagccagcggttgaccaataaaatggattcggtgacgccaccccgccatcgacccaattacccgtgttttcaatcttgacatttttacctgttaacgtgaaattaccattttgcgtgccaccgccaaaaaactggtcagtgccgcgttttaacacttgcgttgcatgatcgttggtaatttctaacggctgactctcggccatgaccacctttgagcctttggaaacctgcagtgttgcgtttgcttgattaaatccaatggcaatcgcatcggtcttgatcgtccacccatcaccgttatgatcaagcgtagcagccgcaaacaccttagctgccgatgcatcaatttccttggtaaaaatttttgcgttaagccctttttccgattgggcaggcgcagcaaatttacctgaaggatcagcataaaagcgaaattgattgttcgctaatataaacacccgtgccttcaggttgttggagtaagtaacttcaaaataatgcgtttgtttggtgacattcacaatgttaagcatgcttgtactggccttcttcaccgcgctacttgtagccggttcggatcccttagctgccgttaccggaaccgtactactgacatacacgacagtcgcagtcaatgataaaactgcgctgctatataacagtgaacgcggcacccgaggccgatccttcactgtcttcattccattgtgcatcgacaaactccccctaaaaattgttgtggctcctccgcgtggtcggtaccactcaaggggattgtaaccgcattcatttgtttacttcaaccacaaaatattgtctaaaagtggcgaaaatctattttctggaaatatttttcagaaaatataaactaaattattgttagggctgtgaactagatattgacgcaatcgagtttcccgaagctttgccggtgcacaattaagaacaagagttatactagtagcgcttaattattaattttatatgaatgagaactgaactcatttcattcacatagtacaccatcaacaaaatgttgaccaccggaccagtttagataagcgcaaaagaccagaaacttggtagcctctgattcagttcgcgttccttagttaaaggtataaaatggtactactcgatagcaccaaaatatgatgaataccaattaaaaaacattttaaaaagaaccgccgttatcatttcaatgtatttaatgatcatatatactaaaaataccgccaagttaagacggtaaacgtcataacttggcggcagcgatttagcaaggcacgcacccctcaccattctaacttccggaggtgatcgccatgctaagaggagagatcggagggttgggttacgctagaaatggcgttggccatcttggttttagcccaggcgtacttggtttacgccaaggcaaccaagatactaaaagaagctaaccgtaacggctagcttctaccaccagtctttctaactcgcgtcgaggtcatcgggtcgcaccccggtggcctcttttcaccttctttattctacctgacaatcaagcttgccgtcaaacaaaatctatctatcgaaaatcacttattgagattagcacgaagcgtcgccccaacctatgtgcatcaacctcaagccaacccgaccacgttttgctataatcaactccgtacataccctatccacaaaaaggaagattgatgctatggcggatgaatttattgcccatcctttgatcaccattaccaacgttatctggagcttttcgcgtaccacccggcagttgcagatcttattgattcatcgcgcggatgatccttatgccggctactgggccctgccggaaacgactttgcgtgtgcgtgaaagtgccgatgcagcggcgatcaggctaattcgcgataaaatcggcgtgcatgtcaatcgcggatccacggagcagttggccacgtttacggacccagcccgcacacctggcgagcgggctttggcgctgacttacatgacgtatctgccgacaatgcctaagttacggccgggttatggtgcaaccgatgcgcggtggtttgcttttagcgccactgccaacgattatcagttacaaaatggtacgctcacgtttcagttggatcaacaggtggcgcatctggcttttgatcacgcgcggattctaggtgtcgctattcgtcggattcgcaataaacttgattatcaacccagtattttgcaagtgctcggccacaccttcaccttaaaagaagcacgcgaagtttacgcgccttttctcaatacgaccgcggctgccattgacaactctaactttaaaaagacgcaccagcatctttttgttgaagtcggtactgcccatgatcgcacgcgcagtggccgtccgcctaaattgtttaaacttgcctagttgaaaaataccctgaacccgcgtatcgtagacagcaaataaaagtctaatgtacttttatactgcgtgagtttaagtaagttttactttaattagaaaggaagcctcaagaatggctcattcgaatgaagcactgctcatcattgactatactaatgactttgttgccgataaaggtgctttgacctgtggcgcggctgggcaagtgttggcgcctcacattgtcgctttggctgatgaatttttgcaacaagatggctgggtttacttgccaaccgatgtgcatacaccgcacgatccgtatcatcccgaaagcaaactgttcccgccgcataatgttcgcgggacttgggggcgggcgttctttggttcgcttgcgccttggtatgcggcccataaagatgaagaacgggtgaacatgtttgataaaacccgctactccgcgtttgccggaacgccgctggatctgcgcctgcgtgaacgcaaaatcgacaccgttcatttagtcggcgtctgcaccgatatctgcgttttgcatacggcagttgatgcttacaatctcaactatcaaatggtcgtccataaaaatgcagttgcggccttgacgccagctggccaggactgggcgttggaccactttgcacatgttttgggtgccgaagtaacggattaattaaccacggactgataaagaaggcttttaaagatgaatatgaatcaagcaatgttgacggatctctatgaattttccatggccaatggatattgggcgaccttaccgcatgaagaccaggcagttttcgatattttctatcgcaatgtcccggatcatggcagttttgtgattgccgctgggttgcaacaagttgttgaagcgttacgagactttcacttcgaggatgcagatatccaatatttgcgttcgttgaaactttattcggatacatttttagactatttaaaaacgatgaaattagcttgcacagtgacggctttaccagaaggcacccccgtctttccacgtgagccgttgttaacggtgcaagggccgctgatgcaggtccagctactagaaacgctgctgctcaacattgtcaatcaccagtcactcattgcaaccaaagcccggcgcatcacggccgcggctgaaggacggccagttatggaatttggtgcccgccgcgcgcaaggaccggatgcctcggtttatggagcgcgtgctgctgtgattggcggctgtgccagcacctccaacgtcttggctgcacaacgcttcaacatcccggctgccggaacaatggcccatagctggattgaagctttccctgacgagctctctgcttttcgcgcttgggctaaagtctatcctgacaacagtgcgttactggtcgatacttatgatgtgctcaagtccggtgtgcccaacgcgattacggtgttcaaggaactcaagacaggcggccatcacccagttggtatccgcatcgactctggtgacatcacccagctagcgaaacaagcccggaaaatgctcgatgacgccggtttccccgatgccaaaatcacagcttccaatgcgctcgatgaaaccgtcattcagtccctcctcaaagaaggcgcaccgattgacaactttggaatcggcgaaaagttaatcaccagtgcctcatctccggttttaagcggtgtttacaaaatggccgcattgcaagtaaatggccagtggcttcctaaaatcaaggtaagtgccagtcgggaaaagaccactttaccaagtcataaacaggtttatcgcctgtatcaccgtgatgatcaaacggcttttgcggatgtcattgcgttggctgacgaaaacctgcctgcagaaattgccgcggtcaatgccaacccgctggctacccaaacgcaagtcaccttacgcgatttcactgccgaaccgttattaaaaccggtcttccctcaagcacaagagccgctcacaactgatgtttttaccattcaaaaacatatgcggtcagcactcagccacctgccagaagcaacacaacggctcgtcaacccggacctctatccggtttacctcacgccgaaattagccgctttgcaacagaaactgattgatgaacatcatcaaaattaagcaggcacttgttattaagcgcgtctcggtttgatccatcatgaaaatcaaaaactgcttcgaaagcaagattgcttccaaagcagttttttaatttcgtgaatgaaacttagtcttgcgctgtacttaaactggtgtctcggcttccttagccaccaagtcgcgcatatccattgcttcttcaaaacgattggtaatgatcccggtaacgtaacgttcgcgcatcagttgtttcattttcagcggatcatcaactgtccagacgcgctgggctttgttgaggtggctgttgtaatgttcaatgtggacggcttccaaatacgatggtaaggtggcaccggttagaacccgactcgttaaccacgccgttttcattttcggcgcaagggtatgaatgacgttgatactgtcgtgattgaatgaggagtagatgacgcgatcctgcatattgaactgctcaacgtaatcttgcgtcagcgcctcaatgcccggatagcggatcttgccggttttaaactcaatgttaaccatcacgtcataatggcttaaaaccgtcaatgcttcccgaagcgatggaatgtgttcgccattggccagccgcatccctttgagttgcgtccgggttaaatccgcaatccagccagtgccatctgttgtgcgatcaacgcgctcatcatgcatgatcaccaaatgcccatccgcactcatctgcacatcggtttcaatgccatcgatgccatgctcacaggcatattcgaatccttgcaaactattctccggaaaacgcgccggataaccgcgatgtccataaattgctactgtcatcatgagcctccatttcgcatactttactgatcaaaaaccgtctgcgccaagctgtatcaggcatctgctttcaaggcccgcacatgagcttcaatctgatcgcggacttggcgaaaaaccgccaacaccgcttcttgcgaaccactcgccgctgctggatccgccagcggccaatgcaagcggcgaacggttagcggcgtcaccgggcaccgatcccgcgcatccccgcaaagtgtcacaatcaaatcagcctgctgcagttcggcttcgttgagcacttttgattgctgttgcgaaatatcgatgcctttttctgccatgaccttaaccgccagtgaatttaggccatgcgcttcgatgccggcacttttcacctgccactgacgccccagcaattttttggcaaaaccttctgccatttgactgcgacaggcattccctgtacagagaaaatagacttttggcatgatcacgaccagctcctttgcgataatgatgtctaacgttgtcttgatcatacgcgggttacggtcgttgggcaatatgggtgcaactggcaacttaacgcttgtagtccagcaggttgccactgacggaattggtctttgaaatggccgtattcgtatcggcttccgcttcatctaaagccttcttaacatcggcaccgccataaatctgttgcatagccaattcaacattttgccgttcttcttggatattgctgaagaacgcacctgctgtggccgcattgatatgaccttggttcagttgttcaatcggaaccgctaaagcagggtttttcttaatcgcatcagccagactcttcacttggttagctttttggttaaccgcaaagtagcccgtgccgagttgccatgttgcttgagacttaggcgtcattaggtacttcataaactgccaagccccttcttggacagcggttggtttgtccttagtaatccatagacttgcgccgccaatcgctacaccattcgctttggtaccatccggatgcggtgtgaaggtcacgccgtacttaaatttggcgttcgtttgtaactgccctaacatagcggaactttgcatgaagatgccgaccttttgcgccaaaaacgccgcgctttggttgttgccagctgctgatccggtcccaaagttttggaaggcgttttgtttgatcacgtcttgcagccaattcatgcttttgaccatttccggcgagtttaatgtggcgctggttgccatcgcttggcggccgttatcgtggttgacgacaagtgaattttgattggcaaccaactcttccggcagccagccatagatctgcatcgtcatccctttgaccgcacctttactcttttgagtcaacgcaaccgctgccttggtcacgtcgctatacgtcggtgacagtggcaaatcaggaataccatactttttaaataggctctggttgtagtacataaccgaactagaggagttaaacggcatggaagctaacttaccattgattttataagcggctgtcacccctggatacaattgactcaaatcataatggtcacgatcaatgaacttttgtaccggtaccgttgaattcaagccgatcatcatagactggttggcctggtcactttgaatcaaatcaggcgaaacattactgccgaccgtattggcatatttcataatcgacaattcataactgccggcataaatcggcttaaccgtgtatttggtctgactcttgttaaattgatcgactaagccttccagaaccttttcattcgggccattcatcgagtgccaaaacgtgatggtcgtgcgcccgttgttatcagcagcactggccgattgttggtgggtgaagaaaaagccaagtccgaaaataacaacaatcgctgcgactatcgcaataatcttcttatatgtggttttcaacccttcgtcccccctgcattcaaattacgcttgaagaatttctggccaatgagcaacaatgccaaggttggtaacaacacaatgatcgccgtggccatcaccatcccccagttggcgaacgtatcttccgcctgtaactgcttcaagccgacttgaactggccggaaatcatccgagaaggtcgtaatcaacggccataggtattggttccaatgcgtcagaaacgtgtaaagggaaaaggtaatcaacatgctgcgactatacggcaccgcaattttccacagaaactgcaagcggctaaggccaagatacttgccaaagtccaccaagtcggttggaatctgtaaaaaggcttgacgcaacatgaagaccccaaaggctgaggtgaaaaacgggatcgtcaagccagcataattgttcagccagccgagtgcttttaccgtctgaaaattaggaatgatctgggcttcaaatggcaacatcatggtgatcaaaaaggcaaagaacaactgctttttgtagcggaagttcataaacgcaaaggcataagcagcaagtgtacataaaactaattggccgatagtgattaatccggccgtcacaaacgagttaatcatgtagcgaataatcggtgtggtgacaaatgcctgccaatagttattaagcgagatattggtggataagaaattccctgccgcaatatcttttgtcggtagtaacgatgcccaaatccccaacagaatcgggaataaaagtatcactgcaaccaccgtcaataaaagataacgtgctccgtgtttgacatgtgtcatgcgtaatacaccttccgttctgtgaaatggaattgaacccaagtggccaaggcaataatgacggttagcacaatggattccgcactggccgttccaaagttgtggaaagcaaaggcatcttgataaatcttatatgctaggaaattcgtggcattattaggaccgccgcctgtaattaagtcaatctgggcaaacattttgaacccatcaatgatttcaaccacaaacaagaagaacagggttggcgaaatcatcggaaccgtaatcttgagtgtctgcttgaattgtgaccagccagcaatgtcagcaacttcatagtattctggcggcacactttgaaacgcactcagaagaatcaaaaaggcaaagcccaatgccatccagacactggctaaaacgatgacaatcatggcaccggtcggatcaaccaataaattggcattggtgacgcccatcgcttttaaggcaaaactggcgaggccgacagatggattgaataagaacagccagagaatcgaagcagcggcggcactggtgcccatcgtaccggcaaatgccgtttggaaccaactgatccggcgtaacttcatcgttgccaaacgtgccaaaataacgccaagaacaatggtcgccaaagcaaaggcaacgacatagactagcgttcccgtcaaactctgcaggaataaaggatccttgaagatatcaagatagttacccagtccgacgaatttagccgattcaccgcggatgttggttgcaaagaaactgttatacaccgtcatgatcatgggataaaaagtaaataaggtcaggatcagaagtgacggcatcaaaaaccaaaaggccggcttattattttcccgaatcgtttcagcaagcttgccttgcgatttggcagtcgatttattaagttccttattaagctccataagcggccgcctccttaactggcgccacggcaatccgctcaccgtcatcaatattaaagagatgccattcatcggcattagccggcagtaataaattaagctcagcgccaaccgctacggtgaactgttccggaacccgactgaccaatgactggccatcaaagtcgcagaaaatcaaggtgtcattgccaagctgttgcaagctcttcaccttggctgtaatggtatccgggttggcaatcgaaaccggtaccaacttctccggccgaatgccaagatgataggaaccagccggcaagtcaaacggaaggacaaacgcattgtcagtccagaaagtatcgccaatgctaaagcgatcgccttcatcgctaaccgtaattggcagcagattcatttccgggctgccgataaacttggcaacaaattcattggcaggatgattatacaagtccagcggggtgccaagttgctgaatcttttcatcatccaacacaagaatccgatcgcccatggtcatcgcttcgacttgatcgtgggtaacataaatcaaggtcatgccaatttcacgatgcaaccgcgcaatttcttcacgcatttcggttcgcaactgggcatcaaggtttgacaacggctcatccattaaaaccaccggcgccttagttgccaaagcacgcgccagactcactcgctgctgttgcccaccagaaagctcttttggtttccgctcacgcaaatcggtcaagtgtaccaagtccaacgcccaatccacgcgcttgtttttttcatcatcagttaaatcctggttctccaagccgaagcggacgttttgggcaacgttcatgaatggcagtagcgcatagttttggaaaaccatcgccaatttgcgatcttttggcggcaaatccgtcacatcgcgttcattaaaataaatccgtccatccgtgacactggttaaaccggcaatcatccgcaacagcgtacttttaccggaaccagatggcccaaccatgacaaaaaactcgccaggctcaatctcgacggaaatgtcggatagtactttggtgttgccaaaatcctttgacacatttgctagtcgaatactcattcctcatcaactccttacactgagactaccaagcctttgtaaagatcagtgtcaaggcgatgtattaattatgtaagcattctgtaaaacgtatcgttccagcttgaaatttttcaatttaacgcttcatccgcggccacattcagcctgatagccatgcaaaaagcgttggtgaacgactgctattccgctcaccaacgcttttccacgaaagtactctccactactattcaatgccttcctgaacgaacacccgcaagattcgcggtgtgatcgcaatcatgtaaagcaacgccacaatcccgctgtatacaaagacgaggtaattcttcgcgatgttttgaaacaggaacgtataaaagaaggttgccaccggggtcaccgaattattgatcgtcatcaacgtcgtattgacccggcccaaaaaagaagtcgggaccgttttttggatttccacctgaatgacaatgttaggaatcacgatcaaaaaacctagtactaccatcagaatcgtgccgggaatcgtcacgccactggctgtcttggcaaaattaaacacgccgcctaatgcgatcaaaagcacacaatccgctaaaaccggcccgagaatcttaaggcgaatccgcttttcaccgctgatcgtactcataaacaaactgccaatcaaaatcccgatagcagaaccggtttccagatacccgatcggtgcactgcccagatgcagcgtattcgtgatgacaaaaggcatgccaaccgtgacgctggtgaagctaaaattcaaaaccacgccaaccatgatgacccccttaaccaatggacgcgttttgacataagccataccttgtttaaacattgccaatggccgactggcagcagcatttttcgcggtcggctgccgcttggtcacatgaaacttcatcgtcagcataatcaaaaacgagaccgttgacgaaaccatttccacgaaaataaaggcttcaaacccggcaagcgtgtaaagtcccaagcccaacatcggcgaaaaaatcgaggaaatggagccagccgtggatgttagtgaacttaacttttgaattttccgctcattaaccaattcatggacagaagcagcataggctgttgagctaaaatcgctgcatatgtaatcaacaatggcaaaaaggacaaccggaacaagtttttgcacgccggaaaatcccggtagcgcccacgcgaacagccctagtcccagcaaacgcaccagattgcttacgattaaaatacttcgatgcggataacgatcaacaatgctgcccataggaacaaacagaagcaaactaaccagcggcccgacaattgttgataaaccgaaactgatcgccaggtgcgtttgattcagcaacatcagccccatcccaaacgaaaacatgccgccactcaacgagccaatcaggttgctagtaaaatctttgccaatttgaagattggattcccgatctgtaatcagaaccgggctggttgcgtgggctacctgcataggctgtcagcactcctttattttcctcattttttcgtaataattattaatcatattataataattttcgcaaaaataaaaccccgcctgcacacaaggtcatggaacaagacgcttgtgtccagacggagcttaagccgctgccaactcaattcatttttcagtgtagtcgattccggcgctgctgaaagtcatccacgattagcgcaccaacttgttgattaaaccgcatggccgcttcacgttgatgatcaaacgttgtcaaaacaactgcatacaattgttccccttcagccgcaaagcaagccgcatcatgttcacaatttggcagttcaccagttttacccgctgtccagccaacaaaattcttcatggttggtgccagcagcaacttggtacgattctgttgatgacgcagggcacgggcacaccagtcaccgtcagctggtcggcacggtggggtcaataaggatcgcaataaacgccacgttgctgcagccgagatccagttgtcattgtcggtatgcggctgcatcaaggaacggtttaatttggcacccggaaactgctgatccaaccatcgctccaccgttgttagcccatacgttttcaacaaagcattggccgctaaattatctgaaaccatcaacattaaagtcaccaaatcgcgcacgcaccaggatgaatcggccatgaaccgcagtacccccgcgccgccaaccggccgtggtaatactactttccgctgccactggctagaatcggcttgtgcctgcgctttaacataggcagcgatccccaacttaatcaaactcgccgcggggaaaagcacatcggttcgcgtcccaaaaagcacctgccgctcatcagcaagtaacaaagcgtgcgattcaccaaactgttgctgcagctgatcaagttgtgcaattaagtggtcatgcgccatttcacattatctccgatcgcaagccagccaccatcacttgcgacaagcggtgatgactaacccaagttactatcgatcatacacccacgcatggtcgtcctgccaagagccaaccaagtaacgcccaacctaatccggccaggaagtttcaatcccgaaaaattgagtcagcagttcccggcggatgcgtaaccaagcgcggtgcgtccgactcggataaatacgattggttaaacaaacaaagccacgctgcgtatcgcgatcaaatgcaatcgaagtacctgtgaacccagtgtgccaatattgatggcgaccttgcgcccagcagcgccagcccaacgtccgcccaccaacacagtaacgctcaagcaacgaaaatgctgccggaggtaaaaccttctcaccatgcgacactggcaaaccggccaacagtcgggtaaaagtcgtcagatcgcctaacgttgaaaataaacccgcgtgaccgctaaccccgtcaagcaaaaacgctttatggtcgtgaaccgtcccacgtaaaaccccaccgcgttctggcacattttcagtcggcacaaaatcgcttggtgccactgcctgcggacaataaccggttgcctgcatccccaaaggcgcaaaaacatgctgatgcaaactggcggcaagtgacccatccaccgccgcaattgcccagcctagtaatataaagttcaagtcagaatacagggtggtggtgtctggcgggacaactgccgccatcgttttaacggcctgaatcaaccctgcttgatcaagtgcgtgcacattagggacgtcagcaggtaacccgctgcggtgcaacatgagctgttcgatggtgagctgtgggtagcgcaatccactgaccagtgatccaatcggctgatccagctgaatttttcccgccagcagcaattgcagcaagcgcgttgtcgtgccaacgactttggttaacgacgccagatcataccgattctgaggcatcagcggcaaatggtcggctccggttccttgaaagcctaaaaaatgcacggcattctcgtccgctccgacgacactaaacgccacaccgcaaaccgcctgctgctgaattgctgcggtaatcggtgccaacaacgactgcgactcagagacttttgccatgttctgcctcccaagcggtcaaaacatcactaatcacgccatcatgagcagccagcacttgggtcgccgcagcagcatccagaccggttttggccatcacgatcgcaaccggaaccttgtgtgcagctgcctctagtaaggatgccgctcgagtcgcactgacaccagttgtttcggcaataatgcgttgcgcgcgatccaccagtttggcattagtcggcaacacatcaatcattaaattgccaaaaactttgcccgcccgaatcatcacgccggtcgaaagcatgttcagcaccattttctgcgcagttccggctttcatgcgcgttgacccggtaatgacttccgggccaaccacgggggcaatggcaatgtcggcatggtcggcaagtaaactggcggccacgcaggttacggatattgctaacgcctttacttgttgcgcatacgtcaacgccccaatggcataaggggtccgcccggaagctgcaatgccaatgaccgtatcgttggcattcagattcaacttcctaagatcatgttcggcaagctcagctgaatcctcagcgccttcaactgatttaaacatggctcccatcccgccggcaatcaagcccactgctcgttctggcggaatcccataagttggtaccaattccgcagcatccaaaactcctagcctcccggatgtaccggcaccggcgtaaatcaaccgcccgccgcgattataacgctggctggcttcatcaatcgccgcggcaatctgggctgtttgcgtagcgatggccggggcgattttggcatcctcatggttaatcagcgccacgatttccggcgtcgtcatggtgtcgatgtgcatgctggcgggatttcgttgctcggttgttaagtctgcgattgacatatttatcccctcgaatcttcaacgctccagttaagtgtgatgttgcccgataattctgctcggtttgcttaatttcaccatgaaccacgccgaggaaaagaatattggcaacataagtctccgtaaacattgacgtcacggctccgattcgtaacaacggctcggtcggcggcaaggcaatcacgcaactggccgcatcgcgcaatggacttggttcggcacgcgttacggcaatcaccggcgtctgattccgccgcgcttgctgggctgccaacaccacttctttcgtcagcccgctataggaaaagaccaccaccgcatcagccgccgttgtataatacacgcgctctagtgccgtgtgcgcatcggcgtcaaaaatggccagataccctgcccggatgagttttaaatataaatcctgggcgactaacgccgacgcactcatgccgacaagataaatatgccgcgcatggcgtaacgtggtaattgcctcttgaaccgccgcctgatccagctcgtccggtaaatcgcgaaccgccgcaatcgccgtctgactcaattttcgcatcatcgttggcaaatcatcatcatcctgaacaagcggatcgagcggcgtcagcgcgggggcttgcgtatcccgcaccaaggcgagtttaaatgattgcaagtccggatagtcaaacaaccggacaaaccgaatcaccgatgctgccgatacgccgctagcccgggcaatctgcgcagttgtctgagcgatgaaggcctcggcatcggttaacacatagtcggccaaagcgcgattcaccggacttaattgcggcaatcgcgcttgcaccttcgttaaaagggccttcattcgactttatcaataaaagtagcaatcgaggtcttactctcattgggcaccatctgcgcagtaatggtaatcccttgtttgagtaagcgccgaatcatcgcaatatcatcggcagtcaacgccactgatggcttaatcttctttgaccccggcttttcagacagattgccgacattaaaggatgtgatcggcacgccaccgtcaattaacttcgccatatccggaatattgcgggtaatgacgaaaacctgatcagcggcaaacttgccattttgcaaattttcaatcgccttggcaaccgagctaatggctaactttttccctgcaggtcgggcgattttcagtccttgaatcgccatgtcatcacgaaccaccgcatcattgacgaccatgagccgattagcgccaaccgtattggtccacaccatcgccacctggccgtgaatcatccgttcatcaacgcgtgctgccacaattgtcattcgaatcttcctttcaccataacgtttgaactcagcatgtgtgctaatcgccgtttcacgttagtacttaacaagctggcggatcttcttttaaaaagtgtcctcatgcttaaactaagctgccaatccagccgaaaatcgcgcctaagttgccgagaaccatgccgatgaggattaaaacaaaaatcagccgagtcgagttcatatgcttgcgtcccaaaatccaataagagaacaaggcaatcgccagcggtatcaaagcaggcatgatcttatccagcatatcctgcacattcatcgtgactttgccgactttataggttaaatcaagcttgtaattgataactgcaggaatcatcgcaccgacaacggttaaaccaagaatcgaggcgccttccgtaaaaatcgccatgctatcagcaaaagtcgtcgccaaccgtgtcccttgagccagcccgacattaaataacttccaccgcacccataaaataaccaaacagccaattacaggaatcagcaggccaatcggttgattcgataaggccaaatatgccgtaatagaatagataatcgcattataaatcgcgacaaaaatcgtatcgccaacgccggcaaacggacccatcaaccctgttttcaaaccggtaatcgctttttcattttcatcgttcatgcccaattgatcttgcaaggccacatccgcaccgacaatcaagtgtgccatttgcggggtggtattgaagaagcccatttccatattgagggcttgtttcattttcgccggatcatctttgtataaacgcttcagtgccggcatgaccgaataggcgtaacccaagccttgcatcttttcatagttccagcccagctgtagtcctaaaacattgtgaatgaaaatctgcttaagatcttttttggttaacttgcttaattttaactcagacatcgatctcgacctcctcatcgtcgctatcaccgctaccgccattatcaggcttacttgggccattgccgccgttgccattgtgcttgcgttcgttagcatctaagacatgtaacgccgcgaagacgaagccaaccagcgccgtgcccagcaaggagaatgacttcgcaaagtaagccattagcacaaagccaagaataaagtacggaaaataccgtttaatcggcaagtaccgcatcaggattgcaatccccatagccggtaaaataatcccggccgtcttcaaaccggtcatcaaccacgtcggaatccaagcgttgatcgccttgaccactgcagagccaaagaacaagccgacaaaaaccggtaacatccgcgaaaccgtccacgggataataccataaagattgttacgctcgacgcctttataatcacctttagccgccaacctatccgcgtgatgctggaaaatcgtattcgtcatccgcgctaaaatatccatctgggtcagcagcaaaccaatcggaatcgccaacccgatcccatacgcagccccgcgtcctgccataatcgcaaacgcactgcccatgattgatccggaaagaaagtccggtatcgtcgcgccgccataagtagcgacccccaacgttgccaactgcaaagtcgcaccgacaatcaagccggttttcaagtcacccatgactagaccagttactgccccaccaaacaccggtgaaaataacccgatcttcaatgagagtgcatcaagctgtgccaagccaacatagatggttagaaaaataagtgcaaaagcagatatcgccatgatgtttcccctccctacaaagatttcattgctcaacctgattatggcgctagatgaaactcaatttcaagtatttgagttagataagtttacaatgaaattttgtttctaggaggacacggaaaattgtgtgtaccaattcgcaactggtaagcccgttgcattggttaaacagccatagaaaactgtatgcggttaaagtctacgcattgccaaatttgtcagagagcagccaactgacaaaaaagcgcgggctactttcctataaaaccggaaatagtccgtgcttaatcgtatgcaataactttggcgaggttttacttcaactgaaacttcaacaccaccggattatggtcagaatactgaaatccggtcgacacaacatggacactttccgctttgatatttggcgacagaatgtagccgtcaattaaggtcacaaaactttttcccggcttatacggctggtccaacgcgcgtactgatggtacctttgccgctgccagtcccattgtcgggatataaaagccggctggtaactttgacttaggaaacagatgcgtccaggtttcgtctaggtccttggtgtggaagatttcggcggtatttttcaagagccggtggttataatcacctgctaccatgacgtaattgccttgctgataggcgtgattgatatatttaaacaacttggcaaactgtgcctgttggattttgacatttggcgtgaaggcggacatgtggatgttcaccatgatgaattgcttaccgtttgccaccgtggttttcgttgccgtgaacgcgcgatccaagtcgataattttattgaagtcagtgtccaccggtaaactgtagcggcgggcgctatcgactttggccttactcaaggttagaatcccggacttggccttgccgatcggttgattaaacgggtaaaacagatacgccgaatcgtaattctggccgtaaacgttagcgtattgccgttgcgcattcgtcaccatctcgacttcattcacatgccgcgagcgatcgccatccggatcaatttcctgataaaaagcgatgtccggctgctgcgcctgcgtggttttgatcaccccattgatgcttttccgcacggcttgttggctataagcacgcgaatacttaccgccgtccatgaaaaaactataactgggcggataggagccatagccgatgttgtacgtcatcgctgtgtaggtttgtccgggcttaaactgcgcactttgctgatgcttaaccttcaacgcttgatcgtctggcaaacgataataagtcgtaaaaagatagatcaaataaccgcctgctgccagtaccaccacgccgataagtgccgctacccatttcaatagtcgtttcaagccgccgcctccaataagtttgcttgcatttattatagcagttgtctttttccttgagaccggtacgattaaggaagtaagtgtcaggcaacgattttcgccaacggactgtcaccgcaacatttttatcaagggagcttactcaacatgtcaaccgaaatcaaacagatccttgctgcttttgaaaaattcgagaccattatcattcatcgacacatcaaccctgatcctgatgcaatcggctcacaaaccggactgaccttgctactgcgcgcggcctacccgcaaaaaaccatctacaccgccggaccagccgcaccggatctggcgtggatcggtccgcagcaagacgtccccgccgctgcgtatcaacatgcgctagtcgtcgtgattgatacgtccaatcgtgaacgcgtggcgggttcgctttttgagcgcggggccatggtgattaaaattgaccaccatctggaagaagaaccgctgggcgccatcaactgggtcgacacgaacgcttccagtgcatctgaaatggtgtggctgctgactcaacacagtcaacgcctgacgctcacgcaaccagccgccgcagctctgtatgctggcattattggcgacaccggccgcttcctgtacgatctgaccaccgctcaaacccatcgtgccgctgctgacttactcgccaccggcatcgatgctccagcaatcggccgccaagaagatcaattcccggaaaatgtcggccgcctcatcggttgggcacttgaaaatgtccacatcactacaaatggtgccggctcgttgatcatcacgcaatccgtcctccagcagtttggtttgcaatatggcgaagaacagcgagcagttggcaacatcggcaaactcgccagcattgatcgctgggtcgtgttcaccgaacgccaagatggcaaatatcgcgttgaattacgcggaaaaacgaaagagatcaatacgcttgcagtccgacacggcggcggtggtcatcccttggccagtggcgctgtggctgatgatgaagccgaagttcaggcaattgaaaaggaattagcttctgattgaggacaacttggatcaggaaccaaacgactcatttaactgtggttcagggtttgaataacgtatcctcaatacagcacatctgaatgaatgaagtttgcacttgggtgaccaaaaggaactaacaattcggtttaactttttccttgctttggagtgcgctccaaggtttataacaagggcagcaaataaaagaaaagagattttataaatgcagacttttacattaaacaacggtgtcgagattcccgcactgggctttggcgtgttccaaattccgcaaggtcagacaaaacaggcggtgttggaagccttgaatgtcggctatcggcatattgatacggcacagtcttatatgaatgaagctgaggtaggggaagccttggccgcaaccaagatccctcgtgataagattttcctgacgaccaagatctggttaagcaattacggttacgaagcgactgcaaaatccgtggaagcctcactgacaaaactacaaacggattatttggatttagtactgctccaccaaccctatggcgatgtttttggctctttcaaggctctggccgatctccaaaaagcgggaaagattcgcgcgattggcgtatcaaacttcaatagcgagcgtctggccgatattgtggcttttcaagatgctccagttcaagtcaatcaaatcgaaatcaatcccttctaccaacgcgagcaagacttaatgaacgccaaagcacgcggtcatgttttactcgaagcatgggcaccttttgctgaagggaaagacggcattttctcaaataaaactttaaccaccattggaaaaaaatatggcaagtctgcggcacaagtcatcttacgctggaactttgaacgcggcatcgtcagtcttgcaaaatctgtcaaacctgagcgcatggctcaaaacattgacatttttgattttgctttgacccatgaggataaagcccaaattgccacactggataccaatactagtcaattctttgatcacaactctcctgactcggtagatatgtttgtgaagtttttgcaagaaagagacatctaagattgattggccagtcttcacaaatcgaaaaatagtgagtgatcaaaattatgaatatcaaaaaagctgctgacctatttgatttatcaccagatacgttgcgttattatgaaaaaacaggaattgtgccgcctgttcatcgcgcagcatcgggatttcgtgattatcaaacgcgcgatttaaactggatctatttagtgagaagtctgcgccgcgcaggcatgggcattgatgctctcaggcaattcacgcagcttgctaaaaagcgcgagtcaaacaacggttcatcactcaagcaagtagatgctgcacagaaggcaatcttacaaaatcaacttattgagcttgacgagaaaattgtcgaactccaacaaacacgaaaaattttggcttataagattgccacttacgaagatcacatcggcaaattcaagaacggtgaatgggatgcagaaaatcaagaaaagctatgggaacgctaactttttgactctcactattattcagagaatgctagccaactggccgcgattttttgtagactcgctgataaacatcgactaagcaaccaacgcatctccgtagccactttcgaatgcagaaagttggctatttttttcgcgccaaaacaataaaccgatcctcaaacgttgtgacgctgccgacactggcaatcatatcttggagctgatgcagctttggcatagcctggttaacgtcaaagtttggaaactcccacgggataaccgttgcataataaacaatcgcaccaacatccgtgaaacgcattttgacaaacgcagcatctgccttcaagatttcaaacccgtgatcctgcaattgcgtcaatacttgcggaaggttattgtcaggaaaagcgggtacatacgcgggatctagaaaccgtgacaacgagtaattgttagttgcgcccacctgctgcgaaacgaaaatcccttttgagcgaagtacccgagcaatcgccggaatcggcaagccgccatgactgttggtcacgatatcaaaatgctgatctggcacctgcgccatctgtccatccgggtcggcataaagcgtcaccccttgtggcaccaaggttcgcttcagcaagtcaatgttgggttgccagccttccgtgaccgaggttttagcaacagggtgtttaaacgtctgcatcagctcgccaccccctgtgtccatatccaaccactcatcactagactggagatgctgctgtacccactcactataattccatggcagcgactcggtttcacaacgaccctttaagtgactaaaatcccaaccatgcattgctaggtgactttcttcaagccacgatgcttcttcattcatgtcgtattcacaccttttttaatttgactcgttcgtttccgcaaactcaccatttacaatgtcccctatcaggcttcaggaagaacgacttgaagtctacgcttaatccgattcggtgacattacctcacctccagttaatggtttaagtctagcacgcaaaaggtgaaaatcctcacctactcgtcactttaattccgatgatgccaatgactaacaaggcgatgaaaaaccaagtcgccggttgtaactggtccttaaataaaatcaccccgacaataatcgatcccacggcaccaatgccagtccaaaccggataagccagactcaacggtaaatgcttcaccgccaatgccagaaacccaaagctgagaatcatcccggctaatgtcgccaaagcaaagcccaagcgcgtaaaaccgtgagataacttcataaaggttgcccaaacaacttcaaatccgcctgctaacactaaataaaaccactgcattttcttgttcctcctgtcatttaaccggtccgctacccaataaaaaaggcgacagtatccgcaaccgctgcatagacctaatgcggttgcgatactgtcacccggtagtgactggttattgaattgcgattagtagttatcttttcacatattttaggtggtgtcaaatggatgtgcgcgacacaagctgtccgcttattaacgctgaggtttggccattccttttttgaatcacgacattgacggctatcaattgttcctcgattaaacattccacgttacttatccttcaaatagtcaatgccggttttatatttgtccataagatcctggatggtggtaattaattcctctttgccttccattttacacccctttataacacgcatttgcactgttccatcttccatcatgttgaatcgaaccttggtattcttctttataccgctccgccgtctaatttcggcaggtatcgttacttgacctttgctagttacggttgcttctaagaactttttatgggacaaagacatacgtgccacccctagctttattcttacttttttctgaccttatttaaggtttaacacgaggcaaggaaaaagtaagcgctatagtttgattctcttaatctatttcttggagcgtttcacccgcttaatccttggccgtatctcgtggcactgaacaaagaaaactccagggatttctccataaagcaattaatcgacggtttgatttccgttatatttctaatctaactgattaccattagtccgcctgctcatcgtaagtaatttcttgattccactatagcatctatccctcagtcacatctcttattgttccatcgctcaagttcaaatggcggttaaataatcgttgcatcttcggatcaatatgatgatcgatttccaaaatcgttaatggactatttagcaaaatcatatgaatttcgtcagcagtcttaggatcaagcgatgcagtaccttcgtcaatcactaagaatgtcttattgtataaaaatgcacgagctaattcgatccttttttgttctcctcctgataagttcgttccattttccgcaaccatatagtcaataccattaactcgaacaaattcagataatcccgcttttttaagtgctatgagaatctgttcatccgtaaattctcttcccaatgttaagttcattcgtatgctatccgtaaagatacttgagctttgacgcaccacgccaaacatgtcgggtaatggtgctacggtgtctccttgcgtttctttaagttgcactgtgccttttcgtggcttgatttgaccaatgagaatattgataaaagtcgattttccagcaccagatggacctgtcagtaacaccttttcgccactgttaatttggaacgaaacatcacgtagaatactgggactattttctgaatgatatgaaaaatccacttcatccatggctaaggtggcgaagggaatcgaggtccgtgtactgcccgctgaagtgaacaaattaggatcaagaggttgaaaagatgtaatttttgcaatagaaggtcgtgctgcgttcatcatgctatttgcccgcgcaataccgagaaagacgttaataatccaactacttgagtactggacagccacaaaaccggccaaagaaacattccctttaatcaccataactataccaataccaataggaatataagtcatggtatatgcgagcgcctcagctgcaaagttactatttgcaataacgttgtctcgttgtcgtctgttttcgacgccatttgcaataacgccctgaccgcgctttaagaaaaaggatagcgcattataacttaagacagagtttatattacgcatgagatctgtcatgaacgtgacgtaactccccattgccgaactccagctttgagattttttctcaatcttagatttaaatattttaggaataaaaggcgttacgctaccaaataagacgaagattatggtcaataccacacttccccgaagtgcaactaccagtgtaaagaggaccgttgagactgactgaaccaacgtaaaagcttgtcggatatagttattctcgatcaaatctaggtcattgtttaaaaaagaagtacgatcagagaccccttcctcatttgtttcgataaagttggattgaataagccccacacggacgttttgattaaagtctgcaatatttttattcaaatatcgttgataaagccagtcaatcgttgacagtgctatcatcccaaaaataatgaagccaattgtctctattaccaccactacccgcttttggctcaccaatgcaaagatttgcgaataggcccatgtattgaatggaatcatcaagcctgaaaatgcagataatataatacaaactaagagtgaccgcttattcatgtattttctcataatagcctccacgcgccgttaaagtgatatcatctcttacactgtttgaacgccagcgggtttgtgatccgtaatccgtaagcggtcgtcaaaaaagctaaagcaatggacagaatttatgcttatctatccgctccgcatgatattgactatggatcctagcctcagttttctagaacacaatatgtcttagtttgcaacaagactgtttgaccagtcctaagtccagcagtgaactggaatgctttaatatttgctcttctgtatgtttgacaaatcacctagctaaaagcttcacagaagtagtgataattgttgtattaccacatgttgtattaccacacattctttgtctttctgttccatcgctgaattagatgaattaattgcgaaaatcttctaattttaaaacacgctaccgcaaattagatataactaatgatttgattgtaactacattaaatatcggtgtcaattaattatttcaacttaacttgatttaaatccggcatttaaatccagcttgaacttgcaataaattgtttgatacttatttcagttaaagaaagccgaaatccacgtgcagcttgtgattgcagaatgacatgcccatgttgatttatcgtaaactcctgatcttaactttaaaaaaatggttcaagtctacaactgccaatccgttctccttctcttttctggttatttcaggttacaatatggcgacgagtcatcaatagtatcttcatattcgatactgtcttcccgcatttattctccgatgaagtaacgaactttcttaaagtgaggtctaatcctatgcagacattttacaaaaatcgtcccgccacggtttggcaaatcagcaagacgaaccaacgtcctgattgggtacaagaggcgtttgatcaaaattaccttacgtggttagatgatcgccttcgaattgtcatggccggtttgtattcacccatgatcccaagcttgcaaaacgaaaaagccgatattttccatgatcatggtgttatgttcggcatcacttcgatcggttatttaggagattatctagacgttacaaatcatcgtgttgtcacgaaagaacaattttcaaagcactatcaaatccatgcgtcaggtacttggacataatgggtatttaaaaagcaatcgcctcgtctccaaaaactgacgagcgattgctttttaattgctgcggggtcagtaaatactgtggtaactaaaccctgtcgagcactttagaaattccgtgcaaaagaccagagaatgacccactgaacaaaaacaaatgaaagcgtataggtcagtgcccagcggctgccggattggacaatgaggaacccggccagatttccaatgatgatcaaaccgatcacaattgcgataagttctttggtgcgatgatcaattttgcctttgtaggttttaacgatccataaaataacaacagacgtaaataaaacgttaatgacatcaccgaacatcatggtgaccacctcaaattgtgcgagccaactcgttgttgcaaatggcttgttaacctgacatgcgagctaagttcctagtaaaagtatcgaacggcgccacgatccttttcctagcgttaatctactgccaattcgcactagacgtcaactattaatgcttcttctttttcctagagatcatcaaatcactttacccgttcaaccacctgctgtatcgcctccgcaaacgcttggggttgggtgatgttcaactcatgcccgcctgctagaacctcaagttgactttgcggcattaaccggttcaagcgcttggctgcaccgcgattagcccagtcgcgagacccgtataagattgtggtcgggacggcaacggttgccaacttcgcccttaaatcaagttgcatcagcgaatcagtcaaggtacgtacttgcgatttggtaacacctagatcagcgaatgccgaatctggttgaaatcggaacatcacatcttgcgccttcatcaataatcggtttggcggtgagtactgcggtgcgctaactaaggccccgacaattttagtggctgggtggcaaagctgcattagcgttaaaacagcacccaaagacaaaccgcacaaaataaccggggtttgattcttttgtaagtcccttgccagtttgtcattgagcatcgacaatgtcagcgagtcgtttggcgttagtccggcaaatacatcaaacgtgcgactgggcacccgtaactgcttttgaaccggttgccaaacatcggcagactgccctaagccctgaactaagataatttccatatgccctccgtcaataatgatattaggatcacttttgcatgatagttctaatctacctgatgattgacactttgtctgccccgcgcgccattaagttccctgagtggtaggtaaaaagatccccacttccgttttcgggataggcgtatgcaaaaagataggcagtttatcagcagaggcaggtgttttcctccgattactgtgccggcttccgcaccataacaagttcccgaatcgttccaaatttcgtcgcatcttcaaggaccgtcttagtttcagtgaagccaaagcggcggtaaaatgcttgcgccgcgtgattgttgtcaagtacgcgcacatagtcattcgaataagccccatcaagttccttgagcgcggcgttaagcaagcgttcgccaacatgctgccgctgaaacgctggcaaaacataaatcgagtaaagctcaccccacccagcacgttctgccatgcgcgccggtccataactacaaacgccgacaataccggcgatgtcgtcaattgctaggaacgtgttttgccagcggcgctcaggatgccagctggccggactcagctgtttcaaaaagctcgcaggaatcagatcccagtaagccacttgccaagtcgtatagtaaatttgtttaattgctgcaaaatcactgttcggtgtagctgcttggatgcgaatgttggtcattgcctacctcgcctctttttcctgttgattgtaccgaagaatccaagctgcagcggctgccaaatctgcacattcaacatagttcccgacaacatcctgccggccagcacttccgcgaccggttgcaacatgaatgccaagaatcccggcgttatcagcacattgcatatcggcccgataactgtcaccgatgattaccgcttcctgattcttaaaatgatatttcaaatgagcctgaccaataagaccggtcttcggctttcggcaggtacaaccagcattttcagcgtgcggacaaataaacgcatcgctacatcccagcttaaaaagcgagcggcgtaatgctgcttcgtccaactgacccgcagcaatctttgtctgattcgtcaaagcaaaaacctgaagcccagccattttcaaagcgcgaatccccgcgacactgcctgcgaaaggaacaaattgacgaataggcgtaaaatgaccatcgcctccaattgtcccgtcacgatcaatgaacacgatcttaatcggcatcacatcgtcaccgtcatttcgttaaatacagatcgcgaaaccggttaatttcagctggtgacaattgcagcccctcatgtaaatattgatcaaaagagccaaaatgttctgtcaccacctggaaaaaacgctgtaaatacgctgcatccaccgttaacgcttcgccaatggcctgtagtttctgctcgccagacccttgcttttttaagccagcgagaatttcttcgttggcttttttacgttcctgattagtccgcagataatccgccatgatgtcttgatcagatacaccgaggatttctaaaataatcgcagcgccaactccggtccgatccttgccggcaaaacagtgaaaaatcgttggccgatctggcaccaataacgcttgaatcaatgcgcgataaccagtttgagccgaactgcttactgccagctgctcatacgttgccaacatattttcgcggacactgccttgctcggtaatcatacggccgagactggcattattagcggtggcgtcttttaaaatatccaacaccgcataatcggcgcccggccacacggtatccggaaactgggcacgctcatcggcactgcgcatgtcaacaatctgcttgatgcctagatccttagctaaataatgttcctgcgcttcatccagttcaaacaactgaccggaacgataaatcaagccagctttaaccgcttgcccgttcgcattccgatacccgccaagtgaccgaaaattcgtaatcttttccatttctaatccgccctttcactgtgacgccaaccgataatagtttcaactcacacagaacggtgttaatgccgctgcggaaacttttccaatcgataaagctgttgatcatccaccgttgcatccccatttttaaacgcataccccatgtggcggtaaaagttcacagcagtaatcgaagcaggaatctcaacccgatgtgcctttttaaaatagggatcatgttccaatgtctgaatgatcaattttccaataccacgcttttgataagctggcagcacgaaaatgtcaaaaaagctaaattccgtctcactgccccagtaaggtccgatggcgccggtgcctacaattttatccgcatcacacactaagtaaaaatgcgtctgcttggccttttcaatgaagaaagtcggattcattcgctgaatacttgcctctaagtaagcttgcgagtaatccgcgcgatttgagattctcagcgtctgggcaacaaccgcggctacttcttgggcatcttccgaccgaaaccgcctgatatttagcatactgccatccccctccagaaacctgacgtgtccatgcgccccttgtatccgcttaatcctgatccggttcagacgccaagcaagcagccggcaactgcaaattgtgccagtcagtttcgtgatagtcttccataaattgttcaatatactggcaggcataaatatccaacagccgccgtccaccttctgtcaggtacatcagaagggacttttgactggtaaagctgccaattaaatcagttccatacagttgcccaagtgcctgattaagatcggctgacaacccgttcatcatcacgcgcggtcgtttacccaactgaatcagctggtaaaagatcatcgcttgcgactcttgggaaaacgtggcatagctgtcatcaatttgaaaggttgtccgatggtgatgcccatattttaccagtgacaagacgaaaaaatcccgatagcaaaaggtcagccatggtgccgtcttcaggaacgccgtcaaatcagccgtcaattgttcctgtgagcgcaagacaaatgtcggcactttttgaaacccgctgaaagaacgatgattgctgacccgaatcggcaaatattggttctgcgaatggccaagaatcacatacatggactggcttttacgcgctcgatagaaactaatcatatgatccccagaatctaatgcctgggcaatggccgctttaacatgcaactcaagtttttcactcatctgcatcagctcacctcgctttcaaaatcccggttgctactaacttaacacacggattgactagctggtgacgattaatgaaaagttatggttgctagcgatgttctgatgccaaaagtgcaacgttcttcggccaacaagtcttcaactgcctgattgataacgggatcatcactggcaaaagattggacctgccggctgtgaagatctattaactcgtacagaaaaagtctccgcaattggagactttttcttcggcatcaataaatactgctacatcaaagcggatacaccacatgaaaagactcaagcacaatccgcgccgtttccgggtcaaactgcttcccctctgctgcgtattcgtttttgaaaaatgccagatgaacggcgcgccaatatgccaggctccgatcgccttcaccttcgcgataagcgtgatcggcactgacagctaaaaagggctgcacttcaaccgcatctgtatacgtcacacaaaccggttcatctgcaccatttaaaatcacgccataagcgccaacctgaggcaatggttcatctgctgcgtacaaatcccgcgcactggctgctgctgtttttttgcctgcaaggactaacgccgccaacttatctgcttcggcgccgaattgataggcactttgtaaagtcgttggtgctggcaggttcaaagcctgcttagcctttgtaaaatacgcttctggtgtcatcacataaccctttctgttcatattctttgacggatcttcacgctcatttgtgatatggactgccgatattaatcataaaggcccggtaaatctgttccattaatactaaccgcattagctgatgcggcatggtcagcttgccgaaactaagcgtatcattggcccgcttcatcacggctggtgacaagccaagcgaaccgccgatcacgaaggtaatatccgaatgcccgtatgtaccaagatcggcaatttctttggcaaaaacttcggaaggtcgctgtttaccttcaatggccaaggcgattacccattctttgtctttgatcttattcaaaatccgatcgccttccttggcttttacgtctgccatttcggcttcggaaagattctccggcgccttttcatcggccacctcgacaattttaacttttgcaaatttgtccatccgttttaaatactccgctatgccgtcgcgaaaatacttctctttcagcttacccacaccaatgatcttaatgttcatacaactcagccctttatcacgtcattcatcaaccggtaacttatccttttcaagtataccagacgttttgcggcgtttgcctattgtcatcgttcggtttttagcgcaaaatatacaagttgaggttttttcaaatgaggtaaattgatgattgttattcagcgtctgatcagagatcgggtcctgcagatcaccgccttgttggttgtcataagcttattcatcggacggcctaaagcaagcgacataagttttgccacattatggtcaattcttgccatgatgacggtgattcaaatcttcgaacacctacatattcttgattactgggcttatcggttaacttcgcgagcaaacaacacgcgtcagttaacatggtggtttatttttctggcgatttttgccagcatgtttctttccaatgacgtgacggttttaaccttggtgccgttatatctgcgggtagccaagaaatatcaactgccggaaattcttccagtaaccttgatcgggatggccgctaattttggtagcgccttcacgccatttggcaatacgcacaatatcttcttgatgcaccaattcgaaatcgatctccagcagttctttagttggtccattccgctgttggggtgcagtttcctggtgttagtgctattgagtttattcttgcgtaatgtcccagtgccaaaagtaccgactgaacatattcacatccagatgcgtccgaccctgtttgccattgccgttgcgtgtgtggtttttgccggcgtcattggtgtcgttccggcttggctgggtgcaattctagccattgggttgtccgtagcgctggatcctaaagacatgaaagatgttgattatgcggtcgtgctcacgtttgccggcttcttcattatcgtcagtgtggtgcggcaaattccttgggtgacacattttctatccagccttatcaactctgaaccgtctgtttatttcagcagcatcatcacaagtcaggcaatctccaatgtgccgtcaacggttcttttagcgcggttcactggttatgtcgaggccttgttctacggctccaacatcggcggcgtcggaacgctggttggttccatggcgaatctgcttgtcttcaaacaatacatgatctatggcagccgaccgcatgcacgcttttttgtcggctttacgatcttcaacttaattggtttattgattctcggctgtgcgggctactggctgaccattcgctaaaatagatgataccgtgacactaggtaaccatagtgtgcactggaaaaaagtctttgggcacttacataataaataacacatgaaatgtatgcgttttcattgcttttccccaagaacgtgctagaattaggatttgctaaagaacgaagcgcatttaatccgcacgatggcgtcagacaaagttttgtctggcgtccttcatttccgcatatgaagcggttcgttcgcggactcaggaggaagataaccatgaagcgcaggacgttgttttcgatcatcgtcgtcacgctgaccgcaggatgttttaccttattctacggcatgcatagtatgtggactgatacccaatcagcccaagccgttcaagctgccaccgaagaagttgacacattattcaaggataaggcacaccaattaccggcagaccagcttagtcaagaaaagatcgaagcggtcgcgaccaagttacacgcagcgcggcaaaagctcacggaacctgaatacgccgccaaacttgccagtgcccaggctgatgtcgatgcagctaaacatatgctgaccgttaaaaaagcggttgcacaaaccaccactaacttatccgatttaaagaccttaacagacgaatcacaccaggccttatccgaacttgccacccaaaagcccgagtttgttcaggcctatcaaaaacgcgtggcacagttatccgatcaggaatcggcggttgcaaagattgccagtttatttgatgatcccgacttcaaggagccaaaagccggtcttagtgcttcccaagtgcaaaccgctttggctgcccttgaacatgtgaataatcaacagtttgccgaccaaatgctgccaatcatcgccaccgcccagcaagcagcaactgatgatcagacaacgagtgaagccagttcatctgaatcatcaacatcaggcgaatgtagataggctggaagtggaagtgcagcgatgcatggagcggaccagtactaatcggtcgaggacttaaccaagtaaagcgcaaactggtgctaagccagcgcgcgcgtttcgatgaaatgcgttaagttccggcaatgcaaaccaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcaaagataagatccggtcattgaccggatcttttttcgtaactaataattcaatgcgacggatttgatgaaagcgttgaagaacgcttgaaaacactcattaatgagtgctaaattgcaagagcaggtatagaaacgaggtccggataatgccaacaaatgcgacaaagacaacactaaaatctttgacagccagaggcactgttgttgttgatttttgggcgccgtggtgtggcccatgtaaaatacttgagcccatattaacggcattggaggcggagttatcaggcctaaccattgtcagatacaatgttgaaaaagatccttccttaccgcagacgatgggtattatgtcggtgccaacgttggtggtttatcaagatggtcatgccaaggaaaaagtgaccggtgtctatgctaaggagaaactcaaacgttactttgaaaagaagctagaggccgggcgatgacaaacgtgatgaagcaaagtaaggtgaatgaccaaaatcaggttctagctacatgcttattagcaggccggattatgattgaaggcggttcggagatgtatcgtgtggaagatacgatgcggcgaattgccgttaatgcgggacagccggataccttggtttttaccacgcctaccggaatcttcgccagcattgaaaaccaaccctatattcaagagcgcccgattaacaagcgatcaattgatatggagaaggtcgcccgcgttaatcaattgtcgcgctcgtttgcggcaaaagaaattgatttgggtgatttgcatgcggctttgacgcagttggatcagaataccccgttttttccaatatcatggcagattctgagtgctgccgtggtgagtgtgacgctaatgattctgtttgcgcaaaaatatgattggtttgatatccccttagcagctgttgttggtgcgatcggcttttgggtcgatatcaaggttaatacgatcacgaatatccgttttatcagtgaacttttaggtgccttggctgtcggattaactgcatggattggcgtcaggctgggatggggacatagcctcgataacattatcattggtgccattatgccgttggtgcccggcgttgccattacgaattcgattcgtgatatgttggctggacacttgttatccggcatggtaagaggaatggaatcgattctcagtgcttgtgccattggggttggcattgcgattatttttcgattcttttagtaaaggaggcaggcggtttgtcatggatattcgcgttacttattcagctatcttttagttatttggcaacggtggcgtttgcgattatcattaatgtcccgcgaaaggcgcttaatctcgctggttggtcgggaatgatgggttggttggcatactggctgttgatggaagcaggaatcgggcggatgatggcgaatctgactggcgcatttgtcattgggttatgcggcattttttttgcccgctataaaaagatgcccgtgattatttttaatatcccgggatttgttccgcttgtgcctggcgcaattgcttatcaggcagtgcgtgcagtcgtgatggggcaattgaatgccgccttgcgttatgtgagccgcgtcatcatgattgcgggtgcgattgctgttggcttcatgttggcgcaactgctgtcggaattattatacagacgcgctgttttgaaacccaaaaagtgatacaatactcatatgcgatgagtcgagtaagcatgtatcaatgctgaaagaagcagctgacaggttaagagccacccgccggatttgtggggtcagcgatctcaaggttgtggagccagcgagatcctatccaagtttttggatactgcaagaggcagtcagataatttatctggctgctttttttaagtgctcaacaggacagcttgtttttaatttgttttttaaaaagttttcccacgagcaaatccgttatttattaataaaattatcagaaatagcgtgcaattttcccgggtgaaaatcggcgtgaatataaatagattttgcttcatgatacagacgtagacgcctcgacataaacgactatcaaaaagtttaaaatttaagttgactttttaagtgaaccagattaatattctaaccaatcattaatcttacttgaaagaaggcgggtctatgtcagtcatgtgtatgtcagcaggcacgatgtctgttggggttattaatcatttagccttgttgctgatgtcagggacccgaccgtttgatcaatagcgatcagcgtatcgagccccgtcttcgcattggcaatggggcgctgatacaggcacccattcgttggaatgggtgctttttttcttcgagattaatgacaattcgcggatagacgcaaagggggaaccaaaatggcgaaaaagtttctaaagacgattatcagcacagggatgattgcggcatcagtattggccttatcaggatgtgcgaccaaaagtgctgcgaataagggtaacacggcgggcagcaccattaagattggggtcaatatggaattatccggggctgtagctggctatggcgaacaggaaaagcaaggcgttgagttggcggtcaaacagattaatgcagcaggtggcattaaggttggcaacagcaagaagaagatcacggcgatttatcgtgataacaagtcctcaaccagcggagccgcatccgttgctgctcagttggctaatagtgataaggcggtcgcaatcgtagggccggcaaccactaacgacggcacggcatccatcccgaatgtaacaaaggctggggtgccaatggttggaccaagcgcgacggatccaaactttaccttgcaaaaaaatggcagcgttcaaaagtatgttttccgcgcttgtttcaccgatgccttccagggtgaaaaagcagcagtctttgctaacgataccttgaaagctaaaaacattgcaatcatcgctgataactcgactgattacggaaccggtttggcaaaagcattcaaaaagaagttcgccggcaaagtggtcgcgaccgagtattatcaatccggcgataaagactttaacgcgatgctgacgaatatcaaaaataaaaaaattgatgccatttacgcacctggctattattcagagcttggccttgtgatcaaacaagcgcggcaggcaggcattaaggtgccaattattggtgccgatgggatggctgatccaaaacttgccaagattgccggagccgaaaatgcaactgatatttattacaccacgccattttcaacgttgagtgcaaatcgcagcagcttggttaagaacttcctggctaactacaagaagcaatacaacgcaaatgccccgacgttctcggcactggcttatgattcggtttacatgatcaagcaagcgattgaagatcaaaagtctgctgattcggctagcatcgcaaagggcctagctaagatcaagaatatgcccggcgttaccggtacgacgactattgacagcaagcataatccggaaaagccgatcgcggttgaagaattgacacaaggcaaaatcacaaaggcgtatacggttaaataatgcgcctgttggaattgcaaaagggggttacatcgcttgcagaccatgatgcaacaaattatcaatggactttcactcggcagtatttatgccttgcttgcactgggctacaccatggtctatgggatcatcaagttgatcaacttcgcacatggtgatatctacatgctcggtgctttctggggctattacgcgattaattatctccactttgggtttgtgacggcgctattgtcagccatgttgatggccagtctttcaggggtattaatcgaatatctggcttatcgcccgttacgtaactcgccgcgaattgccgcgttgattacggccattggggtttcctttttccttgaaaatgggatgtcgtttttgtttggcgcgaatgctcgtaactttccacaagtcatcgcgaccaaaacgtatcatctcggcggggtggatatttcaaacgtccagttgttgattttattcacttcgctggttttgatgatactgcttcaatttatcatcaaaaagacaacgatgggaaaggcgatgcgtgcggttgcggttgatccgcaggcggctcagttagtcggcattaatccggatcacgtcatttcctttactttcgcgttgggatcggcattggccggggcggctggtgtcatgatcgggctgtattacaactcaattgatcctttgatgggtatggtaccaggcatcaaggccttcgttgcggcggttgtcggcggtattggctcgattccgggagcggccatcggtggtttcttgattggtctgcttgaaaccggtgtccaggcaattggcttgtccgcttacaaggatgcggccgtttatctggttctgattttagtcctcgtcgtcttaccagccgggttgtttggcaaacgtcaacgagagaaggtgtgagctgatgcttaaaaacttacgcagcaaattaatctggttggcgatcatggtggctggctttgtcttgatcgatattggcgagtttaccggaatcgtcaacagtttcattgaaaatgcgctcgtcacgatcggtatcaacattattttggcagttggcttaaacctcattatcggcttttccggtcagttttcattgggtcacgccgggtttatggcaatcggagcgtatgcgactgctattgtcacgcaaaatatggcgaccccgcttggcttttaccttgccatgctactggggatggtgattgccgtgattgccgcgttaattgtcggcattccgaccctgcgcttgcgtggtgactatctggctattgcaacgatgggggcagctgagattattcgcgttattatcaataatctgaaaatcaccaatgggccagcaggcatgttcaatattccgccgcttgcgtcttggcccacagtatacgtgttgatgtgtgttaccaccgtggtcattgtcaactttgtgcatagtcgctcaggacgtgcgatcatggcgattcgcgatgatgatattgccgcagaatcgatcgggatcaacccgaccaaatggaagttggccgcgtttgtgttaggtgccgcaacagctgccattggcggatccttacatgctagttatttgcagaccattgcaccgggcgactttggcattatgaattctatttcactcttgattattgtcgtgctaggcggtgtcggtagtatgactgggacgtttgtggcggcaattgttctaggcgtgatcgacacggttttgcagaacttcgggacgttgcgcatggtcatctacgcgttggctttgattttgttgatggtctttaagccgtccggactactggggcattatgagctttcttttagccgcaaacggcgcgcgcgaaaggaggcggcgtcatgaccaagcaattggtagtcgagcatgttagcaaagtctttggtggacttaaagcagtagcagatgtcagtttaaccattgatcaaggttccttgattgcgttgattgggccaaacggtgccgggaaaaccacactgttcaacatgctgaccggcgaatccggaccgacaaccggtaaaatcacacttaacacagcaaccggtgccgtcgatattaccaaaaagaaggcttttcaggtggctaaactaggcgttgcccggacttttcagaatattcgactgtttggggcgatgtcggttaaggaaaacgtcttggtggctagaacccacctgtatcacgaaagttttctgggaacggttttgcgcttaccgcagttttatcaaaaagagcgggcagtcggaatggcggctgatgaattgctcacatttttcgaactcaatgatgtggctgatgaaccgactgccagcctgccatatgggacgcagcggcgggtggaaattgtgcgtgccgttgctactaagccgcaactactttttctagatgaaccggccgcggggatgaatcctgaagaaacggctgatctaagccgcctgattgcccgggtgcgggaacattttggcatcacggtggttttgattgaacacgatatgtcactggtcatgaatctggcagagtatatctatgttcttgatcatggagcgatgattgctgaaggtacgccgcaagcgattcagcgcgatccgcgggttatcagtgcgtatctgggaggtgaggtgcatgcttgatgtcaaagacctagtcgtcaattatggcggcattcaggcagttaaaggggtcagctttcgcgtgcaaaccggcgaaattgtggccttgattggggcgaacggggccgggaagagtacgattctaaaaacaatttccggattgttacggccgcgttccggcaccatcctctatgaagacaagaatatcgtggggatggcagcagccaaaatcgtgaaaatgggcatctcgcaagtaccagaaggacgccacatttttgccgggttgacggtgagtgagaacttgcagatgggggcattcggactaaaggacaaacaagtcgccagtgatcaactggcggtcgtctatgatcggttcccggttttaaaagaacgtcgcaatcaagacgcggcgaccctttccggtggggaacagcagatgttggcgatgggcagagcgttgatggcccggccaaaattactcttactcgatgaaccttcaatgggcttgtcaccgatctttattcaggaaatttttgatattattaccaagattaaaagccaggggacgaccattttgttaattgagcaaaatgctaaacaagcactggccgtggctgaccgcgggtatgttttagcaagcggcacggtgaagttaaccggcaccggggccgatttgctggcagatccggcagttcaggcgacctatctgggagcgcaaccggcgacctgaggcagataagatgttattttgcagacgagcagcgattggagctgctcgtcttttttataaaaaaattgtatcgattggtgtacgcgtgtagcatgatatcggcagagcaaagacatcaacaccatcgcatctgctttggtacccttgaaagggaggataaggacttgaacttaatcgcgcaccaacagtggctggtggacttttacgaaaagcgccactggtatcaatattcaccgttcattcggctcaactttctcacggaggaaaccggcgaattatcgcgggcgatacgagccattgaaattggccgtgatcatccgggcgagccggttcaaaacgaagcagacctcgaggctaacttgaaagaagaactagcagacgtgttggatcaggttttaatcttaagcgctaaatttaagatcgatcccaatgatttgttggcgcaaagtgaacataaattgaaggcgcgttttaagcaagatgtttgagccaatgtgattgcgtcaatgagcggtggtcacttggattgtctgaaaagtgtccatagaaaaacggttctggcaaactgatgccggaaccgtttttgctgggagcctgttaggggtgattattgattttgccccccatcgcccggtgctggaccaacaccgcggccgctaccgcctgttcccggacgaacgccttgttgatttggtgttgcaaccatgtattgactaatcagactaacaatctgtcggttttgcggcaaggcgctatggttggcatcgtcgcctgagacggtaatctgggtataatgggcaacctgattttggaaaatatacttaccggcttcgacactttcgatcggcaccgtgccatcgccatccaacgtttcggttccggcaatcgagtaaacggttagactgctcggaagtttgttgcgactggttataaagtcattgagcatctgtgtccggttatccggattactttcttcgaggttatacggagtgccaatggtcattagccgagtcatttgaacatctgaatcgttgtaatatttttctagaaaaagcgtgaaaatgagtccgccattactgtggccgataccgcggaaccgattgaaattgtatgtcttggccagctgcttaaacgcgatattgaaccattcggcctgcttcttaatattgttgtaaccatctttattattttcaaatgccacaacgatataaggttcggtatcacgggctgcgattttgccactataggtcatggtgccatttgtcttcaccgtgatctttaaaagactatgaccggttgtttgcgcattgagttgcgtgattaacgtgttaaaacggtcttcggtggccgaactccccggaattaagataattggctgcattcgggaattgtgaactacacgcgcagatttaacgttttgcgccatccactgagttgcgggaaacacgacagcacccattgcaagtacgctgagaacaagcaaaagccatttgcgccaatgtttaatcatgatgaccacccacttttgccgattcaagattgatggtttcggctaaccggacaaacgggacataaatgaagactgaaatgaccagacacaagactgcgactaataatgcgacaagattgccattggttcccagaaacgcgattaaaggtcccggggttgtcgccgggaccgtgtaaacagaaggcggcataagatgcagtctgatggcagtccaggcaatggccatgttgatcagcggggtgattaaaaacggaaccagcatgatcgggttaagcatcaccggccagccgatcagaaccggtgagctgacatttaccaaacccggaaacaacgataacccggcgatgcgacgtgatgcctttgaccggccgacccagagcgtggcgataatcaatgctaaggtcatgcccacaccgccaaagctggcaaacggacgataaatcgtgcccatcgtgatcggattgggaacgttaaataaatcggcatgttccaacgcataattcaaattggcggtcgccgtggtgctgcctgattgaaccatcaacggattaatcggaccttcaatcccggcccaccacatcaaagcattaatcgtcgtgacaagtgcaagtcgcagtgaaacgtgggttaagtgagcagccgggaattgaaagaccacgtaaaagaggcccacaaacccttctgttgaaacaaaaccgagtccgtaattaatgaccacgcagctaatgagtatcaggagcatcatccaggttccccgtaatccgcgactgacaagcccggcgatggtatagcgatgtgaaggttcttctaaatccgcccgcgtgaagcgaaaaagccagccaatcagtaacccgaagataatcgcaatgaacaagccgcgatagcccagattgttcatttgaaaaactgattgggcattccggcgcgtttcaagattgagaattaaaaaggctccgacgcttgtgatggcagctaaagaatcgtccttcttatacgatcgtgcaacatacttggcaacaaaaaaggcagtcataacggccattaagttaatggtgacattttcgatggcgatcaggagtgtgcgcatctgggtataaaaaggaatgaccttgttgagattataaatgacggcaaaaaaaccgttacgcgaaaaaacactcagctcaagcatttgtgcccatgcgccgatcacgacgaacggaaaaatgacagcaaaagtttgttgaagggcacgataagttcgagtttgccgcagccgaacactatttgctacgagcatcggaagcaatctttttgtgagattgctcatgactgccatctcccttgatttgttgaacacctattactgttattctaacaaatattattgtaatcgagtagttttatgacggacaggacggcgagtttggcaaacgagaagatgacacattgacgaacgtgactcgagcaatggcgatgtgggttcacttgttacttttgttgcagcgtatgcaagtgactcgttaccatggtatccttaaagctggaaagcaaaagacgttaattagaaagcgcgttcataaaggcagtatcgctattcttgcgccacgtgaatacgcgcgtctaaagcatgatggaggcataaaaatggataagccattggcaaagtatattgatcacacgttattaaagccagacgcaacgcaagcccagattgatgtgattttggatcaggcgaagcaatatgattttgcttcagtgtgcattaatccttattgggttgtgcgggcagcagccagtctacgcgacaccgatgttaatgtttgcacggttattggtttcccacttggcgctaacacgacacagaccaaagtatttgaagccggtcaagcagttgacgaaggtgctaaggaagtcgatatggttttaaatatcggtgaactgaaagctggtcatgatgatcatgttcgcgcggatattcaagcagttgccgacatcacgcatgcaaaaggcggcattcttaaggtcatcattgaagcagttctattaactgatgatgaaaaagtgacggcatgcaaactcgcagctgcagccggcgctgatttcgttaaaacgtcaaccgggtttgctgcagggggtgcgacggttcatgatgtcaaactcatgcggcagacagtcggtgatcaattaggtgtcaaagcggccggtggtatccacacctatgctgaagccaaagcgctcattgaagccggcgccgatcgtttgggtgccagtgccggcgtgcagattttaaaggaagcaggggaagcttaagatggcttttgatcgaatcattaccattgtcttagattcaattgggattggcgaagcaccggatgcggctaaatatcacgataccggtgccgatacgcttggtcacattggcgattattttgccgggaaattatcgttgcctaatttacaggcaatcggtctgggcaatattgaccgccctacgccaattgctggggttaagccattagggagtccgagtggctattttggcaaaatgtccgagatttcagcaggtaaagatagtatggacggtcattgggagatgatgggtctgccggtgacggaaccgcttggctattttcctaatggattcccggaagacttgattaaacaaattgaagaattttccggccggcatgtcatcttaaataagccttattccggcaccgaggcgattaaagactatggtgaagagcagctgaaaaccggtgatctgattgtttatacgtctggcgattcggtcttgcagattgcggctcagactgatgttatccccttagaggaactgtatcggatttgccgttatgtccgcagcatcacgattgacgccccatatcgcatcggccgggtgattgcgcgaccgtacgtgggaaccgatccgacaacctttacgcgtaccagtgatcggcatgattatacattgaaaccggataagcccactgacttggatcgcttgcagggagccggtgtgccgacatatggcattggcaagatcaatgatattttctccggacaaggattggatgatggggtgcacacggttagcaacgtggatgggatgaatcaaacgattgccgccgtaaaatccgatcgcaaaggctttattttcaccaatctcgtggattttgatgccatgtatggtcatcggcgtaatgctcaaggcgatggtgacgcattaatgacgtttgaccaccagttaggcgatttgttgacggtgttgcggcgtgaggatttgcttatgattacggccgatcatggtaacgacccgacatttcgcgggacagatcatacgcgcgagttcgtcccgttactagcatatagcaaggcattagccggcaacggggatctgggtatccgttcgcctttttccgatttaggggccaccattctcgacaatttcgaggtcaccgggaatcaggtagggcaatcgtttttgagtctgcttcgctaatgaggctaggatccggtagttgtagttgcaatcaatccggatgatgacgggtagctatctgacggttgtcacttgcttgtcgttcatttgtcgacccgaatccaactaagggggaattttcatcatgagtacacatattgacgctccaaaaggcgctattgcagatgttgttttgttaccgggcgatccattacgtgcacaatatattgccgaacattttttggaaaaggctgtccgctacaatacagtgcgtaatgcctttggttatacgggcacctttgaagggcgacggatctcagttcaagcgacggggatggggattccttcaatttcaatttatgttaatgaacttattcaggattatggcgttaaaacactgattcgagtggggactgctggtggtatgggtagcgatgttaaggtacgggatgtcattctggtacaaggatcatcgacagacagcagcatcgttttgaatacgtttggggcggggatgtattttgccccaatagccgactttcagcttttgcgtgaggcagcaaatttggcagacgctggggcattgcgctaccatgtgggtaatgtgctcggagaagatcgcttctacaacgatgaaatggatcgtcaaaagctcatcgattatggcgtgttagccaccgaaatggagacccctgcactatatcttctggctgcgaagttccatgcacaggcgttatcaatcctcaccgtctcaaatcacctgatcacgggtgaagaaacaacggctcaagagcgtcagactagctttaatgacatgatcgggttggcactgggcgtcgctaaaaagattcctgtacgttaaataacgtataagttgaaggcatacccgtgtaaaatgacggtttaaaattttccggaaatagcaaattaatgtgcgaagaagtaggaaacgtgttattctgtatatggtttcttaagaaaaggtaaatgcaaattaaagtgtaaatttagattcgtgcaattattcagtttagaaatggaggagtacatacatggtagattctaagaaagtattgtcagtaacggcaggcttcgttggtgctgccggtctggcggctttagcaaccggagccaataccgtttctgcatcgacagggacggtcagttacaaatccggtgcgaccaccgtatggaatagtccatcatggcaccaagtcaaacgctacgtgacttttggcgacacggtgcagctattaggtaaaaccgttgaccaaaatggtgctacttggtataaagttggcgacaatcagtggattccggaattgtatttgaatgttgcgggtaaaacggccacggttgaaacaccgagttcggcagcaagtcaaactgctgtcagccaagcaccggctagtcaggcgcctacaagccaagcaccagcaacccaaacacctgcagcaccacaaaccgatacccaaacagctaatacacagctttatgtcaagaatatcggttcagcagttaccgtatggacaaccccggcgtatactcatgcgacaggtcaatatctagaaggcagccagacactgacggctgttgcccagcagcaagcaaatggtgaaacgtggtatcggcttgccaacggcggttatgttcctgcacggtttgttagcacaacgccagtggctgtaacaccacaacctgcagcgccacagtcaaatgaggccagtgttgcatcaacgaacaccaatgcagctaatgattctgccgctgcttctagtgcagccgcatcgcaagccgcagcttccagtgctgccgcttctacagcagcagctaatgcagcagtagcatctgcaaatgccattgcatcacaagcagcggcttctgaagctgctgcatctcaagcggctgcatcacaagccgcagcgtctcaggctgccgcatcacaagctgcagcgtctcaggcggctgcatcacaagccgccgcttcacaagctgcagcgtcccaggctgccgcatcacaagcagctgcaaatgctgcccagcaggcgccggctaaccaggcaaatgttacaacaacacaggttaatgccaatcaagctcaacagcaaaccgcgacggctacaccagcagttaacacgtctaatcagacggcggccgtaagtgcttcaagacaggccaagattcaagcagtgattgccattgccgaacaacaagttggtaagccatacgtttggggcggtaaggggcctaacagctttgattgctccggtttgatgtattacgctttcctgaatggcgctggcgtcaacattggtggctggacagttcctcaagaatcttcagggacacaagtttcactgagtgctttgcaacccggtgacttactcttctggggtagtcacggttcaacctatcacgttgccctgtacatcggtggcggcacgatgattcaggcgccacagccaggtgaaaatgttaaatataccgcgctggcatacttcatgcctgactttgcggttcgcccgtcactataagcttaatgatcgaatgaagaatgcaagaacatctctgagtcgttagaggtgttctttttatattaaaaaaccagacagttccgcggctcttagtggctgcatgaactgtctggttttatatacatgacaaaatattcgtaaagcgagttaggctaccggtgttgtcgttttctttttagccttggcaactgccgccatagctacggcgtttacccagttaatcggctgatcgaagttaggttggaagagcatgtcaaccatcgcaagtgtttcgatcgtcatgtgggtctggatcgctagcgaaatgacattagcgctttggctgatatcgtgcttggagaaaaaggcacctcctttaacttcgtgcgtcttgggatcccatgtcaggctgcagagcaccggcgttgtggttaacatgaaatcgggacgataatcctgttcgatcgtgacactatcaagctcaagtccacgtgcgtgagcgccttccaccgttaggccgcttgccgcaatggcgtgatcaaaaagttcaacagccgagctagattgtgttcccaggtatttttccgtgggggtcatgatatttttaccaacaagaatgccctgacggactgcgttggtcgcaagcgggatgtagtcatttttgccagtcggattatagtggacggtagcggtatcaccagcagcgaaaatgtcggggtcactggtctgcatatatgcatttgttatgacagcgccattaggcagggtgtccagatggtcctttagcagatccgtgttcggacggaagccggtacataaaattgcaatatccgcggtatagtcgcctttattggttgtaaccttgataccctgatcagcttgtgcgaactcggtaaccatctcattgagtgccaagtgaaccccgtgatcggtgtaaagcttttcaacgcgatccgtgatagtggcgtcaaagtttttcgccaaaacccgtggaagtccatcgattaacgtgacttctttgtcggttaacgcaaattgttcggctaattctgcaccgatgtagcctgcaccgatgacaatggcgcttttaatggacggggccagatcttttagcgtcttggcgtcggaccaatttttgcataagtagacgtttgaatcgtgaataccgggaatatttggaatgattggcgtcgatccggttgtgtagactaatttgtcataagtatcggtagtaacggttccggtttttagatccttgacttcaactgttttagttgctggatcaatattgagcacgtcatgttccatttgcatattagcaccgagtttagcgagtgcttcgggactggaatagaacattttatccgggtcactgacatgatcaccaacccacaaagcaatgccgcacgagaggaaggacaggttgttattgcgttcgtagacagtaacctctgcatctggatggtcggttagaatctgctgggttgcaaatgtaccggcatgggtagcaccaatgacaagaatcttcatatcgcaatcgctcctttaaactattgataaaaatttcacaagtgaattataacataattgattgtgtcatgctatattgcttgcgatttattttgtgaagaaaaagttaagaaacgctttcaaagcatcgagatcctgtcattcccaatggcacttactagttaagacgatgttcttgataagggtaaatttttatgagggatttacccagtactgtttatttttgtttatacaaacaggccttgaatcttggcttgaaggcgttcttgatttaaaagtgaaagaaattggaaaaaattgttcattaagcgtttacattgaagctgttacatggtatagtcattttgttgaataaacatgcacatgtggatcgttactattcaattaggcgtaaccacggtagtcgaagataggaaaatatcttcggctaaccgtggtttttctttgccctttttctacgcagccatatacgagcagcacgctttcatttatctggatcgcgaccggataaagtgacatcaaaaattatccaggaagaaggtttaactatgcaagtcattgttaaacgacttgagaaacatcaggcgttgtttgaaaaaatctcgcgtaatatttacctgatggccattaaagatggttttctggcagcaatgccgattattctgttctccagtattttcattctattatcaaatattccgccactgattgggattaaggttccagttgatctcaacgcatggttcaataagatttataactacacaatgggttttgttggtttttatgttgccgggacgacagccaaggccttaactggatcgatgaatcaacgaattaaaggtgggcgctttctcaacaatacgtcaacgatgatggcttcaatggtaggattcatgctgttggcgattggcaccaccagtaaaggcaacttcttaccaacattctttggcacacaagggattttgtctgcctttgttgcagcgtttgtgactgtttgggtctacaaattctgtgttgaacgtgatttgaccatcaagatgcctaaagaagtgcctggagccatttcccagaacttccgtgatattattccgttcggtgctgcaactttaattttttcactcattgatgttgcctcacgtgcggcgttgaaagtgccattcagtgctattattgcgactgtgcttgcgcctgtctttaaaggtgctgagacatatcctggcatgatgtttatttggttcttaatcccgatgttctggttcttgggcgtacacggaccatcagttgtcaagccagctcttgaatcagcattgtttgggaacaccaccgccaatttggacttgtttaaggccggaaactttccatatcatgcactgaccgaaaattttggtaactttgttggtgaacttggtggtaccggggcgacctttattgtcccgtttctattcatgtttttcatgaaatcaaaacaattaaaagcgattggtaaagcatcatttatccccgttatgttcgcggtcaatgaaccactgctgttcggtgcaccaatcatcttgaatccttacttcttaattccgtttgttttggccccagtcgttaatgttgtaattgggaaggcgtttattgatttccatatcatgagaggctttatgtacttcatgtcgtgggcattgcctgggccgattggtgcattcatcgataccaatttccagtggacttctttgctgcttatggcaattttgctaactgtggatgcgctgatctatatgccatttattaaagcgtacgatgctgaactgcttgaacaagaagctgctgtcgatgccggcactgcaaccgctgcagcaactgctggtgcaagtgaagttacagctgaagcagatgcagcaacggcacaagaattcccagaaccggaagaggtaaagcaggctgaaacagctaagcaagaggaagctaatcaaaatccagctgcaggaaagaaactcgatcatgagttgaaagtattagtgctatgtgctggtggtggtacaagcgaacaattagccaatgccttgactgaaggcgctaaagagtatcatgaaccaatcgttgccagtgcaggtgcatatggctcacatcatgatattttgccaaactatgatctggttgttctggcaccacaagttcgaacctactacagtgacttaaagcatgatacggatcgtttggggattaaacttgttgcaactaaaggtcaacaatatatagccttaacgcgtgatcctgaaaaggcattggattttattgttgaaaattataaggatgtcgaaaagaaaccacaagatagttcagattcaaagtaaatatgttgacttaatttaaaatcaagcgaaaagaaaggtaaggcggtgtatcgatgttgctaaaggtcaagcaagtctataacaataatgctgtacttgtagacgttggcaacggtaaagaggcgattcttcaggggaaaggaattggtttcagcaagcgtaaaggtgatgacgttgatccaaaagcgagttcggaaatactttatctaaatgatacgcaagtcaaaaatcactttacatctttactcaaagatgtaccgattgacattgttgttgctacatttggtgtgatcggaatggcaaaaaagaagtatcactatccggttttgaactatatttatgtcacacttacggaccacgtctttcagatgtataaacgattgactgccggcaaatatcaagctagtccagcgcctgacatccgtgatcgttacccgttgccttaccagatcgcagccgatgcgcgccgacagcttaaccatgatcttggcgttcagtttcctgaagccgaaattaagaatattgccttacattttattaatgcaaagggagtggatggcgaactggatccgaccgtgaccctgacggcgcgcgtcaatgcaatcgtgacacaagtatttgctaaatatgggttaaatcgcaattttgctaatcaaaattacttcgatcggctaatgattcatttgcaataccttgttgaacgtttaaataccaatgagcaagacgaggctgaccttggtccggaaattggtcaggacttcaggcgcctttatcccaaatcgtttacgatcgcaactgaaatttgtacggagctggaaaaagccttacaaattaagctcaacgaaaacgagcatgtgtactttattatccatattcaacggctcatccaagaaccgcaaacacttccgcctgaatatccatagccgtgggtgggagtttagaaagtaatcttggcttagagcgatttaggcttaagaaatcgctgctagcgtagaggattttcaaaccaagggaggaattttgatggcaaccaaagaagagatttcaatgaccggttttgcaattgttgcttatgccggtgatgcgaaaaccgatttaattgaagcattgaacgaggctcgtaaaggcaacttcgaacatgcccgctcacttgttaaagaagcgcgtcaaagtatcgatgacgcccataatgaacaaaccaaactgcttagtaaagaggcaggcggcgagaatatggatgttactttcatcatggttcatggccaagatacgctaatgaccacgatgatgctgctagatacgattagtttcacgattgatgagtatgaacgactggcggcaattgaaaaacaattaggcattgcattgccaacaaacgatatccattaaagtatcaaacgaaaggagtatcattgtgacaagtttattgaatcgcgttcaatcactgcctaaaggttttgtttggggtggagcgactgctgcttatcaggtagaaggcgccaccaaggtagacagtaaaggcaaaaccatgtgggatgactatctgaaagctcaaggcagattttcgcctgacccagccagtgatttttatcatctttatccagaagatattgaactcgccaagctctatgggttgaatgctattcgggtttcgattgcctggacacggatcttcccagatggttacggtgaacctaatcaagctggggtcgcatactatcatcgtttgtttaagtgctgccttgataacggcattaccccgtatgtttcgctgcatcacttcgattcacctaaaacgctgttcgatgatggggattggctgaaccgtaagaatatagactattttgtcgattatgtcgatttttgctttaaagaatttccggaagttaagaactggttcaccatcaatgagctcatctcgttagccttttcgcaatacattcaaggcaacttcccgccaaatcatcactttgatgttaccagtgctattcaagcgcagcacaacgaactgttagcccatgcgcgcgtggtcaacttgtttaaggaaaaaggctatcaaggacgaatcggattgattcatgtgctgcagccggtatatccgtacccggatacaccagctaatgagcatgctgcggcacttgaagatgccttcatgaatcggttcctgctggatggtacgtttaaaggcgaatatacgcccgaaacgatggcgttgatcaatgaattgctgaaggccaaccatgccaagcttgaaatcgaaccaggcgatatggatgtgttgaagcaagcgtccacgcaaaatgattactttggcatgaattactatcaaccttcttttgttgctgcctacgaaggtgaaagcacaaattcgtttaatggtaccggcgaaaaagggaccagttcctttaagttccaaggggttggccagcacgtcaaaaatccggatgtgccgacgactgattgggactggaatatttatccggctggcatgtacgacatgctcaaacgagtagctcgcgaatatccaaatagcaagacgatttacattactgaaaatggccttggttataaggataagtatgaaggcattggcaacctcattgaagatgacaaacgcatcgattttattgatcaacatgttgctgcgttactaaaagcccgcagtgaaggcgttgatgtccaaggttacttcgtttggtcgctgcaggatcaattttcatgggccaatgggtataacaaacgatatgggttattctatgtcaactttgaaacccaagcgcgcgaaattaagaagagcgcactgtggtttagagaattaggtaaaaccttaaaaaattaaagagacatgcaaaaacaggcattccaagttcatctggcgtgcctgtttttgtgttgcttcaagtggtcgcggtgctggccagccacctgccaatcatttccaaatgatgcatcaattggaacttacgtacaactcccaaccccgggaaatgatgctgcgcggccgctgccatcaaagctttcgttccgagcgtctgtgcgtcgggatggtgtggtaaccacgcagccagctgcaccagaatttcaaaaaatttggcttgcgggttagtgaagtcgtcattgttgactgaaacaaaatggtgcaggcgcagggaaccatcagctgccgggtaaacaaggtggatggctaaggcgcgctgcggatagccatgctcgaaataatcagcagtggccagcgggtaatccgcaaagccgatgcctggcaacatcaacggcgggtattggtaaaactcatcttgcagcagcccataatcagatgtgtgtggataaacggtgaagtgatcatttaaataaaccgcgtgtggcaaagctaactggcgcacccgagcttcatcaggcaccaaggccagctgacggcgcggcaataatttggcttgggcggctgtggtcgcaataatcaaaggcgctggttgggcatcaaaaatccgcgcctgctgaacggtcccactgatgttcggtaaatgacgcggggttgccaataagcgatacgtcccgacttgcgggttttgaatcacataagcggcatgctgggctcggctaaaggcacgggtagctttggagacgccggggatgtctttaaccggctcaagaattggcgtgacggtggcgggcaattgctggtgggtggccaattccgagacggccgctaagtcgaattgtttgccgcggataattggaaaatagttcatgataaccgagccatttttaaagttgcgagttcagccgtcaatgcatcgatttcttcttggagcgccgtgatcgtggtattgttgagttcatcgacaaactggtcataaagatttttgtcaggatgataaatgtcataatctgccgttcgtttacgcagttccgtgaacaagtccgcggtcgaaaattgcccgagtcccttgacaacctgcttggctttgacgacttcacggttgagactggcaatgaagcggtcggtgagctgattttctggtacttgcaaagtctggcggcgcgcaggtttggcaatcgtcaacgttcccggcgtcaccaccggcacggcacttgctttaatagcggcttttgaaaatggctggtagaccaacacgccaatcccagccggaatttcggcagatactgctttgtaaagccgttggggcaaaacaaaatagttataatggccgacaaaactcagttgggcatgactatgaaaatctgctttagtgacttttaattcaaaacaccgccaaatcgtttcggactgctgtttttgccgcacgagggtatcgacaataccgaagtcgtccggcatcgtgacttcttcgaccgcagtagcgccttgtgcttgccaataagcgtaaagtgtcctttctaagtcacgcgtgagttgggttttcatgatgggcctcccaaaagtgtgtcagtaattgcgctaattgcgtgggattgtagctaatctgggcgtgggtccagtgatcaggaaacagacgggcataacgcggggtgataaagcgttcatcaatcagcaggatcacgccgacatccttggctccgcgaatcacccggccacctgcctgcaagacattgttaaagcctggcagctgataggcataggcaaagccctgaccagcattgtgatcaaaataagcccgcaactgatcggtttccggattgatccccggtaagcccactgacacaatcgccaccccaatcaattgcgtccctttgaggtcaatcccttcagcaaaaatgccgccaagcacagcaaaaccaatcaccggctcactaccagccttaaagtgatcaagaaatgcttgccgctcactttcattcatggcattttcctgaacacaggttttaagatcgggatttgctgcagtaaacgcctcgtatgccattttcagataggcataggatggaaaaaagaaaagataatgcccggcttcagccctgaccagcgtggtgagacttgcgatcagcggcggtaaatcctgcgcgcggcggcggtacgtggtgtggacactcgcatcgacaatgacggcctgattgtccggcgtaaacggtgatggcaaggtgtaagcaaggctatgttcagcgcctcccagtaacttttggaaatacggcatcggggacaaggttgctgaaaataaaaccgtgcctcggccttttttcaaggcatcatcgacaaaatgggacgggtccagacagagcattttaatcataatcgtgtcatgttccttggcaatctcggttttgaaggtatcgtcataaaaatcaccaatgcgtaaatactgattagcgagaaaaaacactggtaaaacaagttcgacagcaggctgcaacgcgggggtgggcggttctgccagccagtcgtgaaccgtttcggtaaaccgcgttagcacctgcgtcaagtcatcgagcggtgctgcttgaaagatcagtgactgcccgttgagtagctgatcagccaaggtattcatcgtggtgacaattcgcgtcatcgtccggcgtactttggttaatgcggctcctttgaacggggtgagggcttgtttgaggtcgataaagtcctgattggtcagacttgcggtatacatatcgcgcgcccggctgacaaggttgtgcgcttcatcaaccaagaaaaactgactgtcatctgcttcactgaagaatcgctgcaaaaaaaccaagggattgaataaataattatagtcgcaaatcaccacatcacaaaacaaactggcatctagcgaaaattcaaatggatccagtgtgtgtttgcgagcataggcttcaatcacagatcgggtgagtcgatcttcatgttccaaaagatcatgcagtgcgggtttcaggcgatcataatagccaagcatatagggattttgactagggtcatcgggctcatcggcgaaggtaatcgtgtctttagccgttaaggtgatgcttttggctctaagtccggcgtctgccatcagcgccattgcctgttccgccacccgacgtgtactttgcttggctgtcagataaaaagcgcgctgaatcaacccactacccatggctttaatggtcgggaaaagcgttgaaatggttttgccggtaccggtgggcgcctgcacaaacaaacgcgcgcggctgtatatggctttgtaaacagcggcagcgaactcgtgctggccagtgcggtactgcggaaacggaaacttgagcgtggcgatagaagcatttcgctgtttaataatatcgctgcgcagttttaaccaggcagtgaattcatcaagtaaatcggtgaaatcatcggctaactcggcggcactttttgtttcagtgaagcggctgactgtgtcggtactggtttgaacataaaccaaggtgataacggcatggtcttgatgccgctgttggcaaagcaggtgaccataaatccgtgcctgcgcccagtagcgatccttcgtgttttgcgaacattcttcccatgaacgggcactagttttaatttcttcaacggttagcgtcttgttttcggtccaaaccccatcggcacggccttctagttgataatcctcgtcattgacggtaacggtggtttttaaatagacttctttttcataatccgacttccgatgcgctgcttgaagtttgcggtgaatctggctgccgatcatggcggtgttatttgagttactggtaaccggatttagatcaccggtacgaacggttaactcgacaaattcgcgaatcccgatacggttatgagccatcagcgcacctcctcgttgtgtgagtatgattagcttttagtatagaacatacattctgtttggggaaattgtgggtgggattccggttgtttctttgcttttaatagaattagaggcataatagggggtgtcaagacatatgacaaatacggcggcttgcaaacactgtcgatcggtaagccgcgacatcaaatgagggacatatgatgaaaaagacaagtttctggcgattgttagggtttatgggcgcgattttattgttattgaccgcctgtggtaagcaaggttctgcggcaaagtcgtcgtccagtgcgccggttaaaattacatactggcatcggatgaccgggacttatgacaagtcgctgaataagttgattaccaaattcaacaatagccaaaagaagtacaaggtggttgcgacctctcagggttcatacaacgccttgcaacaaaagatcatggcggcaggaaaatccaagacgctgccaaccatggcccagtcaccgtatacaaatatcggtgactatgtgaagaatcagttgttgttgccgtttgattcggaaatgttaaatggttcgaataaattaagcaatcgtcaattgaaagatatttacccaagctttttagcggcgggcaaatacgacggtaagtactatggcttgccattttcagtttccacttcggtactcttttataacaagaagttgatgtcacagtataacatcagtatgccaaagacctgggctgattttgcggcggatcaggataagctaaaggggaccgatattaacgccatcgagctggatcagagttatgatgtggccttggaagggatggcttatggtgctggcagtcagctgatcacgccgaagttgaaggctaacttgaatgcaccgaagacattagccgcggtgaatcagatccttgatttgcgcaagagtggtgcgttaaagaccgccggcgaagatcagtacttcagtgtgccgtttgcaaatggcaaggccgtctttgggattggttcctctgctacggttccggtgttgcttcaacaggcacccaagagtcttgattggggtaccgcggtcattccggaatacgaaggcaagcgcagcaacccgctcaacgggaattacaatgtgctcttcaaaggcgcctctaaagcgcaacaagccggtgcctgggccttccagaagttcttgctgaagtcggaaaatgccgcacagtgggccaaagcttccggttacgtgccagtgactaagagtgcgtctaacagtgccaccttcaaagcctatctggaaaagaacacgcaatacaaagcagcagtttcagcagtctcacaaagctttgcctctactgtttttgccggttacaccgactaccgcaacgatttgatgagtaccgttgacagtaccttgaccaagaatatcagtggcgaaaccgcctttgataatctacaaaagcagaccgacaaaattttagaagaaaataaatagttttttaatcagccagtaataccgcgatgtgttactggctttttgctgccatgtcggtaaacaaccgtctgtcgctgccgatgtcatgatgcggacatggcggaaaacagtttacatcattgaggtcggatttgcgccgtattaccttagtgggctatgatggtcaaagcattgttatgcattaaaggagaccgatatggaaatcaatgtacacaaatttcaggaagctattttggccggcactttcgaacacacagcagttcacgtcactgctgcggcattcaagaaagacggcatcgctgacgcactgacgaaggtctttgcagatgtccgcgcggcgattgagaaggatcaattgattcaggcggatttggtggttgatttccctgaaccgacaaccattaccgttgagaccgggatcatcaacctgccatttgcgaatgttaataaaatccctaattttctggaaccggatgaaattgttccggtacgggtttatttaattgtggcatcaccttttgtcaacgtatcaggtttgcgcattgatgaagccgcgactgccgctgattatttgcaggattttgacacgatcaatgcccaaatgacggcctcagttcaggaaaagcttgaacacattcaaaccgaaatggccaagccaaaagaaaccgttaaagaagtgcccgccaataagcaaaagaccacggctaaaaaaaccacgcggcgagcgacgaccaagaagaaaacgaccacgcggaaaacaaccaagaagtcgactagtgcaagtaaggcggcgcccaaacgtacgacgactaaaaaaacaacgacacgtaaaactactaaaaaatagccttttagcgaatagtgatcctgagcttgatgactagtttttcgttattgctgtcagaattaagttactgaaaaaaggtaggcccgttgcacttcaaaaggtgtgacgggtttttcgcgtgccaaaaacgcatgcagtgaatgaaacactataagcaagcaagacaggcaaaaactatcaaggacatataaattaaacaatggcgcaaaagttgcgcttttataaatgcaaaaggaaacgtttgcagaagctgaatagtggtctagactcgtataagtggagagggggaacggcaatttgaaagataaaaagctgcttattttagaattcctgttacagcatggcaccgttcattacgatcaaattgccgctgcaaccggactttccgagcggacaattggcaattacctgaatcggttagacggggaattacgaccgtataatgtcaaactggtgcgcaagcgtaatgtcggcatacgtttagacggaccggccgatcaaaaagcccacttattgcggagcgttcacgggcaggagggctttgcctctcaaagtgcaagagtgcattatctgatgattaaattattgctgacgacgcgaccatgtacacttagcaaattagcggatgatttatttgtaagccgccggacgattgataacgattttaaggtggtgaaacaaatatttgcgcagaatcaggtgacggttcacacaagtcgtcgcggcattcaggtgacggcgtctgaagccaaccggcggcatatgttagctaaattgttacggcaatattggggtgaaagtctttatatcgcgaaacaaaaagacggagaagtcgttcagcaaattcagttgccgcattatctgaatcatttagtgaacccggcaacgaccaaagcggttatgcaaagccttactgagtttttaaagcaatcaagccttatcttttccgattatgcgctgcagtccttagccattcatctcattatcgcctgtgaacggcctaaaaaggaacagccgaccgcgattcatttaacgccgatgcttccggaaacgaagcaattgctggccttagtcagtaagtacgttcaccagacgctagacgcagccaatgcccaacagatcaatgcccatatcgcggcgcttgtggatcgacaagtgagcggggcacctgctgccagcattgaagatcagacaacgccggaacttagaagacaaatcgcaagctggctcacccaaatatcaccggataaacgcttgctggaagacttaagcgtccatcttagcggggcactggtgcgagtcgcccatggtatgtccattcccaatccctatacggaagaaataaagcggaacttcccgatggcatttgatgccgctgctcaattaagcatgacggtcgctaaacattatcatgtccagctcaatgacgatgaatcaggctttttggcgttacattttgagtccttttttgaacggcaacaagtcgctgatcgcatttcgacggtcgttgtctgctctagcggtgtcggaaccagtcgtttattagcgcaacggcttgaagaacgatttcgcgagaagttagtgattacccgcaccatcggcttggctgaactgatgcgtcatgcgatccctgaatcactcattattagcacggtgccaattcagggaatgcggcagccggtcgtcacggttaacccattgctgttgcagcacgatgttgaaaaagtctcccaacaagctgatcgctttcgtttcggaacagaaggtgatgcctttctcggtttgcttgagccggctttgattgtccccaacttaccgagtacggatcgggaaacggctctaagtacactgatccagcggttaacccaagccggtgtctttgaggacgcatccttaccgcttaaacttgccgaagatcgtgaaaagttggcgacgaccgccatgggcctagttgcgatgccgcatatctcccccgaaatggtcaggcgccctgccatcgcccttggcttagctccggatggtttggattgggcaggccaaaaggttaaagtgattttctttttggcagtgaccgcaacagttccaggtgatcaaagagggatttatcaggtgattaatcgcttaatagatgatcaacgtttttgtgaagtgttagcacaaagtcaatcaacgaccgaagcggtaaaggctttggctgaatatatccataaggagttaattgaagatgaatgaagttaatgtaccaacggatgttcacacggatgtggcagtgccatccgataaacatgctgccttgggtacgattgcaacgattctaagcgcacaacatcctatttctgctgatgaactgcggacgaatcttattgcacgtgaggatgaaagcacgaccggatttggtaatggcgttgcgattccgcatgccaaggtcaatggattaaccgatccttttgttggtgtcgtgacatttaaacagcccgtcgattggggttcactggatggccagccagtttccattgccattgttcttgtgatgccaaatcaaaatggggcagataaagtccacttaaaaatgctttctaaattggcgcgcaaactgatggacgatgattttataaaagcgctaaaagcagcacaacacgataaggaccaaatgaccaaagtgttgaatgaggttctttaaacagaaaggggaattttaaatgccaagttttgttggtgttacaaaatgtccagtcggtattgcccatacttatatggcagccgaaaaattacaaaagactgggcaaagcgatgggtacaaagtcaaggttgagacgcagggagcatctggcacggaagacactttaactgctgatgatattaaaacggctgattttgtggttttggctattgatgttgccattgacggcatggaacgttttgtcggcaaacgcgtggtcttttctacgacggcagaggcaattaaagacccgcaaaagttgattgacgcagggaaacatgctgaagtttataccggtgaaaagcagcatggtgacgagcaagaaacaagtgacgttgatgattcaggacatgaacaaagtccggttatcaaacagttgttgaatggtgtttcacatatgattccgtttgttgtcatcggcggtctgtttattgctttgtcaattgccttaggcggccacgctactgctaaagggatggtggttgcgcccaacacgatctggtcaacgatgaaccaaatcgggacgattggttttagcttgatgatcccgattctggcagggtttattgcgtatgcgattgccggacgtgcagctttagcaccggcgatggttggtgcaatggttgccaacacgcctgctattttaggtaccaaagccggaaccggttttcttggtgcgatcctagttggttatgcagcaggttatttaactaaatggatgaattcatggccgattcctaagagtttgcgcgcggttatgccgatttttgttatcccgctattagggactgcggttatctgtgcagcctttgtttatctgcttggcagtccgatttcctggttaatgacggccttgcagaacctgttgacattcttatctaagagcccgtcgacgagtattgttttgggccttgtcttaggtgccatggtctcagttgatatgggtggtccggtcaataaggtagcgtttcttttcggtgtggcttccattacagctggtacgcctgaaattatgggagcagttgcctgtgcgattgctgtaccgccattgtcagctggcattgcgaccttattcaagtcagaattaacgactaacgaagaaaaaacagccggtgtttcagctattttgatggggctgatcgggattaccgaaggcgcgattccacttgctacggcacatcctaagcaggtcttccctgggattattatcgggtctggcgttgcaagtgccgttgggatgatcttccatattaccgatgcggtgccacatggcggtccgattgtcggtgtcttaggtgccaccaataacctcggtttattcttcctggcaattttaattggtgttttggtttcaactgcgatcatcgttttgctcaaacagcatgcggttgcgcaccaaaagaagttggcagctgctaaataataaaaaacagcccgctgcgcatcttttgcgtaacgggctgtcgattttcccaacgccttcgttcattatggcgttgaatcgcaacagcgcgcgatctcagtggacatcttttactatttttaactgttgttacatttagttaagagaacgaatgattggcctagggtgatcgtgtataatgaaaggcgaaaccggaaaaagtgcttacagatagtcatgatgactggaaaacgcgattgaagaggagtggagcttttgacagaaccattgtttttgaagccatattttaatcccaagatctggggtggccgtaaacttaagactgaatacgggtttgatattccggacggcaaaatcggtgaagcgtggattatttccggacatccgcatggaccggcaaccatcgaaaatggcccactcaaaggcaaaaccttgcgtcaagcctggcatgaagatccggcttactttggcccgcaacatagccaggaatttccgctactggtgaaaatcctcgatgctgaagccagtttgagtgttcaggtacacccagacgatgcatatgcagccgcgcacgaagccaagggcgaacttggtaaaactgaatgctggtatattttgaaagcggatccgggcgcctacttaatttatggccaccacgccaaaacacatgaacagctcaaggaaatgatcgaagctggcgattgggagcatctgttacgcaaatatccggtcaaaaccggcgactttgtttatgtgccaagcgggacgattcacgcacttaacaagggcattgtcgcattggaaacgcagcagagttctgacacgacttatcggttgtacgactatgatcgaacggatgatcaaggacacaagcgtgagttgcatattaaacaaagtcttgatgtgaccaccgtgccattccatgatcctaagttgcacattaccaaagaaaatgtcacaggtggccaaatcactacatttgtgaaaccaccattatcaccgcattttgccgtctatcggctcgatgttgacggcactatgtcatttacccagcaggcaccttataccaacgtgacggtacttgacggcaccggtacctttacggcagatggcaaagattatccaattaaaaccggcgatagtttcttgattcccaatcaaattaaaacctggcagtttaccggtaaacttgccatcgtcacctcaacgccaggtgccgatgcgtaacagttgagtttctggtttcagacaggttaaccattcaaacagccttggagacgaaaaatctctgaggctgtttttgactgttcagacattgcattttcactgaaaagtaatttttagatcatacagacagtctttaggaagacggtaaaaaaattaataaatcatgagagcgctttcttattgattattttatattaaaacgttggtctaaggtggtttagcaaggctacttgactcatatgcggcggattgaaaagcatctagcgtgactggtatggactagggcaaaaccgcagtgcgaagccgccaaattagaattaagtcgtttccgttgacaagcataactgcaaacgcatacactacatgtggttggtaccacttggaggtgaggagatggaaaaggttccgttgaccaaacaactggtagatcagttggaggcctttatcaaagaaaaacttcagcctaatgacaagttgccgtccgagcgggatctgagtgaactgtatcatgtcagccgcaatacggttcggtccgcgttgaatgaattatttctgcgcgggttcatttatcgcagtaccggcaaaggcacgtttgtcgctgaacggtttgacgaacgaacggatgtaagcggatcgtacagttttaccaaacaaatgctagccatgaatcgtcagccagtaacgaagattcaacgactggaaaaaatcgcggtaccgcctgacattgccaaacggatgcgggttgatccagagacaccggtttatgttcttgaccggctgcgaattgcggatcagttgccgatgatgattgagcgtagttacttaccggcgttgacggtgccggatctgcaagcatctgatttagccaaaaatccactatacgattggctggaacaacattatggcattcacattgcgtcagttgatgaagcatttttcgccgggctggtctcgccggaagatgccaaacagctgcgagttgcgccggcatcggcatgcttaaacattcggcgaacgacttttgccgatactggggaaatcgttgaatatacgttgagtgtggcgcgcgcggatcaatttgtttatcacgttcatcatgtgaatcacttgggaggatattattttgttcgaaaaaacgacagaagaattaacgaaaatgggtgctcagattaccacggctgagatcaagcagcagccggaactgtggcaagaagcgtttgctaattatacgcgtgacaaggaaaagattacggctttcttgaagcaggtaaccgctgctgcaaatggtcagaccgtccgggttattttcaccggtgccggcagttctcaatatgtgggtgataccgttacaccgtacttacgggcgcatggtgatcgcagcaagtttgaatttgaatccattgcttccaccgatatcgtttctgcaccttatgactttttggaagccgataccccgacgattctggtttcgtttgctcggagcgggaactccccggaaagcctgaagaccgttgagctcgcggaacaagttgtgcataatctccatcagatcagcattacctgtgctcctgaaggccaattggcaaagaagtccgctactgaagataagaccttgttgctgttgcagccagcaggttctaacgataaaggctttgccatgaccggcagtttctcatgcatgacgttgagtgctttgcttgtttttgacactgccagtgatgatgacaagcgtcaatgggttcaggcgatcgccgcgatggggaaagaagtcgtagcgcgtgaagctgaaattcaagcggtattggatcaagactttgaacggatcgtctatctgggttccggcagtctcggcgggttgacgcgtgaaactcggttgaaggtacttgaactcaccgcgggccaatacgcaacgatgtttgacacctccatgggcttccgtcacggaccaaagagcttcgttaacgacaagacactgttgttcgacttggttagcaacaatgcttatacccgccaatatgacatcgacgtgcttgaagaagtcaaagacgacaagattgccccttctgtcatggcagtcggaaccaagcaggatcaaaacttctcaggtgacggtttctactttgaaaatggcctcaaggatcttccggaaggctaccaagcattgcctgatgttatgtttgcgcagactgtggcacttttggcttccatcaaggtcggcaacttacctgataccccatcaccgaccggcaccgttaatcgcgtggtaaaaggggttatcctacacgactattcaggtcaggaataaggttgcaactgtcatggcgccatttagtcgagtaagtcggttagatggcgttgctaaaactgggaggcaagtgttcatgagttattacattcacgccgcaaaattctttctcaaacatgtgactgaaattggcgggtatctagaagtgaccgatgatggccagtttggtcaatatttacctgaaagtgccaaaccagaaggcgagattgtggaacagccaggcaagctaattgcgcccgggttggttgacacccacattcatggccttttgggacacgatgtcatggataacgattgggacggcatcaataccatgagccagaatctgctcaaggcaggcgttacaagctggctacccaccacgttgaccgggtccttcgatcagctaaacgatgtctgcaaaaccatcgcggctcatgcaggcgaagaatccggcgctaagattcaaggcatttattttgaaggcccatacttcacaaccaaacacaaaggcgcacaaaacccgaagtatttcaaaaatccgagtgaaaaggaatacgatgcgtggcaaacttcggccaatggcttattgaaaaaaatcgccattgcgccagaacgtgacggtgcagttgcgtttacgcggtatgcgaccggagatggaaccgttgtggcgctgggtcatagtgatgctacctttgaacaggcaaaagcttgtgttgaagcgggtgccactgtcttcacgcatacctttaacgggatgagcccactgagtcatcgggcacccgggatggtaggcgctgcaatgtacctacaaggcgttgatgacgagctgatttgtgacggtcatcatgtgcggcccgaagttgccaccacgttaattcggctgaaaggcgcagagcacattgctttgatcaccgattgcatgcgcgccggaatgatgcctgatggtgattatgtactgggcgaattcccggtttacgtcaaagacggcatggcgcggttaaaagatggcgacagtttggccggttcggtgttggaactgaaagatgccttgacgaatctcttagcttggaacgcagccacgccggaagccattatccgcatggcaacccaaactccggctgcttcctgcaagattgacgatcaatgtgggagcattttaccgggtcgagctgctgactatctggttttggatgctgacttgaagctgcaggcaacctatctcgatggaaaacttgcgtatcaagcagaggcatgacagctttcctgacacaaaaccttgtcaaaaatggcgttaatgtgtgacactggattatggcagcggaacgggtgttataaatcgttgtggattgccataaacgcgccggttcacgctcattctgaaaaggaggcggaagttcgtgacgaccttttcgatcgatcatgaatttatgttggatgggaagccgttcaagatcctatctggtgccattcattattttcgggtgcatccgagtgactggtatcacagcctgtataaccttaaagctttagggtttaacacggtggaaacctatgtgccgtggaacttgcatgagtatcgtgaaggcgagtttgattttagcggcatcctcgatattgaacgttttctcaaaactgccgaagatctcggcttgtatgcgattgtgcggccgtctccttatatctgtgcagagtgggagtttggcggatttccggcatggctgttgacgaagaagatgcgtctgcgtaccgatgatccagcttatttggcggcaattgaccgttactataccgcattgatgccgcatttagttgatcatcaagttacccacggcggcaatgtgatcatgatgcaggtggaaaacgagtacggttcttatggtgaggatcaggattacttggcggcggttgcgaaactgatgcagcaacacggagttgatgtgccactgttcacttcagatgggccgtggccagccaccttaaacgccgggagtatgattgatgccggcattctggcaacgggcaacttcggctcggctgccgataagaatttcgatcggttagccgcttttcatcaggaacacggtcgcgactggccattgatgtgcatggaattctgggatggctggtttaaccgctggggtgagccgattatccgccgcgatcctgatgaaaccgcggaagatctgcgcgccgtcattaagcgcggcagtgtgaatctctacatgtttcatggtgggacaaactttggcttcatgaacgggacgtctgcgcgtaaagaccatgacctgcctcaggtaacgtcttacgattacgatgccccgctaaatgaacaaggcaatccaacgccaaagtactttgccattcaaaaaatgatccatgaagagcttccagaagttcagcaagccaagccgctggtcaaacccacgatggcgccagcttcacacccgttaacggctaaagtttccttgttcgcagtcttggatcagttagccaaaccgatcgccgcttcttatccgcagacgcaagaatttctgggccaatataccggctataccttgtatcgtacgcagccgctcattagtggcactgacaaaggaacaccggccaagttgcgggtgatcgatgcccgtgatcgggtgcaagcttatttggatcaaaaatggctagcaacccaataccaagaagcaattggtgatgatatcttgttgcctgaagttgagggacatcatcaacttgatttactggtagaaaacatgagtcgggtgaattacggatccaagattgaggcgatcacgcagttcaaagggattcgaaccggtgtcatggttgatctgcacttcatcaagggctatcagcaatacccgctggacttgaatcgcgcttctcggcttacctttacggaaggctggcagcccgcgaccccagcgttttacaagtacacgtttgatttgaccgccccgcaagatacctatcttgattgtcatggattcggtaaaggagtgatgctggttaatggtgtaaatgtcggcaggttttgggagaaaggccccacgttgtcactttatgtaccggcaggactcctgcacgccgggaaaaatgacgtcattgtgtttgaaaccgaaggccgctacgccgaaagcttgaagatggctgaccacccgatatttaaggaaccatgatggataacttccggtgcaagcttcaaaccgcaccggctcacgctcactataacgcgttcgccggtgcagaaacctgcgtgtaaggacctcggtcgtaatggccaaaagcgggccatcacgcccaaggccgcttacactccggtctcaaaccgcaccggctcacgctcacagacacagaaggaggagtagaacatggctattattgctgcacggattgatggtcgcttggttcatggtcaggttgccaatctttggaccaccaaactgggtgcgacccgaattatggttgttgatgaggcagcatccaagagcgacattgataaaagcgggttgcggatggcgactccggaaacggtacgcttatcggttctggatgtcgcaactgccgcaaaccatattttgaaccacaagtatgattcccaaaaggtgttcattgtcgcaaaacgtccggaaacattccttgctttagtcgaggcaggtgtaccgattaaggaattgaatgttggcaacatgtcccagacagataaaacccgctccattacaaaatcgatcaatgtggtcgatgaagatattgaaacgttcaagaaactggacgctcacggtgttcacttgattgcacaaatggttccgggtgatgctgcagctgactttatgtcattgctcaaaaaaggatagggggagtcaacaatgattgcatggtggcaaatagtgattataacattatacgcaggttatcaaattcttgatgaactgcaaatttattcagccatgagttcaccagttttcgccggcttggttgctggtcttgttatgggtgacatgaaggccggcttgctaatcggtgcatccacccagttgatggttctaggggttggtactttcgggggtgcttctaaaatcgatgcaaactccggtaccttgttagcaactgctttctctgttagttccggtatgaagccggaagctgctgttgctgcgattgcggtaccagttgctagtatcatgattcaaactgatattcttgctcgttttgcgaatactttctttgcacatcggattgataaaatggttgacgagtataattacaaaggcatcgaacgttacttccttgccggagcacttccttgggctttgtcacggatgattccagttgggttggcgttggcctttggtggcggttttgttaccaatattgcccacgcattgaacaccgattggaaatggttaggcgatggcttggcaacagccggtgcggttctgccagctgtcgggttcgcaatcctgctccactacctgcctgttaagaagcattttgcttatctgatcttaggctttatcttcaccatgttgttcaccaccttgtttggcaatattcagacattgggaacggcagtcgctggtgtggctaagaactttacagcgacattcaacggcttgtccatgctcgcaattgcattgattggatttgcgtttgcagcgatcagctaccagcagtcaacacaactgcatgacagtgtcggtggcggttcagaagccaatggtggtgctaaagcagcaaagaagactaatgatgagggggaaatcaccgatgatgaactctaataaacccgcttacaaattaactgacaaagattttcggcagattaaccgtcgtagcttgttcggcttccagttgggttggaactacgaacggatgcaggcttcaggttatctgtacacgatcctgccgcagttgcgtaagatttatggtgacgggacgccggaactcaagaaaatgatgaagactcatacgcagttcttcaacacctctaacttcttcaacaccattatcaccgggattgacttggcggttgaagaaaaagaaggcattgccggtgaagaaaccgttgttggtatgaaaaccggtctgatgggctcctttgcttccattggtgattcaatctttgctgctttgattccggctattttcggggcaattgctgcgaacatggcggaaaaagggaacccagtcggcatcttcatttggattgcggcccaagttgccgttatggtcttccggtggaaacaattacggattgcctataacgaaggggtttcgttggtcacaaccatgtcgcatcggttggcagctttgaccaatgccgcaacgatcatgggggtcttcatggttggcgcgttggttgcaaccatgattaatgtgaagtttgcgtttgcaccaaagatcggcagtgtgccactgaacttccaaaacagtgctgacatgatcattcctaagttacttccggctttgatcgtgggtgccgtttattggttgcttggccgtaagcatatgacgtcaacccgggccatcttcattgtgttgattgtgtccgtcgccttgtccgcacttggcgttattgcaaaaggctaataaataacctgccgaaatgtttagcacgaagcatgagccaatccagccatgttcggcgtgtgagcatcaaatggttacgcggtttcatcacaatgaattgcaaagcgttggatcagcgcatgttaaaggagttttggaaatatgagtaagttagttttgattagtcacggtcaattatgcgaggaactcaagaagagtgccgaaatgatcatgggtccacaagatgacattgccacggtggctttgttaccgaatgaaggcccggaagattttcaagccaagttcaaagcggcaatcgaaggtgaagatgatgtcaccgtcttagccgatttgaaaggcggcacacctaataatgtggcagcgcgggtgttggcagaaggcggcaactttgatctctatgcaggcatgaacctgccaatggtgatcagtttcctcaacgcccagatgctggacatgaagccggatcttttgggagacggcaaggccggtgtggtttatattaatgatattgtgaagcattaatttggttcacaagttggaaagtctgtgtccgttgggatgcaggcttttttgcgtggtagggaagattatgtgaattgaaaaggcaagtagaatatggctacaggtgacaagacttggcaaaaatataatcactgtatcatcgctgctttgtaggataacgaaaaggaaccaatggcttgattgatagactaatgttaacgttgaggtgttaacttttttaactaaaaatagtctctgctaactgacagatgagaatggaggttcctcattgaattattttgtgaatgaaaacatattttcaatgaactcaggtacggaattttccgcggcacaacgggtaatgctgttcaaaaagaataaagtgccggcgcagatagtcacgcgtaattacaatccgttgatgattgatgatgttcaccgaattgggttagagcaaaaagatgttgtcaatatgtatgactattttcaggagatacttgatgtcgcgcctaaagatgttaatgttcgttatactgaagctattgataagtatcaataccacattgatggcgtggatccaaatgaatctaaaattgtttatcatggtaaaacgatcggtaaagtcaacattgcgccaggtacagtcgggcttgtgggatcgattgaatactacaatgatatgaatacggttgtcgctaaagacatttgggatcgccgcgggtttaaatcgtcaacccagtattttcatcctgatggtgcgtttggtccacaggttttttacgatcgtgctggtaagcccaagattgaaattacgcggatgaatgtgaatggcgaattgcgcaacaccatgtacaagctgcttgactatcaaggccgggcatggcgctttgataccgaaaatgaaatgtttgttttcttcatgaatgaactcatgcttaaacatcctggcgtcttaattaacgatcggccttcattaattagtgaagttgccgcagttgttggcgcacgtggtaagtggcagtttcttcacagtgcccatacttacaagccagaacaagcaggtggattgcgtaactatgtcgactatctccaaccgctatttgccacgcacatgaatgactttgatggcgtcatggtcccaactgtggagcaaaagcaagaaatcgataagttcttccactttaagcatgtcgtggtggtgccggattcatatgctgaaccgcataaactggtccctgctgaaaaacgtgatcgcaataagattgtttatttgggtcgagtttcaccggaaaaagaaccacaagaagccgttaagatttttgcaaaagcgaagaaagacttaccagacttacatcttgagttttacggttactcatctgatcagtcgcttgataattcactaaaagaactgattaaaaaactggaaattgaagacgccgttcactttaatggctaccaaaacaatgaccagttggcaaaaaagcttggagacgccgcggcagtattaagcacctcttcttcagaagcattcggcatgaatgtgttgcaggcgatgagttttggcgtaccggtgatcggctatcaggttaaatatggcatgaagttggtggttaaagaaggcatcagcggatacttagtgccaaatggtgaaagccaacaaggtgccaaggcgttggttaagttgttgaccgacaaagataagtgggtcgatatgcttgaatcaacctatgaatcatcgcagaagtttaacgctgcggcagcttggcaacagtggcaggctcaacaagcagctgttcctaacgtattcttaaagtagggggagagcttagcatatgatattctttattaattcaaattttaataaaaataattccgggattgaacacgctcaattgaagcgggcaggactctttcgtgatcatcatgtgcctttcaagatgatttttcgcgaatggaatccccgcttacatgaatacttaaatcataacggagtcagtgatgacgagactttgaacatgtttgactactatcagaatgccgaacaggttccagctaaaattcttcacgctgacgacattgattttggattcgacaagctcagttacgccaaagagccagataaccaccgctatttggtgacccgaggcaaactttttgtcggtcggatcaattactttgagaatgacccgactgaacgcgtcagctcagtcgaacaattcgatggttttggtaatctgtatcgggttgacttctatgactttcgcggctttttgtcgctgtcgcagtggtatacaccggacaataaagttggcactgaagtttggtataaagttgatggccggccggttgttgagacttttaataaatacgacgccaatcatgcgtttattaagaccggatggcggttaattgaagacaacggtgcggtttatatgttttcgaatatagatgatttgatgcagcatttttacaataatgtgaatgagcaatactggaatgacaaagaagccaatgtctttattcttgatcggtcacatttgggcgattggcaactcattcacttacagcggcctgcttatattgtcatgcatttacacaactcacatgcaggcgatgcccaagatccgatgcactcggtcatgaataatttttatgagtacagcttgattcatgctaatgattacgatgcgattgtttcagctaccaataagcaaactcatgatgtgcgcgagcgattccacccaacgtgcaagttgtttaccattccagttggcgttttgccagatgaacagttggctcgaccgcatgttgccatgaccgatcgccagccggcaaaagttctggttacggcgcgggttgcccctgaaaaacaaattgatcacattgttgcagcgattgggattgctaagaaagatgtccttaacatttctttggacgtctatggttatgtcgaccaccgggatgataaccgggcgatgaagcggatcaacgcagcaattgaaaagtatcatttacaaggtgcgatcaagttgcacgattacaccaatgatgtcggagccgttcaacggaatgctcaggtttatgcacttacatccgtgatggaaggctttaatctgtctttgatggaagcactcagcaacggcatggttggggtcacctatgatgtcaactatggcccgaatgaattagttgttgatggcaaaaacggttttgttgtgccatttggcgatattaaggcgatggccgctaagtttgttgaactattcacccatccggatgaattacagcaaatgtcagaccaagcctatgagttgtcggatcgctattcggaagcgaatgtttggaaggcatggcaagcgttattggatgatgccaagaagaaggatatccattacactaaagaaatatccgctggtattggcgatcaacggataaagaaagggtaagctccggttttagatttaaaggaactgctaaagtgatcgttattttagaacgaaacactttttaaatttttctcaaaacagtacaattagataaatcaactttaaatgaaggcgggcgcctgaatgaatgacaaattaaagattattgaattacttaagcaacaagtagcagcgaaaacagctgaactgacccctaagaatattcagaaaataacgcaagacattcaagatttactgaaaattttaaatgacgttgttgccattgattttatcgacactacttctgaaacgagtccgcaacaagagaatacagcagttgcaaaacctgaatctaacgcggcagttgcgccgatgattacccaaacagcgcctgaaactaaaagtgaaccaaagcagcagacgcaaccgcagcaaccccaacagccaaaaccgtcgcagccaaaatccaatcctgaaccggaaacaccattattatcagagcactggttaaataatcataagtcgtacattggtcgcttccatttagatttgaacggcggacatgtcggcaccattaaagtgtcggaaagtaagttacataaaatgaagaacccaccggaaaatggggactgggtgcgtgccgatgagtatcaggatagcgatagtgttaattacaagattacaacgttgaagcgcgatccgttgccaaccgaaattgtacggttgaagtttttgcctgctgtttttcgtgaagatgtgaagcggtggtatattgagtttcaatcaccggaacacgagacgcggcagcagttgcttttaggcgattatgatgtgatgttgtttaagttgaagccgggagattatattgactacgcttatcggcgcggtcaggaaatcaatggtaagatcatttggcgttacactgattccgcggcggttgcgacccgaatgaaacaacgctatgcaaagtcggcgaatacagacgctgataaaaacactgcaactagtaagcagaaagcaacacaaacagcgaacaagacggtcaagcctgcaaagaggcggcgagctgtccagcaagtctttgccgataaaaccttgctgctggtttgttttgaaaactccgccatgccgcgtaaagtcaagcgccatgttgaagaacgcggtggcaaactcgtgttatcatcacactcggattccggcgcgatgttgaagaaaaaagttcaaaaatctgatgtggtgattgtgacgaccgattttgttggccatagtcaaatgtttgcggctaaggatgaggcgaagcggatcgggaagccgatttggatggcgagaaataccaatgagcgtaatttgctgcagtggtacaaacgacattttcctaatgaaagtaagccatctgcggcgcgccaggaagtctaatgaatgagctagaatcaatcattgtgtcacttaatactaaaattttatattaaaaaaaccggtcctgagtgttttgcagtgtgtgctgactgctcagggccggttttttaaatgtgaacttctaaatacaacgggatattcaggcttcttgtccaattcgtggccaagttgcataagttgcgaccatgcgatccaaggcttctttgagtaacgggcgcggcatgccgatgttgagacgcacgaagccgccaccatcagccacaaaatagctgccgaccacacaggacaaatcagcagcagtaaagaaacgtttcatcgccgtttcatcagggaaaagccgctgggtatccagccaggctagaaaaccggaatcggaaggcatcacctgaatttccggtatgacctgcaaacggttgaccaagtaggcaaagttagcggcgacataagccaccatttcatccagccacgcatcacaatccgtataagcagcgatgagggctggcacggcaaagctattaggcgaggtaatcgaattggcgacgaattgagcgttgagtcgggcgcggatcgctgggtcagggatgacgacataggacgttttcagaccgcctaagttgaaagctttattgggtgataaacaaagaatactttgggattgaatagctgggcaggcttgccagatgctggtaaatgtaacgccgggataaacaatgtcccggtgaatctcgtcactaatgagtaaaacctgatgctggcggcaaagttcacctacacgtgctagttcttcagctgtccacacgcggccggatggattttgcgggctacataaaatgaacaacttaacgtccgagcgttgcattttagcggccatgtctgcaaagtcgaattcgtagcgattgtccacaagcatgagcggactggtgacgagctgacggtggttattgcgcacggcttcagcaaacggatcataggctggcgtgttgattaacaccgcttcattttgttcggtgaatgcctgaaccaagtagtggagcgttggcactgtgccatagctgagcttgatccagtctttttccagttgcaacccgaagcggcgcgcgttccaggcgatgactgtctcataaaaggcttcggggatgtaagtgtaactgtagtcgggtacggccgcgcgtgtcatgatggcttggtgaatcggcggggcaaccgggaagtccaaatcggccaagtccatgggaatcgcgttggccgtgagcccgaatttctccgcgagcacttgatccgcccacttccgcgcattgccggctttgcgatcaaaaaggcgatcaaactggctcatgttcaagcacctccagttgattcatctgccgagatgtttggtttaacacacgcgcgccggtttcggtgatgacgacatcatcttcaatgcggacgccgccaatgccgggaagataggcgcccggttcgattgttacaatcatacccggcgctaaaacggtttgactgcggggattgagaattggctgatcgccgcctagtcccaagccgtgccctaaaccatgcgtgaaacagtcaccatacccagcagcggtcaaaacgccacgggcaatggcatcgacttcacgaccttgcatgccgggtttcaaagcagcaattgcagtttgttgggcgtccagaaccgccgcatggaccgcggcaagttctgcgggcggcttgccgatgctgagtgtccgcgtcatatcggactgataatcagctaaaacaatcccaaaatcaatggtgatgagttcgttttcctgcagtattcgctcgctgggtcggccatgcggaaacgcaccccgcgggccactcgcaataatcggatcaaacgccatccccgtcgcccctgcttgcagcgtataaaaatgtaaccacgcattaagcgtttgttcgctgatgccggggcgaatatgcgggaggagttgggtaaaaattttgtcagtcatcgcacaggccgccgcaactgccgcaatttccgcttcgtccttgcgcatgcgttgttccatgatcaagtcatccgccaaactgagcgtccagttctgggcagctaaggtctgaaattctttaatcgaaaagccgctgctcaccaagccgatgcgccgactttgctgggaagttaagaagtcaatcaattgcggtaagtaagatccctgaggcacttcgatatttgtaaatccctgggtatctgcggcctctgcacgatagcggccatcgtggatttgcacggcctgcgttggggtcaccacgacatacacaccgctgccgggcaacgcgccgacatagcgtttactttggcgatcatgcagcagcaacgcgtccaaatgttgcgcgccgatcgctttttgtaagttggttaaatgattcatatgagcctccgttttaagtgcattgtttttcgaaaaagggatgcccacgcaaacggtgcggcatcccattgtgagcattttttcagtaaccacagcatgcggcctgattagaagtcgagatccaagccagccaaggtatcctcgtcttcttttgaaaagattgatttctgcgatgcttttttagcttcattcttcaactcggcgcgttccataaccttgaagaatggccagtacaaagcgattgctaagaccagctgcaaggcgttggctaggattgtccggtaatcgccattgattaagaaaccttccagaaagaccccaacgtacggcgggttgaaaataggtttagcgatccaaccccagtgcatgaagaacattggcagggtaccgataatggcgccaccaaagacgtgcgggatgaacataatcggattcagaataatcggtgccccgaacagaatcggctcattgatgccaaacaaggcggggaataaggaaattttaccgattttacgataccgcttgcttttagacagcatacaggcaaccacacagccgatggaaatgccgcaaccggtaaaaccgaagaaacttgaaacggcgccggctgtgtaaaaatgcggaattgcttcgccggcgttcatcgcagcaatattttcggcgatgaatgtcaccataatcggactggtgatcggcgagaaaaccgacgagtgaattccaaagaagaagacagtacaaatggcgaagttaagcgccaagacagcccacggattatccatactcccaaccaatggcgccaagaagcgagtcaagatgcttggcggcagctcaccagccagattcaggaagataaagcggccggcaataaacgcaccgccagtaatgagtgtgaccggaatcagctcgaatgaacgggaaacaaaatccggcaccccatccggcatcttgatcgtcaagtggtgagttttgcaccagtgatataactcaaccgtcagcaaggcaacaatcatgccggtaaataaaccgcgagcgccaaggttggcgacatcaagttggccggttttgttaaaagttgcgaccatcatcaaaaaggcaaaacccgacaaggtgacacatccgggaatataaagcttgtaatgattacctaagttgtaagcaatagataagcaggcatacaggccgatcatcccgatggacagcttaacaggcagatcgaataacgcggcgttgccagtaatgaactgcgaaacggcatttttaggaccgagcatgttcggcagagcggggatgatcgtgaaaatactgccgagaatggtgaacggcgtcatagccaccatcccggccttaatggcactcagatgacgctgattatccactttatgggcgatgggcatgaagaagcggttcatgaaagcttcgaacttgttaaacattgtggagcgctcctctcaaaatcttgatcagccactaaccggcgtgcttcttttgatatttcgcatgggtcaccagtgccagtttcatcaccgtggcgccatccatttgcccgtaaacatctttatcgatgacggcatacggaatgtggcgcggatcacagatttccccaatatagccagtcttatgcccaatctgaggaccgaccaaaacaatgtcatagttgtcgatttcttcttccagtccatcaaccggaatagcattaaaatgaaaatccgcttcgttcagtttgcgactgtctttaacaaccttcgccatattttgcatcaacatattggtggaaaagccacctgcacagcataatagaattcgcataatatagttctcctcatatatttattaatgtgagcgcgagccggcacggttagaagccagcttcattcacgctctagtttcaaatacctcaatcaacgtttcgatcaaatctcgtgccagttggctggtcatgtagtgatcttgcgcgtggaccatgagcagacttacgggttcgggcgtctggtctggtgcaaactcgcgcgcgatcatggccgtttgcgcgttatgggcagcgacatcaattgccttggactcggccagtaaactgcgggcccggtcaaagtcttgcgttttaacagcagccaaagcttcaaaggccttggttttgctttcgccggcgtttgcgatgagctgcataatttcgagttcttgagtagttgccatgggggtggactccttcttacaagcctgcagtgggtgggtgcaggtgttttttaatcgttgggcgggtggtagtggtgaaacttttaaaaggtatgcgccgcggccacgagttttgctgataattgacgacacatggcagcgtataaagcgaccatctgatcaacgtcgcgggtgtgggcaagcgattgagcgcaatggccgtaacggcaagggaggattgtgaccacggttggaatgcctgagccgaccttgtgtgcttcacctccatcggtaccgccgccattgaacatgtctaattgcaaagggatttctgctgcgactgcggttgctttaacaaactgttgcagatggcgatttggagctaaggtgcgatcaaaatgggtgagaatcggccctttacctacttggcgctggttaacctcgctacgttcccgtggattttgaaaagttgccacatcgacaataaaagcaagatccggtttgatcagctgggtggcagttttggccccacgaatgccgacttcttcactgctagttgcggcaaaatgcagggtgaacggcaatttttcatctgccagttctgcaagcagttgtgcgccgacgtagcagccgagccgatcatctaaagctttgccgccaaagacgccatctggggcatacccatgaaactcggtcgcaaacgtcaccatatcaccgattgcgatccccaaggctgcgacgtcatcagcactgtttgcgccgacatcgcataacacctgatcaaatgccggcaatgtgtcatcgcgaatgaccatgcccggaagcttgtgacccgcggcggttgtgatgcgtacgttctgccagtgactggcggcaggtttaacgccgccgacaaccatcagacgcagtaggccttcaggggtaatggtacgaaccatgtagcctacctcgtccatgtggccataaatcatgactgaaaattgcggatcagcggcttctttggtgaaaataaggctgcctagcccgtcagtttggctggtcaatccatatgaggcaaggtgatggcgcaaaaccgcgcgcacttcgtcttcgttggccgcaatggcatcagcgttacttaacgccgccattagttgtaaatccatgtcgtttcggctccttccagttcagtccgtaaagtttgttgaaatgcgctaaattcggtttgttgaactaattgattgatgagatcaggcttttgcattaacgcggccaattgggtggtcaaggttcggtgtaagggtaattgatcctgtttcaacgcaatcaaccacacaatgcgaaccgggcgcgcgctatttttgacgccagttggcaaaagcatcacggcgacagcatttttcctagcgctgaatgacaaggggtgcggaatggcgatcccgttgtcgtaaaccgtcgccagaaagtcttcgcgctgcagaaccgatgcggcgtaaccaacttgtccgcaatatgccgccattttggcagtgagggaggtgagtaacgtgcgatagtcggcaggcttttgatcggggaaaaatagcgtcggctgcaacaaatccgcaagggacgctgtggcatgatgttgcgatgccattgatagctcgtgtcgtaaactggcaaaatctaaatccgaagccacttcatcaatctgaatcacgggacagtcaaatgattcatttaaagccgtgacggtaaaaagcaagtccggtgaaagttggtggattgcttttaactcattgaggccaaaagtttgaatcacggcctcggggaaaatccgtcgcaggcgtaaactcagcagcgttgcaatgccgccgccagttccgcagatcacggcaatgcgataaccgtgacggctccatttttcgtgagcctgctcaagtgggaccagcagatgggtggtcagatagccgacctcggtttttggcacctcgatttggtattcgcggcttaaccattgagcaaattgaactgcccagttaaaggcgatcgggtaatcgcgcgccaaaggttctagactcagaccggccagactttggtgttcttttagtcggccaattaaggcgaggacgtggaagtacataagcgacaggaattccggatgcgtggcaaagttagtttcatggcgtgcatccagcgttgtgaaataagcgcggagttttacttttagccgcttgtggtccaggcgggtggtcagttgtttgcgtttggcagcaaaactgacggttaaaaaatgccacgcctccggacttaggcgaatagcggctaaaagcgctgcaaagtctgtatcagcaggtggggcgtgtaacgtttggcccgtgacgactagcgaccacccaatttcgctggcaaactgggccgtgacagccggatcgagtcctaaaggctgcagttgctgagtcaatgttgcatgattgggcggtaacccatattgttgcagcgcatggatgcgactttgccagttgccttgaattcgcacgccgtaatgggctttgcggattaacgacaggggcgttccaaccagcagtttgtccaactcgcgtaaatcacgctgtaactgcttggtactaataagctgggtggtggccagttgcgccacagtcaaatagtttgtggtcgataacagttgttgcagaagctcaggtaagcgtttggctggcatttttggctgagcctgacccgctaaagtcgctagataagcagctaaaagtttcgtatctgtaatctgtaattcataccctcgtccccgaataagtcggatttgaaaccctgacgcagcgtggtttagcaggcgcaaatcattttgcaacgtgcgccgtgataccccaaccgctttggccaaggccatcgcggacataaccccgttagcttgtagtgcttgaatgatgagatgttcacgcaattgccttcccccaatccgtaagcgctttcaactatattgtcagtatgccgcagatactttctgccaaaaagtcccacttttgcaagctgacatggcaaaaatggcatgattgccaatgcgactgccactggtcgtgaatgacgaatgatatagtgaccgtgctcattccctgcagtgtaccaatgtttgaggcggataacgatttgagctggtcgagaaaatagtgagacgacttggttagataatgagaggcataacaaagagttggggcagtttacaataaagggggagtaaatgaaaaaattgcacgcaaaaagccccatgctgtttgcatgaggccgagtggatagagagctagcattaccggcatgcagcaggcgcacgccaccaaaatgaatccttaactacgcaatgccgccctctgcgtttaactgcgccatatgaatcaaggtctcggcaattttacccattgcttctgttgagacgacttcatacgggccgtggaagttaatgccaccgttaaataagttaggagtagggataccttgataagtaatctttgagccatcggtgccgccgcggaatgggacggttttaggcgtcagaccagctgctttgatgccagcttcagccaagcggagcgggtaaggatctttattaataatatcggccatattgtaatattggtcgtgcatttcgactttaagccgtgggtggtcaaattgggcgtttagttcatcaatcgtcttttggaagtaggctttgcgggcttcgaattgttgatgatcaaagtcgcgaataatgtagaccaactctgcatcactgatttcgccatggaatttcagaagtagaaagtagccttcatgtccggcgctgaattccggccgatcaaatgccggtaatgcggcatcgagctgacggcctaaggtgttggcattgaccatcaatcccttggcctcaccgggatgaaccgaagtcccttcaatggtgacggtggcttgagcagcgttaaaggtctcgtattcaatttgcccgggatcgccattatccaaggtatacgcaaagtcggttgcaaagcctttcgcatcaaacttatcggccccaaccccgatttcttcgtccggaccaaagccaaatttaatcaggccgtgtttgacttccgggtgcgctaacaaataacgagcggtcgcaactgccccggcaattccggccttatcatcaacgcccagtaaggtagtgccgtcgctggtgattaaggtctgaccaaaatattgcttcaacgcggggaactgttcaactgtgagactcaagccatttgcaaagttgatcggtttgccatcgtaatgcggatggacttgtggctgcacattctcggcgttgtaatcagccgtatccaaatgcgcgatgatgccgaagcttttgaccggtttatcagtgttggccggcaaggtggcggtgacaaagccattttcctggtttaagccaacgtcttggagtccgagttcttgcagctgggtcactaataacttggccagttcggtttggccaggcgttgatggggtggtgtcgcgtcccggataagaccgggtgttgattttggcatagcgaatgaaatctgtttggatttggttcaaatcaagttcaattgtcaatgagaatccctgcctttttgatgagaaaaatattaatattccattgcaattagtgtgagactggcttagtattttgtcaatagcacactaaggaaattattggaggggcgcatatgaaaatatccaaaaaatggacgctggtgttgccggttgctgctgtactgcttctggccgccggatgttcgtcaagtagcagcagtggcaagtcgagcaccaaccaaacgcttaattggtcggaaacctcgtcaatcgtcactaacgatccatcgcaatcaactgacacggtatcgtttcagacgatgaccaacacgcaggaaggtatttatcggttaacggataaaggccaaaagccacagttggccttggcgaagaaagtgacgaccagtcaagatggtatgacttatcacgtcacgttgcgtaatgctaagtggagcaatggcgatccgattacggcgcaggattttgtctatagttggcagcgcacggttgatcctaagaccaaagccactgatgccttttattttgctccggttaaaaatgccaatgcgatcattaaaggtacgaaaccggccagtgatctgggcatcaaagccacagacaaacatcacctgaccatcacgttggaaaatccaactgcttacttcaagaagttgctagccttcccgctgtattatccgcaaaatcaaaaagtggttgaaaaatatggcaagaaatttggtacctcggcaaccacccaggtttatagtgggccgttcaagctgaccaaatggaacgggacgggtgatagctggacgttggttaagaacccacagtattgggacaaaaaacatgtgaagcttgctaagattaatgaaaccgtcattaaagatgttcaaaccggcatgaatctgtatcagacgaagaaactggattcgatcgtgctgaccggtgaacaggcggccgcgcatctgaatgataaagacgcggttaatcgcatttcctccaatatgacccgcgtggacttgaatcaaaaacaagtaccagccttcaaaaatgtcaaagtgcgccaagccttttcaatgatgattaatcgtgcggcgctgacaaagaaggttctgaaagatggctccaagccggccctgggttttgttccaattggattgcatacgaaccagaaaaccggtgccgactttgccaaaaccacgcaggtgaaaagtgcggttgcttacgacaaggcaaaagccaagaaactgtttgaagcagggatgaaagaagccggtcaaagccagctcaacttgaccctgttagcagatgatgcagatgtttccaagcaggtagccgaatacttgcaaggcgcgtttgaagatttgccaaatgtcaaagtgacaattaagagcatccccaaggcccagcgcctgcaagcgatgatgtcaggcaactacgatatggtcgtcaccggctggcaatccatctttgcggacgcgtacaacttcttggatgtgtggatcagcaattccagctacaacacatccggttacaaagatgccaaactggatcagctgctgagtgaaacggaaaccaagtacggcaatgaaccccagaaacgctggaccatgttgcaggatgccgaaaagatcttgatgaaagaccaaggtacgctgccgctatatcaagccaacaatttggagctattgcgctcaagtgtcaaaggtgtatcgtttaatcctaacgggacaccatatgactttaaaactgcatacattcaataatattgggataacaaaaaaagcccgccatgctagtgacacggaatttaaccgtgaagcatgacgggctttttgcattcattgacaaaattatttcaagatggagtgactcacaatataaaaagcttcctgactagcttgatgatgcttggccttttccgggaacccctcatcgaatttgcgtgcgtccgcggggtcataagtcatggcggggctttcatgatagaaccacttctgcccggctagcgtttgcggctgcaactctttgactaacatcgcggttggctgggtattgtctgccgcccaaacgttgaatttttgacagctttgaaagccacgagcgacataattatcaggatcgccaaaaatgacaatcgcgccatagccaaggtcggctgcttgctgcatggatgcgtcgattagttgctttccgaacccgcgtcgctgataagctggcgtgatactgaccggaccaaatgtcacaataggcttctccaaacccgttgcggtcaccaatttactcttggtgtacatgatgttgccaataatctgtccgtccagcgttatgacaagatccagttcaggaatgaagtcagcgtgatcgcgtaaaatatgggcgatataatgttcatcggccccaggcacataaagattccagaaagcattgcgatgaatggtttcaactgtccgataatcggatggctgttcagtacgaatggtgatgtttgtggtcaagattaattctcctaagaaaggttgcaattcgggactacttttatttcgaataaaattttttataggaaaatttattcagaaaaaagtaattataaaagtatgggaaaagctcggaaataaggcacttacataaagtgcgaaataaaaaccgaaactgccgttatcttacgcatccccggcaagataacggctaatctgataagctgatgccagcagataaggataatgagcggtggtacctgagtcagaaagtaggtggtgtgtatgggcaaattgtcgataacccacacattgatgagaaaggtgcacctgtttgtcagtgatcgatgttgtaacagcgatcacggcctgcgtttgttcgttagtagtcttggtcattggggtaacccagttgatcaaggcgacgaccaagctgcttcatgcagtaaacgaactcatgcaggcgctcgaattatttcgagaaaaataggcaaactaaaagccgcaattccttcgctgggatgccgcggcttttagttgcctaatcctagttaccatcgttcattagatgggtctgcaagggcaaatgcccggccgtcgtgcttgaacgcggcggctttttgcttgctttaagtatagcatggcgtctcaggatatttctagtcagacgactaaaaaatatgttgggtgattggttgaggcaatacgcgaactcatgcaggcactcgaactatttcgagaaaaataggcaaactaaaagccgcaattccttccacgggatacggcggcttttagttgtctaatcccaagtgccatcgttcattagatgggtctgcaagggcgaatgcccggccgtcgtgctccaacgcgacggctttttgcttgccgtaagtatagcatggcagctcagaatatttctagtcagacagttgtaaaatttcaaaagatgatttctaagtgaacgtccgatacatttgatagatgaaagataactcatgtttcattcaaatccgtttcctgacatggcaattattcagtttcagactgcgaaagccctttaacgtagccttctgcctgcattcggtacatttcggcataggctgcattcgtttgcatcagcacttgatggggcgcaaagccaacaaccttgccggccttaaggaataacactttgtctgccatcgtgacggaagaaagccgatgggtgacaaaaagaacggttttattttgacttagctcggcaaaatgttgataaatttcaaactcactgcgcggatcaattgcagcggttggttcatccaggatcgcaggtgggcatggtcgtcatttaagaaagcccgggcaatggcaatcttttgccactggccaccagagatttcaatgccatcttcatattgcttgccaaagtgcgtttgtaagttaatctgctggtttgaaaagttatcccatgcactggcttttttcagtgccaattcaacattctgcgcgttaaagtttggcagatcggcaatacccacgctttccagcagtgacaagttgaacttggaataatcttgaaagacaacgcgaatttggtggcgataagcatcaacgtttaattgctctatcggcgtaccgtcaattaaaatctgacccgaagaaacatcgtataggcgtaataagagcttaaccagcgtggacttaccagagccgttttcgcccacaaccgccacagttgtaccgggatcaagcttaaaattgacgtgttgtaaaacggttttgtgattcgtttcagggtaagcaaaagaaacatcgcgaaattcaattgcaaatggtttgtctggcaaagctgcggcattttggggtgtggttaaggcgtctttcttgttcaaaaattgataatacttctgcataaataacaacgtatcatacaacaggcttgagctttcgactaaacttcccagactttgggacaacgaaacgacggtcactgcaaatgtgagtaaggaagccacaggatagttgccattttgaatgccaacgatgactaaatacagtgaagcaaccagcgccactccgttgatgaaggcatagacacctgaaatacgcatttgcttcagacggacttgactgaggcgacggtgaatttgctggaatgtatgctgatacttcttgataaaaaaatcaaaggcattaaaaatccgaacttccttggcatccgtattcgccagtaacgttttggcttagtattgcattttacgggattgcgggcttctgtccaccatcgtttcaaaggcgtcttgttggatcttataggtgaaaattgcttgcggaataatcggtaataaaaccaacaagatcacaacaaaattaaactgtgacaataggacgatgtatgacacgattgataaggttccccgcagaaggtctaggccgaaaacgatcaagttgaccggccgccagctggcttgggaccgaataaactccagctcgtcataataggtcgctgtttcaaatgttgcgatgcctttgagctttttggcgtgcgccatcaaggcaagattgatatgtgcgacaagttggtctgtcagtaagccttgcgttaacgtgacaaccggcccggcaatacccaaggcgatcaccgagacactccaaacgacagctggtgcgagcggtgaatcgtggtgacttaatgcagtcaaaagcgcctgagaaccggcaatcgttgctgcaggtagaacggactgaattggcaccagaatgaaaagaatggttgcgtacaagggtgacgctttaaagaactcacgcaaactcttccagtataaatttagaaaattgactaaggttttaaccatgtttgcatcttcttatcgttttctaatatttaggatgattatagcatgtgctggcatgcggaatacagttaagttgatcgtgttcgttgctaaagcagtgtcagcaaagtcttaatttagcggaagtgatccttcaacagggatggccgctattaccgctacaattcagctgaatcgatcttgaatgacagacgatgatgacgataattgatgttttaaatattaatatcggaattcatttttaaacaagctaatactaattgatgtccatcactttataaattttattctattatataaatgtttttggatattattagtgatacaaaacgtcaataatatttctttttaaggataaaatacttgacgtcattaaattttagtgtactattcattataaaattgcaaattgtttatctaacagccgctagatgtatagggatcgagtatgcaccgtgagtttgaatgatgactttctttacaatgagcgtcaatactcacaagctgattcataaagccgggctgactcgttagatattacagcttcggcgtggagaaaatggggatgtttgcatgctagcaaaattaagaacgttaaatcttttatcagtatttttggcagcaaaggggacgctgctgatttgctgcgccttgtacttttgttttttactattttcaactttgacaagtacgtttctaattcccgctaacgatcttttgggggatatttcgtcaatttctaagggcgagttgtggcggattgtgacaagttcggtttacttttcggattgggagccactcataaagacggtgcttgcaattctgatgattggtccgtttattgaatggaagattggcagccgtgcgtttgtgatcagtttctttgcggccagttggatcggagccgggcttatttgctttggctttaatggcattattcagtcaactgttggcctgaatacatatattgacgcattttatggcgcaaccttggcagtctatgccctgtttccgttagccggattggtatttgccattaaaagcccgccgttttctctgctgacaaagctcgttacgaccggagcatttctaggtgacttgattctggtgttttgggctaatgcgaataggtcagatcctgcaatcgttgttcgaattggccagttgtgcggtgtactgggcggaattgtttgcgcgctcggcatttttactttgaaaaatttgaagcaacgtcacttctttttggcaaagtcgaataactgagcttctcacggacggattgacacaaacaattttgaaaaatggggtgggcttatgctggcgaagttgcgaagagtgaatctgctatcggtgtttctagcagctaagggaacatgcttcatctgtggtattttggtattatgttatttccccagtttacaattcaagtgcaacaccctgacgactagaccataaaggccatgaagacctattcttgttagtgctagccattgcgaccaaggtccttacatgcaggtccctgcgccggggagcgcgttatgggcgtaagctagaatgtcagcgcccccaaactaacggccgcgctttggccattccaagcaaactccttacacacagacctccgcatccagaagcgtgccatagcgaagcataatccaaccccgctcacatcccccaaaacaaacatctaactaaaacttctgcgtccaagccggtacttcgcttccgtgatacaacttctcgatcaaatcagcgatatccttagtccgaaaagccttcacaatcttcttgtaagtggcgttattcttatctttcttattagccacaaagacgttaatccacggttggctttgcttgttcactttctccgtgaagactgcctttttcggatttaacttagcatcctgagcaacgccggaattaacaacggacgctgccacatctggcaaagagctggcagtttgagcagcatcaacggctttaagtttcagattcaatttattggtggtcacatcgcgcgttgtcggcaaagccactttcttgttaagcttgatcaacccagctgtttgcagcaattgcagcgcacgaccttcatttgtcggatcatttggtaaggcaattgtgtcgccttgcttaatttggctgattttcgtgatctttttggaataaatggctagcggtgcaataatggtctgcccaatgctaaccaaatcagcgttatgggttttattccagttattcaagaaatattgatgctggaataagttcaagtcaatatcatgatctttcaaagcggtgttgggctggttgtaatctgaaaactgaacaatcttaatattgattccttgcttcttaactttcttggcgactgcctttaaaacgcgattatcagcaccgacaaccccaatcttgaccgttgtctgcttctgactgctagcttgactgccactttttccgcagcctaccaaaatcaatcctaaaagaaccaccgttgcaaaaattttccagatacgcttcatcctgcatcctcctcgtttgtttgcaccaagtacgatttattaacttgccgcatttacctgaaatcgccaatcaatgaacccaataaaaaaagcccacccctaacagttgctgttagaagtgagctttggcccacggtaccattctaattggccacgaaaaacgcgacccactcaccggacgtattcatccgggagcacgataatgggcgccaaccatcacagccttgcaaaaatgctcggtgtgccgtgtgcactaagccatgttcatgatcactcacaaccctgctctcatcactacaggttttctgtactgtcttgcgatcactactcactcagtccgtttatcatcaatttcaagtttgtattcatgagtttagcacaaatttcttggtagtcaatcattgaattttaattcaaaaagagtgtaagctgtcttcaacaccgacatgacattttcaaatcgccaatcacacagccggcatacggaaaggatgatcaaacatgacagatcccattgcgtttttgcaaaaactaatccaaattgactctgcaaatggaaacgaacttgcagtagcccgcgttttgcaagctgaactcgaagcggccgatattccgaccaaattgatcccatacaaagatgatcgggtcaatttagttgcccagctcaatcacggtgaccgcgtattaggcttcaccggccatgaagacgtggtgagtcccggcgatgagaacgcctggacctatccgcctttttccggaaagatcgtgaacaacaccatgtacggtcgcggcaccgatgatatgaaaagtggtctagcagccatgaccttggcactgatccaccttaagcaaagcggctttgcccatccgctgcgtttcatggccacggtcggtgaagagtttggtgcaatgggagcgcgccaactcaccgaacaaggttatgccgatgacttagccggactcgtggtaggcgaaccaacgaacaaattgctaaaatacgcacacggcggaacggttaactacgaaattgacagcgaaggcgtttccgtccacagctcccggccggaaaaaggcgttaacgcaattgaagggttggtggcatttgctactcgcgaaccgcacgcctttgatcaggcccctgatgatcctgacctcggtccattccgccactccattaccgtgatcaaaggcggcgatcaagtcaacaccattccggcccatgcatacttacgcggcaacttgcgcccgactcctgcagcaaatatcgaattagtcgtcgggttattggaaaaattagtcgatcaggcaaataaagccaccgccgctaacttgacgttgaacgttttacatcgttttttgccggtacactctgacaaaaacgggcatctcgtgacaaccgctaacgaagccattgccgccgtgactggtaaaccagccgagttagcggtggcttttggcggaaccgacgcgtcagaattcatccgttccgataaccagtttgacgtgattgtctatggtcccggcgataatcatttcagtcatcagattgacgaacatgttgatttagatagctacacgacagcgattaaaacttacgaagaaattgccaaacgcttttttgcctgaagctcacgtccgccacttatggcagtgttaataaccttttccaaaagtcaaaagcagccgagtcattatcgttgacccgactgctttttttacgctgtgagaagtcacaacacgattgattgctgacgcttatttggttgaaaccgtgacaacccaattatcgttatgatcggtttcgtctaacaaagcaggtttgtcgctgagctcacgatgaacatcaacaaccgtaccagccagcggtgcctcaagatctagcacggccttttcagcttccacactcaagaagggtttgcccacggttaagctggtaccaatttcaggcaggtccacaaacttgatcttacccaacgcttcctgagcttcttgcgtcaagcccaagcgaacttgtcctgcagccaattcatcttgccaaaaatacgttgtcgccattataatctcccctattcaaaatcttctgtgtcccggctgaacatatagctcgtgtgatgataacgcatggatagtaccatcccaaccgataacatattcgccaataagaatgatcccccttgcgaaatgaacggtaacggaatccctgtcagcggcaacaagccaatattcataccgatattttcaaacacatggaataagatcatcatgatgactcctgtcgagatataagcatagaactcattcttggtgtcaaatgtcacccgaatcatctgatagatcaacataaagtataacagaatcaacacagccgcgccgataaatccgaacgcctcaccgatgaccgagaaaatcatatccgattcccgaaccggaaccgcaacggcgatatgaaacgcgcctttcccggttaattgtccggatccgatcgctttcatcgattgccacaattgataactgtcgccacttgtgctgccggaagggttcaaccatgagtcaatccgtgcaaactgatacgtcttaaagccaatggatccaaggaaagaccgcccccacgattgggttaccagcaagattgccagtgttccaatggctgccccaattaaagcgatgggcaataaaatgcgccagttaatgccggcaactaaagtaaccccggcaaaaatcgccaaaaataccagcgttgtcccaaagtcgttttgcaatttcatcaataccgcaatcggcaaggtccataaaaccatgcgtccgatcagctgccaatcatgctgaatcgtgtgcgaaaaagcggcattgtgctgggtcacgacccgactcagcatcaaaatatacgcaggtttcataatctctgaaggctgaaaactaaccggtcccaaagcaaaccagcttttagcccctgtattaatagccgtcgttttatcataaaaaatcaaaacggcaatcatcaagaaaatgccaatcccgtaaagataaggcgcaatccgccaaagttgctcagcgtcaaaacgcatcacaaagaaaattccgatgccgccaatcacgtaccaagcagcctgcatgatggttgcgcgaaccggattttgaagcgttgtcgtatcatgagcggtcgccaaataaatcgagactagtccaatcaaagccagcagcatgaccgacagaataataccgtagtcgatgcgatcgccttcagaattggatttgatttcatgcgattccacggccagcctccttacaccacattcatgaacccattgccacaccgttaaaagctaggttagtcattcacctacagtgtttcgctaggttattgttaccgttattttaacaaaagaaaattgctcagccttgatgcaaatgatattccgcaattaaagcattcactgcatcatcaatatttttaaagcgattgggcttgttagaaccggcaacataagcggcaaaccgcgtgccatccggttcgataaaaccaatctcctgatcgccgattcttaagacggaaaccgtgtggccattgcgggtttcatccatctgtgcgactttaatatttttttctttagccatgatggcctcctagcttgcgattaagattttgaatgtcactaagatccaaatcattttcgggatgcggattacgccgcaacgtaaaataagctggcaccggatctagcccacctttaacaaaggggttgcatcgtaaaatccgagcaatccccattaaaagcccttttaccgccccatgtcgttgcaacgcctgaatcatatacgtcgaacaagtcggataataccgacaactcggcggaaataacggggaaataaatcgctggtagccccgcaccagccaagtcaggatttgtttcatgtccactcctaacgcaagaagttaaagaaatggatccaggttgaaggcaaaaataccttaaatggattatcgccacccataccaaagccgattaacaagcccaaaatcaaggcaatcaaggcaacaatcagccaaatcttgacgtgatgaaaaacgcgtttaggatattgcgagtccataagtgacaactcctagtattggcgatgatgttcaatattgtctaataacacgcctgttcccagtgccaccgcatctaaaggatcgtcagccagcagaaccggtactttcaattcgtcggcaaatagctgtgaaatgcctttcaataaggcaccaccgcctgtcagcatgataccgcgatcaataatatcagccgaaagttccggcggggtcttctccaaaacccctttggcaccatcaataatcgccatcatggtctcatgtaacgcatctgacacttcagctgaggtcaccgaaacctcgcgtggcagtccggttgcgatatcgcgaccccggacttcaatcgtttctttaggatcggcatcataaaccgcaccgatcttgatcttgatttgttcggcagtgtgttcgccaataatcagcttgtgcttgttcttgacgtaagcagcaatggacgcatccattttatcgccggctaaccgcagtgaacgactggtaacaatctcccccagcgaaagcacggcaatatcgctggtcccgccaccgatatcaatcaccatgttcccttgcggctggaaaatatccaatcccgctcctaccgctgctaccttaggctcaaactcaaggtaaacatggcggccaccagacttttccgcggcctggataatagccttttgttcaatgtccgtaatattagtaggggcacaaatcaaaatatttggttttgaaaaaacgccttttacatttaatttgttaatgaaatattcaagcattgcttcggtaatgtcgaaatcagcgatcacgccatctttcaatgggcgaattgatcgaatgttacccggtgtgcgcccaaccattttgtaggcttctgtcccaactgccagcactttgccggtatgggtatcaatggcgacaacggacggctcattcaagacgatgcctttgcctttaacattgattagtacattggccgtccctaagtcgatcccaatatcttttgccatgggtatatatctctcctcgtaaattgactaactatcgcattataacatagttaagacgaggtttttataggaaaagtttaggtaagtttaaagctgcttgaaccagtgataaaaagaaggaactaactaaataacctaagccaactgccataaaaagtaacagcacctgtgcctcgcgaacatgattggccttaataaactgctcaaagcgtaatgcattcaacgcccgaaacgccaacatgatgaaaacaaaatgggaaacaagggttatggcagcatttaggccgatttcctgaaacatgcgatcacctcacagaacatcttcccgcactttcaacaatcacgcaagcctaagtgagcgtgagccagcccggttagaaaccggagcataagcggccttgggcgtgatggcccggcttggccattgcgcccaaggtccttatgtgcaggtttctaggccagcgaacgcgttatagaaagtgagcgcgagccggcgcgcttagaagtcggagtgtaagcggccttaagcgtgatggccgggctttgccattgcgcttaaggtccttacacgcagacttctgcgccggggagcgcgttatagaaagtgagcgtgagccagcccggttagaaaccggagcataagcggccttgggcgtgatggcccgggcttggccattgcgtccaaggtccttatgtgcaggtttctgggctggcgaacgcgttatgggcataaaccagagcataagtggcctcaggtgtgacgaccccgggcttggccattgcgctcaagaccctcacaccccgacttctgcgtccagaagcacctcatggtatataccgggcttggaattaggactataaaaaaacaacccattcaaaaaaggcgtcctatttttccgttaagtttggaaaataggacaccttcttttgcgccaatgtgccaatccagccacattggcgtatcaaggtgattatcgtggagctaacgccgcaacgactgatcaccttccaatcactgactagtgactggttttaacgttgatccggttgattgcccgtcgtagtgcgacttgcgcccgccgtagatcatcttggttattttcatccttggcctgagcgatccgcttcttggcccggtcacgtgcagcttgcgcacgactaaggtcaatatcgcgttcacgctcggctgaatcagcgacaatagaagcaacattatctgaaacttccataaagccgccattcaccgcaattgagtcgttatgatcacttgaatcaacccgctgaacgtcaacttcccctatttcaagaggcgtgacaatcggctcatgattcgccatgatccccaattcaccggcgaccgaatgaacgactaacatctttgcatgatggtcatataccaaaccatcaggcgtcacgatgttaacccgcagaacattgctcgtttctgccaaaacgcgtcgcctccttagttagctgcagcttgtgcagctggcttttcgtcagcatccgtgtcctgatcatcaggagcaaagcccatctttttagccttttcaacgacttcttcaatccgtccaactgaacggaatgcatcttctggatagtcatcgtacttgccttccagaatttgtttaaagcctttgaccgtttcttcaaccggtacataagaacccggctgaccagtgaaccgttccgcaacgttaaagttctgtgacaggaagaattgaacccgacgagcacgggcaacgataaccttttcctcgtctgataattcatccatccctaagatagagataatatcctgtaactcacggtaacgttggagaacctgttggacttctgttgcgactttatagtgttcttcaccgacaatttccggggtcaaagcacttgaagatgactccagcggatccacagccggataaatcccttgttcagtcaaacgccgctccaagttagtcgtggcatccaaatgggcaaatgttgtcgctggcgccggatcggtatagtcatcagcaggaacataaatcgcctgaatcgatgtaaccgatccttttttagtcgacgtaatccgttcctgcaactgacccatttcagtagccaacgttggctgataaccaacagctgaaggaatccgaccaagcaaggccgaaacttcagaaccagcctgggtgaaccggaaaatgttgtcgatgaacagcaggacgtcttgaccttcgacatcacggaagtactccgcaatcgtcagtccagtcaaggcaacccgcatccgggcaccaggcggctcattcatctgaccaaagaccatcgctgtattctccagaacgccgctttccttcatttcgaagtaaaggtcgttcccttcacgggtccgttcgccgaccccggtgaagacggagatgccgccatgctcttcagcaatgttatgaatcagttcctgaatcaaaacggttttaccaacaccagcaccaccgaaaagtccaaccttcccgcctcgcaggtaaggttcgagcaaatcgatgactttgatgccagtttccagaatctcagaactggtattcaaatcttcaaattttggtgcatcacggtggatgctgtcacgccgatgatcaggtccaaaagcctcaccgtcatcgatcgggtcacccaatacattgaacacgcgacccagtgtgtctttaccgacaggcactgaaatcggaccgccagtatcttcaaccgccatgccgcgttgcaaaccatcagtcgaatccatcgcgatagtccgcatcacaccatcacccagttccagcgcaacttccagcacaagctgagagccgtccttacgggtaatcgtcaaggcgttgttaatttctggcaaattgtcattgattgggaaggctacgtcgacaacaggaccgatcacttgcgcgattttaccagttgaatttggcatattcgtcctcctgttgtaaaagtgagcgtgaaccagcgcgcttagaagtcggagtgtaagtggccttagacgtgatggcccggtcttggccattgcggctaaggtccttacacgcagacttctgcgccagtgaacgcgttatgggcataagctggcacattagagtcctgaatgtaagtgtctctagacttgatggctcgactccagccattacaaccaaactccttacaaacagccccctgcgccaacaaacgcaatatttattccaatgctgccgcaccaccgacaatttcggtaatctcggtcgtaatcgcagcctgtcgtgctcggttatactgagtcgacagatgtgaaatcagatcattggcattatcagtagcactacgcatagcagttgtcgaagccgcgtgctccgctgttttcgcatccatgatcgcaccaaagatcaagctttccgcatattgcggtaacaccgcatctaagacggcatcaagatcaggttcgacaagatactcaacattggtatcttcaacttcactgacatctaaatcactgattggcaacattttctctgcccgaaaagcagaggttaatgtgttgacatggtggttataacaaacgtatagctcgtcaaagacaccgttgtcatacatggtcacagcagttttcacaatctcccgtacctcattaaaagtcgggatatcggaaacgccacgatattcataagccagattcataccgcgggctttaaaaaagtcagcgccgacaccaccgattgccatcatgacgtaatcgtcagggctttcgtggtcatctttaatcatctgcatcatggcttttaataccgtgctgttataactgccgactaatccgcgatcacttgtgatcacaagatagcccgtctttttgacaggtcgcttctgaagcaagctggcaacggaaatgacctgattcttatctgtctcagtgtcatcattcgcagcagtagctagttcaagaagttgacccgcagctaaatgagtcacaatctggcgcactttgtcagagtaaatttgatacttcttggcacgcttttcgatctggctcaatttggcgccggaaaccatctgcatggcttgcgtgatctgaccggttttcttggtcgaagcgatcttgcgcttgatatccattaatgactcagccatgcggcacctccttaacctttagctgcagcaagttgtttgcttgtttggaagccgccagcaaacgccttaatctgcgcatcaagcttatcggtatccggtaaattaccggtatcgcgaatttgcttcagcagatcagctgcattgctatcaaagaaatcaaacatttcgtcttggaaacggccaatatcttcaattggaattggatcaaggaagccatgggtcaaggcataaagaatcaacacttgcttttcgactggcaatggcttgtgtaccggctgcttcaacacttcaactgttcgacggccacgattcagttttgcctgtgtagctgcatccaagtcagagccaaactgcgtaaaggcttcaagttcacggaaggatgccagatccaaccgcaatgtcccagcaaccttcttcatcgctttgacttgagcatcaccgccgacacgagaaacagacgcaccagcatcaatcgctggacgtgtgcccgcatagaacaaatcactttgcaggaaaatctgaccatccgtaattgaaataacgttggtcggaatataagcagaaatatcgcctgcctgggtttcaatcacaggcaaagccgtcatggaaccaccgccaagcttatcgcttagttttgcggcccgttctagtaaacgactgtgcgtatagaaaatatccccaggataggcttcacgaccaggcggacgacgaagcagcaaggacagctcacgatatgaagttgcctgcttgcttaggtcatcatacacgatcaaaacgtgtttgccattgtacatgaattcctcacccatcgccgcaccggcataaggcgcaatgtatagcattggtgcgggttcggatgggccagcggttagcacaatggtataatccatcgcgccatatttcttcaacgtttcaacttgggcacgaaccgtgctgtccttttgcccaatcgcaacgtaaacacagatcatattttgatctttttgattcaaaatcgtatcaatcgcaattgatgtttttccggtcttccgatcaccgataatcaactcacgctgaccacggccgatcggaaccaaggcatcaatcgcttttagtccggtttgcaaaggttctgacacggattgacgttgcataacccccggtgccttaaattcgattgggcgggttttatccgtcttaatcgtacctaagccatcaactggctgacccaaggagttaacaacccgaccaatcatggcttccccaacaggaacttccataatacgaccggttcgtttaacctggtcaccttcgcgaatctcatcgaagtcacctaagataatgatcccgacatcattcgtttcaaggtttaacgccatcccgtatgagccattactaaattggagcaattcgttggccatggcattttccaacccagtggcgcgggcaatcccgtcaccaatgtaggttacagtgccaacttcttcagccgccaaatcatcttgatatccttcaagttgttttttgatcagagaactgatttcctcagtcttgatgctcatccggttcacctctttacttatctctaatctgccagcagtgccgctttcatcttctcaaagcggtgcttgaccgtaccatcaatgaccgaaccgcgagcttgaatgcgaacaccgccgatcacacttggatcaacgatttgcttaagctgggtcgatttcatgccaaaacgcgcagcaatagaactgcgtaaagcatcggcttggtcggctgacaaagcaactgcagtcgtcacagttgctgcaataatgccggcttcatcatcataggcgcgattaaacgtcgtgataattgccggtaatgcaccgaatcggccatactgttgggtcaactttaacaagttagcaacaagtgggcttgcatccttggtcaaagttgtcaacaagttggctttgtctgcggctgaaattcgggcattgtcaaaaattgtcaggattgttggattttctttgaatacagacgctaacgcctgtaactcttcatgaaccgtctccacttgattttggtcatgcgccgcttctaacaacgctttagcataacgcggtgcaaccatttgattagtgactgccatttgcatcacctaaccgtttgatatagtcgtcgatcaagtctttttgatcgtctgcattaagctccttgccaatcagcttctgggcaatggctaaacttaaatctgccacatcatttttggcactggccagtgcgtctttgcgcgcttggtcaatgtccgcttgcgcatttttctttaacgtagcgacttcggtgttagcagcgtcaaccaatgattggcgttgcttttcaccattttctttagcttgattgacaatcttaacagcatcggcttgggagtgttgcagcgcttctcgacgcttagccgctaatgcctcggcatctttgcgggacttttcagcataatccaagtcgccggaaattttttgttggcgctccgccatcatctttgagacgggcttccaagcaactttcccgaccgcgatcatcaggaccaaaaatgtgacgagtgtgaagagtgtgtcacctaaactcatcttttgccactcccttctttattgatgactcaaaattaacgaagcatcaacatgaaggcaataacaacagaaataatcggaacagcttcgatcaagccaacaccgatgaacatcgtaccacgcaaggtcccggccatttctggctgacgcgccataccttcaagtgtcttgctgataaccatcccattaccgattgaagcaccgagagcagcgatgccagcggcgattgatgcagcgatgaattgcatatgaaatttcctcctaaattaattactcggacacaactttgtgtgacgtataaaccataccaagcgtgacgaaaacgtacgcttgaatactaccaatgaagactgagaagccttgccaaacgatctcaagcaagaaccctgaaacaaaactaaacgctccgcccgaaaaagcaagctgcctaatgagtaaaactaaaacttcaccggcgaaaatattcccatacaaccgtaaggaaagtgtaataaagttcgtaaactcttccaataggttgattggaagcaggattccgatcggtgacacatatcccttgagatatcccttgaaacccttaaaaacaatcccaaaataatgtgaaataaccaatactgtcatggccaatgtcatggtaatgacaggcgatgctgttggcgaacgaaaccaggtgtctttgccaatatcaagctcaaggaacaacccaatctgattactaatgaaaatgaacaagaacagcgtaaatgcaaacaggttaaaagtgtaccgttgtgaaccgggaattgcacccttcacaatgccgttcgtaaaattcataatccattccaagatgttttgctttgcgccaggccgcatctgcaaattgcgtgacaaccaaaacaccagtaagaataccaagatcgccgaaaccaatacgccaatgtcattggtcaggttgaaatttaagccgaaaagcttgatcgagggatattgttcgttcacagaattcacctccttactgaagcggcgtcatatcgtatgtatcatcaaaccgatgatgcaagattacggagacttcgataatcgttgatactagggtatacccttgaaacacaatcattactctaacaccatttcgatgaaaagacaaagccagaaaagcagaaacttttgccgccatagaggctttttcactcatgttttcacatcagacaacagattctccctgccttgacgcaccataaaaattattttaactaaaaatgaaaaaggcatgtgcacggccacatgccaaatcatgttattttgtcccaaaaagtctgtcaccggcgtcaccgagaccaggcacaatataaccgttcttatttaaatgatcatcaagtgcagcggcataaatatcaacatccgggttagccgcctgaactgctttaacgccttctggtgccgccaccagcactaccaaccgcatagaagtagcgccacgctttttgagcgcttcaatggccatgttagccgagcccccggttgccagcatcggatcaacaatgatcagatcacgctggtcaatatccggcggcatcttaacaaaatactcgtgcggctttagcgtcttttcgtcacgatacataccgatatggccgacttttgcagcaggaattagccgcaagacgccatcaaccatccctagcccggcccgaagaatcggaatcacagcaagcttcttgccagcaagctgtttttgaaccgttttgcccatcggcgtttcgatttcgatactttcaagcggtagatcccgcgtaatttcatacaccattaattccgcgatttcattagcgatttcgcgaaattccttggtgccagcatgcttatcgcgaattaacgtaagcttgtgctgaatcaacgggtgatttaaaactgtaaatttacccatgaagcgcctcctgtgagaaccatttgtttgcaaaccctatctatgataagggatgacgggcagtcagtgcaagaacttcttgccgaatttgatccaaaactggctgttcgtcacgatgcgcaatggccatgctgatgagttctgccacgcgtttgctttcttctggcgtaaatccacgcgtggtaatcgcagctgtcccgacccgaatgccgctggttttaaacggaccattttgctcgccgggaatttgattcttgttcgtggtgatatcgacttcatccagcaagtcctgaacctggcgcccattgaccccgtaaccggtgacatcgactaagaccatgtgattgtcagacccgccggaaatcaagcgtaagtgttcatcttccttgaaacctgccaccatcgcatgcatgttgtcaataatctgctgcgcgtaagtcttaaacgccggctgcaacgcttcgcctaatgccaccgccttagctgccaccacgtgatccagtggtccgccttgaatgccggggaacaaggctgaattaattgctttgccatactccgccttagccaaaatcatgcccccacgcggtccacgcaaggtcttatgcgttgtggtcgtgaccacatctgaatacggcaccggattcatgtgcaatcccgccgcaaccaagcccgcaatgtgcgccatatcaaccattaaaaaggcaccgacatgatcagcaatttcgcggaattttttaaaatcaatttcccgactgtaagcggacgcaccagccacaatcaaacgcggcttgacttgttctgcctgctcgcgaattttggcatagtcgaggcgctctgttttcgggtccaaaccataatggtagaaatgatattcctgaccactaaaactgaccggactaccatgggtgagatgtccgccatccgttaagtccatggccaaaaccttatcgccgtcttcaagaaacgcccgatatgccgccatgtttgcctgcgaaccagaatgcggctgaacattggcaaattcagcaccaaaaagcttcttcgcccgctcaatagcaagattttcaaccacgtctatgtattgattgccaccgtaataacgatgaccgggatagccttcagaatacttattcgtcaacaccgacccttgtgccgcccgcactgccggagaaacaatattttccgaagcaattagttcgatattatgttcctgacgcgcttcttcttcgtgaattgcgcggaaaacttctggatcatgcgccattaaatccatgcctaccactctcctcttaaaatcgattcatccacctatcgacaggtgatcgccgtttaacctgtgcaaactagcaaatgccaaagcacgttgactagatttccccaacactttgcgctcaatcataacacgcttaccggcgcagggatctgcgtgtaaggacctcaggcgcaatggccaaaacccggccatcacgcctgaggccgcttacactccgatccctaaccgcgccggttcacgctcaatcataacgcgctccccagcccagaaacctgcgtgtaaggaccttggcgcaatggtcaaagcccgaccatcacgccaaggccacttacactccggtttctaaccgggctggctcgcgctcacaaaaatagccaaccgacttgttgctgtcagttggctatattatagcaaatcaaaaccgatccgttggcatattcggttgatagtgcatgttcccagccgatttaagcagtcgattcatataagcggcacttaattcgctgtggctaaaggcttgggccagcacgagtgttacgtccggatgcaagtcaaaccagcgcagcccggcaaacaaggcgtgtgtagcgctggtaatatcttggcccaacgagtaactaggcacatcaggaaaatgggcaagaatcgaatctgtcgccaaaagtccaaaagtttggcccgtctttttagcccacgccactgcatcatcaaattgatcaatcgtatccactacaacgacttgcgctgctggtgcgtaatgtttgtatttcatccccggcgctttcggtgcttcgtttttgccaacgtgatgcgccgcagaatcaaccggtccaagcaacggttccaattcatgcggtccaattgcacccggtcgcaaaatagcgggtggggtcacggttaaatcaataatggttgattcaactccgactcgggttggcccatcatcaaggacgccggcaattttatcggctagatcgtgcaacacgtgatcggccgttgtcggacttggcttgcccgatgtattggcagacggtcccacaatcggcacgccagcggttgcgatcaactttcgggttaaggcgtcatccggattgcgaaatgccgcggtttgcaacccgcctgtcaccttcattgacaaacgccctggcaaaatattcaaaataatcgtcagcggccccggccaaaaggtgtccatgagtttcgccgcatccggggtaatcgtggcatactgactaaccattgccgcgtccgccactgtcacaatcaatggattatccgatgggcgccccttagcagcataaacttgactaaccgccgtaacattagtcgcatccgctcccaacccataaaccgtttcagttggaaaagcgaccaactcaccacgttttaaagcggctgctgcttccggaatatctgattcatgataacgttttgccaaaatgatgcctccatatccattgactgttcgtttttactaaaataccacatcatcggacttgagctgaaagatgacgtgtcttcttctgacaatggcaacctaaaattgaagtttgaccatgcgcggatgcccagccatgtcgcggcgaaaagttgcttgagcttgcggcagcttttcggcaaataattgccgcagtgccggttcctgatgatagccaaactccaaatacactgcgccatgcgggttcagatgttgcggtagttcagtgacaaaccgttcaaataatgccaagccatgatgatcagcaaacagcgccaatttgggttcataccgtaacgtactttgatccatcaccgaggcttcttcaggcgcaatgtaaggcagattggtcaccacaaaatcaaagcggccaggcaggtggttgaataaatcactggtcacaaaatgcacgctcgctttctgcgccgcggcattttgcttcgcgacagccaaagcagacggagaaacgtcactcaacgtcatgtcaatttgtggcaactgacgggcgagggttaacccaatcgccccactgcctgtccccatatcaaggccggtttgtgcattcgtttgctcctctgcaacccatgcaacaagttcttcggtttcaaatcggggaattaaaaccgctggggtcacagcaaacatcgtgccaaaaaaaggcgcttgaccggtaatgtattgcgccggctcaaagtgggccaatcgcgcaacatccgcctgaaattgacgccaggcagcatccggcatcggatcttggcgatgtaaaatcagttggctcggcgtccagtcagcgcgtgtcatgagaacataacgggcgccgtcaggatcaactttttgcttggtcaataacaaagacgcccacttgagcgcctcagcgtatgttttagacattgagcgattccatcttctgcgcctgatcgtggacaatcagcgcatcaataatttcatccagttcgccattcataatgcggtctagcttattaagcgtcaagccaatacggtgatcggtcacccgattttgtgggtaattataggttcgaatgcgttcggaacgatccccggttccaatcgcattcttacgattttgatcgtatttttcctgattttcggtttcgtaatagtcataaacccgtgaccgtaaaatctgcatagcgcgggcacgattttcctgctgactacgctcgtcttgcatggaaacaacaatcccggttggaatatgggtcatccggaccgctgaactggtcttgttgacatgctgaccaccagcaccggaagaacggtaaacatccgtccgaatatctttagggtcaatcttcaaatcaacctcgtcatattccggcatgacaccaactgttgcagtactggtatgcacgcgaccggcactttcagtcactggaacccgttgcacgcggtgggcaccgttttcgtacttgagtttggaataaacattgtcaccagtaatcatcacgacgacttctttatacccgccgacttcagtaggggttgaatcaacaatctccgccttccagccttgccgttccgcatagtgcatgtacatattcaacaagtcgccagcaaaaagactcgcttcgtcaccaccggcagccccgcgaatttccataataatgttcttatcgtcattcgggtccttaggcagcatcagcaccttaatcttctcttcaagatcggccttttgcttctgcaagtcctccaaatcttccttagccagcgcttccatgtcttcgtctttactctcacgaagcacttcttcgctttctttaatatcagaaagcacctgtttatatttcttataggcagccacaacatcccgcatgccgccttcttctttggacaaagccaagtaacgtttcgtatcactgataacctcaggatccgacatcaactcttctagttcctcataccgaaccaaaagcccatccaactgttcaaaaatcttatccataaaatcctcctgagcgcgaaccggcgcggttagggatcggagtgtaagcggccttgggcgtgatggcccgctcttggccattgcgaccaaggtccttacacgcaggtcattgcgccggtgagcgcgttatgatagagcgtgagccagccaaaccgcaccgaccaagcacctattcctcatcctgatcaatcttatccaacggcgggtgaaaataatgatgccggcaaaccggataatacgattcattgccgccaatcaaaacctgctcgccttcatacaccggcttgccatcgtgaatccgtaaattcataatcgcctttttcgcgcaaaaccagcaaatcgtcttcatttcttcaatcttatccgcatacagcaacaaatattttgaaccttcaaacagctcattgcggaaatcgttcttcaagccaaacgccatgactggaatatgcaactcgtcaaccacccgcgcagcttcaaaaatatgatgcttctgcaaaaactgcgcctcatcaattaaaacacatgctgctttcggatcagtcgttttaatgacatcatacagattcgtttcatgcgcaatcggaatcgcagtccgctcaagaccaatgcgactggcgatcatgccaacaccggcgcgatcatccacggcgctggtcattaaaatcacgcgcttattttgttcttcataattgtgggcaactttcagaatttcaatactttttcctgagttcattgcgccataacgaaagaaaagctgggccatatgccgcctccatttaaaatctcacgtctcacagtataacggatttttttcgcaaagaacactccggctgccggtttgatttcaagttatgctaaaatagtcccattaagttgagaggaagaacgccgtggcattttcagcaaaagccagcctggcaactgccattggtcgcagcagctactggttcttacacacatttttcaaaggtggatcgagtctccccggaaaactcgctaaccgcctcgatccccatgttctgcaagcattaggccataactatgatgtgatcgtggtcaccggtacgaatggtaaaacgctcacaactagcttgatcgtcaaggtactcaaacaaaaatatcaggaagtcctaaccaatcccaccggctctaacatgttacaagggattacgaccgcttttttagcccagcccaaaagcggtcatggtcgcgggatcgctgttttggaagtcgacgaagccaatgtcgctcccgttgccgcgcagttgaagcctaaagcgtttgtgctgaccaatattttccgtgaccaaatggaccgctatggtgagttttacacgacttaccaaaaaattctggatggtatcacgcttgatcccaccgctgtcgtgcttgctaacggggatgcgccgattttcagttcgcggaagttgcccaatccgatttattattacggctttacgttgaccaacgaaggcgatcacaaggccccgccgaatacggatggcgttctttgcccggtttgccagcacattttgcattatcacgctttgacttacgctaatctaggcaacttcttttgccctaattgcggtttcaaacgaccagagttgacttatcaagttaatgccgttaccaaaatgacgccgcaaagcagtgagtttgtcattgacggtcagctgtgtcacattgacattggcggcatgtataacatctacaatgcccttgccgcatttgcagttggccgaacgtttgatgtcagccctgaacaaatcagccaagcgtttgcctacgatgaaaaagtcttcggacgccaagaagtcattcagctcggggccaaaaagctgacattgattttagttaaaaatcccgttggcctgaatcaggttctgagcatgattcaaaccgccaagcagccttttgggtttgcaatgctattgaacgccaattacgcggatggtattgatacgagctggatttgggacggcaactttgaagaattcgttgcgagcaaaaaagccgccgactacctggttggcggcgagcgctatcaagatattgctctcaggctgaaagtagccggagtgccagaaaccaagcttaccattaagccagatcttggcgatgtgctcacgacgcttcaggaaatgccgcagcagcaactctatgtcctcgcaacgtacacggcgatgctacaactacggaaaaaactcagtgatggtggttatattaaaggcggtttttaaacggttaaagctatcatacacacaaaaacagggtcgtgaatttcggccctgtttttgtgtacgcattactggtctaatatcggctgatcattcaaaaaccggtgaaccaactgatcgcgtcttcccagaaattcctgattgggctgcggatggacgcgattcgtcaagacaatcagtgccagttgactttgcggttgaaccaaccaaaaagttccggtatagccagtgtgataaagccataagcggccctgattgtcatgtttgagatcccagccgagactgcgcccaagatgatgaacggtccagtcacgcgttaggtcttgggcatgtttcggccaagctggggcggttcgaagtccgaataaatactgggtaaatatgatcagatcgtccaaactggcaaataagccggctgccccactatgcgcccctaaaatggcactcttgggatcatgcacaaccccgcgccgtaatcccgaaagtggctgataagtagttggcacacactgcgctgcttcaggttgaaaagtggcacgtggtaaatccagtggacgcaaaacctgccgtgtcactagtttctgaatcggttgatgatacacttcctcaagtgcccaaccaaccagcagcaaattcacatctcggtaaaccaccttgcgattcacttcatccgtcaccgctaattgagtcagcagcgcatgttttaatgccggagcaggtaaagcatcgcgatgaggaatgtacccctcaagtcccgatgtatgcgtcagtgcctgctgaaacgtggtcgaatgtggaaacgccgccaacagttgttttaacggcattgtcggcgcaaccagcccatgatcccacgcctgcaaaaagacagtggtagtgccgaccaccttggttaacgaagcaatatcataaagcatcttaggccgcagcggttccggatgcggcagccactgcgcttcacctgccaccttggattgaacccgcttgccagctagcattgcaacactaaaacccggtacaatccgctccgctacccatttttgcaacctcgtcgttactgcttgaaaatccatcctggccttctttccgatccaaggccagatcggttacgccactcgaaaccatagcgtcagtcgattcggcccagcgatcatcaaaaactggttctcatggtgataatcgtaatccgttaagccagctgcatcaaggttcatcaaaatgttggccatcgtcattttgtcaggcaaaataaagctcacatagtccaatccatacatatcaggcgtcggtaacaataatttgggatcccggcgtaaattaatcccaatgtgatggcgatagtcgcctgcagcaagaaagatctcatcttttacctgtgttgccttttcgcgaaacccaagtccttgcgccaaataatgactggtcgtttgtaaatcagccactcgaaactgaacgtagccaatcgccgtccctgatggcaggcggtcataatcgcgcaccgcatgcttgccaatttcttcgggatcaagcgcctgttccacttcatcatcccaattgtattgacgctcctcttgatactgttcaattgcacgatcaattgtaaaggccacgccattaccttccggatcatgcgccaaaaagccttggcgataatttgtctgaaatgccttggtcactgcctgatcctgcttaacaatgcgatacgccgcccctaaagcccccggattcggtaataaaatggcaaaataatccagtccggtgaccgcttcttgaggggttaatccgctaatctcatgcaacacgactaacacctgctgatttaaccgcgtgcccagataaaccgtactgccgttttgccgcaataaatctaaccgcgcaacgtcttgataccagcgactcaccttggccaagtcagccactttaagcgcaataaaatccacgcgtgtttcttccggcaatggaattcctgccatgttgaccctctccttctcattcatccatgagatcctaacgcctttaaccttttgttgctgccaacagcataatgagtcttcatcttttttgccaataaaaagcttgatgcgcatgagtacaaggatcggtttgcaaaaattcttaatcttttttaaagttaagaggaactaatacttgcaaaaattgttatttttggcaggttgttacttaagtcgtttattttgttttgtgaggctttcaaatgaaaattttaggtatttacggcgggcaggatcctgatgggttgacggctagcctagttaaaacaatccttgccggcgttacggcaccggcgacaaccgagtttattgacttgaatcagtaccagctgcgacctgatcgtcctggccagaccaaccccgtgctagacgaactcgaggaaaagttgcaagcggctgatgtgtggattcttggaacacccacctactttggaaccgtggctggacagtttaagcagttactcgattgtttacgccatcgcatcactcggatgacgcatcaaggggatacgcttccaggaaagtttaaagataaacattacgttagcgtcaccagttgttttgccaccggcctggacaacacttttacgcatcagaccgatgcgacccttgtcaccatcgacaaagccatgaccgctgccggtttacataaaattactgaactggttctcccacatacttggggcatgacggctttaccagcggccaaggtcaaacaagcacaagcgctcggggcaaaattggccacttttaaaaagaaggatgatgagactttgaaacgttacttattgttgttcggcatgatcgtggtaatggctttggcaaccatgggtatccagcaactcataccaggtgtggcaaccaacttctggtggcgctatgtcagctttgttgtcatctttttcgtcttacttgcttgtttgctacactacgcaacgtttatgcggcacaagcggcggtaacgctaaaagggtcccgaagacaagatcgttcttgtcttcaggaccctttttcatgtcacgggataaaaacattttccccgcaacgcactatttttctaagcctcagcatcattgcaaactaacttaaatcgcgacattgccactgaactgactgttgtacagatcagcataaaagccgtttttagccattagttcgtcatgattcccggtttcaacaatggagccgtgattcatcacgataatcttgtcggcatcacgaatcgttgacagccggtgggcgactacgaagctcgtacgatcagtcagcaagcggttcatagcgtgctgaatatgaatttccgtccgcgtatcgaccgagctggtggcctcgtccagaataagaatttccggatctgccacgaaggctcgagcgatcgtcaacaactgtcgctgaccttgcgaaatattcgaggcttcttcgttcagaatcgtgttgtagccatccggtaactgccgcacaaagttgtcaacatgggctgctttggctgcggccaatacttcgtcgtcagttgcgtcttcccggccatatttcaagttatcccaaatcgtgccggtaaacagccaagtatcctgaagcaccatcgcaaaatgcgcgcgaacatcttctcgcttcatatcgcgggtatcggtaccattcaagcgaatcgatccgccgctaatatcataaaaacgctctagcaggttgatgatcgttgttttccctgcaccggtcggcccgacaatcgcgaccatctcacctggtttgacttgcaggttatagtccttgagcaacaaggcatccggggtataaccaaactgaacatgatccattaccagtttgttaggatcattggccactgccggcacaccagacggctcatcctgcatgtcttcttcgtccaacaccgcaaagatccgctcggcactggcaatagtggattgaatcgtattggctaggttagcaagctgggaaatcggctgggaaaattgctgcatatactggaggaacgcctgaacattcccaagggtgatcgtgccattggaaacttcaatgccacccataatcgcaacaaacacgtaaccaatgttgtttaggaaaatcataagcggcatgatgatcccggaaacaaactgcgctttccacgctgcatcataaaatgcctggttctggccttcaaatgcctcaacttcatcatcttcacgattaaagctcttgatgatcacctggccaccataagtttcttcaacttgattattcaagagacctaaagctttttgctgggcggcaaagaaccgttgcgattttggtgcgacaatcccgacaacaattaagcccagcggaatcgttaccaatgcaatcagcgttaacttccaggaaatcgtaagcatcatccaaatggtccccacgaacataaccgcactggttaccatctgcgtcagactttgttgcagtgtcgaggcgatgttatccatatcgttaatcgcccgtgacataatatcgccattactatgtgtgtcataatacttgatcggcacagtcttcatcttgtgcttgagatctttacgcaattgataaaccgtattctgcgagatccgagtcatgatgaactgctgtaagaaactaaacagtgcactacccaaatacagaaccaagacgattaaaataatctgtttgatcttatcaaaatcaattggatagttgccaacagcgataccggccttttgctccgcttggcctttcataacccctttaaaaatctcggttgtagcttcccccaagatttttggtgtgcgaatttgaaagacggtcgaagcaatggccaagactagcaccgcaataataccaatcagacggttgcgcatgtaaccaaataaccgcgctgttgtgccccagaagttcttcggtttttcaacgagaccaccacggccaggacccatccgtgggccagatggctgcttggtcgtttgggctttgtgattgtctgccattattgctcgtctccttcccgaatctgtgacttgataatctcctgatacgttggattgttggctttcaactcggcatgcgtacctttaccaaccatcttaccttcgtctagcacgacaatcgtatcagcatctgcaactgtcgaaacccgctgaccaacaatcacaaccactttggtctgaatcttggcatcggctttcaaagctgcacgcagattcgcatcggttttgaaatccaacgctgaaaacgagtcatcaaaaacataaattgaggcgtctttcaccaatgcgcgggcgatggctagtcgctgccgttgtccaccagagaaattgccgccgccttgttcaacttgataatcaaggccttctgggttagcttcaataaaatcgcgggcctgggcaatctctaaggcatgccagatgtcatcatcagtcgcgttttcatttccatatttcatgttatcgcgaacacttccggtgaagaggttcgctttttgcggtacaaacgcaacagcttcatgcaattttttcaaatcaactgctttaacgtcttcaccgtcgacgcgtacggcccctttttccacgtcataaaagcgtggaatgaggttgaccatcgtcgttttaccactcccggtaccaccaatgatggctaaggtctgtccgccttttacctgaacatcaatgtcgcgcaaggccggttcttcggcatggtgataacggaactgaacatggtcaaatgccaatgccggatgagcggtatctaatgctttaggcgcttctggtgtggtgatccgactttgttgcgccagaacatcattcaaacgtgccgctgatgcctgagcacgcggaatgaacacgaagatcatggaaagcatcatgaaactcatcagaatctgcatcgcgtaagtcataaacgcgatcaagttcccggtttcaagcgcttgttgggcaattaaatggccgccccaccaagtgataccgatattggtaccactcataatcaaggtcatgaccgggaaaacagcggcaataattgagaataccttgaccgcattttgggtgtaatcctgattgaccccttcgaagcgattctgttcaaaatcatcttgccgaaacgcccgaatgacccgcacaccggttaagccttcacggaaaaccagattaatattatcagtctttttttgcatcgccttaaacagcggaacagcaaaatacataatgatgactagaaaaagggccaataatggcaagctaatcaaaaacaccatcgtcaatgtatgactcttttgatacgccagaaaacttgcgccgatcaacataatcggtgccatgatcatcatgcgcaaaatcatcatccaaacattttgaatctgcgtgacatcgttggttgttcgggtgatcagcgaactggtcccgactttatccatttcgtcatgcgaatagttgatgactttacgataaacatctgaccgtaatttttgccctagcttttgtgatgtgcgcgacgcaagaaagacgttccctacgctcgccagaatactgagcaaggcaaaaagaatcattttcatcccggttgcccaaatatagtcaatatcacccttggcaaccccgttattaacaatatcggccgttaagttcggcaagtacagattactcatgacctgaacaatcataaataatatggcaccaatgacggccagtcctgacattcgcttttttgcaagcttaagcataatttcctcctaacagttgctttggaccccgcgtatagtccagtgtgatgcgttgctaacgctgctgacgatcactggcaacaccaaattgcaaccagtcaaggagctgatgactacgccgttttaattcggcgaccgtaatcggcttaccttcagcctggtgcgaatagtaataaccgattgtctgcatgaacatgccgacaatctggcgaatcagcaaactaatctcatcatccgtttgaatccggaggcgactgcgatcaatgctggttaacaaaaacgcatgaatttcaccatgcccgtgcggtggcttggaaaatggcacatccgactttgccattttggtggcactccgaatatccatgtgcaaaaaaacattccgatacaatgcagcatgtgggccatgagtgagcgctgtgatcactttgtcaaaaaattctgacatcgccgcaaacaaatcgccatgatgtttggtcatcacttgttgtaataatgccaccgtccgctgtcggacattttccagcaaataaaaataaagatccgccttatcatcgaaatactgataatagctgccacgcggaataccggcctgcttaataatattactaatgctggcttcattaaatggtgcccgcgcaaactcttgataagccgcatccattaatcgctgttgcttagcttttggcaatcgaaaaaaagttgctttcggcatggcgacctccttcctagtcttcatctattcgtcaatttggaaagtgtttcattatgacatcccgtcatatgacaaggtgtcattatagacgcccatgccacaaaatgcaatcgaaaaatggaagtatcaactttttcttggacctatagagatgcttttcccgttaactttggcatgattcctgatagtacttgttccatgaaggtcacttgttcctctactcttgttggtaacttaattagcgaagcgggtctctttttaaactcctccttatggctctattatttggatctatcgccttaccgatagaaattctacactaactcaaaaacggtaaattcagtcaatggtctgaatttaccgcttgcaactgtttttgaggttggtttcaatagcttctctaactaacgaaacttgtctaacattgatgactctttaccttggtcaatactttgaggatcgttttgatgatcgtctttttgaggctcatcatggcgcaacgccagaatatctgattcacgaatcaagttgaccccacgcaggcgcatccccttgtcagtcacatctactcgcgtcacgctggtattttttaacaaccccagcggtaactgttccggtgccaactgatagattaaggcactcaataataagccatgcgacaccaccaaaatgtcactgttatcaggactctgagtgtcaatctgcgcaaacgcttggcgaactcgcactagcagatccggcaagtcttcagcctgatgggtcggatcggcattgcgaatggatcggatcaacccagcaaaacgctgtgaacccacccacgcgcgccatgatgccgtcaagccatagcggcgaattgtccgtgtcatcacagcattgcctggatcaccttccagtccgccaaaataatattcacgtaaagccgataacttgattaacgccggttgcggttgatgacccgcaataattcgcctagccgtttcaatcgcccgttcgcgatcgcttgaaaaagccttgacaaatggtatcggccgcaacaattcacccaaccgatctgcagcatcacgcccttttgccgtcaagtttgcgtcggtaatcccctgcagctgacgagcaacattcatcggcgtctcaccatgtctgactaaatacaatcgttttgtcatgcttttaaccgctcctatatatctgtgctggtggacttatcaacttagcgtaaacttataacttggtcactgggacgcgtgtaagagccttggacgcggcggttaccgctcttttcctaaacgcgttcctcggcgcaggaatctacgtgtaaggacctttgtcgcaatggtcaaagaccggccatcacgcccaaggccgcttacactccgacttctaaccggccccgctcacgctctcttctaaacgcgttcgctggcccagaagtctgcgtgtaaggacctcagccgcaatggccaaagaccggccatcacggctgaggccacttacactccgacttctaaccgggcccgctcacgctctctattatgttatcatgaatttcgtaaataattttgatttgaatggaggtctttttgtgattgacgcagccattatgattctggcatatgcgcatgaccatccgcaaagttatcaggttcgtcaggtaccgtatcaaaatgttgctagtattttgcttgacgaccaagtcatcttcccgcaacagcaagttttcttcccaccgaatcgattgcgggttattcgattaccagaacacttttcttttgacaatcctgacattagcgcttggttgctgagcttgttgcctgatttaggtgaagatgttgaagccccttcgtctgatcagatgtggctcacgaccagccatttgaccaaggccaagcagttactcattgaggtttcttttgaatagcactgtcaaagtcgtcttaacccgcggattacgtgcggtattgatggctttcttcttattcatcgcccgcgcctttttgacctggccgtggttggcatttattatcgttgctttcttgatctatgcgtgcgggtgctttgcttatgctgggtttttagcttgggtgcagcgtttgtgaggtttttcgtgacgcccaaaattgagacagatctgtaaactagcatctaatataggtgcccgctttgcctgacgcttttaacaaccaaagctaccgtatttgtgtttaattgtcgctagaatcaaattaagatattcgtgcaacaaaggcacacacgcaaaggagggcgcgccatgccacaagtaaagaatgccttttatgtgcatggaaactctgtcgttgaatttaagccagataaaacggttcgaattgacgattattttttagtcaataaccagacaaaaacaaaggttataggactcctatggtaccgccaaatacgccattgtcatttctcatgactggcaagctacacgttggcgatatcttgacatccattccgtaaccaaaataattcacaatattgatggtaagtttaccaataaactatttgggagaaacaacacctgttgcttatttgtgtcgtgactcgaggtggtttaatttaatttattagtgccaaattttttctgaacccgtttcaataaatcatcacgctttttcttgaaaccaggctgactttcaatttccctcatgtgggctttctgctcatccgtaagtggacgagccatactctcatcagaaaccatatattctttttccttattttcagccatacttcaatacccccgatctaaatatcagcagttgcaattttcttgttctctgattggaatgaacatcttctttatggtcgccacatagcgacttaaagcttctgcggtcgactcagaaaggaacgagcacctgaaaatttctcatctatcaatatcacaatcaggattaaactcagtcagaaagatttgctaaactagcacgactgatctttaacaatccgaagactaggtcaaaacaatcgcctcctcgttaacgacccatcaccaagacgattgttcatttcaaaaccagaaagaattattttcattgcaagtctcattgtatttttcagatctttaacgagttgtaagtttataactacagttttacccccacaaggtctatcgtttgcatagggcatgcttaagtttaccatagacagaaacccaactttgatagccttcacaatattcttgtggtgatatgaacggtaatattttgattctcttttagaaatacccgtaattttgaggacaactaaaaaccgcgacccacaaggcttcataagcgcttgtgaatcgcggtcactgttttacgagcatatgttcaaaaaagcagaagaaattcaagttagaaaaacactaaaagcgctcgatcagctttgaatttgtctcaatcatgtctcaattgcccgaagttaacggatatttatggaaaacaaaaagcagaaaccctttataccaaggcttctactctcattagtaatctattgtaatgtccagaattgggtagatagggatcgaacctatgattatggattcagagtccactgcgttaccacttcgctactacccagtaacttaacaacgagtaatatcttaaaaaaaaatcgcgcacttgtcaacgacttttttgatgaaggtgcaaaaaagttaattctggcgtaaactattaccaatacttaagaagtgaggcgcaagaatgaaaattgaatctgcatgtacttcgattctggttggtaaaaaggccagtattgacggttcaacgatgatcgctcgtaacgatgacacgtttagccccctgacgccgcaacggttctatatgcacgccggatggaaaggcgagaaatccttgcacgtcaagtcaccgctgaatggcttcgaggcggatttgcctgaaaatggttatcgctacaacgcggttccaaacgttgaaaacgataaacttggcgactacgaagaaagcggcattaatgaacgtaacgttgcaatgtcggcaacggaaagcacttatggcaatgaacgggcattgggttttgatccgcttgtcaaagaaggtctggatgaagacttgattgttaatatggtactgcctttcattgaatcggctcgtcatggcgttgaataccttggccagctcatcaaacaatatggttcgccagctggtaactcggtgctcttttccgacaaagatagcgtttggtacatggaaatcgtcaccggccatcactgggttgcccaacgtatccctgatgatgcgtatgcgattgcggccaatcaggttgcgattcaacaagtcgattttgacgacaccgacaattttgcttggagtgaaggcattcaggagtttgtcgaaacccatcacctcaacaccgataaagaaggctggaatttccgccacattttcggcacgatgaatgaaaaagaccgtcattacaacactccacgcgtttggtacggtcataaactgctcaatcccgaaattgaagccgatccggaatctgcggaattgccttttatcatgcggaccgatcatctcatcacccgcgaagatattgcccagattcttggcagccactataacgaaacaccttttgatccttatggccacggtgatgatgccgaccgcttccgttatcggccgattggtttaaaccgaacccagaattcccacatcctgcagttgcgcagtgatgttcaggaaggtttggaagccattatgtggctggcaatcggcatgccttcatttagcccgtatgtcccgttttattgcaacgcgaatgacaccgacccgagctattccaaaacaccgaaaacctttgatatcgatgctgattcggcttactggctgcatcgattgcttgatgtattggtagaggcacattacacccagttcattcaagcggatcgtgactatctaaccgccttgaaccgcgactatcgcgaaatgatccaaggctttgacaaaggagccaaagaacttggcgctaaagaattaacgcaatatctgacagacgccaattacaagattgtcgcgcataccaaggcggcaacgaaagccttgatcaacgaatacgtcatggaaagcttgaaactttcaaaactaaccttcaacatggataagaacctttaatagcaagcaagcggtcaaaatgatggccgcttttttgctgggattttactgttacttgacattgtccttcactgcatcactgatctgcacatgtgggtgccagcaacgtcacaagctttttaacgtgaacaaattcagcatgcttgctttaatgcaggcaggttttgattgctccgatccgtgcccacccgaaaaagtcatcggtcacggctataaaaatgggtttgacctactactcatgcttgacgtacgatggccttattatattgggacggaacatttattagtgacaagcagatgggttgattcatacccagcgctgactcaactagtttgacacagctagaacaccatgatcacgattcaagtcttggttcggtgcttcaaaacccgatcccccaaatatgttgacatacaaaggatggtgttgtcatgcaacgcgaaatcagactgcgctggcttctaactggtgctttactgagtagtatcggcatgagttttatctggccactaaccagtatttatttacataatcggcttcatatctcgctaacggttatcggtgtcgttttattactcaactcacttggcagcgttatcggcagtattgttggcggccggctgtatgaccaaagcgatccttttcggctaacgttatttggcgtcggcctcaccggcatcgttttaattggcctgacaatttggcatggatggccggcttactgtttttggctggcactacttggtatcggctccggttggaacattaccatggttaattctctcggcaccagtctacgttcaaaagatggtcgatacgtctttaccatgctctatttcgcgcaaaacgtcggcgttgttgtcggcacctctttagttggttttatctatgacatcagcatcaccctgctatttttaattgcggtcatcttgtatgtgctattttttattgtcgtgcttacaaaatttcagccagcatccaaaatcacacgtacaccttcaaaagaagcgatggcagcatccccaaaagccacattaccggcagcaaatcacctaatgttaacaactttcttttttgccttactggtcttttggctcatgtaccagcaatggtcatctaacttgtcagtttatatgacaggactaggcattccactacgcaactatagctttctgtggacgctcaacgcagctttaattgtggttattcagctatttctaaactggtttaacgaacacgtcaacggcatccgcattatctatcaaatcctgtttggcctcgtgatggtggcaatttcttttctaatcctcatcaccgcccgaacttaccccttcttcgtcatcgccatgattgccttaaccacgggtgaagccaccgcatcccctgctattcccgctctagtcaatgacttaacgccacgggcgattaaggggcgatatcaaggcttcgttaattcgtggggatcagtgggacgtgcactgggtccgttatttggcggccttgttatcgattggctcaactaccgcagcctcttcatcatcgctgcaatcggcgtcttagcacttgttgccattctcactgctatctggatcaaaacccgccgcgacctgatacgttaccagtaatccatctttttctcttccaattaaaaataccccatctgcaactagcaataaaatttacgccagtagcagatggggttttattacgcggctttatttgtcgcttttaattgatgaatggcttgttcaattgtccggccagttccaaaatgattctggtcatgcgcatcaatcgccacaaacaactggtttttggtatcgagttgaattcgatattgcatgatgccgtcgcctccatttttatatcaaaaggctcctttaaaatgttaaaggaacgcctacaccttctatgttaaaacggttgtcaagtgagaatgtaggcaatcttggataggcatgcgaaattttaaatactctggatcatctttagtttgtggttggatttttctttggctcattatccagctgaatagttttactctcatttaacgtcattggagagaagcctcagttgttttttagtcctacaatcagaaaaaaagaacacaaaaatagcccctcaaaggcagttggacacttatctttcagtgcgactctttaccttcgagagctgtaattctttgtaagcttcttcagctacctcggctcgcttatattgatcaaagtctgcttgctgccgagctgtcggatgcttaattgtgagcacgggcaaaccgctttcgaacttaacatatttaatgatactaattggaggaatgaccaagactgctcagctcccttcgcgtgatttttttgacgaatctcataatgatattatcaggatcggcgttcatcttggcatctgcttaagcttctccagacatcttcatagcacacctactataacgtacttttcaacgtacatttgtgtgtattctatgttggctcgcttgaacgcctcaaccactccatcatcaagcgtgtgctggttcgttaatttgtgactcagtttaactttttgaccacattgtcattagttgcagtatctttgtctgactatatcgcgatagtaacaatctatctgtaataaaatgcgccatttcacaattcataatgccataaaattagccgttcactggcggctaacctattacttgttcgtctttattgttaaacgttaacccactcatactcaggataaaggttttcccaagctacttcattaggctttttttctttcgaatgtatttcaatttgagttttctgcttagctgtattgtcccaggcaaacaaaatcactgtgtaaggggtgatccgcatgaattgatgtccaaacttgccatttggctcttctcgctgattcttcaatattccaatgatatagtccttgaattccgtcaaccgtttccaactccttttctgcgtttcttcatccaggttaggcctgcctgttcggctcttcttcaaagcgcgtcatatgaccccgaccaagttttaccccgtaatttttgtactgtcgaatatgttctctttcatgcaagtacgtcatttcatgattcataacggcataaaaatagccgctcactggcggcttgacactttgttaatttgctgtaggcgctggccattcggttaatttatcgtttgcttctttgtgcaatctatcaaagtattcccactcttctttgggaaaatcaagcttccatggaacaatatcttgtggtcgtagtggcaggtcaattttcgctggatgaggcatgtaatagtcaaaagactttctaacaaaatctgttctcagtttaaaccatccctccccttataggatgcatgcgctaacataaacaacatcaattacactgtcagtatacttgcgtgccgtgcttcagcaacagatgcgtctataactttgttgatcatttgtatactccactagttggtcaactatgtatttaaaagccctgatgtcatgcgtacccacaacgccaaacttttagtcacttccttgacactgcctatcgtggttgagccataattctactcgaggacatgagactcattaaattccgaatactttaatagaatgggttattaaaacagttccgggccgtgcctaactacgcaatctccggccagatggggctggaacgctgtgacggcgcttggagcctgcaagtccggcagcctccaagtcgcctaacaacccgcgacaaaacccggtcgctgtgttgttttcacggctgagccccatccggcctacgattgcgccgctttggcactaatatcgttaaaactcatgttgatgtaagaaacctaaaagacgtacaattcatcgattaaatcgatgaattgtacgtctttgtttcagaactgtgaattatggcccaacctcaaccattttatttaaatttctatattgtgttttcatccaattgttgtctcgggccattcggttagcttatcgtctgcttccttgagaagttgatcaaaatattgccattcctctttagaaaaatcaattttccaaggcacaatgtcttgtgggccaaggggcaggtcaacttttgcaggatgtgacatgtaatagtcaaaagacttcctaacaaaatctcttctcattttaaaccatccctccccttatagggtgcattcgctaacataaacaacatcaactacactgtcagtatactttgcatgccgtgcttcagcaacagaagcgtctataactttcttgatcatttgtatgctccgctggttggtcaactatgtatttaaaagccttgatgtcatgcgtacacacaacgccaagcttttagtcactcctttgaaactgcctatcttatacgaatgtatttcatataaaactattttatttaaatttttcatattagaaaacgcgcaatttcttgttacccataaagtcatctgacggagcttttaaaatctcattatcaggaaaggtctgcagaattgctctataagacgttgggtccgttgtgtatgtcgtcataatagtcaacgccatcgggaagagtgactacctgaggaatatgcactcgtattaactgtgagaagagcgccacgatcttagaatcatctccccttaaagaaccgtcccaaaacagtactgactctctatttagtgaattgactttaactttaaagcccacaaccatccctccctcattttactcacgcgctaacaagcctaggatcatagatgcataatccttactgagattatatgtgagccggaatgccgattcaagttctttgagaagtaacatgcaagaggacttctccgtatttccttaatcttttcccaatatacggatgaacggaatcattatccatatcgaatgccccaccaacatttaaagttgtacgagacgatttcgcagttgttcttttggcctgcaagcaggaaaagaggcataaacatagccgacacactggcggccttcacagttattatcgcttcatatcttcttgtatttccttgcgtatttctgataatcgcttacgagctttttcaagcgaaatttgctcaaaatcagcgataatttgaacagattcttcttctgagagctttcgggctggatgaatcggtcgttcatcaacgatacctacaggaattggtacgtccttttgaatatccttcaacttcttactactcatcaaatccatcttcttccatcgaaaattcaaatatcttcatcacccgcgtcggcgctcgtaacatagctaagttccggctagcagcgtttgccatataaaaatcaatcaatctatcaagttagaactcacttgggatcttctttgctgaacgattatactttatatcctatctataatgcctaatcaccgcagttgagtcaatttttccgttcgcctaaaatcaatctattcaccataaagtcactctcgcaaaagaaacatctttaaattcccaaaagccacaaaaataaaccttcatccagcatcagcgagcagaagcgcattcatcagttttgtgctaaccgttccccagccaatttaatttgaggattcttcaatagtctgttgagacacgattggacaaaattaccttggcaaagtatcccacaaggttgtcaaaatggatccaacgtaattcatcaaacgtcaaagtctttgccactcaaaggggtacaggcatcaatgatgaatatcgaacaatcagcctagatttatcaaacgccaaagcatttgtaccacaagacttcctacttttgacggtgaacttgaatctcaagtattcaaatcttttctctccaaaacaaaaacccccgaaacaccgttataaaggcattccgaggatttcgtttcatcacatttattctatttctcacccgtacgggattcgaacccgtgtttccgcgctgagaacgcggcgtcttaaccccttgaccaacgggcaatgagtggcgctttatcgtacctaaattattctacaggaatctataaaaatgtcaaacatattttgcgagtaagcgaccacttcgcacccttttccaccaagccaccagctccagaaatgtgtgtcaacttatcaatacaattccttttgtgctgactgatacgccttaaacgcgccgatggtcagattgcgatcatgctgactcagcttcagcatttccccctttaatccggcattgataaagtcataaattgcagcatcgcgaaacccaattgccgcagcatcatcagcggtattgccataatagacttgtttgatatttgcccaaataatcgcacttaaacacattgggcaaggcatcgccgaagtatagagctcacaaccggacaagtcgtgtgttcccaatgcctggccagctttgcgaattgcggtaatttcgccgtgtgcagttgggtcatgatcaaccaacacccgattatgtgcacgactgacgacttgaccgttcttgacaattacgcacccgaatggcccgccatcggatccgttaacatttgcttttgcttcttcatcagccattgccataaatgatttttgatacatagcacttgtccccttccttatctgctggtccgacactcatgttcaagctggcagatttcattttatcgatcttcaaaagcgttttgggttagtaccctgtctagttgttaatttgattgaccaaatcggcgacaacagcgtgcgctaattgactggttgccggtgataccggattctggccatctggattacccacggcctggacaaatgcctgtaccattggcgcaaatccccgggtttcaagcataggctgccaatctggggcaaaggtttgtgaagcgccaccacggccatacacgacgagttgatccaggttttggacgcgttgaacgccgcttggagctgccacttgtgcctcttcaaggttggtgcctgcttgtaagtcaatccctgcctcaccgcgaatacctggagccgtgaacgtcacgcttgcttgttgaagttggccatcactcgtggtgtgcaaggcatagcgggtgtttggtttttccggatagccagcgagcatcagtgcagtgtctaccggatgaatgaaaagatcccacagcgcatgttcggtatcatcaagcgcatcaatgcgattcttatcaacgcggacgcctgttttatctgtcacttgcgctaaatcttgaatcattggggcaaaccggcgattaaagccaaccgtcagcatgacatgtttcgcatcggccaaatcatataattcattaacttgcgccatatcggttgctaaaggcttatccacaaagacatgaacacctttttccaaaaaatgcttaacatactgataatgtgtcgcggttggtgtatgaatcatcaccgcttcaagtggttgtccatcgaggtcttgtagcgaatggcctgcactttcaagcccgtactgtgctgaaagctgttctaacttgtcttcattgcgtgtattcaataaccagtgcacttgattttgcatttgcgcataaactggcaagtaggctttttgagcaatcgtgcctaaaccaatgactccaatcgttaacatagcttcacctgttctttcattgatatcgatactttcacactagcacagccccatctcacggtaaagataagcattcattatgatttgaacaggcgcttaggaaagctgaaatttcactggccaaccaggtcctcgaacttcacgatcataatggccggttacaaaaagaattccgtccaatggcaatatttcaaaacaagccttcataatattatggcaaaaccctctctatcattcagaatacgccgttccaaccttggcgaacttgaaaacgatcactatttagcttacggttattatgtaaactaaaataagcgtcaggcatttgcatcgtcttttagtttaatcgggtatcgccgctgacaagcagccgtgacaccagacttcttttttctacctaattttcgagtctttgcctgcacttcatcgttcgaaaaattttgaggaggaatggctgtgaaacctgcaaaaactaaatttagtgacgctcctgatggtagtattcatcaatatgatcagatacttaaatacttcaacgatcggcctgccgatcaaaccaaaccgcgcggcaatcggatcacttttgtaacgaccggtatcatcggctttgatggtggtcaaacaacaatgctgcatttaggaaccttgttagccaatgcgggttatgacgtttactatctaagttacgttccgcaaagtcaagatgagatgattcaaaacgccgaatttaactatccaggctataaaggaacttgtttgccaatgggagaactcgaatcccatcgttctgacatctgggtcgctactttatgggaatccgtttatgtcatcaaaaataagccgggttataagatgtattttgtccaggattatgaaccttatttctacccatacggtgatcgttaccaaatggcgcgccgtacttatagcctcggactgcacatggtttcactagggccttggtgcgcacatatgattacgacacattgcaaaactaacagtccgattgacattatcaatttcccggtcgatgtagctcgttatccgtttaaagaacgcgatcccaagccttaccaagataaaaagcaaatcaaactggcggtttacaccaaatggagcagtcctcgccgcgcgcctgtcaccattcaaattgtccttgaaaactgtcgccatttgctacgagctaagggaattgatctcaaaataacttactttggcacgggtcgcagcaaacgttttattaacggtcaaaatctcggaaagctgcccccatcagagctcaatcagctttaccatgaagcggattttggtattgccccttcaatgaccaatttttctttggttccttacgaaatgatgagcgccggcctacctctgatcgactttaaggaaggcactggcagctacttcctgaaagatggcacttacttttcatgtcacttggatgaacgtgatctggccaaaacactccaaacagcatgcgaaaaacccgagatcattacccaaaacatcgaaaaagcacaagcctatctaaaaacaatcagctgggaacgaaccgaaaaagatatgcttgcgatcatcgccagtctatatgccgatgttgacgtggtgaagtcctaattcaaatcgagcttgacgcttgccgccaagctttttttctgggaaaataaaccttgtaaataaggaatgacgaatattcttattcgagattattcctagttcgaacctagcaatattggaggagaaaaatggctacattgggcgactttttaatcttactcggattgggtgggactatctggggtgccgtgcgcttatttcggcaacggaaacatccgtcaacgaaacgactcaacctaattctactaattggcggtattattttaatgttcattggcaccccgataagtgacacaaaaacatcgacagtttcaactttgcaatcaagcgttgttaataaaaggttaacggcaaaacagcgaaaactgctgaacgccgaaaaaacacacggaaaagtcttattggcagtaaaagctaaaaaaaacgcggagttaaaagccttaaccaaagaacaaaagaaactcgaagcagccgcagacgaacgagcatcctcatcgcgagcggcagcagcttcctcatctattgctgcatccacatcagcatctcaggctgaatctgcaagtaaagcagctgcggcatccatccaagcggctgcctcatcgcaagcagcggcaaatgcagccgcagccaaacaagcagaagaagcccagaaatcggcagcacaacagcaagctgcaccggcacagcagcaaacgccaacaaaccaaggtgatttatatactggcacgcaaggaaccatcgttggcaacagccgtagcaagatctatcacgttcctggtcaagccggctaccatatgaacgctgcaaatgctgtctacttccataccgaagccgaggcatcatcggctggttatcgaaaggcattacgctaatgaaaacaaagttaatgaaatatcttacccctctgctcatagtaagtctcttactaaccggttgcagtactcaaggcacctcaaaatcaacctcaccatccacggatcctgtggccgatcagactaaacttaataataagactaattctgcgatcagcagtctcgatgaagctattgctgataaacgtgaagaagttagcagtctaaaagcgacattagataacagcaagccaagcacagaagcttcaaagacgacagcaggtaccacggatgccaatactttagccaatctcgattataccggccagcaagaaataaccgtcaataacaacgatcccgcattttcaaaaaatgatctttcaactgcaaaaggcgcatgggccacttattccgatttagatagtctcaaccgagtgaccgatgccaatgccttgttaaaccgctcactcatgccttcagccaaacgcgaaccactaacttggaacccaaccggctggcacaataaaaaaacggcacatggatggttatataatcgtagccatttaatcgggtaccagctgaccggcgaaaataataacccaaagaatctcatgaccggtactcaaacgctcaatagtcccttgatgttggctcatgaaatggatatcgcttattatctcaaacaaagtaatgaccactacgtccgttacgaggtaaagccaattttccgcggtaacgaactcgttgcacgcggtgttcaaatgcgtgctcaaagcatcggcgacaacaccattcatttcaatgtctatatttttaatgtcgaaccaggatacaccatcaattacgccgacggaacaagcaccaaaaattaaatatttctgtccagagaaaaaagtcgttgatcaactgtctgctcaacggcttttttgcgctcgcaccggaaccgatctcgtgaaatccttaatcaagtttacccaatcttgtgacccattccggctgaaataagctcatcacaagttatggccccaccccatttcgattgctgcccattttttgctagtataatcagttgtagtgacgatcttagcggcaaaaatttgccttctaagaacgcctctatcaatacattacgccctcgtggccaaaacccctttaggaggaagaaaatgaaaattattaatgttaccctacacgtcaaaccagagcttgccagcgactaccagcagttcatcagtcaattggttgcgggatcgcgtgctgaagccggtaacctcagctatgaccacttccaaagcctcactgatcccaacaaatacgagatcatcgaacactggcaggatgcccaagcagtggcatcacataacgaaacctcccacttcaagcagtttttggctggaatcgattccttcttagatgcgccgcttgaaattattcgtatggactattcggcgtaatcaatcctaatcaatatagataaggaaaaatgaaaattagatacctgattatctataatgacgttgaaaatgctctccccgaaaaggcacgtaatttagcgcgtcagtatggaactgagctaaaaccctggagtcaaaagcaattaatagcattagtttagtttttaacgctgcttcagctcttgtggagcaacaaattcaaacgctgcccgaacacttgcccataaaaaaagccccagaaccagttgataactcctgactgacagccacaactcagccacggacctttccaacatgattctggagctctttatttaccttatttcaaatcgcgcaaacccttgcgattaaaggcgtgcgttcaattccttggtcatatcctcataacccggacgaccaagcagtgcgaacatgttcttcttgtaagcttcaacaccaggctggttgaatgggttgatcccgttcaggtagccggagatggaaactgccgcttcaaagaagtagatcagatagcctaaggtgtaggcatcttgtttcggaatggaaacggtcataactgggacgccgccatctgtgtgggccagaacaacgccttcgtaagctttgcggttaacgaaggacatcttcttgccagccaagtagccgaggccatcaaggttttgcgcgtcgtcaggaatggttaggtcgcggttaggttcttcaacccacacaacggtttccatcagattgcggaggccttcttgaatgtattggccgagactgtgcaggtcagtactgaagttagcgcttgaaggatagatgcccttttgatctttaccttcagattcgcccattaattgcttccaccattcgccaaggtattgcaaggttggttcgtagttttcgagtagttcggtggtgtagcctttgcgatataagatgttacgcaaagctgcatactgataggcttcgttttctttcaaatcagctgatgcataggcttttcgaccatcaccgaggccacgcatcatttcgtcaatgtcgccgccagcaactgcgattggcaataagccaactgctgacattactgagaagcggccgccaacgtcatcaggaaccacgaattcttcgtagccttccgcatcggcttcttgcttcaaagcacccttggcccgatcggttgtcgcataaattcgttccttggcaccatctttaccatacttttcgattaacttagccttcaaaatacggaaagcaatggaaggttcagtcgtggtaccggacttgctgatgacgttgatcgagaagtcacgatcgccgataatgtcgagcaaatcagctaaataagtaccggagattgagttacccgcaaaatagacttctgggaactttagctcaggatcgaggttacggaaggtttgggaaagaaaatcaactgccatccgtgcgcctaaataagaaccgccaatcccaatcgcaacaaagacctgggaattgccttgaatcttcttggccgcagccttaatccgggcaaattcgtccttatcataattgactggcaaatcgagaaaaccacggaaatccttgccggcacctgtaccttcacgcaattccttgtcagctgcagttactaacggctgcatctgttcaagttcattcgcgtgaacgaacttatccagcttagatgaatcaaatttgatgtacgacatcgtgtgcgttcctcctctaaatacgtaccttaccgtgaaacttttgatcaaaccggcatcgccatcaaaaatagcggcaccgcttccaaccaaaagtttacgccagtgcagtacgctgttcaaattcacactctaacaagttaactttaaaattgaatttgtaaaaaagcaagcaatccagcaacttctcatcagattactttgctttcatgatccctaagacgaccccgccaagaatgacgagagccgaaccgcagctgacccagatcatttccttacgcgtcttatgctcaccaagtaagtaaatggatccaaacgttgaaataacgatgcccatttgtgaaagtgaataggaaactgccaacccgacatttgccattgacaacagcatgaacacattaccggtcccccacaagagtccggttaaaacattcttcgcagtggctttagcaaaaggctcatgcccgatgctcatcaacaaagcgccaataatcattccaagcgattgcggcatcaccactgccaaagcaccaagctggccggcattgacgataatcgtgtagccggcataacctgctgttgaaatcagtaacgtccgcaaacccttagcgacgccggtttccgaggtgaagtcatcattttgctcccgccgcgaagtcaacgtcgcaccaatgattagtaacgccaacgccaaaatgccaagcaacacatcacggccgctatgccactcatgaaacagcaatgcaccggccaacgtggtcgcaatcagttgcatgccggttgaaatcggcatggtcattgagacacccatatatttcatagactgaaactgttgtccctgtcctaatgcccaaaataacccagaaataatgccaagcagccaagtcttagtgtcgagaaccggatgcatgatcaataacgtgccaacgccaaaaaccagcgcgccaaacgtcatccccaaagtctgctgataggcattgccgccaagtttgccactgaccaggccaatggaaccccaagcaagtgccgggatcaacgcaagtaaaaataccataatgcgcctctttctttatcgtatcgtttaactgagtacgaatacacctgcttagaaaacttcatataaacgactttacacgtgagatgaacgtgggtttcttccatagaaagtctttatacagaagcgcctgcagatatacgcgttttttatcgaaaatagaacacaaaaaaatattctatcgttcttttcccagcaaaacaagtcgaatttttcgcgcaggtaggcggttagtgttgcgaaaaaaagcttgactgcttcaattgaagcgaccgccgtctaaccttttggatgcaataaccggtaaaaggcatatcccaaaatagcgccgataacattaaagatgacgtcatcaatatcagcaacgccgctaatcagcaagaattgtaaagtctcgatacttaatgatgtgataagtccgatcccgacaacggcaaacaatcgccgccgatgcacactgacccaaggaatgccaaagcccagcggcataaaccaggcaacattgcctaacgactgataccataagtcaaaatgactggcggcctgccgcaatttcagcgtttcgaccatggggtgtagattaatgacagaaagtgagcgttgccaatgaaaaaccaattgccacggatagtacacatcgcgaaaaaccgtgagtgcaaacagtagcatcaaatagccgacaaacaatcccaatttcagttcgcgtccgaatgtcgttcgccgatgatgtcgaaccagccagaggcatcgcaaaacggcaaacactaataggtaaaggatggtcttgtccagactaaaaataatgagccgcaccaaaggaaaatggttcacctgactcaaagacgttgaattaatccagttataaaatggccccaaaaaaagcatggcgatacctccagttgccattgtagcaaacacaacgcgtgatacccacaagcgttgcaacttttaaagactccataagaatcagccgtcaatgcctaggttaaggcaaactgcggtacgctattgaatacagcaattatcattggcggttccccttcaccagcccggaacctgtacataaggaccttagacgcaatgacccaaaacctgtgaacacgctcaaggttactagtctgcttttacgcccataacgcgctcgccggtgcagaagtctgcgtgtaagggccttggtcgcaatggctaaagtacggccgtcacgtctgaggctactagatccgcttttacgcccataacgcgctccccggcgcagaaacctgcgtgtaaggaccttatccgtaatggccaagaccgggccattacggataaggccacttacactccggtttctaaccgcgccggctcgcgcttaccgtctctttttgtgcaattgccgttttgcgggtacaatgacaaagaacaaagtggaaaggagttgccgctttgaaacggttacgactcaatcaacttttacaatgggtacgcaatactcgaatcggcttcttagccctgctgctttttttattgtgggcaaaaacgattttcgggtatttcgttgacttctcgctcgggctgaatgacccgctgcaatataccctactcatcttaaatccgttgggaacgggcattattctcctgtcattagggctataccccaagcatgcccgccgcggttacgctattggcctgatcgtctacatattaagcacgttattattgctcgccaacgtcctttattatcgtgaatttaccgacttcttgacggtcacaacgattcttggtgtgtcaaaagtcagccaaggactcggtgccagttctttaagtatggtcaaaccccacgatttaatttatattctggacattgtgatcgtaattttagcttatttgggttacagcatctggaatatttggcgctatatccataatcaacggcttaagtggccgcattttgggctgtcgttggataccagccgcctgcccttccatctgccccaagcggtgacggtttttggcattgccttttttgctttgatgacggcagtgagtgaaatgaatcgaccacagttgctgacgcggacctttgatcgtaattacatcgtcaaatatctcggtttggcgccttttacaatttacgatgcagctaaaacggcacaaaacaatcaggtacgggctcaggcagacagtgccaatctcgatccggttctacaatacacgcgttcgcattatgccgctcctaacgctagctattacggagccgctaaaggcaagaacgtgatcatcattcaccttgaaagcttccagcaatttctgatcggtcaaaaaatcgatggtcaggaagtaacgccatttctgaactcgttgattaaagaaaaagacacgttaagcttcaataatttcttccatcaagtcggactcggcaaaaccagtgacgcggaaaatatgctggaaaccagtacgttcgggattgccaatggatccttgttcagcagtctgggaacggaaaatacgtttgaaggcgccccggcaattttaaatcaacgcgctggctataccagtgctgtcttccatggcggctccgcttcattctggaaccgcgataatgtttataagagtcttggctataacaattacttttccggcaacttctataatcatgatgaaaaagcggccaccgaatatgggattaaagataaattgatgctggcagaaacaccgaagtatttagagcatctccagcaaccgttttacactaaaattattacgaccagtaaccataatccattttatatcacccaggcggattcggatttcccggatgccggtactgatgacgcgacgatcaacggttacttcaagacggctcactaccttgatgaagcattacgggaattctttaattacctgaaggccagtggtttggaaaaaaattcactcgtgatgctgtatggtgatcattttggtatcagcaacgatcgtaataccaccttagcgccattgttaggtaaagacgccagtgactggaatggctttgacgatgcccaactgcagcgggttccgctaatcttccacatgccgggtcttaaaggcggcgtgaacaatacttatggcggcgaaattgatgttctaccgacgctactgcatttgcttgggatcagcagtaagcgctacgtccaatttggtaccgatctgctttccaaccagcatgacaatgtcgttgcttttcgaaatcacaattttgtcaccccgaagtacactgttttaggcagcaaagtttatgataatacgactggcaaactcgtgaccatgacgccagccttacaagcaaccattgataaggaccagaaatcagttgacacgcggcttagtctatccgatgacgttgctaatcgtaatctattgcgtttctatgtaccattaggctttaaaccgattaatcccagccagtatgattacaatcaaagtctcagcaatgtgctgtcgattgaacacggtcgcggcagcaagagcacgagtctttatagcgaaaataacgaccaatcaacaaccggactctatcaaaccgatgcgcctgaattagcagatgacacctcaccgatcaccgattttccggaaaaagttcaaaatcaaaccgattcatccgctagcagcagtgcatctagcagctccagtaccctcaatatcaagaataaccagctcaaatgaatcaaataacataatgaatgctcggtttatgttcacactttgttcaaattcattgcttatactgcttgtgaggtgaacgggtagatgcatttctttgagcgaacgttctcgggtttccgttatcatcgccgttattactttgtgatgatgctgctgtcagttgcgttctgcttgatcagcatcatgctgataacgagtgaaatgatcgaccaatccgcacaaagcgcttttttacagcggctaaattcttttggtacccaaaataaacaaacgattctgctaagtacgcaagttggccaagcccatattaaaatgatgcaaatcacgcaaacattattaaatcgtgtcgtcatcattaatggtatttgctggttgatcgggacggccttgctgtggtttctgcgacgttctgaaaccgatgcgctttatttggtcggcaaaagcagcatgtccatcgggttacaatatgcgtttgaagcatttttcagttccccagtttacaattcaagtgcaacaccctgacgactagaccataaaggccatgaagacctattcttgttagtgctaggcttacacttattatacacttaactattgtcaaagcctatcatgaaagtacttttatagtttttcaccatccactacattacttgattaacgatgctcaagtagttgaatggatggtctaccctaaagatatggcgaatcaagttgtgttacgtcagaaccaaaatagcggtttttctctcattcaggcgaaattggtccaggatccgtacgacaaaaacttctctaatggattaactatgttcaattcggcaacaagtcggagcatacgctttgtaaaacaagaggagcactttagcaaggacgaagaaaaaatcacaacaatctgtcgagacagtcacggaaatacttatcgacatgatgtgtcttgggtaccaggatcaaaacggctaaaagtaagagtgtcatttactaatacttcagggcatgaccagcaattatcgtggctaccttcaatagtgctaagcaatataagtcccttctatgaacaagtcccaactggtgtattggatcttatccgaattcgctcaaagtgggcgatggaggggcgtctggaccaaagacctgttgaatcattcgaattggaggaaagttggaagccctctggtttggcgctagttcaaattgcccaatatggaacaatgcccgttcgtcaatttttcccatatttggggttaaaggacaatagatttgatgtcacttggttaataatgctagagggaaaagcttcatggcagttgaatgccgcaagacttgataatcggttagttctttttggaggattacctgacgctgataacggacattggtataaagatgttgcagtaggagagacatacacaacaccttttgcctatattactgtaggacacgatgaattacttaaatgtagtaggagattacaagcacctgtgcaagaggatacgttgccaatcttctacaatgaatgggggacaacttgggggcggccaaatgcccatttgattagtgaatcgttgcctctgcttaagcaacattcaatagatggttatatcattgacgctggctggtataagtcgaaaacatcggattgggagcaaagtcacggtgattggcaagttgacatgatgcgttttcccggcggttttaagccagttgtggaagagattcatcagcagggtatggaggcaggattatggtttgaaatggaaactgtcgggcgtttgagtgaaaaatttcaagatactgagtctttggtgcaaagaaacgggcatgttgtaacaacattgaaacgccgctttttgaacatgacaaattccaacgtacaggcctatctcaacagacatgttttggaacttctacgtcaaaatgcgtttgattatttaaagattgactataacgacagtatgggtgtagcaactgatgacgcggagtctggtgcagagggactagaaaaaaacatttcggcaacgctgaagtttattgataagttgcatcatgaaatacccgggcttgttattgagaattgttcttctggtgggcatcgtctgaccccagcatttattgagcgaacggaactatcctcattttcggatgcccacgaaacacatagcattccaattattgctgctaacgagtggcttgttattccagcttccaaaaatttgatttggtgcgtactacatgctgatgacacgcttgaagaaatgtattttcatctaattagcacctttttaggacgcgtctgcctttcaggtgacattcggcatctgtcaacagatcaatggcatgcggtagatcaagcgttgacattttatcgcgctaatcaaagattgattgctcatggacaaccattccgttttggttcatcaatattaagttatcgtaatccacaagggtatcaagtttgtggtttcactgataaagaaacattggatgaaagcgggcgtctcttgctaatagtctttggctttaatttgtcaaacagtgaagatgttgatttgcgtttatcgagtcatgagtggcaggttcaagacatcgttggggcaaagaaaattggactgcagagcgacaaaacaaattggcacggatcaattccggcaaattgttatacagctaaagcaattacgtttgtacggaaaagagaaattgaacatttcccagcttaacttttttgttagtatatctgcatgttgtcttttataagacagcatgttttttatatgtggtcgagaaataaagccatactaagcgaatgacgcaaatgagaaaataaaaggatttatttttcgaggcatagatctccttgtagccacatctggcggataccaagctttttcgtttgattgcgctttcatataaccggtgataagctcacaaaggttatttcttaaacaatggtagcttgtaattagcctttggggtgtagttatacgaggaggaagatgatgaagcgttgcctatttggagttggagcgtttgttcttgcattagggatggcggttggtctgaaggttcaagcagaaattgaccctgatacacgagttcctaacaccgttcagcgtggaagtgttcaaagaactcttggtcaatctgaccaaaatgttgacacagggaccaatagaacaacggcagacgagacccagttcagtttaatgcgttcacgatggcgcaaccgtttaatggcaaggaatccagacctaaacaatccgaatgtcaatgcgtatttaatcgatttagcaggccaaagcaagacactttggaatacgatggatcgacgccctgatcgtaagcgtttgtgggccaagaagagttcggatacgacatcagccgattatacaacgacttttactaatataaagttgctgacacttggttactacaatcctaagagtgagcagtatcaagaccccgccgtttatcgagcgattcttgatgccatcgactttatgatcaacgtcaagcagtacaatggaaccttttcaactggaaactggtgggattggcaaataggagcagctcaacaacttgatgatacattgattttgctctatgacgatttacagcaacaggatcctcaaagattgaggaggtttgttcaaccattattgggttatgcaaaagatccaaatattcagtggccaaaatatacggcaactggggctaatttgaccgatatttcaatttctgttcttgctagcggcttattgttggaagatgatcatcgtgtcgcactggttcaagccaatttacctaaagcgatgggacttgttaccgctaaggacggtatttatgcagatggctcatttatacagcacacttttttcccgtacaatggtagttatggaaatgagatgatcaaggggattgcacgtatttcgtctactcttgtcggaacaccatgggcaatcagtgaagttcaatttgctaatgtttttaatttgatcgacaaaggctttcttcaactaatggtcaatgggcgaatgccgtctatggtctcaggccgaagtatttcccgcgcacccggcacaaatcctgagactacagaactagagacagggaaggaaactttagcaaacttaaccttaattgctgaagccgcaccagcgggattaaaacaaaaaatctaccaagcagtggcaacctgggtagcgcaggtgggggattattataacttctttaataaccctcgagattatgcggctttaaatggactgaagacagccctgagtcaagcaactgcacaagaaaatgatcaagattctttgaatgtctatggctcaatggatcgtgtgatgcagaaaacgtcaaaatacgcggttggacttgctatgtattcaaatcgaattgctaatttcgagtatggtaacactgaaaatgctcatgcttggcatacggctgatgggatgctctatttgtataatcgcgatttcaatcaatttggtgagggctactggacgacagttgatccctatcgattacctggtacaactgttgacacggcaccacttgcagacggtgccaagtcttcttctagaagtcctcagtcatgggtcggtggtgcaacagatgggatcgtggcaagcgtagggatggtgttagataagacaaatgaaggtcagaacttaaaagcaatgaaatcgtggtttttgcttaatgaccaaattgtcaatcttggcgcgggtatctctggcacgacgaaagcagatattgaaacaatccttgatcaacgccaaattgacccactgacaactaagatcaccatagatggacacacgtatgtaaatcaagaaacggctaaaaattgggtgaatttgaacaccaacgatccgagcaataatgtcggttatattattgcaaaagataatgatcaagttgatattagtcgtgcaacaagaaccggttcctataaggacatcaatggctattttccgtctgacactgtctatcgtcatcattatgttacgttagcagctaaacatggctccgcagttaaggatggcaagtatgaatatgtgaccgttccaggggcaagtgattcaacaattgccgccttagctaaaaaaccaaagtatcaagtgttggccaatactaatgaagtacaggcgattaagactcaagaccagattatggcaaatatttggaataaggccagtttacttggtggattacttgagattgatcaaccggtttcgcttatcataaaagatctcggtgagaatacttaccaattaacggctaccgatccacgacagtctgatgacccaatcaacttcaatttcaaatatcctgttcacattcgcaaaaagcaggcagatggtttttctgtcaatcaggatttgctgacgcttaagacaaaaggactggccggtgctagtcgttctgtggtagttacggttgatgttcctactgataaggctgctttggaggggttaatctcacatgcggaaaatgttagggcaatagattatacgccttccagttataaaaagttgataaccgtgctggcaagtgcaaaagcagtctatgcgaatgcagcagcaaaacaagtagttgtggatcaagcaaaggcagcgcttgaggatgcgttaaagaaattagtgaaagttgctgatactagtgcacttaaaaccgtcttagccatcattaataagcttaagggtgaagtatacacatctgagagttggcagaagcttcaggatgccttgatatttggaaaagtgacactcaagaatgtagagtcaactcaagaaacggttgattatgctaccaaattgttagttgaggcgcaacgtgctttgattaaaaaagacgttaacgaagcaagcaaacatggccagacaacaagactaggcaagaatagtgaagatagccgtcacgatccggaaaaaatgccaaacaccggtgagaaaggcaacttcattttcatcataatcggctttaccattatcgtgctgactggtatcgtaatgtttgtatgcgagaaaagggagaaccagacgaactagatgcaacgggtaaatataagtggtgagtataaaagaattgcaaagcatccgtttataaactcgcagtagtgtctgttttctttcgctaattagcagatttatcggaaaaattgaaaactttaatttgttgttttcttcacaaatcgccatctacaccacaattcatattataatgaagataataaagcgaaaaggatggttaaccatggaccagaataagttgaagcaagaagccgctcaacgggcagcagagtttgttgaagacgggatgacaattggcttgggaacgggctcgacggttttttatctcgttgaagccattgcaaagcggattaaagaggagcatcttagtctgaatggtgtggccacaagcattcggacgcggaaacaggcggagtcgttggggatcccgatgaaagaactggacggggttgacaaaattgacctcaccattgacggtgccgatgaagtcgacaagcattttcagggtattaaaggcggcgggcgctcacatctgatcgaaaaaattgttgcgattaattcggcacgtaatatttggatcgtggacgaaaccaaactggtggacacacttggaaagtttccgttgccgctagaagtgattccgtttggtagtggcaagctgttacagcggttggcggatgaaggcctgaaaccagcttatcgtttgaatgaggatggcagcaaagctttgacggattctaagaattacattatcgatctgcatcttggccggatcgaacacccgcatttgttggcagaatggctcaataagcaggttgggattgtcgagcacggattgttccttgatctggttaaaacggtggttgtcggaacaacgcatggtccggaaattttggatgctcatcgtggatagaactcaaaaacggtatccccccaaaggtagataccgttttttgctacccaatttaacctttaaacgctacttataaaacctactgctgacgactttacgtaagaaactccatcttttcaacgattcacaccactgctggtattcatgattgcattgatgtctttgtcagtgacgagattcaaatcaccactaatagtcagcttgaggacgctggcggatatagcatagtcgatcattttttgcggattaaaatcttctatgaaaccatgaacaagacctgcgccaaaagcatccccagaggcgacaccctcaaaaacatgcatgttaaaaattggtccctgatatgccgcgtcattttgaacgagcagtccggtccattggctcttttcaactgagtagatgttacgaaccacactggcaactgtatgaacgtttggccagcgattgatgacttcgaacatgccacgtttaaaatcgtcaatctgatcaatcccagtggccatgttaccatcaaaagctttaattcctaatgttgcctcaaagtcttcatcgttggcgatacaaacattaatataaggcatgaccgttttgaaataggtttgtgctgtttcggctgtccacattttcccacggaagttcatgtcacagacgacggttatcttgtgattggcacagtagcgacatgcatcaagaatggcttgttgcagttctgatccgattgctggtgtaattccggaaaaataaaaataatcaacatcctgaagcagagatggccagtcaaactcagatgccttgacagtcgcaaaagcacttcccgcgcgatcgtaaacgacatttgtatttcggacactagtacccttttcaaagaagtaaattcctagacgattaccgccccaaagaattttggtcgtattgacgccaaagctacgaatagtattccgtgcagttgaacctaatggattgtcaggaagcttggtcaggtattgcacttgatcgccaagtaaagaaagcgatacagcagcattagcttctgcgccaccatagtttgcctcaaaattggatgcttgaaagatccgttgatggtcaactggtttgagcctaagcatcgtttctccaaaagttagaacagttggcattttttcatctcctagattgtttgatttgatcaacttttttgcgatatttaagagcagttgctgtgacttgatcaaagttaccatgggcagcggcttctacgagatttgaaccagcacccacaagcgtagcaccagcactaaaccaagcttccatattatcgagagagacgccgccagttggcatgatagcaagtgttggaaatgggcccttcaaagcttgaatcataggcagtccagctacactgcctgggaagattttaactaggtctacgccggcttcgagtgcctgctgaatttcagttggcgtgaagacacctggtgtataggggatagcataaagattacatatttttgcgacatccgggttgaaacttggacttacaatgaactttgcaccagcaaggatggctaaacgtgcagtgaccgcatcaagaacagtacctgcaccgatgacgatgcttttctgagagtcgtacttttcggtaagttctttgagtgccttatctgcatgagggattgtgaatgtaaactcaattccggtaatacctccggcgataacagcatcacaagttctgattgcagcttgcaggttttcaccccggataacggcaacgcagccggtgtttattaaccggcttagaaaggtgtatttttgcaaggggcctccttcttttttctataggataacaacgaaagctccgagatggacaatatgccgcctcggagctcgcgtaaattgtcagctttgtaatagagagtcaaacagtaaagtgatgatcagctaacaaggaaaccaccgtcaacagggatgatggcaccattaatgtaatttgcggcatcgcttgccagaaagactgcaatccccattaactcatagggttcaccccaatgtcccgcaggaatacgactaagaatatcatcattgcggttcttatcggcgcgcacaggtgctgtgttttccgtcttaatatagccgggtgcaatagcgttaatctgcacattataaggacccatttcggaagcaaacgcctttgttaagccggcaacaccatgcttacttgcagtataagagggaatatacttaccgccttggaacgagagcatggagccaatattgatgatttttcctgacttttgttgggcgaatacttttgaaacttctagagacaaatggtacacagcgctgagattaatcgcgataacctgatcccagtctttgtcttttgattctaataatggattacgccggatcatacccgcattgttgaccaaaatatcgatatggcccatctgctttagtgcttccttaacgactttttcagcacttcctggctcagttagattaacctccatgaacgcaaccttttgaccacgtttttcgattaaccgccgtgtgttatcccattctgctcggccaaaagttggaatgaaaatatccgctccggcttctgccattgcaacagcataaccttgacctaatcctgtatttccacccgtaataattgcgactttaccattaagattaaattgggtcatcttaaaatggtccagttcttcttcatgttgacgaatttcctcttcagtttggtgaatttcactcattttaagcactccttcaaaattgataacacttgattagcgtaattcattcattgctacttgatccatgtcatcgtatgtttgattctccccacacattgcccaaatgaaggcatagtttgtggttccaaccccacagtgaatggaccaacttgggttaacaacagcttgttcgttgaatagcgtaatatgccgtgtttcatccggcttgcccaaaaagtgaaagactcgcgtttctggatcggcaaaattgaaatacatatatgtttccatgcgtcttgcgtgcgtatgggccggcatcgtattccaagaagagccgggttctaatacggtatatcccatttgtaattgacaagtatccatttgcgaagcgtcaatatatttgtaaatagttcttttattgagatgttgctgatcgcccattggtttcgcaagtgcggtagcaaatggcagttttttattcggataggttttatgtgctggcgttgaaactacgtaaaacttcgcaggatggtcgcggtcttccgaagtaaagacaactttttgggttcccatgccaatgtagtaaccatcttggttggacatggcatccttccgtccgtcaattgtaattgcgccagcaccgccaatattgatgatccctaactcgcgccgttgaaggaagaaatccacacctaattctgttgataatttaatttcaagtggttcgtctgttggcatgacacctccgaaaatcattcgatcattgtacgtataagtgagtaggatatctccgggattgaagatcttttccatcaggaattcgtggcgcaacttggatgtgtcataatgctgaatatcttctggactatgtgcgtaacgtgtgaccatgctaaaactcaaaatgatccctccaatatttcttatatagaaacttgatttcctttatgctacgacaacaatataaaacgttttcaagaagaaggcaagcatcaaattgaaaaaattcaatttgatgcttgccttcttggcttaataaaagggctgttgaatttggcagccttgtcgataactattacctgagatagtgtggtgaaggaaaccgaatgtgcagtcaaataacagcgttaatggttaaatagcactttcgattgcatgttttgtatctaataacattctgacaaaggcggaacgtctttcctgaggcatacgatatttaggagcgctaatactaaacgcaccgtatagttgcccatcacgaacaattgacgccccgaggcagaagacctcctcttcgttttcttcattatcaacagaaacgcctaattctttaatcgagttaaggtccttttgaagcttagatggtgttgtgatcgtgtggggtgtcattgggaccatcttagtagacttgaaataactgtctaaagatttggacgaaaaggtggcaaggattgctttacccattgctgaggaataaaggttcatgcttccaccgatcgttgattgtagtttaatgctacgagggctttctagcttttcaaccaggatgatcttattgtttcgctcaatacctagattaatggtctcctcggttttgtcacgaaggtcctccaaaaaaggacgtgcaacattgacaatgttaaaagttgctagagctttctgcgcgtaaggtataaagtgtgttcctaaaaaataacgcttagagtcggtatcacgccagacaaagccaagcgtttcaagtgtgctcaggatttttaaggttgtcggttttggcgaatgtaaaccacgactgatatcagataaagttggtggatcatttgctgccaacagaaagtccaagatttccttggccttgattaagacggttccatatggtttagacgcttctttaccagtattcaaagtaaaacctccgattacagtgatttattatttagaaatttataatcattctaaacgctgcctgtcctagaaagcaataacatatttttaatacccaaggaaaaaatattgtgaatacgtttactttttcgttgacagcggaaagtgtgcacgctaatatacaagcgtaaggtaaagaaacaaagtttattataaagaaacaggaaaggagaaaacagggatattgctaatttcattgatctcagctaaatcgcgaatcgacagtgacttgcggtctgacgaatcagacgctgagctgattctggatcacttatatgtgaaaggagattatcttgagattgcttttgagccgcaaacgttaccttgtttcagatggattcaggttgatgcggctttgagtccttctctggtttattttacacaaactccttggcgttatcacattccgacaaattatttacgtgtgacagaaccggctcatgaaagcatctttccagaaatggcttttgccggtcgtgaacatgttataagaatttggcgacctgatgttgttgatttaaagggtgaacgcaacctagcgttaaactgtcatgatcaggcagctgatatgggcgcatttcctcatgccagtgccaacattgaaacgcgacatgatccaacgtttgcagctcgaaatgccattgatgggtatcggttgaatcatcatcacggaaaatttccctatcaatcgtggggaattaaccaagacccaaaggccagttttgaaattgactttgggcgcaatgtcaatctagatcacgcagttataacgctcagagctgattttccacatgatagttactggaaacaaggaactatgacgttttcggatggtagtcaaatggtgatccatttcagtaagacggataatcagcaaacctttacaatcaataaatcaaatatcagatcaattcgactttctgagttagtcaaagcagaggatgattcgccttttcctgcactaaccgaacttgaagtatatgggagcgaaacctttgaggagatgaagcattgagaatagaacccttaacagatgcgcagcgctttttcaacgctggattggtggataagcgcatgttaacaacagctttagataatgcaattaaacatctagatttaaacataaaagtaatgggtgaaaattttcctgaaccatctactattcataatcgttatgcgccaatgaaaaacattgaatggacaagcggtttttggacgggcatgttatggctggcatatgaatacactggcagtaatcattatcgagagctggcagaaaagaatgtcactagcttttctaaccgaattaatcagaagatagctgttgatcatcatgatctagggtttttgtactcgccttcagtcgtcagcgcttatcaattaacaggcagttcggtcgcaaaaagatctggcattaaagcagcagaccaattattgactcgcttcaatgaaaaaggcggctttattcaagcatgggggaaaaagggtgctaaggatgaaaaccggctgattattgatgctctactcaatattccgcttttgtactgggcaacacgcgttactcgtgatgttaagtatcaacagattggggatcgacactatcaaacggctttaaagacagtgtttcgatcagatggatctacttttcatacttatttcttcgatgacgacggtaatccgttgcgcggtgcgactcggcaaggctattcagatgattcggattgggcacgaggccaggcctgggcaatttatggaacggcgctgcattattatgacacgcatgacaagactacttttgacgtttttaaggccgttacaaacttttttcttaatcgtttgccggcggatcacgtaccatactgggaccttatctttcaggagggaagtgatcaaagtagggattcatcttccgcggcaattgctgtgtgtggtatgcatgaaatgttgaaatacatacctgagtccgacccggacaaaaacgtttatcgaatggcaatgcatgctcagctcaaatctttgattcaaaactatgctgcaccattagacggacaaacgggagagcctttgctgcttcatggtgtttactcttggcattccgggcacggtgtggatgaaggcaacctctggggcgattacttttatatggaagcgttgatcagattttataaagactggcaattatattggtagggggaactaaagatgacagaaccaaatattaaggcagtaaggcttgacgagcgactcattcacggtcaaggacgtctctggatttctaatcttggcgttaatttagtcatagttgctaatgacgaggtagctactagccacattcagcaacagttaatgtcgtcgttaatgccggaatcggtcggtatccgtttcttttcgctcgaagaaacggccaataaaattttcaaagcttcaccgaggcaaacgattttcattattgttaagaccgctcaggatgttttaacacttgcagaaaaaggtgtgccaatcacggaactaaatgtcggcaatattcatatgaaggaaggcaaaacgcgccttacgaattttatttctgtagatgctagtgatcttgaggctttgaagacactacacataaaatatcatgtcaatctaaacacgcgtacaacgccattaggtaacgatgttgggtccgattttgatttaaacgattatgtaactaagcattgaagtcaatgagaactgagggggaaagagcatgacctattctattttgcaagcgcttttggtaggcctttgggcagcgttctgctttgctggccaacaatgggggatttataccaatcgtgcattgttcatatcattcgggattggtttaattttgggtgacttacagacggccgttgtttttggtgcaaccgctgaattagcctttatgggatttggtgtaggacctggtggctcaacaccgcctaatcctttgggccctggtgttgttggaactatcatggcgatctcgattcaaggcttaaaaccagccgctgctttatcactttcgtatccgtttgcaattttaatcccattcgtcatcacattcatcttttctgtcaatgccaacaaccttgcttggtcacgaaaggctattgaagaaggcaagtatcgcaagtttcactttcttgccaacacgaccttgttagggtttattctgttcgctttctgttttggctttgctgctacgttaagcacaagtgcattgaaggtttttgttcaagcaattcctcagtggctgattagtggcttgactgttgcaggtggtctgcttcctgccgttggatttgcacttattatgagcacgatggtcaagaaggaatatattccggctttaatccttggttacgtttgtgttgcttacctgaagatgccggtaatcggattggcatttgcgggtgcggttctcgcctttaataattactataatggacatcgcgctaacaaaaaccaagaccaaggatcaaacacaaataatgacagtaacaacagtgacgatgggggtattgaagatggcatctagtcgaaaaccggttttaaccaaaaaagattacttaaattccattctccggtcctatgtgttacaaaacgctcaaaattacggcacgatgcagggaaccggaatggcaaatagcattatgccacaacttcggaaaatttataaagatgatgacgctgagtttaaacgagttacaacctcaaatttggaattttataacacaaatccacaaccttatccatttgtgaccagtattatgttggctatgtatgatagtggccaagatgaaaatgatgtacgagcgattaagttcgctttaatgggacccttggctggtattggagatgcactttctcagtttggattagcacctttgtttagttcaatctttgcatcgctggcgcttcaaggcatgacatgggcaccgattccgttcattctgtgtttgtttggtatcactttcggagtccggatgttgatgggctatctgggatggaaagtaggtaccagcattattgataccttatcagatcggatggctgccattgccgatgttgcaagcatgttagggttaacggttattgcaggcttgtcagtttcttttgtaaaggttaacttggcttggcaatatacacaggttattaagggaaagacacaagtagttgcagtccagacaattctcgacaagattatgccatttatgttgccgattgcgttgacatactttgtttattggttgattacaaagaaaaaatggactatctacaagattgttattctgctctttgttgcaggtgtcttactttcggttctgggaatcttaaagtagtttatgcatttttcagccgtcaattgtggacggctgttttagaaacgttgggtctagccaaatgaagatggaggatgttgaacaaatgaattatgcaatggcaattgtcgggcacggtcggtacccagagggggttctctcggcactgaaattattgattggaacgacagagggaatgactgcctttaacctagacgaaaacacaacccatgaacgatttgagcaatgcttgaatgacttccttaaagaaaataagcacgcaattatatttgcagatatgactgggggtgcaccgcatcagattgtctcccggctaatcattgagaaaaatcagccacatcaatatatcatttcaagtgcgcctttaaatttaatacttgatctatatgcaaagaatatgagtggatttgaggataatgcaattgaggagacactgcggcacactgtagaactctcaaagcagctgattgagattttgcctgacagaatgaagaccaattccacgaaggtaccgattccgaatgccgccccagatgaaggggatggtatttgatgactttgtggcaaatcgttctggcaatattagttgtcgtagtctttctgctgtatctcgttgcaattccacttgctaagcagcgtgccatgaaaaaacaggcagcaattgttgatcaaatgcatgctaatttaaagttaggtgatcagattgtgcttattgatggcatcgtgggcacaattaggggattggatcaagaaaacgtgcgcgttgaaattgctgtcaacaccatcattaatgttaaacgtatggggattgctggcgtgacaaaggaggccaaaacggatggcgaaaatgacttggaccacgtacattcaacagttgcgtcagcatcaacacctcactgatcatgcgcaaaaaaatgctgatcgattattgaagaatgtctatttatttgataacccctatgcaatggagcctacgcaaatcagctatacgatggatccgattcagtggcagaaaacgcccaatggtgatccggaatggctttatatgttgaaacgacaagaatatttgcttgatcttttagaagctttctatgaaaccggcgacatggtatatcagaagaaaatgaaggcgctgctctttagctggattgaagaaaacttggcatttcctgatacttggcggacgatcgacacaggaatacgattgttgaactggacccccgtgattgccaatcttctggagagtcagttactgactgcgaaggagcgggtgaacgttgaaagcgcggtgaatactcaagccgcctatttaaagcaaaactatacagaaaagtttgacatcagtaactgggggatcttgatcactacgggtattttaacctatgctgctcaatttccaaacgtgattgagtcagatattcttcattgggctcaaaagcggtttgaagtagaactggatcttcaagtagacgcccaaggcatgcagtgggagcagtcgccattatatttgcttgaagtttggcgaagttcacttgctgttattgcggcacagcagcgggcagacttatcagtgtcgccaatcgtattagccaaaacgaaagcgatgcacaacatgatggcgcagtatatcaaaccgaacttgaagttgttgcagcaaggggatactgatgcaattagaattgatagtttgtatcaagcttcagtagcaatcctgaaactgccatcagcattgtcgaaacaacttgatcctgtgtttgactttgggttgttagagttggctcatgagcaatggcaattaactactagtgaagcagttttacctaaacaattcgatgcaccaattagcggtaattacttttggcgctccggttgggataagcaagcagattattggcaccttttcaatggtaacttaggcagcgggcatggtcatgcagcactgggacatcttgatttaacgatcggtggtcaggatgtacttgttgatccgggtcgatacacatacgttgatggaaccgaacgccgttatttgaaaggggttaccgcacataacacagtgatgttggatcacaaagcgttcagcttaccgaaggattcatggaagtaccaatacgtctccaatcccatagctaatcaaagtgtgaaatttgctagaggacaggtagtcaaggcggtttttctcgaccagtcccaagaggattcggccataatcacacgttttctcatcggtttgagcgaagaaaggctgtggcttgctcttgacttaatcagttatccaggccaacactccctacagcgattttggcaaatatccccacaccttgaagtggcaagaaatggtgatgggtatattttgggagatagtgcccgttttactacaacagaaagccagattaggcaaagcaaacaacttttttcgccacgatataacgagcttcagcatttgacgcgactagaaagtgagaccctttttcaggatttcacagcccaagtagctgtattttcagccggagataaagtcgttaagattacgccagtctcagccaagcattctggtgaagttgaggaagaagttccacaaaagttggcattgggctttcgactggatttgggtgaaaaccgtgactacctaatcactttacaacccgaaaataccattctaggacgtaaactttactggtttgatggcactgaggcatacggaagtttgaacattttttcaagacagggtcacaaagttatcgaacattttcaattgttatagggcttgtgcctatggatagatttcggtggacttgataagtgatcataactcattcgacagaggaggaaagcacaacgaaaaaagcagtgagtctaaaacttcttgcactttgtctcttaatgattttgatagtcggttgccaaacgcaaaaggtcaaagcagcagatttaaaggtggctgacacgcctgtcccgacaagaatctatcagatgtttttgcaggatgagaaggccactactgtgaatcgttacatcaaacagtatcatgcaaattatgataagcatttttggaaaaccaagtataacggcaaaacgcctcaacaagcagcccaaaatgaagcattgaaaaagattaagcgttttgtgattgaagataaagctttggtgaaagcagggcttataaaaagaccgtttgcggagtttgaaagataccaaaaagaaaatcaagctggggcaaatctttcaggaatagctgcggcacaaaagcaacatcagggtttgatgctaaagcttgaatcacagtatgtgcaatcacatcgaaagtcggtaacaattaaccagaaaaaagatttttatgccaaatataaagcgaagtactggtcagttcccgcaatcgtgcattatgaagttttgacgttcgatcgggcaaaaattaaagatatcaaccaattttcggagaaggttcagcaaattaatggggaacatattgatctgaagagtattcaaaatgattttgaagaagctggattcaaaggtcagtataaccaaactgactcgctacatgatgataatcaatattacggcgtatattcacgcttggcttcggatcatagtaatgagctagatgtaattttcccagtctggatttctgaagaaaagatgggtcttttgcgaattttttcaacagaagatggtggatttcaaccattttctgacgtgcaagatgatgttgtaactaggcttttgaacgataagttgcgaagaaaaatttcaaagacagtgcaacaagtcaagattcatattgatcaagctgccttgtcgaaacaagcgttaggctgaacaggaggacgatgatgaagtgttggaagggtacaaagctatttctgttgatgatatttgtctgcggcttagcctttattcttaatgaccatccacagcaggtagtaaatgcaacggacatacgtacattttatgtttcaaatactggcgatgatcatagtgacgggttatcagctaaccatccttggcgatcactagacaaagtagaaagttcgacctttcagccaggagatcgcattttattcgatgctaacagcgtgtggaatggacaattaatcttggatggcgctaaaaatggtcaaggagcgactggaaatccaatcacaattggaagttacaatcaagggaataccggcaagaaagcgatcatcaacgggctggggacgacagccgataaaagttcgtatcatgagcgtaagttgagtaaccttaacctgatgaccggtacaattgagctttggaatgctaataattggacaatatcaaatctggaagtgacaaattcagctggtagcggtaagcgagatgctatgcgtatcggtattctggttgcttcggatatcagtacggcatatccacagggaaatgatagtcaaaccattcagaaaaagttggcaattttcaaagcatcccaccgaacagggataaccgtggataataattacgtccatgatgttgaaggtgcatatcaaagtgatccggttcctgacaatactggcaaaatggttccagccgggaaaaactctggggggatcatcattgtcggcaatactgatgcagtcgcaaagaataatgttgtaacggatgtttctaacgaaggactccgcaatgatgccaacgcctcggtacttccggggggatgggatcaatattcatttaaagccagcgcaaagattaatttccacaacaattatattcgcaatagtgccggggacggcatcgttattagttccagtgaaaatgggaccgctgaatacaatacggttcaagctgcaaacagtatgccaaactcaaaaaatgaagcaggcgtaagcaaaaattttgccggcttgtggtttatgggtggagaatataattttgctcaatataacgaagtgtttgacattccaaaccattacttagatggagcggcgtttgactttgatggctttgcatcaaagggtgtctatcaatataattactcgcacgacaattctggcggctttacattgttcatgggagatcatcaaaccgataatgtctttcgctacaacttaagtgtgaatgatgttaagaatgtaccttcgcctgctctgaaccatcttatctttgtcgtttccggcaaagcagacgggattgatggcttcccgttatttgccaacaatacatttatcgttggacaggatgttaagaatttaatgatatcaaataacggacaaacagggattcgatttgtaaacaatttagtctatgcgccaagcggcaatacgcctaaatttgttgtaaatcaggatggcactaagcagccactttttacagagggacgcttggatcacaacctcttttacccggaggctttgatggataatagtcacactggggaagttgatgcatcaaataatatcttttctgatccccagttaccaaatgtaggttccatgcctagtggggtgattcaacatggcgatggcagttttgattttagtaagttagcaggatttgtgccattggcgggatccccagcagcaggggctggtattaatgtcgatgcgttaataccgaatgatgtgaaagctaagtttccgattacacatgattttgctggaaagcctattaatacgaaccgaccaactattggcgcctttgaagcagcttcatctgttacgaacgttgataagggggcgttagaacgattgattgctcaggcgcttgatgtcaagcggactaatcgctatttgttggcggggacaacaaaaaagcacctgtttgatcaggcgcttaatactgcacaacaggtgttcaataatccttatgtaaatcaaaatcagattgatcattcagttgctgagctgcaaacgactatgaaaggtttagatgggaaagatgtaacaaagcatgcgccgacagaagtggtggtaaagaagcagtcggttgccggtgataagcgaataaagaagtcggatgaagaacagagattgcccaagactggtgaacaaacagcatcttttttaccgtctgttagtatcttggcagtaatgggaattgtttcagggagcctatactcgcgatttattaagacaaaatgaccgtattgaatcccccgtaatgaacattacctagtctgtcaggttaacatttacttcacacaagcaaaacccccgcagccttcacactgcgggggtttatttatgtattggtcagccggtgggaggccggctgacgatttctactttggaggagtaaaaatgaaaaagttgggttggggtttgtataggaatgagtgggtggctcatttctatgttgctaatactacagagcagatgtgacgaaattgtgacggtgatatggtatttgtgttattcatccaaggtgaaaacatgatggcatgctaaataggcttcatcgttggccttcagcttgatcagccactggcgccgatgatatccatgactggtttggcatttgtagggtggctgcggatagaactgcggcaactatttagcgtttctcttttaatgatttatgttatgtaacgcaacagcactgttgcataaagaacccccgggggagaagaaacgggtaaagcgcggttgagaggtcaccgataacggccagcaactattgctaattggcggtgaggctagtgataaccagtagcaagttggctgacggccgttaaaagagaaccgaatcaaccggtgccatcacgatgattatcttgatgtggccgcatcgttacgtaatggcaagtagacgcgttctacatgaagataaatcggtgaggacgggattttgacaacccccaaatgagattcgttgcgttttttaaagatcaaaagtgaactcactatcgctcaatgattaaatacgctttagtttcataaggccggagcgtgttttcagcatcgtcgtcatagttgctgatgagtagtttggctgaaggtgacagctttttggcgatattgcgagtcaacgtttggtcggtgaagttgctgatgacgagcagttcttgattggcggcctggcgctggtacatgtacacatcagggtcgtctgagtcgagtaaggtgtaagcgccgtaaacaatcagatcggggtattgtttacgcagccgaatgagtttttgataaaagaagaagaccgagtcggaatctgctagtgcagcggttgcgttaatgtccgggtagtttgggttcacggctagccaaggggtgcctgcggtgaagccggcttgcggcgcagttgaccattgcatcggggttcgagcgttatcgcgggaacgacggtgaattctttttaacatatcctctggcgcaagagcgtgttgctgttcaacaagttcatgccaagcgtttagggtgtcgagatcgcgataatcgtgaatggatggaaaggcaacgttggtcatgccaagctcttcaccttgatagatgtaaggcgtcccttccagaaaatgcaaggtggcggcgagcattttggcagagcgaacccgaaaagcctggcgatcgtctccgaaacgcgaaacagcgcgggcttgatcgtgattatcccaatacaaactgttccaagccttaccgtgtagtgcagtttgccaatcggataggacgcgttttagatcgattaactggggatgcttgagtgaccacttgccgaattgtggatcgttatcaaggccaacatgtttaaactggaagaccatttcaagctcgtggcgatcgaaaccagtatattgaagtgccaaggcgggggtaacgccgggtgcctcgccaactgtcataagatcgtgcttggacaaaactgccttgttcatcgcgcgtaagtactcgtgcacgtgcggaccattggcaattaagcccagcgagttgccgtttggctgttccaaaaggtgtggatcatcagcaaaaacttcaggctttgaaattagattgataacatccattcgaaaaccatcaatcccttgatcacaccaccacgtcatcatgtcaaaaacggccttgcgcacggcggggtttgtccaattcagatcaggctgtttgaccgcaaaaaggtgcagataatactggccgacttccggtacatacgtccaagcggagccgccaaaatccgcgcgccagttagtcggtgcatgaccatcaacaggatcgcgccaaatataccagtcatgatggggatccgtgcgactttgcatagccgcttggaaccaaggatgttcgtcagaggtatggttgacgaccagatccatcatcatcttcagaccgcgggcgtgggctgcttttaacagttgttggaaatcggtcatggtaccaaactccggcatgatttgttgataatccgcaatgtcgtatccgttgtcggcgttgggtgatttgtaaatcgggttgagccagataacatcagcgccgagttctttaatgtaatccaaatgctggatgataccttgcaaatcaccgataccatcgccgttactatcttgaaaactgcgggggtaaacctgataaaccactgcttcttgccaccaacttttgtgcatgggaaaagaacctccttgtgagtgagcatgggcctgaatctgagcatcgtggtgagaaccagtgcactgcagccaagctcctaacacactgatttttgcgcagacaaacagacgatgatcattagtttcagtataaagtttcaaaccatatgtgcagtaaaaatgctgtaaaggtttagttgttttgccaagcgtactgacgagccgaactataatgtttaaaaagcgccatgttatactttttctatgagctaacaaagtcgataaggcagcgtaacgccaacaattaagtgaggtttttaaacttgaaacagactagtgaaagcagacggcgtcaacgaccacctaagagaaagtggatggcgccgttagcagttttgatcctggggttggtcattatcggcggctatttttatattgcccaacaacaaacaaagcgtggactgactgaatcgcaacaaagcgcgatcaaaaaggtgacctcaaagcagcatgcaagtaaaagcagtgcggtcaagccaagtgatatgggggaaagtcgggggcgcagttctcagtcaacagctggtagtcaagattatgttgttgatgttgccaagcttttgcgggaacgttcaggggcggtttttacacgacaaggcgtgaatgcgccgactcggattgagttgcaagcggacccgcagacagcaaattatcgcctgaccattcagtatcaacatgcggatgccgtcacgatgaaagcgaccatccgcaatgttgcaactaaaacaatcaaggtcttcagtgctgacgctgcaggccaaacgcggaccgtcaaatgcaacaccgagattaaagtgggatcgttcaccgatgaagggagccattcgcaaaccgcagcgaacatgattggagataagttttatctgttttacaacgcacacggcaccgtctcattggtgacaccgaactatgcgggtaatgtggagacaaaggccgacgcggcgattatgaatgagtatgttcaggcatcggctgcggagtgatgttttaatacgttgggagtcaccatactttcaagcctcacataatcagtcatattgaaaaaatgttttactaacatcagaaatccggataaaacataccatccaaattaataacatatattgttataagtgtaagaaatctcttaaaaaaacaaccgaataatttaccgacacaacttcctttggtactttgacctaaggagcgccaggactgaatactagagataattcgcagtcaagttgcttattttcaaacttgttaaatagcaatgaacagtttctttcaacttgatcaaggtgctttttgaaaacagaaaggaaatgctcggggtgagaagattaacgattgaaacagaggagacactttataaagttggctttgtgagtgcattggcggtggttattgcgcttacgctttggtggacggtgtacagagatggtggtgtcgcctattatgcaaaagtacatgaaccacgcagccaattttcggtgacagttccggttaatctgcgccaaaaatgttacgtttatcgagcgttggcgaaagatgctgctgggcgcgggaagctacttgagtttaagacggatgagtatgatcccggccccttctctgacggacaaatactgcgcctgacttataatacgcgctatggtgtgactcattatgagcgagtttcgatcaatgaggttccgcttaaagccagagattaataaaacaaggaagactgaacacaataaagcaccaggaaactcagcgttggagttcctggtgctttattattttgtgcttgaattcaaaccacagctagggccaagggaaaagatcaattacttacccggtacatagtctttatcaataatcaaaaccggtttaatggtcttgccagagcgggagtcagcattggcttcgttgatctggtcgaattgatagaatttttcggttttatcaaagtcgaacataccttgcttatagaactcaattaggcgcggtacgtcaatttgtgggatggaatcgcccatgttgacgccgacgatcttcttgtcattgacgcagaggtcgttccaggtatcaacgtcaatatgatgtggcgtaaccgcgatcgttgcggtggtaccaccctgagccagcatctggatcgtatcttccatcactgccttgacgccggttgtgtcgacagcccagtcaaccccgaggccaccagtcaattttttaactgcggcaaccgggtcttcggttttgctattaacgacatcggttgcgccgagttctttggctaattcgagtcgggaatccacaatgtcaatcgcaatcactttggtgcatccggagatcttgcccgccatcattgcggctaatccaacggcgccagtaccggtaaccgcaatcgtatcaccaggctttggcttgagcgtattcaaaacggttccggaacctgtgacatagccgcagccaagcggtccaagcttgcgcaaatcaagatctttgtcaactttaaccgcattacgttcacgaacgaccgtggtagttgtgaaggagctttggtcgaacatgtctgcgaccggcttgccattttcagtgaagtgcgcggagccatctggccgggtaccggacaaattgttatgggcgtaattaagacactgggtcggaatacccttcaagcagttcttgcagttgccacaggcataaaagcttaaaacaacgtgatcgccaggtttgaactgggtgacttccgggccgactttttcaacaatccctgaaccttcatggcctagtacgatcgggtagccgataacggcatccccgatacgtaaggcttcgtcggaatggcaaataccactggcgaccatatggacttgaaggtcgtcaggacccatcggcgctagttcaacatcgtcccgaattttaaaatcagcacctttttcatcaacaacggctgctttgattttcattgcaatctctccttcacttgctcatcatttgattacacgttcattgtttcacaataaagaaaattatcaagcgccgtttacaaacatctaaggatatgtcccaatgtttaacttgactttttagtttcacggtgaaagcgcttaatgcttttgcggtgcaacggcaaagtgtgaaacaaaaacgaaacagatttacagaattgttaacggtgggttggtgtgatcaggagaaatgtaacccgtagtgtgcaaccgatcatctttaggcgtattgccgaatagcgcgtgatatttgtggtaaaagaagcttttattactgataccgacttcaagacagatctcgctaatgggcttcttggtgttctgaatcaagcggcgcgcattgatgagtcgttcttgcgtcagtgcttcggaaaaggtcttgccaacttcttttgagaacagattaccaaggtagtttttgttataagcgtatttattggctaaatcttcaagcgacaagtcccgataatgttcgtggatatcgttaagcaatttgaccgcaagcttttgcgatggcgaaggatccttgatggttggttgatgcccccgaatcagttccgctatcagaaccgttaactcggactgaatgatcgtatccgaaaacgcgcgcgggcggaaatattcttcaatgatgcgctcaagtgtgatttgaatgtcatgaaaaccattgcgaaacagaacataccgctgcttggttttttgcttacgtaaatgattaatcatgaaatcataaagcacactttgctgactttgaatctggttgaggaaatcgatagaaatattgcgatcgcgaaacaaaatgttgatcagcaaatcgttgtcgcctaacgcatcaatggaatgctcacttccaatatccagtagcagcacgtcgccttgtgacaggtggacgcgctgaccgttaaccgtttcatcagcgtgtccttgcaacatatagttcatctcaaagaactgatgggtgtgcaaaggataaggggcatatcgattatgtttgctgacataaatggcgtgattgcggaaaaaataatcgtttaaaaccgggacgttagccgtttttgattcccgcaagtcaatcgcggttggcggaatgtcatcgctaaaaacatgatgctctttctgctttttttcgacatcagtcaaactttgcaactgctttaaaattgctaattccatggcaccctcctgtgcttatgttccgatcataatatttatctgacattgtgaccataacatgtaagcggttaaatgtgaactgtaaacggtgacaaaaaatgaaatgtgcaggaggtaacacaatggcttcagagaaaagctcgttgaaatccaccattcgtgtttcaatcacgaattttctggattcaggcagtattgttgccggtgctagcggcttgacactgtggacgcagcattttggactcagcagttttcaagtcggcttattaggcgccttgtcagccaacgcatttggcgcagcgcttggtgctctcatcggtgggccactgtctgataagtttggtcgtaagttgatttacacctatgacatgttggtttatatggtgggcacgatcctggtcatgtttgcccttaacttcccaatgttactggcaggatttctcgtaactggcttagcagtcggcgccggtgttcctgcaagttggacttatatttccgaaacgtcacaagatgacaatcgagcaaagaatattggtgtatcacagtttgcatggtcattgggaccggcagttattttcattctcgggaccgttcttgcaccacttggtctgtttggtaaccggatattgttcggattgctgactgtgattgccttcattgcttggctcttgcaacgtggacttggtgaatcaaaagcatggcaggatcaaaaggcgtttgaaaagagctccggtgaaaagtcgcatccttatcgcaccttgttctcgaataaaacctcacttaaatggctatgcttcctagtcggtgtttacatgttctggaacttggtagccggcgcgatgggcttcttcatgccatatgtttatgaaactgctggcggtctgtccaatcaggaagccaacttactgcaggccgtgctttgggtcctcaccgccttggcaacatattttggatttgccaagtacggcgacaaagcgaaccatcgaattttcttcttcgttggcgccgcaatggccgcagcatcttggatcgtattgacctacgccggcatggctcagtcatggagcttatgggcgttcgtagcattgtggggaattagcgcaggaatcggtgcccaagcatggtatgcattatgggcaaccgaactcttcccgacccaattccgcgctggctcacaaggcgtgatgttcttcctggttcgtgccagtgccggtgtttggtccattattttcccggcaattctcaacagcctcggcttcaccgttgccggaactttcatgatcggactgctattagtatcacttgtcattggcacgatctggacgcctaagacgcgtggcaagagtcttgaagaaatcacccgcgaacaatatggggacaagttcttaactgacgatgaaaagagcaaagccgaccgcgacacagcagcaaaagacaccggcagcgagcgcgtttcaccgcagtcaattaattaaccaaacgaatggtgttaaagagaggtgcagcatatgaaagcatacgtagcagttgatatcggcgcatcaagcgggcggctcatgctgggtgcaattgtcgatggtcaactgaaactaactgaagttcatcgattcaaaaacggcttcaaaaacgaagcagggcatgatcggtggcaaatcgaccatatcattgatgaaattttcgccggcttggaaaaagtcaaaaagatgggctataccgcagtggacttaggaattgacacttgggccgttgactatgtccttgtcggtaatgatggcaagaaaatgcacgatcctgttagctatcgagatgcacgcacgaatcaggcagtacggcaactgacatctgagcttccaaaatcctacatttatgaaaaaaccggcatccaattccaggacttcaacacactttatcagctttacactgaagagcgcgatgatcttgctaaagccgataagattctgatgatcccagactacattggttatgtcctgaccggcaatgccgtcaccgaggtaaccaacgcctcaaccacgcaaatgctcaatctgcggcagggactttttgataaagatttactcaaagaagtcaatgttgcgcaagatcagttcccggcattggttgaatccggaacgccgcttggcaagatcagtcataaatggcatgtgaaatacgatattccggaaaccgatgtcattaccgtcgccacgcatgacactgcgagtgcggttgttggtacgccgggattcggcaatcattgggccttcttaagttccggtacctggtcgctgctaggggcggaactcaacactccggaaaatggtcaggatgccttcaaggaaaattacaccaatgaatggggcgcttatggtacctatcgctttttgaagaacatcatgggcttgtggattgtgcaatgtatcaaacgcgagctgaacgatcagtatagcttcaaagagttggcggaaatggctgacaaggtagcgccattccgcgtcttcattgatatcaatgacaagcggtttgaaaatcccgctaacatgattaaagaactacaggattatgtggctgaaaccggacaggccaagctggaaacgccaggtgaactgacgcgggcagtttatgaaaatttagctctttattatgccaacgagattcacaagctcagcaccattattgccgatccaattgatacgctgaacatcgtaggcggaggttcgaatgtaaccttaatgaaccaactgacagctgatctcgcaaatgtcaaagtggtcgcgggtccaagcgaggccacagcaattggtaatctgctcgttcagatgattacgaccggcgctgttaaagatgttgtcgccgggcgcaagctaattaaggcatcgtttgatttgaagacttatgaaccggattcatccgcttatccggatgtattcgctaaatataaggcatttatgaaaacagtcaaggttcagacagctaaggaggcggtttagtcgtgaagcgtattgggcaagtcatgtacgtttatcccgataaatacgaggaatatgagaaacggcatcgcgaactgtggccagaaatgaaagcagccctgaaggaatatggcgccactaattattctatctatctcaacaaggccaatggcgaattgtttgcctatctggaagtgccagatgttgctaagtacaacgaaattgccaatactgacatttgcaagaagtggtgggcgtatatggagccgcttatgaagaccaacccggataatagtccggtcgcagatgatctccatgaagtgttccacttggattgagtcgaagtttaaatgcggtaaccagtcacaatagatgattttaaataaaggagcgtttttcacatggttaaaccagaagaagtcgataaggcatatgaagtcgcaaaacagcgttacgcagaaatcggagttgataccgatgcagccatgaaggaattggaaaaagtacctttgtccgttcattgctggcaaggcgatgacattcatgggttcctattccctaaccaggaactaaccggcggcattggcgtttccggtaattatccggggattgcgcgcacaccggatgaattagccggagatatgcacgaagctttaagcctgattcccggcaagcatcgggttcagctgcacgccatctatgcggtaacggataagaagcgcgatcttgatacacttgagccagaagactttgattactggatcgactgggcaaagcaagaaggcgttggtctcgactttaacggcactttcttctcccatccaatggtaaaggataacatgacggtttcatcacccgatcccaaagtgcgtgacttctggatccgccacggcaagatcagtcgggaaatttccaactacattggcgaaaagttaggcagtcaggttgttaataacttctggttaccggatggctttaaggataacccaattgacaaaaagaccccacggctgcgcttgctcaaagccttggacgaaatcatcaaagatccgctgccagaaaagaacactatcgaatccttcgaaggcaaactgtttggtaccggaatcgaatcctacaccactggttcccacgagttctatcaaaactatgcgatcagtcgaaacaagttatggacaattgacgccggacacttccacccaactgaagatgtttccgacaagttcagcgccttcttcccatttggcaaagggctgttcatgcatgtttcccgtccggttcgttgggactctgaccacgttgtcatcatggacgatgcgctgattcggattacccggtcactggttcgggacggttatcttgatcgcacgcacatcggccttgacttctttgacgccaccatcaatcgggtcgcagcttgggtcgtaggtgcccgggccacccaaaagagcttgctgcaggcaatgctggcaccgattgaccaattgaagaaagacgaactcaatgccgacttcaccacccgcttaattgaaaccgaagaattgaagtcattcccattcggcgctgtttgggacaagttctgccaggatcacaacaccccggtcggcttcgactggatgaacaacattcaccagtatgaaaaagacgttcaattcaaacgcgatgccaagttggtccactaattcgtcaattctgaaaggaaaacgcctaatggataacaagaaacaatttttgaatcccgaatatacccagagctttgtcgagtcaccgtatgtggcacaaatgcgcaaagtcacctggaacctttatcaacatggctgggacgaacgcaatggcggtaatgtcagctaccggttaacggctgctgaaattgccccttatggcgatgtgcatgaagtcaagcgcaacttgccaattaagttcgatgccagtgaactggctggccagtattttctggtcaccggaaccgggcgctacttcaaaaatgtcaaggattttccggcccgcgacacgggcttagtgcaaattgctaaagacggccatagtgttgacctactatggggcttcaatgatggcggacaaccgaccagcgaatttccatcccatctgatgacccacattcaacggctaaagcaggatccaaatcagcgcgtggtgatgcactgccatcctaccaatctggttgccatgtcctttacgctgccgctggaagagaagctcttttcccgcattttgtggaagatgcaggctgaatccattgtggtcttccccgaaggcatcggcgtcttgccatatatgaccccaggcaccaacgaaatcggtcaggcaaccgcccaaaaaatggccgacttccgaatcgtcatgtggccgcaacacggaatcttcggcgctggcgattccattgatgaaacgtatggcttaattgaaactgttgaaaaagcggcgacaatctacaccgctattcaggctcaaggcggccgcatcatcaacgaaatcacggacgaaaatctggaacaactggccaaacggtttgacttaacgcctaatctagcttttcttcatggcgattcacttatcagtcaggtaacgctaaaagtgtaacgttatctgtacatggtaggatacctcctaaacacactctaaagagcccactgattgttgaaggcaattggtgggctttttgggttgtggatgaaagttggaggaaaggtgcttgttaaaagtgggcgggttgagaagtcactcaggtatcatccgagcaagatgtgtcacttgataatgaagatgataggtgcaaaaattaacttagtattgttcaacaagacaatagcagggttgcacggtccatagcaatgtcgctaaccgtttggagggaccttttatgaaaaagaaaccatcagtactggatcaattaccggaacttatcgcagatcccgagacaaccggacctgaattagaaattttgaaacatgcagaaattcgacgtcaaagaggcaataatgaagaaggaatagcctttgaaattagaacaaagcttcaacctttagcaattggacaaaaattgtcgcctaaagtagtggattttctgactgcaatttcagcgcgatacctagggatggggaaccgcgggaacatcatcttttaacgataacaaatagacgttagtaagcccaagttggttttactagcgtctattttgtttacagctatcaggtatgaataagacagcgagttgtttcagtcagccaaatgatgatgcgctttcggataagtgagttgaatatgatgatcatcaaacaaatttccgtattctggcgcgggttgcgtatcagttataatctcactgatttgatccatatttgtgatacgaatgtagtcactttgattgaatttggttgaatcgatgccaagaatgacgcattttgcagcatctatcatggcttctttaacggctgcttgctctgggtcagctacatagataccgtcagcatcgatcgagcctattgaaagcagggcaaagtcaggacgaaaactttgaatttcgtttatcgtcgttgcgcccaaagttgaagcagttcttggggccattttgccaccaagaataatcgtttcgacattgtttaatgaattaaattgcatccccatgtttacgttattggtaatgacgtgcaagccgacctgttcgtgtagaagctcgggcagactgaaaaaggtagaactaccatcgataaagaaagctgctttgctgggaatcttcgcggcaatttggcgactaatgacgcgtttaagacgtgcgttttcgttacgtcttttttcatacgtaaattccagattgtttccttgcagtaactgcaccgtaccgtagtgccgccggatgatattgctgttttcaagctcgataaggtcacgtctcagagtggacttactggtgaacatttgcttgcttagttgcgcaatactgatctctggtgtttcgcgtagaatctgaatgatttcattcagacgctcgaattttgctggactttgtgacattataaacgctccctcaattgaattttattgaaccgatttgaacaggatgagcggcattttgtgaacacttctcaaccttgatgaaaccttacaaatactatagacacgcgcatgaaagcgctttagcattgaaaatgaaataagttaaaagattcaaaaaggttcaaaacttttggtctaaatattcgattgaggtgagctagttatggattatagcacaatgattcacaaacagctgattttcttaaatgaaaatcagccagaccgtcagcatttatttcgagcggttgcagagaagcttcaagctgccggatatgtaaagaaaacctacgaggcagctttgaatcgccgcgaagacgaatttccaaccggcattgtctttcctgagatatccgtcatgttgccgcatgctgatcctgagcatgtcattaaaccgtttatggcgattgtaaagaacgctcagccggttcgggtgctgcagatgggctacaacgagccggaagatgcgactgccatgtttttcttgggtattacagattcgagtcagcaggtaggcctcttacagattttcatggatttactacaaaatcaggattttgtcgccaagtttaaagcgacaaatgaccgtgatgcgatgtatcaactttttgtcgatacatttgaagcacaaaccacagggaaataattaaaaaggagcgtaaagatcatggcaaaaattgttgttgcatgtggatcaggcgttgcatcaagtgaagcaactgccagccgaattaaggattttttcgaaagtcacaatgttaaaggcgtatcggttgatgctactgattttaagcagttaccggaagttctgcataattacgatgtctatgtttggattgcaaaaccgaatcaacaattagaggaactagccaaggaaaataatatcgcggttgtaaatggtatgccaatttttatgaatatgaatccggaaaagtcatataaacaaattattcaggcgctaaaaaacatgcaggctgccggaaagtagttgggtaaacggggacgctagatgtgtcagcgtgtggcggctcgtgctcactttttgaggaggtagaaaactgtgacgatcttaaaagatgtcgttaattatattttgaatcttgggggaccggtgtttgttccgttaatcatgctgattctaggtctggttgccgggttgaagtttaaaaaatcgattgtggcagcgttgactttaggggttgccttttcggggatgaccttggttgttaactacatgatggatgcaatttcaccggctgccaaagctatgtcaaagttgttccacctaagtttaaacgcgattgatgccggctggaccggtgttgcggccatcacatggtcatataaatcggcatttctgtttttcccgttattattagcgattaactttgtgatgttgacgtttaattggacgaaaacattaaacgtggatatgtggaacgtttggaacaagattttcacttatgtcgtggtgctttacttcacgcataatgctttctttggattcttggttgcagggattcagattgtgtttgagctcaaggcaggtgatatgtggcatcgacatattgaggatctgacaggtatgcctggggtaacagtgccgcattttattactttgtttgcggtgattcttcaaccgttaaataagttacttgatttcatcccgattatgaataaaccgtttgacgcggatgccttacaaaaacgtatcggtgtttggggtgacaacacggtgatgggtgcgttgatcggggtactgttaggatttggcgctggttattccgtctccggttcattgaatctggcaatcaaagccgcgactgccatgacgttgttcccgatgatttctaaactgtttatgacggcactgtcaccgattgccgatgcgatgagtggctttatgcagaaacacttcaagggtcgtgaagtttatatcggacttgattggccaatacttgctggccggaacgaattatgggtgactgttattatcttggttccaatcatgctcgtcttcgcaatgattttgccgcataatacggttttgccttttgccggcattattaacctatcgtttgtgaatgctgcgctgttgctgacaggggcaaacttattgcgaatgatcaccttgggcattatcacaacaccgattttcctctatggtgcgacttattttgcgccggtcattacgaacctggcgaagtcaaccggaaccgtcaaagttcaagcaggacaacagctttcgtggtcaacttttgagggacccgatttccgactcttctttgctcaagcatttaatggcaagtggtgggcgattgctttagcagttttatggacgttggggttcatttggctataccgtgatcagaataagatcaaattaccaagccaacgttacggcaccttgacgacgcctgctgtagcaacgacaagttcaacgtcaacagcagatagcgctgatgcagatgtcgatttagataatcttagcgggttggacttcagcgatgcaaaggcttcaaatgaaagcaaacagtcagctgctaaaaatgatgacgatttagacgatcttgacgggttggattttagtcagacaagtcataagaagaagggtgatcaaggtgagtaagaccttagcatcttttctggttttcattgataccatcggcgtttcaattgcgttgcttggcggcagtgttgggctttgcctcctgatgggcctcgttaccatcgtattgtatagcaaagttaatcccgttttgttcggtgattatgaccgcaagcgacgcgaacgaattaaccaacgtcgtaaagagttgttggctcaacgtgtaaaaaatggaggattttcaaaatgactgaacagtatgtatttgaaaatgagcgtaaggatttggcagaagtagcgcgcgaaatgtttgtgcgaaagaatacgaatgtcgctggtggcaatatcagcgttcgtattaccgcggataaagatattgattatggcagcattcatattaaggccggcaaagattatcttattatgacacctaccatgatgtcagaagcttggtatgcgaagttacaaccgacccaaattctggtggttgatcttgagactggcaaacagattgatggggttggccgtttgacccgggaaatcaatatgcatgaagaggcttatcgcgccaatgataagatccgttgcgtttaccattcacatgccgaagaatcaatgttttgggcaactgctggccttgatatgccaaatgttaccgaggtcactgaagaagtcggaccgattcgcgtattaccctatgcaccggcttgctcaaaagaacttgccgacactgtctataatgggctcaaagcggtgggcgatgctgcaaaggaacacattttcttgttaaatagccacggcgttttgattacgtcggaagatttgcatcatgcaaccgagattcttgagacggttgagtggaatgcaaaaattgcctatcagcaaacggtcttcatgaagctggggctgctcgatagttatcagtcttgcggtaaagcgagtgatgggatgttgaaagaacaggtacaagcctgaagctaacaacttgttggcataccatgcgcttacgataactgcttgcgctaagggattgcaaaagaactgagcagaacttaaaaatcaaagtttcggtatgtaagcgttttgtcaaaaaactcttgttatgtggtaatccccatcatttatgccaacctaaaatgcccacaaacattgtgcttgtgggcatttttcgttgcgttctttttgtgaaagcgttaaattttttgcttatttacctgtggtttcaccacgacgtcgccgcaacccaaagaaaatcgcgacatcaccaacgagggttaatagcaggaggaaaccaaacgcatgttgcgaaccgatggcagtgttgtgagcagaggttgaaccggcttgagccagcgccatgatgagtgagacgaccgcagtgccaagtgcaccggcgaattgttgtagggtgttgaagatggcattgccgtcagtggtttgttcttggtgtaactgagcttgtccgcttgtcataatgttgcccattgaaaaaccggtacctagcatgatgaaggcatagccgatcaagacgatgaccggggctgcggttaaggcttcaaggagtagccagacaattccgatgagctgtaagcatagtccgataaagatagggcgtccaggacctaatttatcgtatagtttaccactcatgggtgccatgcatgcgcccagtgccgccccaggtaatagaagtaggccggcggttagggagcttgtgtggttaacgagttgcaagtagttgggtaagacaaaggcaaacccgacattgacgatttgaatgatgaggaaggtcgtcatgtgcagatcaaacggaagatttttgaataaccgtaaattaattagtggttctttaacatgtagtgagcgcatggtgtaggcgccgaggcttaaaattgcaatgacggcaaagatcaaggcgcgtccgggttggtgctcgatgctattaagaccaagaatcgcggtcgcaaagaaaatcgcaatgaataaccaagctaaaaagtcgaggtgaagatggaccgtttcagagacttgctggatggaaaatagccccataatcaaagcggcaatcatgacgaatagcaggaaaataaagatcagatgccagttaatgtcaaccagcacgccaccataagtcgggcctaaagccggcgcaatggcggtgaccaacgtcccgatgcccatgagaaaaccaattttttctaacggcgcctgttccaaaatgatgttaaacattaaggggagtgcaatccccgtcccgcagccttggattagccgtcccacgagcaagattgcaaaactgtttgcaacgctgcacagtgctaacccaaggatgaagaaggcactggcggtaagaaaaagctgtttagtcgtgaagcgtcgttttaagaacccggaaatcgggacgatgattgcaacgatcaacaaatagccggttgtcagccattgaatggttcccgtatcgacattaaactgccgcattaaggtcggaaaagtgacattcatggcagtttcaatgagtaccccgcaaaacgccatcagaccagtggcgagaatcgaaaggtataatttaggtgttacttttcttgtcataaagacctccatcgtgtatagttctatatcgaactatagctactatagcggtcttattttctgaaatcaaggcttaattttaatgtaaacgctgacctgagatttcattgaaaccgaaaggggatagacatcgtgacagtatcgctgggtattttggttaaaaaattaaacaatgacctgcaacgttatgctgatcgtgaagctaagcaattgggtctaacacaggtgcaaatgagcatcatcgattttttggcacggcaaggcaccaagcggccgttgtatcagacggatgttgaacatgaattcaacatccagaaatcttcagcaacggcactgttacaactgatggagcgcaaggaattgattgttcgtgtgccctccaagcaagatgggcgatataaagcgattcagctaacggaaaaatcccaaaaggtagcggcatatattcggcatttctttgaccaaaatgatgcttttttgcgcaacgctttgggagaagatgcggaagtagtcgtcaatgcgcttgaaaaactgcaaacaacgatggcggataaattagcagatcattgagggaacatctttgaagacaccaactaacggccattaacgaattcccggatctggttgagcgattaggcaggtgattcatcgggaccgtaatagtgtggtcttgacgttgcaaatgtttgatgttttagccaagtcattaactcaggcgctagtttatggctgagatctaatgcagcctggatttgtactttgctgatgtgatcgatgtgcaacccagctaaaatggtgcagcttccgggcagtaatggttgcagcgctttggcacttggaagcgcaagtaaatcatctttatgaaatctgttatcatgactggggtagcggattgtttgaatgggttgatctttggttaacgtgagaacatcgccaatatgcgggtggtcgccgccagtaatggtaataagtagatcacgtccgatcacagtaacggtggcgatgagggtgacgtcagactgtgtcacggttgtcgtgtaagtcgggacagggtagtcagacattttatagcttcctttcggtggtgaataagttgaattttgaggatttaaaaatatttgtagcactgtatgagcttaagagtttttccaaagcagcggtggttttacatcttagtcaatcagccttgtctaagcgtattcagcatattgaggctattctgggaagtaagttggtggatactagcaatcatcgccgcatgcttgtcacggaggctggtgaacggtttttctttcacgccagtaagatcttgcaccaagtcgagctcatgaacacggatttaaatagtttgaagtccttgagcaacggtgttttgacgattggtgccgttccgattcttggtcagtttggcatcagtcgattaataaacgattttgccgctcaatttccgaagctggcactgcatgtggtcgaacaggaaggcattagcatcctcaagcagcttttgactggtgatttagatatggcattgctacgtgatacacaagcagaggtcctatcaacgcgggaatatgtcaaacttgatctggctaaagatgagttgcaagttattctcgctaagactaatccattagcgaaacgtccatcgctgtctgcaaaagatttagccgccacaacgattgtcagcttgctaagcggctctggtgtctttgagccgatgcaggcgttctttgcggatcgtcatatcgcacccaaaatcatctttagcagtccgcatatcgagacacttttggggatggtcgaaggcagccgccacgttacctttttgttccgtcaatcttaccagccgtttgccaattcgaactttgttgctaagtcattgacgccgaatatttgtagtcatttgcaactggtttatcgacgcactagcaatccggcaattcttaaatttgctgactacttgagccagcaagttaccgccgaaaaaggttaatggtaaccgtgattgtagaatcccaagacgatatttcgactgttgtgtagcagtaaggattttaacgatacagcagtagcccctaaagaaaaatcatttaggagctactttgcattgatattgacttttaacaagggtaccgctgttataaaagtccagtcagctggaaccaaaagacttctaccagcgcaacaataaacatgacggcagttagcggaatacctaacttcatgacatctttttgcgtataaccaccgccagtttctggatcggaaccgacaaggatagccaggttatgaaacggcaagatgtagtgcaaattaaccactgaaaagacgattaatgaaattgccaacggattaaccccaagtgacgaggttgccgcgataatggcagggattgtaatacccatgacggcaataaccgaacccatgaacatgtgaatgatcatcgcaaaaacggtaatgaccagtgccagtaagtagagattatgtggtaaggctgaaggcaggatcgtttgggcaatccatttattcatgcccgtaaaatcacccacttggccaattgcaattgccgaagtcaggaagaccaaaacgttgacgggaacacctgaccatgatttcgccgtcaagacctcaccgataaccggcagactcatcagcaaggcgacaatcaaagttaaccagccaacgtcaataccagtgatgccactggttaaccataaaccgatggcaatgacaagccagacgatcactcgaatttctttatgcgtcattgccccttgatcggcctgcttggctttcagaacatcaaggtcaatcgtgacttttttggttggtttgaagaggaaaagaaagagcagcatcgtgatgatcgcggcaatgatcatcggaacccccatgtaaataaaatattggacaaagttgacgcttttgccagaatcggcaattgctaaggggttgagcgatgtatccccggttagaaaagcaccggaaagaggacaggaagcggcaaaaacggctagtccaagtttagcccgatcctgttgtggcattttggcgctggttgccaccacatccatcacggacatgatcaagaaggcacggggccagggatgcggaatcagtaaagcaaggatgaaggttaaggcaaagattgagacgataataccggtccaactgcgaacaaatttgataatgaaagcataggcaatacgttcacctaggccagattcgcggacagcaccggcaattaaataagcgcccatcactaaccacataattgacttggtccacgatcccgcaaatacctgtgtcggggttgcaacattcgtcaagatcagcagcatcagataaataccaccaatataagccggctgtgcaatctggaatgcccaccaaacaacggtcattaaactcaaagcaagatccatttgcgctttttcattgatgccgctcagtggggccaggtaaacaatgaggcccaccgcaatgccgatgagaaaaccgatactctgtttattgagaacttttttcatcttaacgacgctccattccagcgactagcggtttcggttttaatatgcaaggcgtctaatagtttcatggtgtgatgctcaattaaatcctggatggtttggggatgctgatagaaagctggaataggcggaatgatttgaacgccaatgtgggctagtttagcgaggttatccagatgaattggactaagcggtgtttcccgcggcacaataatcaattgccgctgttctttaatcgtgacatcggctgctcgtccaatgagattatcatcaaagcccatcgcaatgcccgcaatggttttcatgcttgccggaacaatgaccattgcatcggttaaaaaactgccgcttgcaatggttgccccttggttttgaacaggataaacataatccgccaaagcttcgagttcgctttgtttcatgtcggtctcaagtgacaggttttgctttgcccaagcactcatcaccaaatgaacttcgacatcaggcaggcgatgtaaatgctggagcaggttaacagcgtaaatagttccggatgccccggtaatccctacgataatacgtttcaattcaatcacctatttcaaatatttttgccagtcggaaacttttttaaaggctgctcgtttgaattgatcgcgcatatcaaatggtacggtaccatcaatgaccgtcttcgaactcattccgcgtacccgaatagacttgggatcatattgcggtcgttctgacggatcaagcggatggttgcgcatgccaggtaataccatgatgtcctgatcaccttgaaaacgcgtgttcattgtccagacgacatcattcatgtcaaaaatatcgacatcatcatcgaccagccaaacagtttttagttctttgaatgccgaaaaagcgagtaatgcagcttgacgttgaatcccttcatcagctggattatctttgtgaatttgcatgatggtcatgagtttgccgccaccagctgggggattgtacacattcttgaccttgccggggatggcacgatcaacaagttgtaaaatgctggcttcggttggaatgccggccatggagacatgttcttcactaggtccgatgacactttgcataatgggatgatcgcgccgatgggttacagccgtcactttaatcacttgcaaagccggattggcatcaccgtcatagccgggaaactctggcatggctttgccggtatgggtattgatatcttcttggatacgcgtgttaggcatgatatagccttccagtgtaaattctgaacgcgcaatggctttttcattgacggtcacagcctgaaccagttgcacgggttcttggcgaatggctccggcaactcctagttcatcgtagccaagcggcgtggtaggcggttcaaaagtggcaccaatggtaatggccggatccaagccaatgttgatggtcaccggcatcggcttattggctttttcatattcttcagcaaaatgaccaatgtggcgaccaccgggcatgatataaataccaagcgtatccttatcttccaaaaccatgcgatgaatcgtcacatcagtcattgttttggccatattggaacccaaaactacgccgcatgtgatgtatgggccggcatcttgtggcgtattggttggtgctgcaacgagttttctaatgtcaaagtccgggtcactagccttggcaacgacttcatgcgcaggcgctgctgattcttcgactgtaacgggttgaataggatttaaaaccgctttgttcaagaatcgaccaagtgtgtgatagtcttggtgaaacatcttgccaacccgcttgcgactggccattaaaccgatcaaaacccttgtcgttgggaagccgacaacgttgttaaacatcattgccggaccttcctgtgtcggacgttcgaccgtcccaccggcaccgatgtaacgataaacgccagcaagctctgcatcgggatcgacttgcacctctgtttcatgatattgctgcggatcctgttttagttcatccaatacttttcttaagtcccaaggtgatgctgtcatattaatcactcctaaaggccggaacagcgaaccagccgaattgatttcaaaatctaggctagtctgggttggaaaccttttcaattcgagttttgaatgctgttatgcctgaatggaataagaaaaggacaatgacattttttaatagttgtgatcgttaatgacagctgacttgtaaatagtcaatatatgtaactcgaggctggtcaaaatgaatgagttgacaatagggaaaaactaaaagccggcttgatatatttcggctctctcctaaaaagaaaaataaaacccgcatagatagccatgcaggtttgcaaacagttattgagatgtgcaatgacttaccgataatgctaagcgctccaagaattaagcctaaaacggtgagtcacgttcagttcatttaaaaaacgcctgaaatcattgagatagcaggcgttttgacgttttgtatggcatcatgaacaagacaagaaagtgaatgacggttggcaaatccaacgtattgtgaggtggtcgcctatgcgtgatgatcaaaatctatacggaaggaggtgcctagttgtctgttgctgatgcgttgatgctgatgctggtcttcggtgatttcgtattatcgttgattgcgctgatcatcaccattatgctgataatacaagacaatcaaaaagaccgtcgctaatcttttggctaagatgacggtctttttgattagtcaaatttaatgccaaccgtcttgaacggtcttgtcaggggagtatcggtggacgccgatgctccctttcgtgttttattatagcatggtgccattgaagacggcaatattaagcgatcaaacggtaagtgctaaaaggacgggattttaatattgaacttaagcggttgattttcaaattgtacgaaccttaacctcattcaccagttcctgtatactgaagtgaaagcggacacaaagcaggaggtagacatggcagatagttacatcatggccattgatgaaggcacgaccagtacgcgcgcggttattttggatcatgctggcaagatggtgggcgaggcgcaaaaggagtttacccagtattttcctaaaccgggctgggtggagcacgatgcgaatgagatttgggaagcggtgttgtcgacgattgcggatacctttatttcgtctggggtgcagccgcggcaaattgcaggactcgggattacgaatcagcgtgaaacaacggtgatttgggataagacaacggggctgccgatttatcatgcgattgtgtggcagtcacggcagaccaatgcgttggcggaagcgttgcggcaggctggtcatggcaaaatgattcatgagaagaccggcttgctgattgacgcctatttttccgctacgaagattcgctggattttggatcatgttccgggagcccaagagcgcgcggaaaatggcgagttgctgtttggcacgattgatacgtggctgagttggaagttatcaggcggcgcgattcatgtgacggactacacgaatgccagtcgaacaatgttattcaacattcatacgttggattgggatgacgagattttgcagttgctgcatattccgcgggccatgttgcctgaggtgcgcagtaattcggaaatttacggtactggcgcggcttatcatttcttcggcagcacggttccgattgcagggatggccggtgaccagcaaagcgccttgtttggccagttagcgttggcgccggggatggtgaagaatacatatggtactggctcgtttattgtgatgaatacaggcgataagccgaaaatgtctgctaataacttgttgacgacgattgcatatggcgtgaacgggcagattaattatgctctggaaggctcggtgtttgtcgcgggctcggcgattcagtggctgcgcgatcaaatggggttggtggcgcaatcgcctgacacccagcaagcagccgaggcagccactagtgatgatgaggtttatgtggtgcctgcgtttacaggcttaggggcaccgtattgggatgccgaagcacgcggggcagtttttggcttgacccgcgggaccactaaagacgactttattaaagcgacgttgcaggctttggcttatcaaacgcgtgatgtggttgataccatgtacaaggacacgcagattgccgtcccagccttacgcgttgacggtggggcagctcgcaatgattacctgatgcagtttcaggcggatatcctgaataagcctttggaacgagccgccaatttagagacgaccgccatgggtgctgcctttttagcggggttggcagtcggcttctggcaggatacggatgaacttaaacagattttcaagattggtaagcggtttgaacctcgcatgacaccggcgcggcgggagaatttatacgccggttggcaacaggctgtcgccgccacgcagatgttcaagcaccggccgttaccacggacatccactgccaataacgaataagcagaaaaaagcaatccctcgtcgtataggccaaagggattgctttttacataccgaagatttaatttttctgtccccgttttcgcaccacataactatccagcaaaatgcggctcataacttgtaacggcagacgcgaagccacctcgtatttgtcaaaataggcggcttttgatttatagccgacaaaaagttcatccgcgtacttgacgattgaagcttgggcgttggtcgtcaggatgatttgcggaatgtcgcgggcggcaagggttttggcagcggcgacgagttccggggtttcgccgtttaaggtgatcgtgatggccactgcatgcggactgatctgaccggcgatggtttggatgatgttgggatcactgaagaattcagcatacttgcccagcaactggagcttcaaagtgacttccgaggcgattgattcggataggccgcgcgcaaaaatgaggatgatctcggccttggcgagtagttgaaccgagtcctcaatgacagaaactttcagattatcaagggtgttataaacctcaatttgattttgcataatcacttttttaatttgatcatccacctgatcgaggatgccgaatggttcagtgtcgccaatgcgttttagcaaatcatgccgaaattcggtgtagccgttgaagccttttttcttcatcgtgcgcacaatggttgccggtgagacgttggccgcgacgcttaactgggtgatggataagttgacgacggtttgttggtgattctcgatgtaatcccaaagataagcctctgtgggactgagtgtagccatgagggtggcctccttgtttagtggggttgatgcagatgaaaagcattttcgcttaatccggaaaacgactgaaaacagaaaactcttttcggttgaaagcggttaacatggtgataagtaaaagaaacgacatgaaggagcgcttaatgtgatttataccttgacgttaaatccagcaattgatctttttattaaaactcagaccatggcgccgaatacggtgaatcgaacggacagttatgacattcaggcaaatggtaaaggcgtgaatgtgagctgcatcttgaagcggcgcggggttgataacgttgcgcttggggttggcggcggctttacccttgattacattgcggattttctgactgagcaaggcattcgcaatcacttttacaaggatgccgggttcacgcggattaacgtgtttacccgcgttgtcagtgatcataacgagtataagttagtgaaccccgggccggagattagcgccgaaacattaaaacaattataccaacaactgaccactcttggggctgacgattggctttgtgtttccgggagttttgcacgcggcattgagccgagctttttgttgcaactgggaaaactgagccgggaaaatggctttgcgttgattatcgacagttcgtatccggaagctgttaaagccttggcctatcaaccattactggtgaagccgaatgatgcggagttgatgagttggtttaaccaatccggagaagccgacttggcgacgatggtgaagttgggccacaaagcgttagcggctggggcccaaaatgtgttggtttcactcggtgcggcgggagccttgtttatgaatcaggatgtgacgctggtcggaaacgcgccaaagattgacgtgttgaatactgccggtgccggtgacacgatgctggggacctttttagcgggcctttatcaaaagcaggatctagcggacacgctgaaattggcgattgcggcgggcagtgatacggcccggcgcgcatggattacggattttactgagacggatgaattgttgacgcaaattgagattaagaaactggagggttagctgatggcaaagtatgatttaattgctgcgaccggttgtgcgacggggattgcccatacttatatggcacaagaggcgttagagcaagcggctaagaaaatgggtttgaccattaaagtcgagacgcacggtcaaaccggtgtcgatgatccactgacgcaaggagaaattgatggggcaaaaggcgttgtcattgcttctgatattgacgttgacgcggatcgttttgccggcaagccgctggttaatgtgccggttgcggccggtattcgcgaaccggataaactgattaaagaggcgttgagcagcgcaccggtttatatgcctaaaggcggtgcggccaaggctagcgcggatgaaaacgttgaaaccagtacagccggaattggtaacaagatttacaccagtttaatgaacggggtttcgcacatgctgccgctggtggttgccggtggtgtattgatcgcaatttcatttttctggggcatttattcggcggatcctaagaatgctgaatacaatcagttcgcagccatgttgaattcggttggtagtgcagccatgggactcatggtgccagtgctggcggcctatatcggggaagccgtagccaaacgttctggcttaatcgtcggcatggcggttgggatgattgcttacaatggcggtcaaggatctggctttcttggcgcgattgtcggtggttacatggccggactggtcattttaatgttgcaaaaagtgttcgccttcatgcccgacaaggaatttcggggattaaaagctatttttctatatccggtactgggtgtcttcattgccggatcgattatgtatctcatcaataccccgatgaaagccttgaatctcggtttaatggcgtggttaaaagggcttgaaagttccagtccgattattttaggcattgttgtcggtgtcatgtgtgcggctgactttggtggaccaattaataaggcggcgtatctcactgggacggcattgttggctcagggcaattatttcttcatggccggcgtttcagcagcctgcattgcgccgccactggctaccacaatctcggtattactcaatcccaaagcctacaatcgtgatgaacgcagcgctgggtatgtcaatgctttgctgggttcaacccatattacagaaggggcgattccgttcgccgcgaaaaatccgttaatgaatattccggcgttcatggttggctccgcgattgctgccgttttaacgtatatgtcccggaaccgatgcatggcgtaacagcctagaccactatcaagaattcgttatcatcgttgcacttgacttgaaaattgagggcgcgtatttatccatataatgacgataaaaagttgttcgactgatttttgctgcagaacagatcttatttattgtgattgtttcaaaaggctcagcagccagtactttgaaaaaagcctgctggatggtttgatccgtttcctgaaatttactcatcaagatcaccttcttttttagcgtgaccttttttggcccaactttcaagttaaagtaacattcctgcccattttgatacttctttttcttaatataggccactagactaagggcattaatacttggaaacataataagtttatttattaaggagatcgttcagatgtcaaaaaagaaaacaatttgtttctatgctatgaccgcgattttgtttgccttgatttttatagtcgcagttttcttgagggtcaagacttttgaatatatcatcctgcttatcctgattgccggtttaatttatctgaaacaatcacaacgaatagtacggctttggcaaatctctttaatctccatcggtttgttcttcattgcctgtctaacaaccgctttgactcggccaaatctaaaggtttcattgtctggcaatcttattaataacgcttttcagatgattaatcgccactatgagtcacaacatggcgagtcgtttatcattaaaaaaatggagacaccatctaattaccacttccaggattggcaaccacctaagacctatcgaaatcaagaagttcatctcaagcatgcacgtgcttacttactttcaaaaaagcagcccgatgcatcaaaaaaagtcgtttatcaaattcacggtggtggttatctaagcggctttagtaacacttataaccaagccgctctgcgttactcacaatcggatcatcacgcgaccgttttttcattagattatcgcactgcgccaaagtatcggttccctgcagcattgaacgatgccattgacggctatcgttggttgctgcagcacggctatcagcctcaaaacattataattgctggtgactcttcaggtgccggtctttcacttgcattaaccctatacctccgtgatcataagcttgcattacctcgagcactcgttttggcctcgccttggactgatttaaccgcaagtggcagctcgtatcatacgaaagttaccagcgatcctttatttggttcatcgacaatcaagactgctcctaaatatccggttcccattacttacgccggttcacacaatttgaaagacccttatttatcacctgcttttgggaactttaagggccttcctcccatgctcatccaaacgggtagtcatgagctgctactgagtgacagtacgacagtcgtcaaaaaagcgcgcgctgctcatgttcaggttaagtttgtcgaatttagtggtatgtaccatattttctatatttccaccccacaaattccagaggctcagcgcgcttggcaaaacattacttcctttattgctaagcattcatgaccgttacgctgtataaccagaaaacgtatcaaacgctaaaaaagcgcaaataaaccctgccacctacaatccaactacagtatgttcaaaataaggctattgatggcatcagtttaatcgtccacatttcagtttacgttgggggcaatggtatgtatctttcagacaaaacccacttcagcaaactgctttcattcaccgtgcttctcctcattttggtcctatgaaactgcttgcgtttgcgcggatttttggaatctgctatcgtcatcagtgacctgatactgcatcagattaattgatagaaacgaaggcaaccttatgacgaattcacctgtttcacaccgtacgcaattagccattttatctgccggcttgctgacttttgtcggtattctggtggaaacttctatgaacgtcacttttccaaccttgatcaaaaccctccatgtatcgttatcaaccgttcagtggctgacctcaggctatcttctgatggtaacgctggtcatgagtaccaccgctttcttattgcggcgcttcaacacgcgtttattattccgggcagccatttgctgtgcgctcgcggggacgctgctgtgtatctgggcaccgaattttccgattctgtttgctggtcggctgctgcaggcacttgctaccggggtttccacgccgttaatgttccaccttatcctgaccacgattcctcaagcacatcttggcatttatgtcggcatggccagcgtggtcacctcgctggcaccggctttgggcccgacatatggcggtttgctaacttactacgcgtcatggcggatgattttctggcttgtcatgcccatcatcttacttgtctggttcatgggtgaagcaacgattcgggtcaaagcacactcaacctctgatcgcttcgatttcctcggattcctcttgctggcgctgggtctcttttcactgatcgaagtgctggatcagttcacggcggccggtgtgaccggtgccttctgggcctatgtcatcgcgcttataattgccatcatcgggatgggccgccacttaaaacacacccattcgccattgcttaatttttcgctattcaaaaatgccggcattcgtgcccgcgcgattaacttcttcatcctgcaattcagcaacatcggtattgcatttgtcatcccgatctttgccgaaaatgtcttgcataccaacgcttcagtggctggcttgttactactgcccggttcactgatcggggccgcggtttcaccgattggcggtgcgctttacgatcgttttggcgcccgccgcttgctactcaccagtaatgccgcaatgtttgtcggcgccgttttacttggcagcttcactcaccagttgaacattcccttaattgtcggtttttatatcatcttccgagcgggcttcaatctgggctttggcaacaccatgtccgacgccagcactatggtatccggatcagctaaagcagacattaacgctttgttcaacacccttcagcaatacgccggatcactgggaacagccagcttgtcagccatcatcacgtttcaaaatcgcctatcaccatctggcgccgatgcaaccggcagtcaaattgacttcatgctgctcgcggtactcgccgtgttaacgtttatggttcaatggcggttacacgcttcaaaatgatatcacccgaatgtttggctaaagttattcatatgtacttatgaaacgcatgccatgtaaatcatggattgcgtttttttaatgtcaaaaaaatagatcctttgaggcaaactccctctaggatcttatttttatccgcgtactaatttatatgcttgttgctagcaaggttatcgcctcgtttacacactaacgttaggcttaacccggcaattctgctaaattttctgttgaacctcatcaacgtgaacaatcagcaggcgggttagccagggaaacttttccttcttggctgcaaacgccgggccttgatcgacaaatcggccagtaccaaacacatggaaaccggcgccgggtccaactgttccttcaacttccttggaaccaaacgttaaaagaacatggttatccttagcaaagtcgccttcgatactgtgcataccggctgcaggaatatagagttcatcgtctttgcggctgacataagacatccaggtattgaccacgtgagccgggttgccgttgatggtaacaatcgtaacaggaccttcgtgcttcaacacttcgaggaacttttcattcatcgtctgatcttctttcttttcattcttgatacgaatgcggacgctgctcataggtcgcgcccacgcacgtttctattggcaggataacataaaaaattatgtctaagtatgctcttttttgtgcgatcttgcctttgactctgcctcgagtcccatcattttgtgctataactgaccatcaactaacacgtgtatcgtcaataagctggtactgcttcaaaaactttttctttgaaaccacccgatgattggtgatatctaagtaatcacctggatagcccatgacatacatgccatacccggcaaagccgccgccgatcgtgccgacagctcctatctttaaattagtgtccagcgatggcttcagaccactcatcaaaatccgcagatgattatccaaccaatacaagtaattcgcttcaaacgcttcacgaacccaatctggctggggcgttgttttgcctatttcccaaatatcagcaggttcacctttgtataaagccttcatcattctcacctcatgactttcgaatgttgactgagagcttttatttctgcctctgctagcaacgctatttaacgctctcaaatatagactacgcaacaatgaacattttcccctttataatacccgcaaaccggcacgcggtgtcatctaacaaataaacgtcgggttttggccgattaacgtcattttagcgattaatgttgctactctttgccaccatcacttcctaaaaacgcctgaaaagcggactcaaaccgtctcattttccagacatttttcaacgtgttgatcatgattaaaatagattcttcaagcaacggtatttatagaatcggcgccactccatcaaaggtataactgccatcgatgaccgtcaccttgacgtgatgagtcccggccgccaagtcggtcaccaccgtattcggttgcttggccaacgcagtcaacggcaccacttcctgtatccgcccgtcaacggccagctgcaagcgacttgcgtgtgcttgcatcccaaagagcacaaaaccggttccttcaacatcaaagtcaacggtagcgcctttttcgccaattgactgcgagcgttcccacgcatgcggaaaacgtgcagcaaggcgttcccactgatcattactaaacgttaggctggcatctaagtcatcgcggcgatgtcctaataccgctggtgctgacgtactcgtgaccgtcaaagcctgaatcaccgtcttgaaatagccggtgccgactttgacttgccccgccaaacccggttgatcacttggatcgtcataagttacataagtctggccatcgacttgcaccgtcacatggcgatctgttgcttcaacaataagttcgtgactcactttggcatcgaaaaccggcacatcaagtgtggctgccaaaacaccgcgaacataaaagcgtaactttccgccaattgtcagcgtagccacatatggcgccgagaataaactgccttcaaaatcgtccacactccgcacgccaaggccaatatagttggcactgacagtattttgccgggttgtcgtgtcaaacgtaaacttcaacgcagccgcatagtttaaccaacgaatatcgccaacggtaaagttcggatcggtttgcgtttcccaagccaatgcccgcgactgctcggtaatcttttgttgtaacccgcgtttaccgtcctgctcaactacttcaaacgcgccatccatgtcggttgtatatttcggggtgccgccacggcgcgtgagataatcagccggcatatcggcataggtgtaatcatcgtggaaaagaacgtgattttccggatcctgttgcagtggctgatcaggcttaacatcaggattaggtaataaggcttgtggctggaaatccgcggtggttgcactgatgatcgcccgcggttcaatcgtgaccgttacatttccattgaccggcgtcagcgtggttgtcttttcgcgatcgtgaattttaccggctttatcggcccaagtctgccatacgtgtagcggtttggtcgcagcagccagattcttaaccgcaatctgataggtttggggggcactggtgtcgtttattagcaccaccgtgtaatccgcttcatccggggcaactaaagtcatggcactggcagctccaaacgcctgcgtcagattttcagtacccgccacttcacttaccgtggcactcggaacataccgccagttttttgcggctgtttgatcgcgccatcccgtcacggcaaaatcggtgaagtgatgcatgaccgccaaagccaccgtatcttgctgaaagtaacccgaccacggcgtatccatttcaagtaattgctttcccggatattttgcgccgggatataagccgccaatcgctggttgaaaaatgtataaacttcggcgcgagcgggcataacttttaactaggcgattggcaacatccaaagcactcataggaccgcctatgccaatgccagttgtatcctgcgtcctaagcgtgccgaatgtgaccggcgcaatgccttcactgtaccagacttccttatgcagctgatcggcaatcttcgtaaatggtttgtccggaccgtcatcggtgttgtaatggtagccaactgccggaatcaccgcttgtaactcaggatcgttaagcaatgctgtccccatatcggttccataattttgatctgacgttatcaacttaattgcatgataatctgctactggaaaaccttcagggaaatcagcttgatcggttttcagccggttagcaaaccatttaagatagcgatacatcgggtgtttggtctcgttacggtcgggatcaatgtaatcaaaaagataaccatatgcctgccaagccgcaatcaccgtttgcttgtaatactgatacatggcttcaaaagcttctgtcggcaccttttcatcaggatcatcggacttcacctggcgccaacttggccgtaaaaatccaggctctgcccagcgtaacatgcaggttttcaagtccggctgaatctttttggcatcagcaatgagctgaaaccccatgccccgtgccacattagccggttcgtccgcagcgcgctgaggagccggttcggtgccgcatgatgtattcgagtcgctgccaagttctacttttagcatgcgcattaaagggtgttgtccgccgaataagtgttgcagcacttgctgatagacttgggggtgttcccacttatagtccattaataaccttgatgtattgttgcagcttagaagtccaaaccctttaattgtgttggcttcgttttgctctaactgcaactgactaccatcaatcgtcaacgtatgcatgttattgcatcctcactttcttattgcccgactaacgatcaacaccgctgccggttgccatgaccgcctgcacgtctgcatccgtaatcaaattcagatcgccgctgatcgtcaatttcaacacactggccgaaattgcataattaatcttggcctgcgcatcaaagtcatgcagagtggcgtgcatcaaacctgccccaaacgcatcacctgacgccacgccttccatcacatgcatatggaaagttggcccttggtatgttttgccatcttcagccaaaagtcctgtccaccagctatcttcaaccgagtggatattccgcacaacactggccacggttttaacattcggccactgcttcatcacctgcaacatgccggctttgaaactatcgatctgatcaatcccggtcgccatattaccatcaaatgctttaatgcctaaggttgcttcaaaatcttcatcattagccaaaacaatcgtgatataaggcataaccttggcaaagaatgcctgagcttctgcaggcgaccacattttaccgcgataattcatgtcgcaaacaacggtaatatcatgtgcggcacagtatttaacggctgattcaatggcggtctgcatatgtttgccgatcgccggggtaattccggaaaaataaaaataggccacgtctttaagcagactggcccaatcaaattcatcagcttcagcggtcgcaaaagaactgccggcacgatcgtacacgacattcgtgttgcgcacactggcccctttttcaaagaaataaatccctaaacgcggcccaccgcgcaagatcttatgtgtatctacgcccagaccacgaatagtgttgcgcgcagtgtcgcctaatgcattatcaggcagcttggtgacatactgcgcctcgtcgccaagcaatgccaaagaaaccgccacattagcttcagagccaccataattagcctcgaagccagacgcttgaagaatacgttgatgatcatacggctttaaccgtagcatcatctcgccgaatgttaatacttttgtcatctgtaagccttcctttcgttgggcacgatcgcgcttacagtgaacaaaatctgacaacagcgtcaccttagtcaggctgatggcttggcgctgcttttccttcaaaatagttaggataggcacttaaaactgccttaacatcgtcatcaatcgctaacaaatgatccgcaaccaaatgactggctaactcagcatctttagccttgactgcatcgacaattgcctgatgttccgtgataatgttatgccatttcaagccgctaacttccaaccgtaagtatcggtagcgattaaattgcaaattcatttgctgtacccaagcccagacaaactgcttatgatcggccatataaaatatttcatgaaagtcgtgatcaagatcaaaaaaatgatcgtaatcccgagaatgctcataaacaccctgcaacgcaatttgctgttccaatttagcaatttgatctggcgtcatgacatcaactgcgtccgccacaatcgtcctttccaaattgacccgggcaaaccggccttgatacatttcatccagattgatctttgatacataagtaccgctttgaggaatgacattaaatagtccttcccgccgtaagcggataatggcctcccggatcggggtcgcaccgatcttgagttgcgcgctcaattcagtcttgtcgactttttccccgggggtcagctgcatgctgagaatcatctccttgatagcgttatatgcttcatcttgataattcgatatttgcatgggcgtcacccttccttctttttcacctgattaactgattgtataacatccccagcctttcgagaaagatgctgcttgagacgtttaaattataaaactttttgataggtgttgacaccgttttcggtaagcgctatcatgcccttgtaaggatatactaatatatcagttagccgagtgtcaatgttttcgcgcgtttagtttaaaaaatacgcctttaacattaactgactggttgtatatctaccattaaggtcacaactggttgcagtttgtgaccaatcaggttttaagtggcataagctgattggcaaggaggcgggtgtgtcaaaattcaggttccggcatttatgcatttgttttacctatttatttttaaatgcacttacttaatttcatgggagtgaaaaaaatggcaaatgatgttaagaacgatcctaaagcggtcaaaacgacggttggggttgttaccaacgcaaagattcaagattcacagcagccaaagatgccacttggtgttgcaaccgcaatgttcctcgcgccactttgctggtacgggccaatcggttcaacccgaagcgttttaattccacaactatttagtcaaattgattcggcacacaaggtttgggctgtcggcattctggcaaccgttgcgtctatcaccggtgcgattgccaacttattgtttggtgctttttctgatgtgacgcgaacccgttttggtaagcggaaaccttatattgtccttggtaccatagcaatcgcgctttcactggtcgccattgctaatacgacttcaattactgctatcatctttatctggatcatcgcggcggcggccgaaaacgcgattgccgcagcgatttatccgcaaatatcggatcgggttgcacctaaatggcgtggcactgtttcaaccttttacggcgttggtttcacgatcgcgcaacaaggttttgctctgttagccgctcaattccttggcaatgttaaattcggtatttatgtcatggcaagcatgaccgttgtgttggccattatccacgttctgttgatcaacgaaaagagcaacctggacgaaccaaagatcaagctcgacaaagaatcactcaagaagtacttcttcttcccaacccatgatgcgcgcgacttttatctcgccttgtcaggtaagttcctgatggttgtcggttctacgattgttaccacattccttttgttcatcttcaccgactatattggccaaagcaccaaacaagctggcggttccatctctgtattttcaaccatcatgttagtcattggtgtcttcttcgctttagttggcggtccacttgccgataaaatgaagcgggttaagggtccggttgttatcgcaacattcgccttagccgtagctgctttgttcccattgtttgtcaaagaagcttgggcaatgtttgcctacgctgttatcgctgcttttggtaatggcttgtacaactcagtcgatggcgcgttgaacatggatgtgctgccatcttctgatactgctggtaaagacttaggactgatcaacttagcaaacacgttgggccagatgcttggtgcgatggttgcttctgctattgttgaaggcttcggttatcaggcagtcttcatcttcgcggttgcaatggaaatcatcggtggcttcttgattgccgccatcaaacgtgttcgttaatttgttgaaattatatttgtcacttgacgtaagaaaggacgcttaacatgaccacaactgaaaaaggcttatacccgacggaattttggacggtaacggctggcgatctggcacaaaagcgtgaccatctggcaactccaaaaccagaaacgacacccggcgatgcagccaagatcgtgattgatcctgctgaccggcatcaggaatggatcggcgcaggtgccgccatcaccgatgcagcagcatcacttatctggaagcagagcaaggaacaacgcagtgccttgctacatgaaatgtttgacccagaagaaggtcatttctcgaccatccgtattccattaggatcctgcgaaccagccagtcaaccttattacacttatgatgatgtgccatttggcgagcatgatgcatccttatctaagttttctgttggtgaaggtgaacccggagcgcctgatgcaaccaaagatcttaaatatctgattccggttgttcaggaaattctggcgattaacccagccgttaagattatggcttcaccatggtctgctcccgcttggatgaagagtaccggcgaactaaaaatgggcggccacttacgttttggcgaatataccaacaatggctatgcaattaaggacacgttcgaaggcgtttacgcgcaatactttgttcgttaccttgaagaatatcgcaagtatggcattccgatttacgccatcacgatccaaaacgaaccttccaatgcagctgcatggccagccatgatctggaagattccggaactggcacactttggctacaagttccttcgcccggctttggacaagaccttccctgataccaagatttacttctgggatggcagtttaaacgtccttgatgtcatcgacaagccactaagcgagttggtgacccctgatgaagcggctgcatttgatggttttgccttccatacctacgatggtccttacaccaacttgtttaaaggcagtcgcctgaatccaaactggaaactcgccatgaccgaacgccgctgcatgatcgaagaaacaccagaagatgcttctcatattatgtttggcttgatcggtaattggctcgtgcgtcaaggcttgaacatgattgatctttggaacattgccttggacgaacggggcttgccaaaccaggtagggtcaactggccgtcgcggggttgtcaccattgatcacacaaccggtaaagttcaacgtaacctggaatactacatgctgcgtaacttcaaccaagatgttgttccgggatctattgtgattggctccaccaactacacgcaagatggctacaccggtggcttaggctccgttgcctttcttgctcccgatggcgccattgctgctcacctctacaacccatccggcaagccgttggacgccgccgttaccatcaacaatgacggcccggttacttggcagcatgttaccgttccggcatggggaaccgtaacgcttcataaggcatttggtcccgtcaatgaaagtgcgccgcgtcaggatgaagacttcaagctgaatccttatccggcaaatctgatggacgactgggcaccgggcaaaggtgtgaatgctaacaagaaataacgtcggaaaagtcggaatcaaacaacgcggataactgttgttgattcgactttttcttttttaatggttcagagcctatacagaaatattttttgaattaaaatgttaaaagtattctgatagcgctttccattttaacccgcacgtgctatattaagtgtgtgaaactgatatattaatatataaggaggttcatcattttggttaagctaaccgacgattatcaagcaaaggctgctgacttcaaagcggctggtatcgctgttccgcaattcgaccaagaacaaatgaaacagacaactgaggccaatcctgtatgggttcacttcggcggcggcaatcttttccgctgctttcatgcaaagattgcgcaggacttgctcaataatggcagcttaaagtctggtgtggttgttgccgaaacttatgatggcgatgtgcctgccgatatctacaagccatataacgatcgcgtgttgcaagtggttatgcaaccagacggcacacttgataagacactgatcgccagtgttgccgaagcgatttactacaacaagaccaatcctgaaggctgggaacatttaaaagaaatcttcacgaagccttcactgcaactcgttacgatgtccattaccgaaaaaggctatcaactgactgacatcaacggcaaactgacaccagctgccgaagctgatatcgcaggtaagccagatgatgcgacgaccaacatgggtgccattgcgcgcctacttttggcacgttacgaagccggtgccaagccaattgccatggtcagcaccgacaacttctctgaaaacggcaaacgttatgaaaacggcattttgacaattgccaagggctgggctaaacacgggaccgtcacccaaggcttcatcgattatctgaccgatcctaagcaagtcagcttcccatggtccatgattgatcggatcacaccgaacccggcgcaaaacgttgccgacaaacttaaggcagaaggttttgaagacaccaccatcgtgcacacacctaagcacaccaatattgcgccatttggtaatacggaagaaacccactacctcgtcattgaagacagcttcccaaatggtcgtccggcgctggaaaatgccggtgtcatcctcaccgatcgcgacaccgttaacgatgccgatcagatgaaggtcaccgcttgcttgaatccattgcacacggctttggctatttatggtaacctccttggctacacgtcaattgctgctgaagttgaaaatcctaatttgctcactttgatcaagtaccttggctataaagaagatctgccagttgtgaaggatcctaagattatcgatcctaagaagtttctggatcagctggtcaccaagcgcttgccaaacaagaatattcccgataccccgcaacggattgccagcgacacttcacagaaattgccaattcgttatggcgtgacgatccagcactacttagacaaggatcctgaaagcgttaagcagcttaaggcaattccgctcattcttgccggatggtgccgttacctgatggcagtggatgataaaggtaacgacttcaccccaagccgcgacccattattggatcagttgcagccatatgttgccgacatcaagttaggtagcgatgccgatgtccacaccgcactcaagccaatcttgagcaatgcccagatctttggccacgacctttatcaaatcggtttggctgaccaagtagaagccgacttcaagaaactcattgccggcccaggtgcagtgactaagacccttgaacaatttcgtcaagatcatgaaaaggagctttaatttatgtcagatttaaaaatgggttttcgctggttcggcgaaaaagatgaccccatcaccttacagcaaattcgtcagattcccggtacgcaacaagttgtcggtgcgcttttcgatgttccggtaggtgaagtttggcccaaggaaaaaattgccgcactgaagaaacaagttgaagatgccggcttaaaactggaagtcatcgaatccgtcaacattcacgatgacattaagattggcctgccatcacgtgacaagtatatcgaaaactacaaggaaaccatcaagaacctttctgaatatgggatcaaggtcatttgctacaacttcatgccgatctttgactggctgcggaccaatctccactatcagctagaagacggtagcaatgtcatggcttttcaacatcaatatctaaaagacgatccgcacgatattatcgattcggttcgtaacaactcagaaggctatgttcttcctggctgggaaccggaacgtctggctgaaatcgaacgcttattcaaagcttatgctgacgttgatgccgctaaattacgcgaaaacatgaagtacttcctcgatgccatcattccaacctgtgaaaagtatgatgttcgcatggccatgcacccggatgatccgccgcgcgagctctttggcttgccgcgagtttacaagaacgccgaagacatgcggattattgaaagcatgcatgaatctcggtacaatgggtttaccatctgcaccggttccttaggcgaaaatccaaacaacgatgtaccagccatcatccgtgaatttgtcaaaaaagatcgggcaccttttatccacgcccgtaacatcgagttcatcaacaaagaaggcgacttccacgaatccgatcacctttccaaggatggttcgctggatatgtacgaaatcatgaaggccttgcacgaccttgattacgatggctacatccgtcctgaccacggccgtaacatctggggcgaaaatggccgccctggctatggtttatacgatcgtgctttaggcatcacctatctaaacggcctctgggaagcattagaaaaagggagcgcaaagtaatggcttttttggacgatgattttctcttaaccaatgagccggctaagcaactatttcatcaatatgctgctgacctgccgattattgattttcactgtcatcttaacccgcaggaaatctatgaaaatcgtaacttcaagaacatcacccgcatttggttaaacgaaggcacatacggcgatcactacaagtggcgcctggaacgggctaatggtgtccctgaagaactcatcactggcgatggcgatgactacgagaagtttgtcgcctggtgcaaaaccatggaaaatgcttggggcaaccctgtgtttgaatggactcatctcgaactgcgccgtttcttcggcagtgatctggtattgagtcgtgacaccgccaaaaaagtctgggatctcaccaacgccaaactggctacccctgagtttacgccgcgcgcgttgattcggcgcagtcatgtcgaagttgtctgcaccaccgatgatccagccagcgacttgcactaccacgaactcattgctaacgatgaagacaccaatggcttcaaggttttgccagcgatgcgccctgataagttaatggcgatctgtgctaatacttacggcgactacttacaaacccttggcaaagcagcaggcgttgaaatcaccgactttgcttctttgaagaaagccatgaaacaacgcttcaccttctttgccgagcatggtggccacctttctgaccacggcctcaacagcttccactaccgcccagtcgatcaagaagcacttgataccattatcaagaaaggcattgaaaaccggccagtcagcgatgttgaaaatgatcagtatctcaccggactcgttgaaatgctgatggatctcaaccgggagttcaactggacgatgcagttccatgccaatgttgatcgcagtctcagcttaccgaacttgaaaaagatcggtcccgacaccggcttcgatgcgatgggcagtcaacctgatttggtcggcgagttccgggatcttttccaagcgatggacgcgcgtggcccactgccaaaagtgatcttctattccctgaatccaaatgattggctaccactcatcaccatgttacaaagcttcgttggccaaggcgataaacaacacctgcaattaggtgctgcctggtggtttaatgatacggctgaagggatgcatcggcagcttcagacttttgcgcaacaaagcctgttaccaaactttgtcggcatgttaacagattcgcgtagtttcctgtcttatccgcggcatgaatacttccgtcgggtactgtgcaacttctatggtgaactggtcgaacagggtcgagtgccatatgaccttgatgcccttggccggattgtcaagaatatcagctatgggaacgcgcatgactactttggtttctacgacaataacaacgattaaacgcttaaaggagtacgatcacacgtgaatgaatgcctgacaatcggtgaaccgctagtcgtctttgccgctgaagaagcagatgtgccattagcggccgccaaacattttaccaagtatctggctggcgctgagttaaatgttgccgttggattgagtcgactcggccattccgtcgagtacattacgcatctcggtgaagacccgaatggcattttcattcgccaacaactcacagcagccggcatcggttccgacaatgtaaccacgacttcacgttatccaaccggcatcgagttcaaggcgcgtgtgacgcatggcgatcctaacacctactatctgcgggcaggatcagcggcagcgcattttgatcccgcggcgattgatcggattgacttggccggcgtcaaacttgcccacattaccggtatctttccagccgcctcggcatcaacgctggctgcaactaagcggctgatgaaacgtttgatcagcaatcgcattctgatcacgttcgaccccaatttgcgcccagcactatggcctgatcagaacaccatggtgacaacgattaattcgttggccaaaagtgcatcgatcgtgctgccgggtgccgcagaaggaaaaattctcgtcggcagtgatgatccggaaaccatcgctcacttctatctcaatcaaagtgagcaaacgcaactggtcattgtcaaagtcggtaaacaaggtgcgtatctgttaggccgtgatgtgcctggacagttactgccaagttttccggccgaacacattgtcgatacggtgggcgcaggcgatggctttgcattaggcgtcatcagcgccttactggaaggtcgctcaccggccgaagcagccagccgcggtaatgctatcggtgccttagcgattcaatcacccggcgacaacaccggttacccaacgcgacaacagcttgacaagttcatgcaaaccagtcttaataaaactgagcgcgcgtgagacactcaattcttttaagcatcccatttgattttcttcactacagaacacgtctaaggagaaaaaaacaaccatgcaaaaatatgactatcttaatcgcttaattaacaccggctgtgtcgccgttgtccgcggtgacgatgctgatgaagcggtcaaaaccgttgatgccgtgattgctggcggcgttacgggtattgagcttactttcaccgtcccgcatgctgacaaggcattggatgaactcagtgaaaagtatggtgaccgtgaagacgtcctgatcggtgccggaacggttcttgatcctgcaaccgcgcgtctggctatcattgccggcgccaagtttatcgtcagcccaagcttcaatgctgacgttgccaagatctgcaacctttactcaattccttacaccccaggctgcttcaccccaaccgaaatccaaaccgcgcttgaagctggcgtcgatctcgtgaaggtcttccctggcagtgttgctggtccggctatggtcaaagcacttcacggcccattcccgcagctggccattatgccaaccggtggtgtgtcgcttgataacctcgaaacctggttcgatgccggcgttaccttagtcggtgccggcagcaacctcaccgccgcagccaaaaccggcgactatgctggcgtcactgctacagctaagaagtatcgggccaagcttgatgccattcgggctggtaagtaaagaaaaatctatcactataaaagactgatctacttttgttaactaccaaaaacacttgccatgaaggacactcccggcaagtgttttttagttatatctccaaatactattcttggtatgttaagcgttgtttgctgacaattttgggtagtcattaccttggagatggctgcgacactttttccagtatttttcatctctatatttgaccatcagccaaaaagagactctagggacacttcaatcgtccctagagcctctttatttagttttgatcttccatagtcaggggtcttaagcttatctagtcgttcactttacgtgcttgattatttagctttccccttctggtgtaagaaccatgcaaagccgctgatgccaatgaggaaaacgactgctgccatcgtaacggccagtgacagctgtgattcacctgtacttggatacttggctgttgatgaggaagctgtttcttcgctagaactggcactttcggatgaagcatcacctgttgatggcagcttacctgttggcgctgcgacaagactggttttggctttcttcagtgcggttgcggctgcatctaattcttgctgactcggcttacctgctaacagtttttgtgctgctgctactgcttgctgataaggcgtccagctgttctgggtgtaatcatcggcacgcaaggtttgcgactcggtgacgagctgtgttagctggtcgcggttaacggtcacaacggtctgtttgaaggccgtgaccgcttgttttaatgtcgatgctgcagtgtcgatatcatcttttgaagcatcagggttatccgcgactttcttggcggtgtcgatcgcaacttggagggttttaagcgcatctgctgggtagttaccttcgtggtcgccagttactgctgaatgactgagcgtttgtgcctctgtgagtaccgtttgcagtgccgatttatccgggctaagggttaagccgtcataagcattatttaacttctgcaaagccgtatcaacatctgcttgaaccgcgtcagtgtctgccagcacttttttcgcattagcaagtgctgactggaaggttgtccaacttgcggtcgtgtacttattagcttggttggtcactgtactgtctttgtcataagccgtctgtagtgccgacttatctggtttttggctgttaagctttaagccagcataagcgttattcagcttttgcaaggttgtatcaagactgtcttgggtcgcgttggtgtcagcgagaaccttttgcgcatctgataacgccttctggaatgcctgccaactttcacttgtgtacttgtcgtctggattcgtaaccgtcttattcttatcgtatgcagcctgaagcttcgtcttacctggtttggccgggttcaacgttaagtcagtggctgcctggttcagacttttcaaggcgctgtcgacatcattttgggttgcgttggtgtcggtaagaaccttttgcgcatctgataacgccgtctgtaatgcctgccaactttcacttgtatacttgtcgtctggattcgtaaccgccttattcttatcgtatgcagcctgaagtttcgtcttatctggcttggctgggttcagcactaagtcagaggctgcctgatttagattcttcaaggcgctgtcgacatcattttgagttgcgttggcgttagcgagaacgtcctgcgcatccgttaatgcggtctggaatactttccagctggcgtccgtgtacttatcgcttgggttagtcacagcttttgccttatcataagccgtttgcagttttgtcttgtctgggttaagcgccaaggcggcatatgctgtgttgagatttttgagggccgtatcaatatcgttttgcgaagccgtcgtgtctgcaaggacattttttgctgctaataaaactttttgaaacgatgtccaacttgatgacgtgtacttgttatcagcgttcgtgacatctttgactttatcgtacgccgtttgcagcttgctgaaatcggcaatggtgtcacttgggacgacaccgacataatcaactgctaacgtaccgcttttgacagtgaacgtcacggtatgctggccgtacttcaaatttcgtaatgtgtaggtctgcccgagattgtcagccttgttggttgcagcatctgttgcgacttgtttgccatcaaccgtcacatccaacttcgctgagccatcattgttgccacaaatatccagaccggtcccagtgaacgtatacgtaagggtagcaccggcgcctgtattcttggaaactgtccggtcccgcaagtacataccttgtccggtttcgtgcgtccagtgatcgttataaaccagttgttgttttggtgtggcagatgtgtcgtacatctctaagtcatcgatttgctgcgaatagtacggggtatagcctttgacagtttcaactttcaggttatcaaagtcagtgtggaagtagccgctgcctaaagtgactcgtccggaaagctcagacgtgaccttgccatcagcaaccttttggccatcaatggaagccgtgatggtattgcctgctgcctgaatggcaatattgtgccaagccgtattcgttgtatcgaagccggaaatcttggtgccgccttgaccggtggcgacattgccgcttgcaactgactgactgccgatatgcaatgaccagccaccatcctgccagaatttcaggtaggctgccgggcctgaatcagcctgctgacgtgcaccgatcgaagcataatttgcgctgccatgggtgcctttatcttcaaatgagacatccgtgctggctttgtaattcatccagcgattgtcgccgatccatgccaacgcatcgccatcgttccaagccccgcccggttcgaccaccgttgagtccaactgctggcgtaaaacgtaatgacctgacttggcatttgtcgtcttgtagccttcaagtgtcccattacgattaaatgtatacaacggatagaagccttcgtcaccaccgcgcgatgttatgaagtcttcagtctttgcggtgttgctagtgccatcagcattcagcgtggcaactttcttaccgccatattcaaagttatctgcatacaaggtcgtgtctgaggtgtcagtccctttaccattggcatcggtatcaagtaccgtccgctgcttgttcgatgaagccgatatgccttggtttaaatcggaatcctttgccttatcaagcgtggtgaccgtcttgattgaaaatggtttaaccgtaacggtataaacacctttgctatcagcttggacatcgccaacatgtttgaggtaattgctgtcatacgcatcttttgcagtcgtatcagctgcccgtgtttcccattcctcaagggtcggagttcctttataagccatgttggaagccgagatctgatagtgcttcgtgtacttactatcattgacgataaccgtggaaaaatcctttttatccggtgaagcaagggttaaatagttagccaaaccgttgcggccgttgacattattggaacccgttgccgtggaaacacttgcctgagatacggcgcgccagataccagacgtattgtcgctattttcccaaccaagtttggcaaatttactgaattgggcaagcacatcaatcgcaacatcactattcgtccaccctgaccatggatcggttgcctgcaggacactcttagatgagtattgaccgccttcatagaaagccgcaatcgccggttgatagataaaattcgtccgccgtgaatcggtaaagcctttcacgatggtgttggccatttctaatgagctacctgctccaccgattccggtgcccgaattaggccggtagtcggagttgccaaaagtggcctgagcttcactattccacacttccttgtcgtacttatcagcaagtgccgtgaagttcttagcgctgtcatcttcggttgagtagtgatagccggctgccgtaaccgcgtttcgtaaggatgaatcggtgaccatatccttaccaaaactaccaacgccgacctcatcggaaatgaccactttgatcttgttataaagttgacgttctgtgtcattcttgaagccggtgttatcggttttaacgcgctttgcatattctttagcccacgccagatccggcttatgctcatttaaccccggattaacatagtcgaccatatagccatatgtacgatacgcgttcaaaatcgagttcttgtaccaagtgtaaatctgatcgtttgttttggcccatcccggagcgttccagcgtaaaattgtcaccttcagattgggattaatcttcttggcatctgccactaactggaacccttgatcgcgggtcacattggcagcttctgattccgtacgttgggtggccggttccgaaccagtggagttgttgcggtcattacccatttccagtttgagattggtcataatgggttgactgccgccaaacaaggtcttcatcatcttggcgtaaacatcgggctgctcggatttataatccatcaacagcgcactagtaccgttcccactcaggacaccgaagcccttaaaagtcaggccgttggtgttgttggaagcaatgtcgttcccatcgagatgaacggcaaccgtgtcttccgggttttgcgatgcagcgcgggttgcagcgggtattgtcagcaacattaccagtgataccgccatcattgccatgacaataccggaccaaagcaatgtgtatctactgcttttaggtcttgagccaatcagctttgctttcatttgagtatttgcctcccatgtctttgttccgtctgcgtttaccggttgctttctttgcctgaacgcggcaccccctttagtaaccgtgcataaaagcacttactgaatgcgcttacttgttaaactcatatattagtatacatgtttaaggattaacaacaataatttttgccaaatttgtcgcatgttttttaatggtttaggccaattgtttgccattacggcctatttaagcagggtttgtcaattttctgtcgattaaaatagttgctgatatttttgggagattaagtcaggacatcctttaggcattcacgcgcacgcaaaaataccaatcttaccgcccgttatggacagccaagattggtattctgcgtctacaccaacaacgctattattagaatttcgttactgctgatactttcacccaaaacttacttcgctttataatccagcggcagcttattccagcgatcatgatagaagaacgccgcggctttgggttggcgatcgcgggtgaaaatgcctttcttgttaccgttgacccgcatgttaccttcaaccgtctggaagtcagccaggttccagacctgttcgcctttgatgaagtcataatcatcgaagacacggctgaacattttcagcacttcgacttgatattcttcggtccacatgacacttggcaatttatgcaagccagcttcggtgtcggccccgaactcggtaaagacaactggcttcttaacgcctgctttttgccacttatccatttcatcgcgcaagccagcctcgccatcggaaatctgatagccgccaaaatgataccagcctggataccggttaagcatgtaaaagtctgggaagtcgagtactttcgacgtctcgatcgtatcatcttcgctcaaagtaaacgtccgcgggcggccttgagggtcaagatctttagattcgtcaaaaatctgcttgaagtatgggaccgcattttcatcaattgtatccggttcattaaacagactccatgccagaacagacggatggttcttatcgcgtttgatcaaatcacgaatctggtcaatatggcgttcatgcagcttcttgagccatggccctttgaagaaggactggttcagcccgccaagaaaagcagcagcggccattttaaagccgactgccggcacttcatcagtcagcaggaagccttcctcatccgcgatcttgtaaacctgctcgtcatatggataatgcgatgtccggaaagagtttgcgccaatccatttcatcaaggcaaagtctttcttttcaacatttaagtcaaacgcgcggccagcaaatggtgaatcttcatgccgaccaaagcctttcagataaatcggcttgtcgttgaccaaaatatcggttccggaaatcttgatcgtgcgaataccgatccgatcggtgtaagtatcaagcggtgtctgggtatcatcgccaagctgaatcgtcagcgtataaagataggcattgcgaacctgccataggtgagcgttttgaacctgtaaggcgccttgtttgccttgagcagtcgcaaccacctggccatccgcgtctgccagactaaccgttaccggcgcgtcgccattggtttcaaccgtatagttcactgttgcatcgttaccagctaacgcaaaagtagtggtgtaatccaacacccgctcttgaggcaaggacaacaagtgaaccgagcgatttaaaccagagtagttatagaagtcaaagaacgggcgtaccattttcttaccattccgcagcgtaatcgtatccccggccggcaatgcttcccgcgacaattcgttattacctttgacaaccacggtattttcagcaccatacttaacggcctcgctgatatcggcagcaaatggtaaaaagccgccttcatgcgttcgaatttctttgccattaacaaaaatcgtggcccggtgagttaccgcatcaaaccgcagaaacaatgcctttcccttagccgcagaagggacaaaaaagttacgactgtaccagaaatcaccggtatattcacgacttgctttatccgtaaagaagtcattgaaactagccggaaccggcatcgaaacgccatcgtgaaaaccggtctcccagccggacttttcaccttctccagcttcatcaaacttaaattgccaaagtccatccagtttctgatccgtgcgctgatcattggtcactgggtataacaacgatgtctccatgcaaaaagcctccatttcaagttttaaagagtacgttttctgaaatcgcttacaccttgtagtgtacttattttagtaaaacttgtcaatggctattttgtttggcactagaaattctgatatatgagttaacccaatatgaagctcttatttttactaaaagaaagctttcctgaggccgttaaatcagagttttgctgctatcaataaaattaaaaaagccatctttttaaaagatgaccgtgctggctaagcccaccctagcagccgtaaaatcgccattgcagcaacgcccgcgaccacgacggcaaagagacttttggttataatcgccacgactatcgcaggcagcgatgctagtaaattcgaccagttgacgcctggccattgtccggggtgaatcaccaggagactttcaacaaaaatcgcggataaaatcgccaccggtacaaagctaagaaaatgcagcagccacttaggaatcgtcatgcgttttaccaagacaatcggcaccacccgcaataaccatgtcgccagcccgcaactcaaaatcgccacaaatgtttcaggattctgcatgccgttccacccccattccaaacagacagccaatcacggttgcgacaataatcgccgttgtccccggcaagtaacgcaccagcaccaccatcgcgaccgcaaccacaccagccacacttaaatgccgcaaaaaaggcttcgatcgatccgtaatcatctgtaagtacagcaaaccgatgaacatcgcaacaactgcgaaatccaacccgaaattatcgggattaggaatcaagccaccaatcaccgctcctaaaagactggcaataaaccagactaaataggcgccaacattgacggtatgaaaccagggagcatttaaatgatggccggtgtaattaagcttgttcatcgacaacgcaaagctctcatccgtcagcaaggtaccgatcagcacattttgcgtcatcgattcatcttttaaataaggggcgaccgtcatcgacatcagactcatccgcgcattaatcaaagccgttgaaatcaccatcgctccaatcggactgccagtggccaacatactcaccaacacaaattgagctgatccggcatacacgatcagcgacatcagcccgatcatcagcagcgacaaatgcccggttttcgccacaatgccataagccatcccgacagtaatgtacccaaacactgtcggcatcacatcgcgaatcccgcttcgaatcgtcagctcatcattcatcctgttccctccgcttttagtatattaatgttagtgtactatttactaagcgggttgcaaccggaatctaatctaaaaagttgtggcggatctttcaattatttcaattttagtcagccaaaaaattagacagtcaaaaataccgcggctctatacggaacgtgtgttcgttttttaattttttaaaaaaacactacacggtatataaacaagtcgatgtctgttaacaattatggttattttaaaaaataatagttgatttataaagccagtcagaacatactcagattgttgaaacgaacatgtgtttggttcaacgacaaactttaaggaggtctgcattatggcagatgaagcagtattagcagttcaaaactggctcaacaagacttatacaggtattccgggatttgaaccggcgccaacagatgggcatactggttgggcaacaatctatgccttgcgagaagcattgcaacacgaattaggtattagcagcatcggtgaaggatttggcaccgcaactcgaaccgctctttctggtgttgttgaccagctaaaaccgggctataaaggtaacattgctcaactgattcaaggagcattttggtgcaaaggtatcaatcctggaaccgaattgaatcagaatttctctgcagaaaccgaacaagcttttaaatcacttcaacaagatgccggactgaccgctgatggcactgtgactgtgaacttaatggctgcacttttcgatatgagtgcctttgttttagtttctggcggcgatgcaaatgttcgtcaattgcaacagtggctaaatgccgagtacagcacttatctcggtattatgccttgtgatggtatttatcagcgcgatacaaatgttgggctaatttacgccttacagcgagccgtgggtatctccgctgatgttgcaaacggtaatttcggtgatgccaccaatgctgcattaaagaacgtccagctatcagtcggatcaaccggcctgttagtcaaaatcgtcaaatatggcttgtatttaaatagcatgtacagcggtgacttcagtgaaagctttggaagcgacgtcgccaccagcatcattcgcttccggaagtttatgaaataccctaacgaaacttccggcatcgctgactacactgttattaagggcctagttaccagcaatggtgataccggtcgtgattcaatcgcattagacacagcaacgcaattgaccgcagaagatgttaaacattttcgagactatggttttagcatcgtcggtcgttatctaacaggcacagtcggtactgactttaaacccaagaacctaaccccaacagaaatcaaaacgattcttgatggcggtatgaagttctttccaatttatgaagacggtggatacgttgaaacatacttcactgcgagtcaaggacggaaagatgcccagattgcagttgcggcagcattggagttaggattgccatcaggaactgttgtttattttgcggttgatgttgactttcaggaaggggacattgaggggactgttatcccatatattactgcagtacaaaatgccttagaggggtctatttataaaactgggatttacggcacgcgaaacgtttgtttacatgctgaagaacatggtattcaatatagtttcgtggctaatatgtcatatggctggagcggtaacctaggatttaagatgccaagtaattgggcattcgatcagttcgtagaatacccaatatatggcgttagcattgaccaagatgcaagctcgggcaaagatcaaggagtttcgcatgttagttcatctgtgaaagaggtaaatacagagttctttaactacctgaaaaaggtacaagatgacgccgatgcatttgtcaagaatatggataaaaatggtaacactgtgccagattcactgatggcagcacgtttaatttgccaattgtatcggcagtttaggtatgcaagcttaccatggacaattatgaccggggcactgaatgacacatggatatacaatgaaaacaaaaaatggaatattacaagcgacgatgattttccagaattgaccgatactgcgacaggaattaagactgactttattcatatgattgcagcattagctagcttattgaattttaatgctgccgtttcagcaactgggacacaagatcttgctggatgggcaggagatttgttgaccgggatttcggattcaattaagtcggctgataaatatgccaacttacttgttgcaatggaagatcatattggcaaagatgcatcaaagggaaaaagctcatttggagtaggcgacttgttagctgatgcggatgcagtcaatatctatgccagcttaaaaaatgggaatgcctccctgtattcgattattgacagatattacaacaacaaggggaatacagaacgctttaatcaatatgtatcaaaccggttctccggcaatcatgataaaattgagtcagatgcacttcgagttttaaatcccgatggagagttggctcagacggctgagtttggcaatgcattgaatgctttcaaggataaattcgaagtctcgtattcgcctgatcaagcaacgatggcagcaagcgtatttaaaaatatgatccagggtcacttggaacattaatgaaaataaattgtgagactgaacacgaaatttgctagaggaagcgattttgatggtttactggagacacttatatgcaatgtcgatagttcttgtgctttttttcctgtcacttgcctttgcaaattggacgatgtttcagactatcttaggtctaagtatgtttagtctctttttagctctgactctgtgggaaattcgtctaaattctaaacaggtaaagcgacctcgactacaagttattttaacctatatttgtatctatgttagcctgtttttgtttaatatgagtgtccatcaaacatcactttctacgtttggacagactaacgttatccagttttggaatgagcatgatacgatagttcatttagaaggcaagacctaccatttgatctggtcaaaaagcacatttccaagaactgtctatttttataacttgtatggacgaaaaggcttgttcttccaacgccttaacgatgaggttatctattactcaccaagtatatctagaggcgtagaccgcggggctgtaggaacgttcctgcgcggcattaaaggggaaaaagaccaaataggcgattaacaggtaaataaatatacagatgcagttaacggaaacattctttatgtgaggttctctttcgattcctaagatgtttcagttgactaactaggtcaaggtttaaaaaggaaggcacaccgacgagagctggcgtgccttttttttgaggccgcaccacaatttttgaccgtgcagtgtaccctctgaaacgccgaattattgaaaaatcgttcgacaaaagcgttctaggccgtgccaaccttcgcaatctctggccagctgggtctggaacgctgtgacagcgcattgaaattacatgtgcagttttgcgaggtttggaactatttttaatagtttattccaccccagttttcgcgttttaaacaacgtcaaaattttagatagaattacgacctgtcctcttcatgtagcaaaccaatatcattcatgtaaaaaacgctgacaaaaatattccaaatgaacgctatgcaacacttatatagtcagcttaagcctgcaaataagaaaccaaaaatactaacgccgtgccaaaatcccgaaaaataaaaagtagtatcttcaccgcacacttaatttctggtagctcagtatttatttttctcctcactttttgagtataatatgatgcgccaagattaataacagcaaaagcaaaaaagaagatcgcatcaattaagtaaataacaggcgcaattgaaaaattcgccgttattgctcctaacgaaaacacaacgatgaaaaaataccaaacaataatgatgttataagcacgattaaaaagctgatttgacgcctttgtggtaagctcctgcatcttctttctagcttctgagtaactttcatttgtatatttgccttcttggagtaacttgtttttctgttttcctctgagaattgaaataattgtagaagcgcccacccagatacaaaccatctcaataaagggtatatagacattcatttttgatattcctttccttaaacattttctgtcctcggctaaaaaattcagaatcactcagataaaacacatttaagtatcttggcaggaaaatctgaaagccttttttactgtgacaaaattacgttgttctgactagaaccgtctcagattcagtgataccttagtcactcccgatctcatcactatagactctctctgacgaatattccaagatgaagtatacaattccgtatcaagcattgcttatgtaagtcgatacaggtcaagataagtgtccgttgagactgatatagcgaccaaataggctcatccgacgaaacaacgcagcgacccggtttttgtcagcaccgctctggttccgcattctcactccatccggccggagattggcacgactcggaactgttttacttacttgttccacaacagcattagggttccaataggcatcaaattctgagaagcgactgattcaacgctttagtagaagacaacggcagcagcataaaatatagcgaagttgagtcccccaactacgacaagcagtaaaaggtagcgataataccattttgacccaacctttcgaacacacattaagcttgggtacctttccgagagtctttccaattttctctgcttgatgacgcggaaaacttgttcttcacccagaaaaatcacattagcaaagaggaggaagaccccgatacttggtaaaagaagaagccctgtagatgtgttcccatagataacccctgcagaaaagaaaatgacggccaaatagctcccaatcatttgagaattcatcattctttcaatatacaaatttcgaccaacgagcgtgttcaaactctcatcaccgtctttctccatgccgacactcccgtcagagtcaatccgtttaaatgccgctattcgttctattcgctcttttttaaacatttcattcttaattcttaacgtgatagaaaaaactaacatcacaagtacgtgtggcacgatataaatgtaatccatattttctccctaaattattgcaagttgtgtcacctagcgtataaagcagtaaacctcatccagcctccaattataccaatcgttgtggagatctcccgtgtttaaacaaagcaagatcagttatattaaattaagcgaactatataatcttacttcaaatcccgaaacttcttggtgtgaacgtaaaattagagttgtaacaaaaacaaactcagagaaactgttctgctgtagccgtgcttaatcacgtgattgtaagtctgcaacaataagtgccaaaaacggtgtagctccctctgaactccaaattctatgccaatttagagccatttttgcttaaaatcaaatcttttgaaacaaatctttagagttgactaatccataaaagctatttgaattaagttaaccctcgtggcctcatctcgtcatttctatcgagtagctttaaccttaaagttatgttgcagttgcggccaaacatgctcgtcagcccacgcaatcatgacaccattgccaagaaacgagaataatgtggcaatgttaatccctaacagtttgccagtcgccgcccaagcaattaccgtgacaatgatcggtgggatgaaatcggttaactgtgacgccgtggcattacccttaaagtacaggaagcgcaaaatattggtggtgtcgtcattgggatgcatgatgatattcgcgcgttgatacagcgaaatcgcaacacaaaagcagaaaacgccaaagcaggaaacaaagattcgggcgatgacaggccaatttcccagacccaaccaagtaaatagccacgtgaaaacattgacaaagtaactgaagaacagcgtataaataacctcaccgatgaatcgtggccagtcccactgtcgaatcaaaattaagttggagatggcattgagcacgccaaatgtaaacaaaaccgcaccgatattccatccctgccagtcattgagattaatcgccgcggcggtccacaaaccacttcccatcgccccaacgatacaaagtccattacccgctgcgtttaatatcaagccgacaatcaacccgatccagcgttctgtttttgtattcttaatgagaagaccttctttctattctcttgatagatttcttgatcattataaacgcccggccgcattgatgaaaatccgtcagtgtggccgggcgttcaatttttaaaagtgtgtcagattagcgctatagttcgccgcctttttcaaaagtcggcgtcatcttttctgcgcggatgcaaaccagttgatgcagcaagtattggaggtcgttggtgatcgtggctgcggtttcggcattcaattcgtcatgccacgctggcagatcttcaggcttgacgtctgcaaactctgcgtctcccttagccaccgccgcgcgtccggccgcaaatccgaacttgcgactttctgaaaccgccacttcggcatcccagttatgttcggcaaacagcggatccgccaccatagcaatcaacttattcagccaatagaagctgtcagtcgaacttttatcagtcggggtgtactggaaattctcgggcgtcgtggtgcagttggcaaaaaatggcaccggactattgaagatattgacgccttctgccagccagtgaatcgccgcatgggctttaggcatgttcggtcgaatctgcaaaatatgcatttcctgattacgattcatcccgattggccgataacgatgccgcgtttcggccgtccctgtctgcccatacggatcaaactcggttgcttgataatggctgcttaaaaccatcgccacatcttcaaccgatagcaaatgactcggaacccgactaaatggcatggtccgactttccggatcctggtcaacttcaggattcagcatcttctgggcataccagacacgcggggtattataaaaatgatctgcctgcgtatcttcaccgaaaatatcgcggaaattaaagcctttcttcgctttattcagatgatacttttcagcaaaagccttcaagtcggcactgtactggaaatcatccggcgcatcaaaatcaatctcctgaatccccgtttgattcggcgccaatacataacgatcatcaggaatccgctcagccgcccagtgatgaccgccaaccgtttcaaaataccagacttcatcagcatcggaaaaggcaatgccgttactttcacaggtgccatacttcgtcagtaattcgccaagccgctgcaccccttctcgggcattatgaatatacggtaataccaccgtcagcatagcctcttcaccgataccatctggctcaagtggatccaatcccagcatcgtggtgtttgtgaactcggtttccgtagcgctcatggcaacattttcgctgttaatcccggcctcaccccaagtaccatcgctcgtgtcggcaactggggtacaggtatactgcagcgggttctgcggcaagtccaattgaaagccgttaaacgttgacacataccgctgcggctgttcatccggcttcacaacgataaaccgcttcggattaatcccgcctgccgcatcctcattgcgggcaatcatcgttgagccatcaaccgacgccttcttaccaacaagcaatgctgtacaactcaaatggttcacaaactgattcatagacacgcttcctttcagttgcttttatcatagcactggtagggccgagtgctggggctggactagtgattttttgtaatccatgcccattttgcgttaaaagtttttgaccaaaaaacttcgccttgatgctagttcgagttggcgctattttatacgtgtacctctcttgacacatattagctgaccaatacatacccatatcatcgtttgttgctttcacaactggttctcctattcgatcaagccgctaaaatcatgctagcgaggacaacctatgaccaaattaaaaaagatgacacttaatcagaaacttgcgaccattatttataccattatcgggctcttcgtcattggccatctaaccccaataatggctgtcaggacaaagctgctaatgaacggttattttcagagtgcgttttgcgcccgcattcagcgttcttctgaaaatgcttatgcccctgcgtatagtcatgacgatgaaggaacggtttattacgtcaagccctcccctgtttcgcaggcggaacttaagcagacgactgctcggctaaatcgttatgccgtcaaaacctttattttgagctttgcggaagtaacctgggctgactaagcctcgctacaggtcaattggcttaccgtgatcgtaagttttccggtcttcttccgtaatgtttcgaaccacgtgacaaggggaaccgaatgcaacaacattggctggaatatccttggtgaccaaactgccagcgccgatgacagtattatcaccaatggtaaccccgggcatcaccgtgacattggcaccaaaccaacaattgcgacccacatgaatcggcttattatattgatagccttgttcgcgcagagttggatcaatcggatgagtcgcagttaccaacgtcacgtttggcccgaacatggtgcgatcgcccacgtaaatatgggtatcatccaccaacgtcagattaaaattagcatagataccactgccaaaatgaacatgcgccccaccaaagtttgaatgaaacggcgcctcaatataacttttagcgccaatttcagcgaacatttttttgagttgggcaaatcgttctgcttgatggctcgccggaatctggttgtaaatcgccagctgatcaattgccgccagctgttctttttgcagatctgcattcatcggttgatacaacgccccttgatgcattttatcttgaatcgtcatgaaatcgctcctttacctttaataggtgtcaatgttggactgttttcgaattagccagttttgtttgacctaatcttaacgaccgtcatctctttgctacatgcattcgtagttacctcgtttctgcctcatcgtatcacagacttacgcaacgtaaaaaatcggccatttgatgatcctagcaaaacactcatcagatggtttggggcgatctttagtttggtaaaaatatatggttataaaggcgtcgttttattgagtcttgccttgatgttgaagtcgatgtccaatggtattattcaacgttcgggcgcctaaaccgagcgcaatcacaacaagaatccacttaggcaacagtaaacctacaagaatataaataacggcaacaagtaccattagtgacgcagcgcgatattcctcccaatcatgagcatttaaattttcttttttcggtcgctcgccaatgactaatcggaacaaaataaattgaaacagatcaaccataaagataataactgcaaataatgtcgcactaatacggctacctggatggtcactgataaaactggttgcaaacggcactaaacagatgaacacaagatagaaaaaattcaataccaaaaaattggtgcttggctgctgaacagtgtgcaaaagttcttggtgaaagatccagtactggccgaccaccgcaaaactgataaagtaaatgacgacagaaaacccggttgcgtaaaggtccactttagtcagcgttttgggcactttaatatctaataccatcaatgtcagcacaaccgcgaatacgccatccgaaatggcatcaagccggcttttgctattttcaaacatgtgcatctgtcccttctttaccttttatcatacccccaaatagtcgtgctttagcgtatgatgagactagcaatgtttgccagcttataagtacctatgcaatcctgatacatggtgttgcgcactatgttggctgacattcatacaaattcctgaaggagcagcaattatgactttttcgatctttgcctttttactggttgccgggatcggtgccggactcactgctacgttagcagggttagcttcactggtctcgtatccagccctgctcgcaatcggcgtgccaccagtcattgctaacgtcaccaatacagcggcactcgtcttcactggggttggttcagccgtctcctcactgccggaactgcgcggccggggtaaatttctttggcgtctgattctgattgtgtcactcggtagtattttcggtagtgctcttctattgattgcaccggcttcgacatttgaaaagattgtgccatttttcatcatcgcggcgggacttttactcttattcagcggtaaactaccgactcaggagcatcgtccaggcgagccggtgaagaccttaacctttcgccaagaagctgcacagaccattgttattttcgtaacgggtgcttacgcggggtatttcggcgctgctgccggcgtggtcatgctggcaactttgaccctgacagttgaccaaccgtttattgtctccaactcgatgaagaatctgaccggctttgcagctaacgccattgccaccgtcatttatgctttcaccactaaaatcgagtggttaatggttattccgcttggcattggactcttcatcgacggctacatcggcccgatcatcgcccgccgcttaccggttcaattattacgcgtcattattgcagcactggccttcctgctggcggcaaagttatttgcgcaggcttatctttgatttttcctagttttatcgttcatccgggcaagcaaaaacgccgcatgaactttagcgagtactggcggcgtttagcttgtaatcacgattttgcagggaagtattgtgagaacacatcatactccctgtatttttatacctgcattgaccttggttgcacaaaaagccatcacgctcacagcaaccacattgctaatccaaataagattaagtgaacgactaacctaatcaaatgatgctttatatgcggcctgccatacaatcggatgccattaaaccacgaaaccgctgacagacctaataacccgatcaaaagtatgaccaaagcgctgaatttgtcaggaataacagccgctgtcaggactagcgcagcggccagtgcgaatagctggtttaagtaagaggcgttctggttcgtttttcccgcttgccagattgtgagcagcatcaaaaaaccataaaacccgatcaccacacgaatcaaaatctccgccatatttgttactagccttcctgcgcctgcaacacttgatccatcacatgcaagaccccgaactcatcgttactgcgcgtccgatacttcgcgtgctgcgccatcccttgagtcgcattcgccatgatgtaactgtatccgaccgtctctaacatcggaatgtcattatcataatcgccaaacgccatcatttgtgcggttggaatatcaaaatggcggcttaaaatgcgcatcccgcgacctttattcacccccagattctgaatgtccaaccatgtttcgccgctcacttgaaccgtgtaattttggccaaaagccggccggaaataccgttccgcattgacacgactatcggcattagggaagtaaatcgtcactttgtccacttccaaggaagccgccatcagatcaggcactttttttagttgatgataaaacggcaatagtgccggggcatactggccatctgccgcattaatataggcagcgtccaaggcacataagacgggaacgccatcggtcttgtcacagataaacgccacaatctcgcgatacgctgcggctggaattaaactcttgccgatgatctgaccatgtgaggcgaccaacccgccattatcgcaaaccaatgaaatttgcttagtaaaatgcggaaaggtttcctgcaaggtatacagcggccgaccactggcagccacgaattcgatcccggcttgattgagccgctgaagataacgatcaaagtgcggcggcagcgtcccttcactggtcaacaatgtctgatccatgtcactggcgattaattttacattttgcatttctttctcctattaatgaattaactagcgcttggcggctctcgctcaatgcggcgccccttttgtcaccacattttcgatcaccttcgcaatttgttccggtgattctttcatcccttgtttcaaccacatcgttaacatgccctccgccccttgcacgaaaaatgcgtagtaataagcgagctgttttggatcggcttcacggtaccatgcctggtagcgtgcttgcgtctgcgtctgaatcggacggacaattttctccaacaccgtactatccggattggtcagaataatcgtggctgcttgcggatgctgtgtgatgaccttgagaatcggaactagcatcttggtcatgtcatctattttaacactgagatacggttgaatttcatttaataaatcggtttcaatttgttcaaataatgccagcggtgatgcaaagtgcaaataaaaggtacctcgattcagatccgcttgccgacaaatctcagtgaccgtcacctcatccagtgatttcgttgccagaatttgcaacaacgccgctttaaactggctcacggtatattgtacccgccgattattgcttatgcctgtcatcataacctccaaaccaacatgatctgtacaacgtgttcatttaacaacagatatccggattctgtgcttgaacgactggttttaatctaacataatgttattaaatgaacaacgtgttgagcgtaggtttgactcaagcgcgaactatctcaacacctttcaggaggctaccatggcatatatcgaagtaaaacatgaatcaaaacgttaccaaatgggcgaaaccgtcatcaccgccaatcacgatattaatttttcggctgatcaaggtaagctcacggtcattcttggtcccagcggtgccggtaaatcgacattgctgaatattctaggcgggatggattcgccaacagaaggtgaggtctggattgacggcacggatatcgcaactttttcggatcgccaattgacagcttttcgacggcacaatgtcggttttgttttccagttttataatctgattcctaacctgacgactaaggaaaatgttgaactggctggctcaattgtcgctgatgcattggatcccaccacggttcttaaacaagtcggcttaggtgcccggctggataattttccttcgcagctttccggtggcgagcagcaacgggtggccattgcccgagccttggcgaagaatccgaaactgcttttatgtgatgaaccgactggcgcattggattacaaaaccggtaaacaggtcttgcagctgttgcaagatgccagccgcaaagaccataaaaccgtcttgatcatcacccataatgccgcgattgccaaaatggcggatcgggttgttgaaatcaatgatgctcgagttcgcagcattcacgacgagccggcaccgacaccggtagcggacatcgagtggtaggtgatcagtttgaaaccattaactaaaaatctttggcgtaacattcgcgattcactcggccgcttcattgcgattgtcatcattattatgcttggcgtgcttttatttgtcggggttaaagccacgggtcccgctctcaaagactcactgaatacgaccgttaaagccgatcacctcgccgatgcccaattgctggcaactactggcgtcagctctgcccaagtcaaagcggcacagtcagtcaagagaacccaagccgaagcggttaaattcaaatatgcaatcggtggccgctcaagtgatgttgtcgctttatacggctatcaaaaaacggccacaatcaatcgcctccacctcaccagtggccgcctccccacgcaccgtgatgaaatcgtgctagacaccgttgctaaaaagagcggctatcgactcggccagcattacacgtttgcacgtagcagcgggcttaaggaccgaacatataccatcaccggctttgctgactcaccagcctatatcgaagacactagccgcgggtcggcaaatatcggggatggcacggtccgttattttgcgtatatccctgatcagcaaatgaacctgcctgttgcctcgcagctcaacatccgctttccaaacttacaaacccgcgacactttcagcacagcctatcaagacgccgtaactgcgaaaatgaaacaggtcaagcaacgcgttaaagcgcaggcgcaagcagatttagccaagaccatccaagctaaaatgacccaggcggcgatgaccaaagccaccaatcaggcagttgcagctggcatgcctgccaccgcagcgactgcaacagcgacgcaaaccgtcaaaacttaccaagcagggttcaaaaagcaggcaaccgcaacggcccgccaccaactgaccactagtctcacatggcaaacccgcgatgatttaccgggcttcggcgattatggcggttcagccgatcgcattgccgccatcgccaatgtgtttcccgtattcttcttcctcgttgcggcattaatcacctttaccaccgtaagtcgcatggtcgaagaagcccgcgctcaaatcggaacttttaaagctttaggctatggcaaatgggccattgcccgtaactatctggcctatgctgccttagccggtttactcggtggtatcatcggcgtctttgccggcaacttcagcatcccgcgcatcgtcttaagcctgtataagaactacatcccgcttaagcaagtgatttcgctgcaatggccactgatctttttgtcgctgctattagccttaatcgcaactcttggcgctgcgatcatcgtggtgcgcaatgaactgacggaaaaacccgccgctttgatgcgtccgcgtgcgcccaagtccgccaaacggatcctgcttgaacgcatcacccctttatggtcacgcctttcattcaatcaaaaagtcagttaccgcaatcttttccgctataagtcacgccttgtcatgaccattctcgggatcgccggcggaaccgccttgattcttaccggatttggcataaaggattccattaccgcgaccggcactttacaatatggcgacgtgattcattaccaagccatcgtccgactggcagatggtaagcaaccagccgctgccaaaacgattctgcaaaaaagtcgtgcttatcgtagtgccgtcagtgttagcagtaccactgccaaattaagcagcaacggtcaccaaattagcgatgttaatctttttgctccgacaaccggcaaacagcttgaaccttacgtcagtctgcgttcaacgactaccaatcaagccttaaccctgccaagtaccggcattgtcattaccagtaaactggcaaaagcactgaagcttaacaccggtgatcggttaaaggtgacgacgactgctggtcaggctcatcgttttaccgtcaaagggatcgccaaaaattatgtcggtcactttggctatctctctgccacagcgtatcaacaactagtcggcaaacagtctgcaccaaactcgctgctcgttcgtctgcgctcgcaaagtcagcagcaggacgatcgcttagctaaacgtctgctgaatcatcatgcgattgtgggcatcagcttcaccaccaccgcgaaaaagaccttgcacaacatgagcggcatgttaaacccgattgtcctgatcttcattttgcttagtgcggttttatccttcgtcgtcctctataacctaaacaacatcaacgtttccgagcgtattcgcgaactctccaccatcaaagtgcttgggttctttgatcgtgaggtgacgatgtatatcagccgcgaaagtatcgtccttaccattgtcggcatcctgttaggctatggactgggtaatcttttaaccgcctatattctattccaagccgaaaccgaggccgttgtcttcccgttgacgattagtatgatcggttatctcacggccacgcttttgatgatggcctttaccggtattgtcacctggctcacgcaccggcgacttcaacgtgtggatatggtcgaggcactgaaatcaaacgagtaacttacaattttgtcatgcagtcgcggatcgcggctgcttttttcatgtaaaattcacgaaaaatcgccactaaatgctcaaaatgacgcaaatttgacgcccagatgaagattgagaacaactcctaacaatcctgtaatggtgacgtaacattgacacagtaaagtagcctttagttaattaattaagggtgaggtcaaacatgaaattcaataaagcaatgatgacattggttgcagcagttaccttagcgggttctgttagcgccgtaacaccggttttcgctgacacaagtgccagcatcgcatctaacaagagcgaaaccaacgatttattaaagcaaatcgaagcagctaacactgaagtgatcaacctcaacaagcagattgatgcaaagaatggcgaaatcagtgacgccactgccaagatcagtgcaacggatgccaagatcgcatcgttgagtggcgaaatcaccgctgctcaaaagaacgtcgcagcccggaagaacaacttgaaggatcaattgatttcccttcaaaagaaagccggcagttcagttagcggcaatgtctatattgatttcgtgttgaactcacaaagtctatctgacttgattgcccgtaccatgacagtcggcaagttaagtcaagccagcaaagacgctttggatgcggtaaccgtcgccaaagataagttagccgctttgaagagtgaacaggaaacggcacgtcagaccttggtttcgactaaagcatccctcgaaacgcaaaagtcacagctagagacccttcaaaagaccgcaagcgataagcaagatgctttgaacaaagaaattgccgatcacaaagacgaattggttgcactccaaagtcaatttgctcaagaacaatcagaagcagccaaagcaacccaggctgccttgaagacagcggctgcatcaactgcttcaagttctaccagctcaacttcaaataagagtgccaacagcagtgttctttcgactggtacctcatcaaccaacacttcttccaacagcggtgcctcatctactgtgatcagcagcaacactgcttcaggtagtggcagccatgctgattacagcggttcaggtaacacttatccttggggtcagtgcacatggtacgttaagtctgttgcttcatgggcaggcaatggctggggcaacggtgctgaatggggcgcttccgctgcagcagccggcttcacggttaaccacaccccggcagcaggttccatcatcgtcttcgctgctggtcaatctgttggcggccaatggacagctgatggctcttatggtcacgttgcttatgttcaatccgtttctggcgacagcgttacgatcactcaaggcggtatgggcttcagctcaccaaccggtcctaacacccagaccatctctggtgccagcagctacgtttacatccaccggtaatttttacccacccttaatatcacgtcttgggacctcaccaatgaatcccaacctaaaaataccgttgaaataaataaccctctgaacaactgtcatttgaagacatgttcagagggttattttttatgtgtattgacgcaaaagtaacttaatggaagtgggcgttgccattttactgacttaagatgaaagcttcctcctctaaatgcccgctccctcagcagtcacaagcaacatcacaagttgcacaatcatcaagatagaaactattggcgcggctgattttaacaaagtccccgatgtcccattgttcccgtttagcgatctcattaacgatcactccgaaacgctggcggaatttgtaaatgtaacagaaaatcgcatcctcgtggcgtacatcaggcccggcaacaaatacatttttcgcctgagttgattcatcaacgtcattcaaagcaatttcgccatcattattttcaaataattgtggccagagttttaacgggccggcatcaaaacctgtgcatagaacgggcttatacggcgtcgtaatcgtacgtccgtctgtaaaccacaattgatactgggaatcctgggtgcgcgtgacggtcttcaacgcaatcttctcttgtaacgtgattctgttagcaacttccgctggcaaatccaagaatcgccgccgtgtgtacggtgccaaccgaatacttgggtcggccgatgccgcattcagacccgtttccttggtcaacaaaagtaccttatggcctagcgttgccaaattgatagccgcatcaactccactttcgtttccgccaatcacaatctgggttttccccgtcaagtcctgccacgaggtcacttgctgatagtgaatgacgttttccggatgatcggttaatttagggaaagcatactgaccgactgccatgatcaagtacttggtggtcacgacgccgtgattcgtttcgagttgataaccttcagtagtcggtgaaattgcaccaacgcgcgtatgttcagcgatcggtaatgcgtaagtatccgccaacaatttaagataatcggcaaattgtgaaccactcagatgctctgcaccaagcgtatacgcaggcgaggtctccatactgacggcattcaaatccggcatgccgaatccgttactggtaaaggatggcgtaatgaatcgcgtttcttttggccaacgtcggaaacttgcgccaatttcttcctgctcaagaatctgaaattgactgcagccaagttgttctaacatgataccgataccaacgcccgctgctccaccaccaataatcgtcatttgattcatccaaatcgctccttttgtcaattcaaccgttcactgtcaagattcatcacccgtgttacgccagcttcacacgccttagcaactaactgcgcaaccattgtgccaataaccgtcaacccagccgcgaccaccacagctaaaagttcaaccactgcgaacttccccgcggtcgctattgcatgagtcccattaaagaattggacaatcattaagccaacagcccctgtgatcccaccgacagcattcatcgcaaaagaatctaccacatcatagaaatgttttgaatgctgcatttttgaaaccatctgccgacaaatcacgccagcaacggcagcaacaatggccatgctcaatgccccgacatatccgactaaagcggtactggttaccaaaccacacagcacgccattcaacaaatcgcctaactgcaccacaccattttgccgataagtcagccaataccaaccgatcatcgccatcaacacggccacgaatgtattaatcagcacctgtccggcaagcttattcaaactgcctgccggggctaagttaaaccctaaccagccaaccagaatcatgatcgttgccgcgtaatcagttcgaaaatcatttggcatactcggctgatcacctggaagtaacgcttttgccagcaccaaactcgtcaaccctgccgtcaaatgcacgacaatgccgccggaaaagtccaaagcacctaattgtcgcaaccacccatgatcagcccatagccagtgtgcaagcgggcagtacaccaacacagtccacaccggaacaaagccaaacatgtagcggctgttcctgttaccagcgatcgtacccatcaacatcgcaaccgcatataagtaaaaatccatttgtaccaagccagcagataatgatgaaaaagttgttgcgtgtaataagtcaaaaccaaatgccaggcggttaccaaaaaccaaccaacaggcaatcgcaatcattaacgcaatactcatggttaaaagtgctgattgctggcgaacccgtggcatcatcccgacatacagcagtggcacactaaagatcatcggcaacatgatcaagaaacaaacaagtgcaaacatgaataaccccctcattagcgtcaaccaatccggataagccgcctcagtctgagtagccttggttcctaaccagtgttttcaaacaaagctagcgaactgatcaacgggtgtgtttctttatcggccaacaaggattcattgcttctatagatatacagcgccagttagtacccgcttggttgatataaaagcaatctcgcctcttaaatcgtaatcattacgctttatgaagcgattttcaccttagcatttgttgaacatcattgtcaattaatattttaggaggatgttaagatacgtcgcacgcaggtatgcttaccagtatttcttgttggatacgaagcccgcccttattgggtttctcagcagttataaaaatacggtacttgatttctcattatcgattttattgttgttatcaaaattctgattttcattattattgtaaatgagcaaaatttacagtccgccgccaatatcattgaaagcgttttatatatttgataaaatacttttagtgatgagcggaaaattatttagaagatcccaaatatctgaacttctcaacgaactcaaataacatcctatcccttttccattagtgtttaacctaattcccttgcagtttgcttggggagttgtccctataaaaaagtctggaacacttcattgtcctaaaaatgaatttgaaagaaatgctgttccactgattctcgccacgataaaggattaaacaaatgaacatgattaatgtgaatcatttaaacaaaaaattccaagacaaaaccgttctcttagatgtcagtttttcgattcaagaagggcgaattacaggaatactcggtaaaaatggtgctggaaaaaccacactattaaaaatattattaaacctgattgataaaaccagcggtactgtagattatacttttcaaaataagcatattgcatacggaaacagagcgctttatcgtaacgtggcagcggttcttgaatctgttgataatctatacgactatttaactggacgccaaaatatcaactactttttgaatctcagcggtatttctccagccagcaaaacttccgagattaattcacttttcaaaaagtttgatctttcatctgccattgaccagcgcgttggtcagtactcgcggggaatgaaacaaaaactagcactcatttcctgtttagtcagcgatgccagcttactgttcttggatgaaccgacccttggacttgattttgttgctagccgcacgctaatcaggcagataaaggaaatcaatcaacagttgcacaagacaattatccttacctcacaccaagctgatgttcttgagaaacttgtcgatgatgttcttcttatcgataaccagaaagtacgattcttcggcccctatgaagaattccaaaaaaccttttcttcttttggtttcgttgtggtttcatcccatttttctttcaaagccaataatgcaataaccgtcaactcaagcgacgacggcaagcgtgtgacgacaactttcaaaacattgaaagatcaacaagaattccttaaaaagcttcttgagcatgggattaccattcatgcggtgcaaaatcgttatccatctcttgatgaacttttacgtttagtcttttgatcgagaatgagaggtgaaagacttgatcatacatttatttaaagccgaattttctcgatatctggcagaagttagaacttatttcccggatcaaattaccagtatggtcgtcaccataatcatcttcgtagtctttacttttcttaatattgatgctggaaattcggctttttatatcgggtatgcatattggtacctaattagtggatggtgaaaaactataaaagtactttcatgataggctttgacaatagttaagtgtataataagtgtaagccggcttacacttattatacacttaactattgtcaaagcctatcatgaaagtacttttatagtttttcaccatccactaagtagacgttgatagcagagatgagggtaaagatgatgaggaaaacagcgatcacggcaccgaaattgtaagtgtgtaacggcatgaacaagaggcgctgtagttgattgaatagatatgaagcgataacaatgacgactaaataaatgccccattgaacaatacgaatccgggtttctggtaagaacgccatgatggtgacggataacatatgcacgaggctgacaaacgcccagatgaagaggcaagttagtgcgatgataatgaagccttcgataatctctggccaggcactagcagctggcaagtgcatgccacgaccggaaaattccaggccacctaatacaagcccttcagcaaggctataacaggcaaaattaaccgccgtgctgaatagattggcggcatacagtttcaaatttgtgatcggaacggcacgataataattattaacccaggtatgttcctgtttaatcgtgagccgaataaacagatagatggtgccaaataagacataaggtgaaagcatactgtaaatgaattgtggggataacttcggggaacccgcaagataaaccaaaataacggtaatgacagctgcgactatcgtgacaataaatgtattgactgctgtcttaaatcgttgccgagtcagcacttttgccattgtccaggtattagtcattgcttttgcctccttgatacagactttcatagtaagcttccacgctcatgccggtttccgcgcggagctgttccgtgtttttatgggcgacaatatgtttatcttttaagacaacgatttcatcaagaatattcacgatgtcgttaacgtgatgatccgaaataatcacggtggcggcatcgggtttccaagcgatcatgttgctgatgagtcgtttgcgggtcatactgtcaatgccttcaaagggttcatcaagcagatacagttgggtttcgcgggccaaagtcaacgcggcgatgaactttttacgattcccggttgaaagggcgttgagtttttggtgcaggtccaattcatattcagtggtgaattcagcgaacgccttttcggaaaagtcgaggtacatcatggcataatcgatggcgatttgctgaagggtgcgactggcgttgacacctttgagtgattcgctgaaattgctgagttgtttgcgatcgacaatgctttctgaggcgccgatttgaatggtgccggtaaaattggttgccaaaccgtttaacagtcgcatcaaggtggtcttcccggcgccattcgcaccaagcaaaccgatgaagtggccttggtggacgttgagattaagatcgtccaaaatcaaatgacgattgcgtttataagtaagatgttctgctgaaatcatgctagttgtcatggtgttcctcctgttcgtcaacatactgagaaaaagcgtccttcatttcgtctgccgttagattcaagtcggctaattgacggtataaatggtcaagttcggagccgatgacgcgttttttcatatcgatcagcactttaatgtcatcagtaacgaaattacctctccccctacgcgtcacgagtacgccttcttgaattaactcgcttaacgcacgctgcaccgtgttgacgttgacggttaactcagcggcaagttggcgaaccgctggcagttgcgcgcctgatttgagccgatcggtaataatggcttggtaaagatattgtttgatttgaaaataaatcggcaccttatcatcgaattccacggtgtccctcctcactagtgtattagctatctattacactatatcattaaacgatgacattgccaaggaagtttgacaactattttgaaatcaagagccttaaacctcaaaatcaaggtaagcgtggtacaatgcaaagcaagaagcatcgggaagagcgaggcgaatgatgacgaaaaaacggggaaaagtccttctaatcattagtatctttcttgttgtcagcggcggcgcgtggctgtggctgaatcgcggggtgaccccttcgaccaaacgggttgccggaacctaccagacgcctaccatttttgttcacggctttggtggcggctatggttctgaaaaggacatgattaacgatctcagcaaacatcccggattccgccaagtcctacgatatacggtgaccaacaccggacagcttagtgttagtgggtcgtggtcgccaagtattcggcatccattaatcgcggtggtgtttagtagtggccggccagatgcaccgacactggataagattctaaaacaagtcaagaagcgatatggcgttaaggcctttaatgcagtcggtcattctgcgggttcgacggcttgggcagaatggtccctcatgccggataaaaaagggacgccggcattggagaaactcattacgattgccggacctttcaatggctttccggggatgggcggcatgaatagtggtcttgatattaagctggccagcgatggccgaccgagtacaatgtcggatcggtacaaaccgatgtacgagcatcgccagtattttcccaaaacagccgcggttttgaacttgtatggaaatctaggcaaaggctcagatggccgggtgccggttaactcagcccggtcattgcgatatctggtagcagatcgtgccaaaagttataccgagcgcgagattaccaacagcaaggcgcaacacagtaaattacacgagcataatccactggtgaatcggtacttgtatgagttcttaagtacggggaagattaaccattaaggatcgccagcacaaacaaaaaacctcatcacaagaaaattcgcggtgaggtttttatttgcagtttggtagttcctaaaagcctaattggccaaaaggtattttacgcatcaaactggtggatgagtttttgaaattcagggtcgtcttttaaatagtccagttcaggatcagcagcaaagctttgggctaattgtttttgggcttctgtaagtgatgcgattggctgaagcttaggtaaatgctttagaactgccggtatttttcgatcaatcttgtcgatggacttttgaagtatggcgatggcttctttaggtttgttggcagcttttgcgagtcgtagttgtgaatcaattgcccagggactgtacatattgaaaacagcatcaaacttgaggagtgtatcgacataaagctgagccgtggccagttggtgatcggcgatggcaacttgagttaacaaattgaggacaatggtaagggcggagaaatcgcttgtaagcagctgttcgccatcaacataagctttgtcaaactgtccttggctcaactggagtttaagcttcagcgcctgataagcaacggtttcggatggtagattttgaagctgcttttccgccgcatcgaattcgtgctcgcttaaaaagaattggaataacccttccgctgcgatctgagcttctggcaaacttgaatgcggtcgttcacttgcttggtaaagttgaataattcgctcccgaactgctggccactcatttgtcgggatgtcagattttaaaccttgaagaaacgctggtaccatcatttgcagctgcggtacagacggatattcgcgtagttcttcatcaaccaaagcaactgccgccttccagccatccttttgggccgttgcggttagtttcgtatagaaacgacgcagtgcagctggatctaagtcagccgaaaagtccaacaacgtattcacatccgtgttgagattgcgtgcgagaatcggcagcaacgtgatatcaggataagaaatacctttttcccatttactaacagccggcgacgtgacaccaactttttgcgccagcgcttcctgagttaagcctgctgccaggcgtttagtgcgaataatctgatttaaatgcatgatgatcaccccttttgatcaccttcattatgatggtgcttcttagtgaagacaatggcggcgttttcaagttgctggcaaattttttaactgatggttaagttgaaaatcattaccatacttgttcgatcgccatgacgactaaaagcaaaccgaggagcggacgtaagatggcggtcaacttacgcgggtcaaagcgattgaggatgcggggtgtgattgcggcaccaaccagcgagccgagcatcaggaggccgccgactgtccacgcaatttttccttgagtggcgtgcagaaagcaaccgatgatggataaagctactaaagcataagatgaggttgcagcggcatgcggcatatccaaacccatcaacatcaaaccagccataatcgggccgccaccacttagtccggcaacgccaaccattaagccgctaatcataccaagcacataggcgaaccatgccggctgggtggtcttctttgctttacgcccaaaggattggcgcaacatttgaacgccaagaaccatgaaaataatcgcaatcgaccatgaataaaccagttccggtatgtaaggtgcggccagactaccgacaaccgttgctggtactgccgtcagcagaatccggttgccggcgtgaaaacgcatattgccagtgcgatagtgactataacaccccaccgccaacgccggaatcgccgtaaacagcgatgtcgccgccgcagtactcggtgaaagatgcgcaacgccggtcataataccaagataaaaagcaccgccgccaccacccatggtcataataaatgccccgaccaaaaagccgagaagcactaagataattgtcattataaaaattctcctaaactaaagtgagtgtgagccagcccggtttttgcgctgaagaacgcactatattgaaatgcgagccatcctctataccgaacctgcgcagtcacgtttactcacgattaatataaccgaaaaccataaaaatatttgcatcaagtatccttatcttacctcatttcacaaatagttttcatcgcaacccgcaatccaaaagcagaattttcaccaatcaagccgaaattcaatgttgttactgaaaataatccggcctatcatgaaactataacgcaattgccagcagggtttgctaacgggccggcagtcgtatacagaagggtcgatcatgacaaaaacaaccattgaagcaaaagaacagaatactcgccacgccttattcgtcatcaccattgtcgccttaatgtcgttttttggcgttttgacggaaacttcgatgaatgtcacatttccaacgctgatgcatgactttcatgtgtcgttgacaaccgtgcagtgggtgacatccggttatttgttagcggccgctttggtcatgcttagttcagcgtacatgaaacgccgctttaccaatcgccaattgtttatcaccgcggcattgctttttattattggcgatttgatgtgtgctttggcgccggtattctgggtgttgctgattggtcggctggtgcaggcagggtgtgttggcttgtgcggaccgctgatggtgaatattattttggacacggtgccgaccagcaagttagggacgtatatgggcgttgctaatttaatcattctcatcggaccggctttggggccaacttttggcggtgcagttgctaacttttttgactggcgcatgattttctggagtacgctgccgtttgccttattgttattaattttaggacaagggcggattaagcagtacacgcatacttccgcattcgcgtttgactggttgcggtttgctgcgttaggggtggcgctgatcagtctgacggtcggcttgaatggggtgagtgatcgaacgtgggcgctggccggtgtggctggtcttgtggtggtggttgccatgctggttttcctttggctgtcaaaacatcacgccaaagctctgtttaagctggatgttttccatgacgcaggcttcctgtatagctttttgccttacatcttattgcagttttccaatgtcggcattaacttcttgctgcctaattacgtgcaaaccgtggatggggccagcgcgtttgtcggtgggttaatcttgttgcctggcagtgtgtttaatggacttggtcagcctgtatatgggtggatgctggatcattttggcggacggctgccacttttgttaggcaatagtttgtttacactgggcatgttgggctttacgatttgggggcggcatattagcgtgctatgggtcacggtgctgtacctgatttttgccattggccgctcgatggcatttggtaacagcacggcttatggactgaaggtgatggcacatcagtatcaaagcgacgccaatgcgctgtatagtaccggccaacaagttaccggttcaattggcaccacggtgttggccggcatgatgaccgccgtcaccgttccgggtttaacccacgcccaaaacgtcgggatcggcagtcagctggcatttggcttgttgcttctgattgggttggttaattttgggttgtatctgcgactctttaaagctactaaaagtcaggattagttagacagggaaaaactcaggcaactcgctagcttttgtgcggtagcggcgtgcctgagttttttgtgggtgacttgatttacatggtttgaatacgggcattcgatgcaaaactgataataatcagagactaaaccgactttcctatcaatcaggtaaaaacccatgctcgataattttcagctgacgatccatctggtccacgacaacctgtaaatcatcaaagttgcggtaatggccggttgcaatcatccgggtggtggtagccgtttgctgggcaatgacggcggaaaccacactaaaaatgtcagcaaccgaaacaccgtcccggcgcgggagttgctcgattttttggcggaaaatacggttggcttcagccgaaattgcctgggtttcttgctggatttgttgctgtaagggtttaggaaaatgcgataagtcggcataagcctgcatcataaggcgatactcgtccggaaatttcagctgcagttgcatctcgtatttaacggcttgcgtcatcatcgctgccagtcctggtgcgtcctgccatttatgggggttcatatgatcataaatacgatgatacgcggttttaaaagtatctagataaaggtcttgtttgttaccgaagtagtggaagataagccccttagaaacacctgccgttgcggcaatatcatcggttttggttttagcaaagccttgttggccaaaagcggtggtagccgttgcgagaattcgggtgactttttgcggatcattgacgacatttttcatacgctcaagtcctgtctgcggtaaccggccattcccaatataactaggataatggcgctaatgagcatcacgggcagccatggttgggccagcgttttgagtgggacatcggcaatccagccaaatggcgtaaagtcggcggcgtgtttgggcaaatcgaataagccgcggaagacttgcacaatcagcccggcgcccatatacaaccagaaaagattgctcaggcgcggccataaaccagacagggcgatgcctaacgcaatgaaagccaagacagccggaatgccaccaataaagagtcgaccaaggtacttcgctggcagcggatgactcagcacctgattgccggtgaaaaacaaggcgagtaagccaactgtcagcaccaaaacgccggctaacaaggccatgccattgtaactggcgctgattaaaatgcgggttggcttttcggcgtgaatgatgctgagatagccgtgctgatcgtcatgtttgagtcgaaaggcaatctgaacgcccgctgtcaccgccaaggccacaaaaatgcccatgtacatcgccaaaaacgaaagcaccatggtttgattggcagcgttaatttggctgacatccaaaagttttcgataaattggattggttttcagaatatcacctacgccaccgagcacgctgcccatcacgccgccaaaaacaacggccccgactaaccagccagccaacaagccgcgttcggtgcgccagactaaagcaggcatggagcgcagccagtttgccgctcgcggacggccaccgttttcagcaatgatccccgtgccaagatcccgtgtttgggcgatcatgacggccacgcctgcaagcagtgcgctgacgataagccctaaaagcaggggtacagggttgttgtcggtataaaagttggctttttcaaaccagccgattggtgaaagccaggtcagctgttgatggttgatatcggtgactagccgcatgagataagcaatcatgagtaccatataactcagcatgctggcggtacgactgttattggcaagctgggaaaatagcagtgcaatcgtgccgaagacaaaattggcaacgaccattcctaaagcaaatagcaagtcgcctgcaagggtcgcaccatccattttaatggcgaccaagctgatcaagtaggtgagtcccataacgagactgctaaaaatcaattcgaaaatagccgcagtgacagcggcggtgcggccaacattgcgtgcacgcaccatttccagcaacccgctttcttcttgcccccgcgtgtcgcgaatcatcagcggcatgacccacaatgcttgcagaatgatcatgaacacaaccataacgccagcaaagataatagccgagttataggtgacaacttttggcgtggcaccaaacatcgccgccatgcctggtgcttgcagcattttgacgatatccttcgccccagctgtgccgtttgcaaaagctgcttccaatttggcagctccactgatgatcatcatgatgaggatcacaagccaaatgccagaaaatttgaagttttgtttcaaattagcctggaataggtaaccagcatggcgattattgtgccgcatgatcagcaccttctttttcgtaatagcgcataaagagatcttccaaagttggcggcgtgacttgcaaatccaggatcgcatggctagctaaggtttgcatgatcgcacttaggtcatcgcgatcagcagtgaaaatggccttcgtgtgctgtctctctggaaaggtcagctcatgaataccggttgattgggtcaaactatccaaagccgttgtcgacgtgacttcaacgcgtaaacgcgataaatgctgcatttgggcgagattgccactttcaatcacgctgccgtcacgaataatcacaatcgagtcacacattcgttccacttctgacagaatgtgactggagagcaaaacactttttcccgcctgcttgagtttaagcacttcttgttgaaaagtttgctcattcaacggatccagtcctgacgttggctcatcgaaaatgtaaagatcagcgtcttgtgacaaagcggcgatgatcgcaactttttggcggttaccttttgagtaggtacgggcttttttcttcggatcaaattcgaatcgttgcatcagttcatcggttttttgattatgagtccgcccgtttaagcggagtaacaagtcaatgatttcgccgccggacaaattcggccacagataaacatcgcccgggatgtaagcaattcgcggatgaatcgcagcatcatcatgccaagcgtccttgccaaatacggttaccgagccgctggttttctttagtaaccccaaaataatccgaatcgttgtcgacttgccagcaccattcggccctaaaaagcctaaaacctggcctgacgccaacgtaaaactgacatcttttaaagcctcaaacttaccaaatcttttttgaatatggtcaagttcgataacatttgttgtcatgactaacctcctaagtaaagtgagcgtgagtcagcgcgtgtttctacggtatggtgcgtgcggataccaagtcgttgaacgaaccgagagccgatgttttcgttacagtagtcaatcatcgctcatttcaaccgaagtatagtcgccattgacccatcagtcaacaagaaattgactggtgggtcaataattcttcatctattttaaatgctcgacagaagacacaaaaataaccgcttgatcaacgcttcaagcggttagtattgttaacaatacaggtatggaccaaaaagaaaaacaaacggttagctttcagggaagaagccttgatgacgcatcacatcaaataaatcagcgcgttttgccggcgtatagcttccggcactcactgcgaggtcggtgtaggtctccttacgatgggaaccatgacgggtggcgtaataattatgcactgtttgatcatagtcgctcagtacatctgcttttggcgccggttcaccataatgattggtgaaagcaaccagcgactgaggcatgcgcggcttttcgtctggctggtcagctggcaagcccactgctaagcctaacaatggaaatgtgtacttcggcagatgcaataaatcaatcatggcttgggcatcattttgaatactgcctagtgtgacggttccaagacccaggctttcagcggccaccaccatattttgcagtgccaaggtagcatcggcgcttgcctggagaaacttgtccatccgcccaacgcgatcaagcgggtgattggcagcggcggtcaaggtggcaacgcgattcaaatcagcaataaaaataaataattccccaggaccgtttaaatagccttgtgtgctaatttcggcaattttagcccggatttgcggatcgagaatatgaataaccgaaaacagctgcagatacatggaacttgccgtatgctgagcgacatcaagcaatgtgcggatcgtttgctggctaagctgttccggtttaaattgccgaatcgagcggtggtgaagctggtgccggatggtttcattagggatcaaaatagtcactccttcagttggaacgtatgccatctattgtagctgaatttgcggcctagaaaacccgttggcgcgaattctcgtaccgacacgcgatacacgcaacggttagtctggatggcggcgttgataaaaccggtaaacaagtcctccaatcgcgagtgaaaagagcacaagcccaatgataacgacccatttccacggacctaagttgactttagctgttagaaaaggcttggtttgtggaagacgaagaagcaatcctaaaacgaagtaaaacgcaacataaagatagaagaaaatgttgaactcatttagatgctggacgaatgggaaaataacgataatgactaaacctaagacaataaccgcgagtgatacttgggagggaagcgtgatccgccagccggttttaacaaaaattgacacgaaaaacataacagcaaagacaataatgctaaaaacgattaaactaaaaatttgaatacgagtgtgttttgcaaaagcagaaccacctaaaagccaaacaaaacaccagctgccaataattgcaatgacgccgcaaagaaatgtcatcccgatatcaagggtcatgaccgggttagctagcttcggaatccacaaaataaaaaacatcatgaaaaccagttttaaattaaaccagaagaagtcagcgagattgaacggaatcgtcttcagcaaatcattggccgttgcttccggattctggccaaaataagcagcagcctcaaccccatccgcctgagcatcaattaagtcctgcaaaatagttaacaagttttgctcgacttgataatcatcgcgtaagaaagattttcctcttaagtaagtcagcagattctcgtaatagtcacggttttccttagttaactgtttacgtagttcattgttctccgcaaccatctttttgactgcttgtttccgttttttcatcgtcaaggcctcctcgtataagtgcgcgtgaactggcgcggtcagaagtcgaagtgtaagtagccttagccgcagacttctgcgtcagtgaacgcgttatggagcgtgaactagcgcgattgtaacctgttctattcttccggttgatcggcaataagctgttcgacatgatccttaagttccgaccattgcaccataaaagtctggcgggcagtttctcccaaaggcgtcacggcatagtatttacgctgcgggccatccggtgacgggcgcatatggctgactagcaggccttttttctccatcgtcatcaatagtgggtagatggtgcctttggggacgtcgccaaatccgaaaagatcaagcgattcactgatggcataaccgtattgttcttttcgcgccagtaaaataagcaagcacccttgtaaaattccttttagcatctgactgttcgcgtcggctgccacgtgcatcgctccctttcgactagcatgttttacatactagtagtttaaaccgacttaactagtttgtaaaccataatagtggaaaagagacaactggcccagtctgtctgctaaattaaataattataaaagatgtaatatctgcacgcataacaaggatataaaagcttatttgcctcaaaaagcaatggcgcgatataattaatgaataatgaaggtgtgtgatgatgaatgaaaatcgggatgattggtgcaggtgatgttggtcaggttttgacgcagctttttgtgcgggcggggaataccgtcatgctggctcatcgcggttcggtggatgcattagatgatttggcacgcgttttgggggcagcagcaggtacagttgagcaggcagaggcgcaggatttagtcgtgttggcggtgccgttttttgcgatcaaagcgttaccgttaccaaccggaaatgatccgattattgtggatgcaaccaattactttccggatcgggatgaacggattcccgagattgaatgtcatcaaaaagcaacgtcacaaatggtcgcggaacattttcattcacaccgcgttgtcaaagcctttaattcaattgaaatggcggtatttgcacagctggcacgtcccaatcggtcggtggatcgcattgcgctgccttatgccggtgacgatcctcaggctaagaagcaagtggcggcgttaatctgggcaattggttttgagccgtttgacttaggtgatttgggcgctagtttggcggcgcaggctgacgggtcgctttttttagtcaacgaaacagcaccggttttgcgacagcatctgcatcaaagttagcaacctagatttttgcgacgggcttgactggttttgacatattgaaccagacttcaccggcatgggtggaagctgcaagaccgtcattatgaaagccgacatgctcataaaaagggataaggcgtgataggcaggttaaagtgagcgcagtgcgtttttgcaattgagcaacttgagtcagcttagctagtagttgacggccgatcccatggtgttgcatgtttggggccacggctaagctgagaatcgcaaggtaaggggcagcgggctgattaggctgactatccgtaaaaagatcatctgtgattgtaggcttgaaagtggctggacccacaacataacccacaatggtatttgcaacccgggcgacaataaaggtatcgggatagttcgtaatgcgcgccgccatgctgatacggctggccgcttcttgcggggtgaatccggcatgttcaattcgcatgattgcatcaagatcggacatgcgtgcagcggaaaaattaagtttcaaggtgatccttcctttagtctcattggattttgtgaaaatggggtatatagcaatggagaaacaacttgtgaagatcagtaagcttctcagttttattttacgccatcatccggaaagactcggcttaaaacttgatgcatatggccgcgtggatctggacaccttgatccaacggtttaacgcgcattatcaagtgcatttagatcgacaggtactggctgccatgatgcgtcaaagcgataagcggcgattcgcgcttgaagataataggattcgggcagtatatggtcatagtgttccggttttaccgctaatgcccgccagcaaaccacctacttggttgtatcatgggacttcccatcaggcggccatcatgattgaaagtgaggggttgcggccgatgaatcgtgattttgtccatctgtctagtgatcttgacatggctaaacaagtcgggtcgcgccatgatgcgcacccggttatttttcgaattgacgcattagcagcattcacggcgggcgcacttttttaccccactggtagtcgggtttggctaactggaaaaattttaccaaagttcctaacccgaatgcccacatcgggttgaccgagaatgaacgttttttctcaagaagcgttctttttttatgttagtattaggcatacttaagaaaaggggggttatattatgaaggctgattcgccggatgatttacggttaaatccgaaacagttcgctaatcttgttgttggttcacaccaggtacccgatgacaaagatccggaaacaattgttaaacggaagctaacactttatctgaccgcttactacttagcagagcggtttaacgagcttcaggaagaaacactgagtcatagtccatcgcgcgaaaatttcaaccagttattgaaaaagttggaagaagaacgcttccaggactggtagactgatacagaattttgtttctgtattagtcgaatgtgaactatgtaacaattattatagcctcttttcaaactaatctgcacacctttgctaaagtgccctcattgacttaaaagcgaattttaagccaatgagggcgctttctttttggggaaatttatttttgcggtcaaacgacgattgttcttttcgtgttctaaacgggcaaaaaccgccatttagtgacgaatatcacgtaatatgagggcagcgataaaaacttatgaaaagaggttgggactatgttactcaccgtcattgcttatgccatgatcattgtcttcatgtacgtcatcatgactaagaaactttcaccgtttacttccttggttatgatcccgctattatttgcgattattgcaatggtggctggcgtggcaaagaaaggaacgataggcgatttcgtgttaaaaggtctgacgacgactgctaacaccgggatcatgctcttattcgccattctttatttctccattatgcttgacgccggtttgtttgatccgattacggcacgcatgatcaagattgcaaaaggcgacccaatgaaagtgctgatggcaaccgcaattgttgcgatggccgtttcactcaacggggacggcacgaccactactttgatttgttgctcggcatttattccgatttataagaagctcaacatgaatatgatgaacctgggtgttttgattattctgcaaaataccatcatgaacctgttgccttggggtgggccaactgcacgggcaatggcagttttaaaagttgatgcggatattttgacctacctgttgccagggatgattttggcactggcttatgtgatcttctatgtggcaccgcacatgggtcgcgcagaacggaaacgcttgggagttcgggaattaaccgatgaagaaattgacgaaatgacatcggtagtggatccggaagtttctgaaattcgccgcccgaatatgttcctgtttaacggtattttgacgattgttctgattgcctggttggtggcaagttcctttattaaagccattgcaatgccgccattgttgctgttcttggtcggaacctgtatcgcattgatggcaaactatcctaagttaggcgaccaaagcaagcggatcggcgctaatggtggcgatgccgtgcaagtggttattctggtgtttgcagccggggtcttcatgggtctgttccaaggaaccgggatggcagaagcgttggctaagagctttaccgcgatcattccaaattccatggctggcttctgggggctcgtgatcgcattgatttcggcgccagggacattcttcttaagtaacgatggtttttacttcggcgttatgccggttttggcaactgccggccgtgcctatgggtttactaacatgcaaatggcattggcttcattaatgggtcaggcattccacttactgtcgccattggttgccttcatctacctcttactgcggctaaccggtttggatatgggtaagtggcaacgcgaagccggaaaatatgcattaggcgtgtttgcaatttttgtggtgacggttatgctctttggccacgtgccattttacctgccgcaaaaatagcatttaaccgaaaaaagacaccgaaaagccaattgtgattggcttttccccgtatgatagatctatcaaagttatgcgggttgcgctatttaataacgcgcgttcgcaagcgggctgactcacgctcactttaacgcgttcatcagcgcagaagtctgcgtgtaaggaccttagccgcaatggccaaagcccagccatcacgtctaaggccacttacactccgacttctacccgcgctgactcacgctcaccataacgcgttcatcagcgcagaagtctgcgtgtaaggaccttagccgcaatggccaaagcccggccatcacgtctaaggccacttacactccgacttctacccgcgctgactcacgctcactttaagagaagaggtgatgttatgtttggatggttgcatcgtaaaaagcagccgccgcagacaccggttgaaccgacaacgaagaaagtagcggctccggtcgaaacaacacaatgggaaacggtgccgaactttttggaggttgatcctaaaaccgagttaactgccagcctaattgccgcggcggttactgcggattcggcacctgatgcaaagctggtgttgaaacatctgtacgttgaaaatcccgaagctaagcgtgtgggtttaattgccagtgcgattgctgctggtgatggcgatgctcagtacgtggtcaagtcaattaagaaaaaggtggactgaagaagatgttgagaaagttcaagataacgatcgatgggaaaacctatttggtcgaaatggaagaaatcggcgggacaccggctgccgcggctccgacgccagcaccggctgcggcaccaacacctgcagctgaaacaccagcgccggcaccggcagcaccaacacccgccccagcaacgccggcagcggcaagcggagaaggtgaagtggtcacggcaccgatgccaggcacggttaccaaggttttggttaaaagtggtgatgcagtcaccgaaaaccaacccttgatgatattagaagcgatgaaaatggaaaacgaaatcgtcgcgcctaaagccgggacggtgggcgatattatcgcaacgctaaatcaaagtgtcaattccggtgacggtcttattagcattatttagggaggaggaagcttatggaagcgctcattcacggaatcaccactatcacattaggtcaaatcgcgatgatgttgatcggtgcactcctgatgtatctgggaatcaagaaagaatatgaaccgaccttattggttccgatgggactgggcgccattttggtgaattttcccggaaccggcgttttaacgcaagttgtcggcggcaccaaggcagaaggggtgctggatgttttattcaaggccggcattaacaccgaacttttcccattgctgattttcattgggattggcgccatgattgattttggcccgttattacaaaatccgtttatgctgcttttcggagcggcggcacagtttggtattttcgctaccgtttttgttgcagtattcttcggcttcaacattaaagaggctgcttcaatcgggatcatcggggctgccgatggtccgacatccatttttgtttcaaaccagttggcgccgaatctgttgggggccatcacagtggcggcttattcgtacatggcattggtgccgattattcaacccatggccatcaaagcagtcacaaccaagcatgaacgccgcattcggatgacgtataaggcagaaggcgtgtccaagacgactaaaattctgtttccgattatcatcaccgtcatcgctggcttcattgcaccgatttcactgccattggttggtttcctgatgtttggcaatctgctgcgggaatgtggcgtgttggatcggctttccaacacagcgcagaatgaattggtcaacatcgtctccattctcttgggcttaaccatttccgttaaattgcaggcagatcagttcttaaatattcaaacattgatgattattgcgtttggtttgtttgccttcattatggattcggttggcggcgttctttttgctaagctgttgaatcttttccgaaaagaaaaaatcaatccaatgatcggtgcggccggtatttcagcctttccgatgtcgagtcgcgtgattcagaaaatggccactgacgaagatccgcagaactttgtcttaatgtatgcagtcggtgccaatgtttctggtcaaattggctcagtgattgctggtgggctattgttgtcattctttggcgcttgatgtggtttgtaagtgcggaagtcaacccgcaccagctcacgctcactttactaggaggtttttaccatgaagtttgatcccacagcagttgaacaggctggtgaattgatgttggtcggtatgggcggcgtgtttatcgttttgttcattatctacattgtggccaaattattgcttaagtttgcgccagccgataaagcggcgaagtaagatggcaacgttaaaacgtatttggtttgacctgaatccgcaagaaaaaacagcttggcaaacgcttttacgtgcggctgaattgacgccggatgaacacgttgattttacagttggtattttcgaagatggtgcgttattagcaaccggttcattagctggcaacatcattaaagaggttgcggtgtcaccagatgctcagcatgaaaatctattggcacagattattcaggcactgttggatcggctggatgatgaggcgatcacgcatagttttgtctataccaagccaagcacgaaaaagttttttgaatcgttaggctttaagcagttagtggcaacagacacggtggttttgctcgaacgtggttatcctaattttgctgactacacggcattgttggagcagcatcagcactcaggacagccggttgcggcaattgtgatgaacgctaatccggttacccgcggtcatgcgtatctgattgagcaggcagctagggacaatgccgtggtttacgtctttgtgctgtcagccgaacgctcgcttttcaccgctgccgaacgcttgggcctcgtaaaaaaaatcgcctcacgctgggcgaatgtcgtggtgttgccaaccgctgattacatggtgtcgaataccacgtttccgagttattttctcaaggatcaggcggatgcggcaattgcgtctgctcaagccggattggatgctgcgctttttaaacagcgaattgcccccattttagacattacccggcgttatgtcggtgaagagccattgtcacccgtgaccgctatttacaatcgccaattagccgccacttttggtgacactatcgaactgattgttgttccgcgcttgcagattgctggcgaagttgtcagtgccacgcgggttcgggcggcgattgcacaacaggattggaaaacggtgcaacaactcgtttatccagaggtttatacagaaataaaggagcgatcaacccatgaaaattaatcatcccggtacggctgggacactggagtcaagtgatattcaaatcacgcttgcaccagccgctgacggtatcacgattcagttgcaaagcagtgttgaaaagcaatttggcgaacaaattcgcgcggtcatcaaagcaacacttgcaaaactggcgatcgaaaacgttgcggttgaagccaatgacaaaggtgcactggattgtacgatcaaagcacgtaccattgcggcggcttaccgtgctgccgataacaagacatttgactgggaggagatcaacgcatggataaattaagaagaaccatgatgtttgttccgggcgctaatccgggcatgctccgtgatgcgccgatttatggggcagacgccatcatgtttgaccttgaagatgcggtttcgttaaaagaaaaagataccgcgcgaatgctggtctattctgcattgaaaacttttgattacagtagtgttgaaaccgttgtccgggtgaatgccttggatgcaggcggcgatcaggatgttgaggcaatggtgcttggcggtatcaatgtgattcggctgccaaaaaccgaaacggcgcaggacattattgacgtggatgcggtcattacggcagttgaagcaaaatacggtatcaaaaacggcacgacccatatgatggccgccatcgaatcggcagaaggggtattgaatgcccgggaaattgcccaggcatccccacgaatgatcgggattgcacttggcgccgaagactatctaaccagtcagcatacccatcgttccgctgacggagccgagttgtcatttgcccgcaacttcattttgcatgctgcccgtgaagccggcatttccgcaatcgacacggtttacacgcaggttgacaacgaagaaggtctgcgtcatgaaaccgagctgattaagcaactcggctttgatggtaaatccgtgattaatccgcggcagattccggtcattaacagtgtgtttgcgcctgctttggctgaggttcaaaaggctcgggaaattgttgccggactaaaagaagcagaagcaaaaggggccggcgtggtttcggtcaatggtcagatggttgacaagccagtggtagagcgtgctcaatatacgattgcgctcgctaaggcgtcaggaatggaggtagactgatggtcaagaataagcttaatcgtgaaatctcggagccatatgccgatcaatatggcgtttacggtggcgagtttgccaatattcaaccttatgatgaacatgcgcgccacattaaacccgtcaagcctgatcacagtaaactagtggcgtcaattcatgatgccattgtcgcaaccggcctaaaagacgggatgaccatttcatttcaccatcatttccgcgaaggtgactatgtgatgaacatggtactggctgaaatcgctaaaatggggatcaaaaacctgtcgattgcacctagttcaattgccaatgtccatgaaccgttgattgaacacattaaaaatggcgtggtcaccaacatcaccagttccggtttgcgggataaagtcggcgcggctatttccagcgggatcatgaagaatccggtcgtcattcgttctcatggcggacgggctcgtgctattgctcgtggcgatattcatatcgatgtggcgttcttgggcgcaccaagtagtgacgaatacggcaatattaacggtaccaaaggcaaagcgacttgtggttccttaggttatgccatgattgatgccaagtatgccgatcaagtggttgccattaccgacagcctaatgccatatcccaacacgccgatcagtattccccaaacagatgtcgactatgtggtccaagtagatgcgattggcgacccaaccggtattgccaaaggtgccacccgctttacgaagaaccctaaggaattaaagattgccgaatatgcagctgaagtgatcacgaaatctgcctacttcaaaaatggcttttccttccaaaccggtacaggcggctcttcgttggccgtagcccgcttcttgcgtgaggcgatgttgcagcaacatatcaaagcaagttttgccttgggcgggattaccaactccatggttgaattgttgaaagaaggactcgttgagaaggtaattgatgtgcaggatttcgatcacccatccgcagtctcccttggtgaaaatgctgatcactatgaaattgatgccaacatgtatgcgtcaccgttgagcaaaggcgcggtcattaatcagcttgatatcgctattttgtcagcgttggaaatcgacacggactttaacgtcaatgtgattaccggttccgatggcgtgatccgtggcgcatccggtggccacagtgacacgagtgccgcctgcaagatgagcatggtcattgcgccgctggttcgtggacgcatcccaacgattgtcgaaaatgtgaataccgttgtgactccgggagccagtgttgatgttgttgtgacggaagtgggcgtggccattaacccggcccggtcagatctgattgaaatgtttaaggatttgaaggtgccacaattttcgattgaagcactcaaaaacatggcttatcaaatcacaggcacacctgcacctattcaatatggcgacaaggtagttgctttgattgaatatcgtgatggtaccttaatcgatgtggtgcacaatgtttaaattgtcagttttggatggcccccaagttgacttagggcaaatgttggctgccaaagacgcgcgtatgaccaaggagtatgactggttaaaggcaaatccggacacgacgctattacacgtgacgttgcggattccgggaccggtcaaaaccggaaaacgcgtcgttacagtgtttacagctgcgatgcaagccttgcaggatcaattacaaccaaacgtgcaaggcatgcaaatcgaatcgttaccaactggccctgaagcttacttggcggtgcacatggacccggttagtttaaagcgccgaatgatcggatttgaacagcaacaacgcttttgtgacttactggatttggatgtggtcacgttgcaaggtgaagaactgcatcaggtttcgcgcaccgattttaagttacctccgcgagcctgcttggtttgtggcggggacgccaaagcctgtgcgcgctcacgtcgacacggattgcctgaggttcaagcggcagttgaagcaatcataaaggagggttggaccacacatggctaaacaaaaagtccaattcatggaaacagttttgcgtgatggtcagcaaagcctgatcgctacccggatgccatcaagcgatattttgccaattttggataaaatggatgcggccggctaccacgcattggagatgtggggtggcgctacgtttgatgcttgcttgcgttatttaaacgaagacccgtgggagcgactgcggaaaattcgtcaagccgtcaagcacactaagttgcagatgttgctgcgtggccaaaacttgcttggttataagaactatgctgatgatgtcgtcgccgattttgtcacgaaatcagttgaaaacggtattgacatcattcgtatttttgatgcgttaaatgatacacgtaatttgaaaaccgcactggaagctaccaagcaagcgggtggccacgcacagctggcgattagttataccaccagtgatttccatacgattgactatttcatcaagctggcaaaagaaatggcagacatgggcgctgactccattgccattaaagacatggccggcattttaaccccgcagaaagcctttgatcttgtaagcggcattaagcaggaaattacggttccgctagaggtccatacgcatgcgactgcgggaatggctgaaatgacgtatcttgaggcagtgcgcgcaggtgctgatattattgatacggcggtttccccatttgctggcggtaccagtcagccggcaaccgaatcaatgctcgtagctttgcaggacttaggctacccgactgatgtcaaactagccgaagtcagtgacattgccagctattttgcaccgattcgcgatcaattccgtgatgccgggcagctaaatccccgcgttaaagatgttgaaccaaagtcactgatttaccaagtgccaggcgggatgctttctaacttgttggcgcaattgaaagatcaggggcaagaggccttatatggggatgttttaaaagaagtgccccgcgttcgggctgacttgggttatccgccgttggttaccccattgtcacaaatggttggtacgcaaagcttgatgaatgtgatgagcggagagcggtataagctgatccctaaagaaatcaaagactatgttcgcggactttatggtcggccgcctgtgccaatttcccctgagatgaaaaagaaaattattggtgacgcgccggttatcaccacgcgaccggcagacctgattgagccgcaactaccgacatttcgtaaagctattgccgaatatgcccattcagaagaagatgtcttgagttatgcgctcttccctgatcaggcaaaagactttttaggccggcgtgaagatccgttttatgatgtgccggttcaaaaagtttcactgacatttgatcctactcataattaaggcacatgatcctttcgccccctaatcaattaacgtgccgccgtgagttggtaggctagcacaatttgagctgttgacaaatttgtcggcagctttttaagtgagcgtgagccagcatgttttaagtggtgagacacgttaaggtataatattgggttaggtgaggggggacaatcgatgaatcaagtggtgtcagcggttaagaaaaatttggatttatcacagaaccggccaattaaagaagcgatttacgaagcgctgcgcaagacgatccttttgggcgaaatacccagcggtgagcggattaacgagaagaatctttccgaaaatctaaatatcagcagaacgccaattcgctatgcacttgagcgtttggatgaagaagatctggttgaacgcaaaacgggtgttggtgtacttgtcaaaggtatttcaattaacgatgcctatgaaatttttgacattcgcaaggaattggatgtgttggccacgcgtaaggccatgcgtctgatgacccctgagcaattcaatcagatgcggactcttttggaagaaacggatcgtttgaacgcagccggtcgtgttgccgaagtgatggctaagtttactgaattcaataattttatttatgatgccagtcatatgttgcggctgaaaatgatcgtcaaccagctgcagaattatttgatttattttcgtgatatcagtattaatggcgatgatcggcgcaatcttgccattcaggaacattggctgctttatcgggggatgttgaatcaagatgacgatcaaattaagctcattacgcgcgagcacttagagcattccctgcactatattctgaaagttatgaaggcaaaacatattgaatgaacaagcaattgcacaagcggcagttaccagtttacaagcagaagttcagttggcgcctaaacccggcttggtcgaccctgaatcaaatggtgcacaccgcgacatggatgtgacgacctttgcagctagcattgaagctttgacgccttattttcagcaatattttcatgccggcgtcgttgctaaaacggtacctgatctttatcgccaattacgcgccattgggattgcagcagaaaatgccatgctcgccgctactgctggtgttaatacgcatcgaggggctaacttctcctttggttttttattgggtgcattgggctggctcatgcagcaacaatccctgcagcaaatagtcaccgctgactttgcgccgctattcccgactgtggctcaagtgacgcaaggtgtggctggtgattttcgggatttggagaaaaaagcccgctggagccatggcgaagcgttatatgtcaaacacggcgttactggggttcgaggtgaggctttggccggttatccgactatccggcatgtgatcttgccatatttacgcaagactgccagacgcggggatatgcgctatttacgattaatggtgcacttgatggcgcaagttgaagatgccaatgtcctccatcgcggcgggccaaagggattacgattcgtgcaagatgcggctaaaacattgttgcatgtcccggattcacacttgccccatgccttgcgtcagttaaatgctgagatgatcacgtttaatcttagtccgggtggtacggccgattatctgagtctagcttacttttttgatgcgctgacgagcttggcaacaactaattcccaaccagactagttgaaacgctttaaggtggagaagttgagctataacttgaatctttggaataaaggtgtactatttttcgagttcaatgaaaaatactacgccctttgattttttgttgagatataaggaattataagttataaggctcatgcagtccttgtgccgcttgaagttaatcgctttcaattcggtcaaacttccggtagaattaaggtttgaagaagaatatagttcaagcgacttctttgacggacatcaaaattgggtcaaattcttgtggcagtttagatgcggcacaaattaatcgtaaagttaagacagaaaaaagctcaagagcaagtgcctcgacttgctcttgagctttttgccttgtaactgatcgatcacaacaaaattactggaagcaattatatggaccgcggtttcttgtccatgaattgttcaagcatttttcaaacttatcatcgaaaggagttctcggcccgcgttgataaggagggacttttcccattccgttaacccagtttaaagtccctggattataagaatcaccaccaacgatttgctccaattcccctacatccagaactgccaagctgtcttttcccaaataatccatcccctaaagttttttgatagcgctgttattatactatgatggatactatattttcaacaaaaataaaagaaagtgttttcataacacttgttataatgatattatctggattaaggagtgattcaaaatgaatgaaaagcaagtcgttattgctaaaatgctggaattacaacatctttttgagaagcaaccagatgggatatcccaaaaagttgtctcgaatataagacaaacgatcggtaaacttgctagtaacaaaacagcagctattgatatttcagcacaagtgcggccaataagtcgtcttattagagatgaaatgttagagcataattataaccttacgctagagcagcggactctcctttttgacctagaaggcaaagcacaagatattgaaaacaaattccaaacagcagcagattggatccttttttagtgaggctgaattttaatgattccagtgccaaagcggagcaatcgtaggccagatggggatcagctgtggaaataacacagcgaccggtttttgccgctgatgttgttaggcggcttggagactgcttggctgcaggctccaagcgccgtctccgctctagcttcatctggccggagattgcggagtttggcatggcgcgtaactattttagcaactcgtgccattaaaatatttgaaatttaacaattatcatatttttgagggaaattttgcctcaactatttttcgaggcacacgctctggattaaacaggaaacggaatcagatcgatgtggcgaatcatgcggatactgatgttctggtcgccgacatggacgacatcgctatcggttacaccaccgactttaccggtgatcggcggcagcatctggccatccggtgtttgcaaatcgagctgaatggttacggattggccctcagcgtatgctcgaagcaagatcatccgaatgtaagcctgatcttgtaacgaaagcggcggataagtcagatgctcggtctgcgcctgtttttttaacgcggcggtgtggtcggagaggtaatagccttgccacttgcgcatcccgcgatcaatgtaacgattagcaaaaaaatcagccaccaaagcagcaaacttttgcttaccgattttttcttcgtaagtcatcaatctcacctcaaggaccagtttacgaacacatgtttgccgtttcaagaaaaaggttatgtttagttgaatgttacaaaacgatgacagcaaaaatcttgataagtcttaagattttcttgatttgaaatcattttgtaacatttctgcttgccgcatgttagtctgaaattgttgaaacgatccgacaagcgacaacttctgagtgggagtgattgacatgaaaaaatggatgatgattgcaacggcattcttagcacttagcggcgtttccggtgccgctttatatcaacaacatgtcagtgctaaaagcgatgtgaaaaccacaacggtaaaaacagtcacgaaaaaaacaacaaatcagccgaaagcaacgagcaagtcacaggcatcgtcaaactcagcatcaagtacagctcaaacgaccagcacgtatgagtccggcgctaccgtaaccgttaagacccctgcaacgacaaccgaaaagacgacggcaagttcagcaaccacagagactgatgctgctgccacaaccagtgatgctgcagcaacaacaacgacccaaacggcaagtcagcccacggttcaagcgccattttatgttggcacgtggcataacgaacatgtatcattgaccattacggcaactcagatgaccatttcccaaaatggtgtttcgaagacgtctcgctacacggcgacatcaaacggtaatggttatgttcttacaccaaccgatatcgaagcagacgcgatttacttagtaccagtgaccggcggcgttgaatgggttgcacccggcgccaccacaccattaattctccggccgtaagtgatgcgcataccacatagacttatcttttggagcgatcaaaaaaggcgccgcgaaagccaacttttactggcattcgcggcgcttttaaaatgacgtcaagactaatcggttgctttattcagcgccttgtcttcaaaacttgcaaaaagatggtgatcgaagaagcgttttgtttcaggtaaggcaaaactggtataatcacgtgcatggccaacgccgggtaccacgtggatggaaatgtcccgaccaaacatggcagcttgctggacaaaatgcagggcacttggtaatggcattaattcatctgccgagttgaacaataaggttggcccaagttgatcagttaaatgattggttgggttgacggcggttagtaagcgcggatccaacccgcccagatatgtctgaataaagtatttataaaaagcgtcatggatttcatgaatttcggtcaggcccagttcgttctttgcgtcaaccgatgcttttaccatttgattcttctgcacccagttggcaaaatcaactacgggcgaccatgccacaactgggtagccagtggtcagactattttgcaacaccattgtgcctcccgagctggcgcctaacaagcctactcgttcgcgatcaaattcataaggagaggcaagtagccagtttataaaatgatcaaagtcgttttgggcggtcggatatagatacttaggagctagccgaaaattgggaatagccaccagatagccggcgtccgcaagatattggcccaaatcgctttcattttctttatcgccacggaaccagccgccaccgtgtgcgtatatgacggcaccgccattagccgcgtccggtacgtaaatatcaacgggtaaatcatgggcctcatcatagatcacgtctttttccacttgcatatttgcctgttcctccttattcttatacattaaccatattctaaccatagtcccaaaagccgtttaaatgcaaatctttacatatttttgttcggttttgaaacatcagattattgggatggcgaaaggaaaagcatgcgatatacgtttgattcaaaggtgacaacggcaaccacaattaagcgctggttagccaaacaaggtgttagccacagattattcaagaaaatgttagcgaaccatttattgtggctggatggtcatcgcactggcaatactgcgattcaggctgggcagacggtgcgcttcgccatcccaacgacgatgacggtgacaccggaaaaagcctcgctcgatgttctgtatgaagatcaaaactggctgattatcaataaaccggctcatttaaccagcgttcccggccctcatgatcctcatcacagtttgttgaatcgcatcgtctggtacctgcagcagcaaaaggtaaccgaaccgcaacccgcgattatcacgcgcctggatcgcgatacagttggattggttttagccgcgaaacacccgtatgcacaagggcggtttgaccaggctcatcatgcgaccttgaaaaaagaatatctggctgtggttgccgggcacctcagtcatgctaccgagacaattgaagcacccattggtctgggaccggatggcattcatcggatggttacggaaaacggacaatcggccatcacgaagtatcaagtgctgaaagaagcggtcaacaccttggtcgaagtgcaattattaaccggtcgcacccaccagattcgagtacactttgccagccttggccatcccttaatcggtgattcactttatggccaagcgagtccgctcattgatcatcaggcattacaagcgacccgtttaagttttgtggacccattttctgaaaaaagaattcaggctgatttaccgattcctgatgactttatgaaccttttaatcagtagcaaccgatcctgattgtcataagtgcgactcatcttctatgattattgacaaaagcaagccccacaaccgctgttttcaggttagggcttatttggcactatacaacagctttcaatatggtcgttctcaccgatcaggtacaaaaagcaaaaaaatatcgcgttctatcagtaaaaaactgacagaatgcgatattggctgatgaactgcgatcagattatttaacttcggtgaagaccacgcgtttacgcaactttggtgaatacttcttgagttgcaaacgatcaggcgtgttacgcttgtttttggaagttaaatagatacgttcgccggtttcattgttacctaagatgatgttgttccgcatcttttagcacctcgctttttcataatttaacctgtcaagcatacaggattgacagactaaaatcaaggctggacgttaaaggcagcaaagggcgtgacgccatgggttcgtgcaatttccgcaacgccatcaggatcagccgtggttaagccaggcaggtcaatggcatcactttcgccagtatcggcctgaacgacttgaaagaggggttcagccgggtaaacgagaagttgcgttgaagttttaacatcttgtgtgtcttcatgtagcaatggcacgttttgcagtgaactcagtaatgcttggttagcttccaagaaatcattcagggtatcccaactgtcaagaattgcaatcggaggttctagcggtgtcagataagcaacaaaacgccgtaaatcgtcttcccatttacgaaccgaactttcagcaaaggtggtctgatctaattgttggactaatagttgcggaaccgactcacttttaacagagtcaggcatcgctgtcattcgagcggttaagtcgctaatgcaacgataagcctgcttaacatctgctaaaaatttcagaatatcagttccaccggcattttcataggcagtttgaaactcattgccaagtacacgtttattcgacatcaaaactcctccttacacgcaggcttcgcggctggcaaacgtgttgtgatgaatgcaggcaagtggtccttcatgctgaccgatgcccacaaacgatctagccttgcaaagctttgaacttggcagcacttagcacacgcaacgtctatttccagccatgaccgtacgatcaaaatgcgcaccaaatagatgacaccgtgagaaggatttacattttccaaggcgtttcataatcatttggtttcgcgctacctttatcataagtcaaactgtcaatgctggcacgcttttctactgattttgccgatggtgtaccacgttccagcgccatagaccgagaacaatgattagcaaagcggaagtgatgccggcaattatccaaggaagcaggccatgatcatccgcatcgcttggtgatcgtggtcgggaagcagtcacactgatcggtaattggccgttgtagcgaaagttgacttgtttggaccaagtgtaagatcccgattttgccgtccatttgagcgtgtaggtacctgcagccaacttggtctcattcaaaggcatactttgggtaaaaaaggaatgcggtgcaaccgctaaccccgtaaaatgacctgtcagtagcggcttttggctaccgggtttaaccaaaatataatctgttgcaatttcaccgaattgattacttgaagggttatgcagccgcgccttgacgaccggtgtgtggttgttggtgccgatgctggctttggttatatcaagcaatggtggattcggcgtggtaagatcttgccgcaaaatggtcgtaatgccgattgcaaagcggtttgtgaattgaaccccgttgctggaagcacgacttgatgtggcgccttcttgcaggacataaaagccgcctgcgataatcccgataaaatgctcagccggagcttgcaactgatacgttacggtttgctcggaattggctgcaacagtaaccgttcttggtcctttaattaaggtgctcagacgaatggcgttttgatcaagcggtggttggctttgatcaaaggcaatgaccccgctattggtcgtatatgccggattgactgcaatacggtaggtttgagtctggtcactttgattagcgatccggagctgtaaatcttcttgttggcccgggctaacttgtaagtcaaagtaaccggtaaccgactgacgctgattattaggcaggaccggcgtaaccgtgaatgttggtgaaatggctgcggttgtcacggtcaatggccaaataaagagcatgctaaataaaagaaccaaaatgagactcattatctttttcataattgtcgtcacctttcgcctgtcggtatgtagggcagctgttcgttgagaacggaatcggctgccattactgattatcagacgtggttaactttggctagtagatcggttgttacttaaaagtcctcagtatgttggaaaaattaccatatatgtttgtgaggtgatggcaggtgacctcgccgcgagatcaatgtgttcctgcaagttggcgaactttcgactaacagtagtgcttgccggcatgatgtcacgcacctttctcaaggggttatttgaacgactttattttaccgataagaacaaataatcagtcgtcaaatgcttaggctaagttcgatgtccaattagctgaagcttgtcataccgtggaagatacttgataatatgaaaagataaatagtttcgtgtgccgcaatcgcgagaaaatttgctactggaaatatttttgtctcaaaaaatggaaaaattttgtcagttgatgagacaaggttaatgtattttcacaggccgcaatttatatgtgcggatttaggggttatgagtgaatattggatgtcttggtcgtttggatataggtgcgctggttcataacgcgctcaccggcgcagaagtctgcgtgtaaggaccttaagcgcaatggccaaagcctggccattacgcccaaggccgcttgagttctggcttacgcccataacgcgctcaccggcgcagaagtctgcgtgtaaggacctcagacgcaatggccaaagcccggccattacgcctaaggccgcttatgttctggcttatgcccataacgcgctcaccggcgcagaagtcggagtgtaaggaccttaagcgcaatggccaagatcgggccatcacgcttaaggccgcttgagttctggcttacgcccataacgcgctcaccggcgcagggatctgcgtgtaaggaccatggtcgcaatggccaagagcgggccatcacgcccaaggccacttatgttccggtttctaaccgcgccggttcgcgcttactttttttaggaggtgtcattttgaaaggtccgcgagtgacggttcgtcctttcgctgcatcagatattgatgattattttgcttatgccagactagaacaagtcacgcgggcggcggggatggcgcctttgatgacccgtcaggaggcggctaatcacgttaaacggtttgcccgtgagcgtcaggacttggcgcttgtttatcagttgcatgtgattggcaacatcggcgtttatccgcgcgagttgtcgccattgacaggggatgatatgacgcgtgaaattggctatatccttcatccggcttattggcatcgaggtttgatgcgtgagggactgcaactggtcattgcaaatcaatttgcccatgatattaaggctatttgggcaggtgtttttcctagcaatcatgcttcaattcacttgttgaaacgtttaggctttacatttcaattcgaagtgccgctgccacggggattgagtggcgaccatccccgcgatgaacaatattttagattgttaccgaatcagtttgaaaatgaggatttactttaatatttttttgaaaaccgggtgaattcaatccggcttttctcttttatataggcaacgaattgaaaaatgttataatgaaaacgagtattagtctggaggtttcaaaatgactgtgcaaacagagtatgaacaggcctatcataagcggcttgcagcaatcgaagctgatccgcaattgacagtgctatcaagcatgaatcaaccgcaagaatcggatcaaaatgacgtgcgccaatatattgtcttcaccgattttaaagccgatgaacagaaacaaaaaaccaactcgatttacgtctacacaccgtttgaaaatgttgacaaatatggccattcgaaagcagattatcaggcacagctcttatttgaaacgaatcgctgggacaacgtgatgcatattacggttttagagacgctgggttccgaaagtcgcttggctttttacgattttgagaaccttggcctcgcacagttggcactgaaagcttttctgaatttggcgatgaaggctgacgttgcgctcgtggatggcacgattagctcctttgacaaagttaatttagccaagttacggcatattttcacaaaatttggatttaacctgaaactgactgatccgaaaaccggtatcggtaaaatcagtcgttccttacaatagactggtagccggcaaaatgatgccgcagtatcttgaaacagtatagaaactaagtaaaatcgaccgcaaagacaagttgtcttgcggtcgattttagtttggcgtgagcttcctttaacgatgttcctactaaatcagttaaacttatattggaaagattaaacatgatctataagcttgagttgtccgaaaatgtaacagatttatgaaaatactgcaacagaacctctctgtttaatcggtgtttttcagttaaaataggggttgaaacggaacacaaaaagcgtattatgaaacacatcaataatgaggaagtggcgaaatggctgaagagaagcgttatggcgcagatttaattgtcgaaagtttggcaaatcacgggattgattatgtttttggaattcccggcgccaaaatcgatcgggtttttgaaaccctagaacatcccaaaactaaaaaaagtccgcaattaattgtcgcccgacacgagcaaaatgcagcctttatggcagccggtattggccgtttgactggtaagcccggcgttgtcttgacgacttcaggacctggcgcttcgaacctggcaaccggccttgttacagctactgctgaaggcgatccggttttggcattgtccggacaggttaagcgagcagatttgttacgtagctcccatcaaagtatgcggaatgcggatctttttgcgccgatcacaaaatatgcggctgaagttcaggatccggacaatgttagtgagattattgccaatgcttatcaggcggcggaatcaggcaagcagggcgcaagttttgtgtcaattccccaagatgtgaccgattcaccggtcaattccgaaccgatcaaaccgttagtggcaccaaagttgggaccggccagccctagtgacatgacttacttggcacgtgcgattaaggaagcctcattaccagtgttgctgttgggtatgcgtgcatcgtccagcgatgtgactgctgaaattcgcgagttgttgtcggtcaccgagttaccggttgtcgaaacattccagggtgccggcattatttcgcatcgccaaatcgataatttctttggccgggtcggtttgttccgtaatcagccgggtgacatgttgttgcaacatagcgatctggttattgcaattggatatgatcccgtggaatacgaacctcgtaactggaatgctgatggcaaggcacgcatcattgtgattgatgatgttcctgctgaaattgatcacaacttccaaccggaaaccgaattgattggtgacatttcacaaacactggatattttggttccgttgctgcgcggttatcaggtggccccggagagtaaacattatctgagtgaattacaatctaaattacaagacagcgacgtaccgccagccttgacggatcaaaagctgattcatccgctaagcattgttgctgcattacaggagcgggtcgcagatgatatgactgtggcagttgatgttggtagtcattacatctggatggcacggcatttccgtagttatgagccacgacacttacttttctcgaatggtatgcaaacattgggtgtggcactaccgtgggcgatcgcggcaactttggttcgtccaggaaaaaaggcggtttcaatatccggtgatggcggttttcttttctcgggtcaggagttggaaactgccgtgcggctcaaggcggatttagttcatattatttggaatgatggccattatgatatggtaaaattccaagaagagatgaaatacgggcgtgcagcaggtgttgactttggaccggttgattttgtgaagtatgcagaagcttttggcgccaaaggtttgcgcgttgataagccaagcgaacttggaaccgtgcttgatgaggcgtttgcgactcaaggtccagtgatcgttgacattccggttgactattccgataacgctgaacttggcgctgcgatgttgcctgatcagatctattaatcgttaactggattgacgtgggggcgtgtggctcagtgtgagattgtctgtttacactccgacttctaagcgcgccggttcacgctccataacgcgttcaccagcgcaggggtctgcgtgtaaggacctcagacgtaatggccaaagcccggccatcacgtctgaggccgtttacactacgacccctaaacgcgccggttcacgctcaccataacgcgttcaccggcgcaggggtctgcgtgtaaggacctcagccacaatggccaaagcccggccatcacgtctgaggccgcttacactacgacccctaaacgcgccggttcacgctcacttcaaaaaggagatgtcgttttgaatacggatcggttgtatcaacatggaacattagccatgctggttccggggctttttgcggggacgcagacagttggggaattattgcagcacggtgatactggcattggaactttgactgggcttgatggtgagctaattattcaggcgggtaaggtttatcaagtgaatgcccaaggcaaagttcgagaagtgcaagaagacgagaaggttccttttgctaacgttcactatcaacacgacgttgcagctggtaagcttcaggggcttgatttggcagggtttcacaaagcaactcttgagcggctgcagaccggtaatttatttgcagcagttcgtgtagaaggcacgtttacgcaaatgcatacacgagcggtgctgccgcaacagccgccttatccgaccttgaccgaaacggcctcgggtcaaaaagaatttcatgctgagaatatcaagggcactttaattgggtacttttcaccggatctctatgcaggtgcggtttcacctggtttccatgtccattttctggctgctgatcatagtatgggtgggcatattcttggcttcgaattggatagtggcgaactgtttttacaaaagtttagcgacttccagttgcatttgccaacagatgatcagcctttcttgaagcaacaatttgatacaacaagtttggttgctgatattcttaaagctgagagttgagttaaagctgtgtgagagtgagttgctgttgtcagttgaacatgatatggtgagtcgtaattgagattagaggtcgcatcaatcatgagtcgcagctgcaatggtctgaacaccaagcgcgcagttgttaaagggaaaggtgccgaaataccggttgagttcagccaatcgatattgggccagttggataacatccactggactgtcgcgattatcgcggggcgctaacaaatcggatcacgtttattcatggtaaaaagcagaataagccgatgggttagtcacaacagaccgactcattggctttttttgtgtgagcgtgagccagcgcggttagggatcggagtgtaagcggcctcgggcgtgatggcccgcccttggccatcgcgttcgaggtccttacactccgatccctgcgctggcgaacgcgttatagaaagcagaataaaattaacggattgcccaaagaataatgcttctgcccttgttgcagtttttcgtccataaacaccagtctttggccaacgcatcgttacatttaacccgccactggctgtcaacaaccagccaatcacgaaaatctcaccccagatatcgacagtaaaatctggcattgtttagcaaaaatcaattcacgttaacaaaggagttcatctgtggcacaatcagcatccaatcaagtaaaacgagagctcaagacacggcatctatccatgattgctcttggcggtagtatcggaaccggtctttttgttgcaagtggcagcgccattgccactgccggaccgggtggagccattgcagcctatatcggaatcggactcatggttttctttcttatgactagtttaggtgaaatggccacgtatgtaccggtttccggttctttttccgagtatgcgagtcggtttgtcgatccggcgttcggatttgctttagggtggaactattggtttaactgggccattaccgttgcggttgatgtttcgacgactgccattgttatgcatttttggctgccaaaagtacctggctggctgttttcgctgggatttttggcactgattttcctgattaacattatttcggtcaagtcatttggtgaaactgaatattggttgtcgttgattaaggttgtaacggtgtttgtctttttaattgtcgggttactgacgattatggggatcatgggtgggcatggtcccattgggtttaaaaattacacaactggtgcggcgccgtttgtgggtggtatccccgcaactttggctgtttttgttgttgcgggtttttcttttcagggaaccgagttgatcgggattacggccggcgaaagcgaaacgcctgaaacaagtattcctaaggcgattaagcaggttttctggcgtattttgctgttttatatcctgtcgattgccgtgattgccgcgattattccgtacactagcccgaatctgttgggggccagcgtggatcaggtggcgatttcgccgtttacgttagtgtttgatcgcattgggcttgcaggcgcagcaagtgtcatgaatgccgtgattttgacctcggttttgtcatcggctaactcagggatgtatgcatcgacgcgaatgttgtgggcgatgggcggctccggctttgcaccacggatttttcaaaagacgaacagccgcggcatcccgcttgctgcgttgttgctgacaaccttagtcggcgcattaactttcttgaccagtattatgggaccacacgtttaccagctgcttgtagcggcttcagggttaaccgggttcctggcctggctcgggatcgcggtttcgcattttcggtttcggcgggctttcgtgaaacagggacatgatgttcacgaactcaaatatcatgccaagtggttcccggttggcccgatcctggcgattatcatgagtctgatcgtcatcgtgggccaggatttgcaggcagtccagcactttgcttgggggcggttaatggtttcgtacatgtcaattccgctttttattgtgttatttgtctggtataaagtgaagcataaaaccaaactgatcccgcttgaaaaagtcgacctagccccgcatcgcgaacatgaacctaatcctaaataacaagcttacaaatgaaaaacgacttgaaggatgaatgtcatctttcaggtcgttttttattacgcacccttattggtcacaaaaggatgctaatttgaaattgtcactggttatcatgcggtgacgatttataaccgttcatcgttgtcagccgataaggaagcatcggttttcttaagatataaatgccgaatctgcaagtagagctggaaaatagcattgtcactatcttcagtcatccaactaatgatttcaccgcgaaaatcggccggaacagctgccttaatagccggttcattgtccacactggtgatgacaagatcagctttttcaaatgctgcatcttctggaagtaaatcaacaaccggtaaatcagtcaaaagattgaccatgcgccggttcaacaagtcgtgatccaggtaagccaatttaacctgtacagttggcgtttcaacaaagtagcgtaaataaggcgttaataggaaataaagtgtgtgcaggaattgatggtcggttcccaaaaaatactgatattcaggagttttcggcaaggatgccacgaatttttccaggacccggaatagattcgtcttcgtgtaattcaatccgcgcggctgatagaagtcaaccaaatgcatgaagtccccaccgagcatctcattattcaaagcgatacgtgcgaggttgaggatgagcccatgttcattgttgagatcaaaagcggtttgatgccggacatgctgatttaagaaagccaataagcgtttcacaaaatctgccgtgacagttggtcgctgcaataaatattggatgaagttttgatcgtccggaatacttggcaagaaggtgatggtccgatgttgctgaaaataaaaaaagtcattttcacccttcatgtagcgctggttgaaaccagggaacatctcacgtgtataaacatcgtgttgaaaaggcggatagtcgttaaagatccgatcaaatgcctcattaccggtgacaaaatgattaccgctgatacggacgcggcagatagcccaaaaaaggatttcttcaagaatatcaaccggattcgttttggcgttcggcagggccatgtattcctgcacaatctgatgttcatccagaaccttaaacggccaatcgacgccatgatagccaagccaataaaagtcaaacaggaaaagccggatgcggctctcctggccaataaagcctaaatcgctaaaagaaagttttagttgaaatcgtttgagtaatttgcgtaaggcagcggttttacggaccaaagtcgagcgactgataaaatgggcttggcaaaacttttcggttgatgggtgattggcttgcacgatatagtccacaaactgaaaagcgatagcatgtttcagcaggtaaagatgataatcgtcgacagtgacatcaatttccattaaaagattaatttgacggcgctttaacttttccggatggaccgttaaaccagccatatcccgaaacagttcctgtaaaatgttatagccttgctgatatgaaaggtctaggtggcgactgagggtattgatggtataggtctggacggtgctgtccttgatagccgaaaacatttgaaacttctgcaagtcagcgcggtcaagaaaagtttgctcataaagcatcgcgtaccctccaatctgtagcaattaaaaccccttcacctctaattataccaaagaatgacaaaagcgatgcgactctcgtgaatgattgagctttcgtaaccttaagtaagtgaatcaaatgaccggcagattcacaagttggtatagcaataagccagacaggggtaagaagctgattatgcgtcttcagtgaagtataatcgagatatctagaaattcctattaaatttacgcctgattcagacttacaggcgtagtatcacgcgtgctggtctaagaagacgaggactcatgggctgctacttcaagtctttataccacgcgtttccaaatgaatggattacccaacacagaagtctacgcgaaggagattttatgaaagacaatcatgacattttcttatcaatgtccgatgctgaaaagctgagtttgtttcggaccattattgacgtcagagaagcccagacaccggttaaaaagcgggtgaaagcgtatcgggatcaccggctattggttagtgaagttaaccttaaacaagttgcggcaattaccaatcgtaattatggcagcgtctataacacgtataatggcctgatgcattcgctggaagcaatgattggccgcgaacatgcgtcggtcaaaacattgctgggaataccggttgatgagtttcgctattatttggttaaacagtcaaatccgtatcattttttggatgcggttttgtatcagcgatatgaagactttgatgactttttaagagcctgtgacagttctaaagcgaccgtgttaagacatttgaaagtcattcgcggttacgcccggcaaagtggcgtccaattttcttacgagacactttccttcgtgggagccgaattgaatgtcagattgttcatcaccattgcttactggttggcaacgaacggtgtcgcttggccatttgaaaacttatcccatgaccgtgcaggcgaaattttagatgatttgttggttgtgtttgacagtggcaaggtcaacaagattacgcgagaattgttgatgtattatattgcggtggctcaccagcgtattttaagcggccatgttttgtcacatgaagccggttcaaaagttttgcaatatcctgtcccgaatctctttagtgatgctgctttgagcctgctggataagtcgaagcggttgcagcacctgacaacgcagcagcaacaaagtgaaagtgatgccttgtatttcctttttaattttgccccgctgtatattattacggatggtcaggtagaacaacgaatcattgcccgctacaatgactataatccggaaatctatcaacttattaacggtttctttacgcgttttccgtataactttaagcttgatatccatttgccggatgatacttataatttgttatttgccaatatgctaagcgtgaccgtcagcgtgttagcgttcaacaaagacttcacgaccagcttgttggcggagtttagtgccaatatgcagcaaaccaaagatgacccggacttttatcagcaggttaaagtaaccctcaatgaggtgattgatagtcagcagctgacatcatttgttggctgccgcgatgttttggcagaagcgttttatcgcaatctgcatcaactactggttcaatttcagccccaacaaaaagtattggttgcgccggtcattgaacaaacggtgacgggatacattgatttattggcttttttacatgctgtgccgtttgttgagttggcttcaccggatgccgaccttaaagatgttgacctgattattacgacttcggttggtgccattaaggatgcagcaggacaaacccagatcttcccatggcacatcaatgtcacgaacgatcattatgggcatctttatagccttttgcgggaactatgggacgggaaaaccctcaaagatgcgcgatttatctattgaaaatgacgcatcgttttgctaattcttttaatgaaaactgctctcgatgcttgtctaaacacgaaagatgcggtaatctaacaacgtatagtaaacacgtctgaagcgcctaatggatgttttagagagttagcgggtggtgcaagctgacatatcatcctcattccagcgccttagtgggcagtgatgaactgcacggtgacaaccgttatcagcctcaagagggtggcgttatgcgccaaacttgggtggtaccgcggaaaaagcctttcgtcccattagagatgaagggctttttgtgtgcactgagcactcagacgggttttcgattagaaataagtatagcagtccaaagttggccaaagaggcgcaccctagcgatggcaagcactgggaaagtcggccttttgtgaactgcctgatacttttgaaggaggataatatgttagatctcaagttgattcggcaaaagccggagtgggcaaaaaagaagttggctgctcgcgcgatcaagggtgaggaaatcgatgaattaatcgcccttgatgagaaacgacgtaaggtaacagttcaaaccgaggagttaaaggcaaagcgtaatgaagtttccggccagatcgcggtgatgaaacggaacaaagaaaacgctgacgagcaaatcgcggctatgcgtgaagttggtcaaaaaatcagccagttagataaagaattagcagaactgaatgaaaaagtcacctatattctggttcggttacctaactttccggctgatgatgtcccgatgtcactaaatgaagacgactcgcgtgaagaatataaatggggcaacattcctcatttcgattttcaaccgaaacatcactgggatatcggcgagaaactaggtattttggactttgaacgggcggccaaagtatcaggtagccgctttgtctactataaaggtgcaggtgcgcgactagagcgagccgtttataacttcttcttggatgaacaccaaaaagaaggctatgaagaaattattccaccatatttggttaacaacgattcaatgtttggcacgggtcaatttcctaagtttactgatgcaacgtacaccatcacaaacgatggggagccattaaccatgattccaaccgcagaagtgccgctggtcaattattatcgcggggatattatggatgctgccaaattgccggttaacttcaccgcactgacaccagcctttcgttccgaagcaggaagcgcaggccgggatactcgtggattaatccggatgcatcaatttaacaaggtcgaaatggtcaagttttgcaaacccgaagattcctggaaagaattaaaaaacttgattcacgatgcagaggacctgttacgcaagttgggccttccgtatcacgtcatcaccttagccagcaacgatgccagctttacgagtgctaaaacaaacgatcttgaagtgtggttcccggcacaggatcgctatcgtgaaatttcgagttgcagtaattgcacggatttccaggcacgtcgagcacaaatccgttatcgcgatgatgatggcaagctgcaatttgttcatacactcaacggctcaggccttgcagtgggacggaccgtcgctgccattcttgaaaattatcagcaagccgatggaacggttaagattcctgacgttctggttccctacatgcacggccaaactgcaatcaagcaggaagattaatagcaaaaagtgcatctttatgcagcgaattgttaataattcgctgcatttttctttgaacgttcggcttagaaattcttattaaaacctcatttaaaaagtgttgacgcggcttggcaaagttgctatcatattcttcgttgtcaaattgttaattgcttatcgcattcatcaactgcatgtttattcaaaaaagatgttgacatgcattggtgatcatgataatctataaaagttgttttttgacaaggtagtcctttgaaaactgaacaaagtttcgtttaaatgtgcagggtccttgatacttcggtatcgaggcaaaaagtatagcactaacaagaataggtcttcatggcctttatggtctagtcgtcagggtgttgcacttgaattgtaaactggggctttagtttactatggatattataaagttctgtcgtcaattcgccttgctgatgctttaaaaagtctcattaatggcaatccttttattgttaacagttggtttatggaaatcctgttaattttatatttcatattttatctttctggtaaaatatgccgttcccacatttcgtcaacagtattgctcgttgttacaggtaatatagtagtttttctccttttttatttaaattcatacccgcataattggtacaacacggttctttgcttttctcttggtattctatgggcattgtatgaaccattgctagggaaagtcatgcgctcaaagtcgttatatataggcacaattatatttttacttgtgttgtttctatttttgtttttgtcaagaaaattagaagcaattagttcattgctatttgcagccatcgttattatgatcagttatacttttacttttaaaaactcattctggaagaaaacaaaacatattggattagagatgtatctttatcacggattatttattagcctatttcgtggaaaatacctgtttataaacaatacttttatttttggagcaagcatttttctggcaaccttcgtaactgctttagtcataaataaattaactaagttatttctctccgttgttcagcgtcatgcagcttaattaaaaaaaatccatcggcgatagaaaaattaagttttgtgcctagaagaaataataattaagattaaacattgcggtgaaacgtttgcttttctaaaatcatacagaaagccctccgcccgcattagcgagcagagggcctttttgttacctgatatacaggctttcgcccggataaatcaggctatagattgatttgccgttgttagcagccagcgtgtacatgctgatgccatactttctggcaatgctccagaagctgtcaccatatcggactgtgtagtacgtgtggcttaccagcgaagtatatccagacgaacgcgagccatagctctccccaccattcacgcccaaggcaacataacgatacctgcctgaatagctgagataacgtgcccaaacatatgtgccacggatatacacgtgatcataaatcacgctttcaccgggtgcatagctaccaacagatgcatatccagttccggcacccgtgcgaatgtttaccgtcgtggacggcttgaaaacacccgcttgcgcatagtcggtatcactggctgcattcgatttcgctggttgacttggtaccggtgttacaggcaccgacggagttgctggctgcttcgagtatccattatcggtcacaccaagcagatcaatgttaccatcgaggccttgcgacagcccaaatgcgctcgtgtactgccaaatagctaccccatccatactcggaaaataaccgtagtctggtttggtagttggtagataatcacggtaagcagcaatccaaaggctgttaggaaattctttcagaatacgctgataatcgacatgtgccaacgtatatggcttgtaactgtaatacatgggcgtgtagccttctgaatgaatgcgccgcataccagctaaaattgcatccgtattagctgccatattcccggaagcaccatcttcgtaatccaaagcaacgatgcttccctttggtgtctgcgctttgatacgaggcatataacggtcaagtgcttctaaccccaactggctacttccaccaacgccataccagatgtagctatgcacacgttttcctgccgccttggcactggcaatttggctatcgtacgtccactgatcgatgtaagtaccaccgtaagtaccgccaatctgagcgatgatgaacttgtcttggcctgttccatatcgtccacttgctccctgatactttgaccaatcaggtccctgatctcccttggccgcattggcctgcgatggcaaggcaaaagaaatagccgccaagaaggcgactaccaaggtaattagtttggtttttagtttcatggtttcctcctttattctttatcaatttggattgcacgattttcaaattttttgtaagcatcaagatacaattcatgtttatcaccattgtatgttatctcgtagtacatgccgtcgctgacctttgtactagccagtgcctttgagttctgaagcgctctgcatgaccaaacgatatatacatcatccggagtgattgagtccccatcggtcttatccatgtgatcatttgcataatcagcaactaaacgctgacacgtgtttctaaaatctaagtcattcattgattttcccctccttattgctgtggagcaaaagatgccggagctgactccgccggtgctgcagaagacgtctctggaaccacttcactagcagcagttacctggtcagcctctttatccgcttgcagtgccttaatctgatcctctagcgccttgatcttagctgccttggtggtaatgagtgccgggtaagctaacgcctgctgactatcactaacgccctccgtggttggatcaaccgctaccccgacaatggtcaataatgcaaacactgcattgaccactgcagtgagttctttacccaaactagcaaagtcccagttgtaaccgaagactgccgctaccgtttggatcaccaacaaagaagctggcacaacggccagccagaatttgacgcttaatactcgtactttccaattaatcttcatggttatcttctcctttaatgcctacatggtcttccaatcgagtaatcctaaccgagtgactgccaagctcatcatcgtgtgtcctcaagtgttgtcccaagtctgccagcgattgttcgtgcagttttagctgacgattaattgtctctgaaagaacttgaatatcagagcgtaatggatctaaggcaatctttttgaacagccagctgcccgcacttacacccacccctatgattgatataacctctgcccagtcaccaatcgtgtatccaaaaaatgtcactttctcacttccttccataaaaatagccgctagcttttgctggcgacatagtcactgatgattagaaaaagcccaacggtgagtgctgtatgtgtgggtgatctctgattttttttgcattgtcatcacctcctgtttgatttacaaatttttgaaaatgtaatcggatatgcggaaacgtgtgataacgttcttccgaagcgttttgaaatcgaagaacgttgaaggaatgttaggccagcgtgatagttccttggcgtaggcgttagtgccaacactatccatgaactcctcgaacatgctggtgactttgtctggcgtcagtacagacgtcctcagctgagtataccgtgccttgatttctggcttgaacgctttgagggttcgattcataagcatgttcagtttgaagttagcaaagttcttgcttgtcagaccggtatttagcatatccatttcagggtcgaatattgtcttgccgtcccaatttaaaccccatgtagaatcaaggtcataaggaattggtagccagatgttgccatcgtatgtggtgtactcaatattcttgatataagagtcactgcattcagcaacttggtaaaagattagaaagtcgataaccgcttcgaggtcaagatattgactgaattggtcgtggaacgtagcatcgtcagactgcgaaacaaactgtgctagtcggttagttgccgcttgaaattcaggagttgtcgtgccgacttgaacttccatatctgcatcaggattggctgtgatgtcatcagtgatgacaatggttggcttgccgaaccctttatccgtgaaatgattttgtgcttctagaacaccggcatttgaaggcacgttatcaaatccaaacagattctcatctttgccagtattgatggtgtataacccgtgaaaagagctgttcgtatacagaagcgcaggggttccctgaatttccccgagcatgcttgcgtttagcagatttgagttcacattcgcgcggttctctgttatttcggcaaacagcttggcgctgacgatattaagcgcatgagtgacgtcaatccagttggcttttaggacaatggttccctcgttgagccagcttggggctgctttgaacttggcctttacagtgcaatcagggtcgctgtataacttgagcttgtagttcttcttgtcgtaagtggccgaggagtcgccctgaatagacaacttagcgaagtaatttttggcaatgccatttttgagaattctaaccgttactgttgttttatcgcctttttgagttggtaaagtaccgtcgattttgataaccggaagatttgttccgctagtgaaggcgtgttccccttggttatcaataccgacatcagcacgaatgttaatgtttgatactgaataagacaagtcacccgttgatgttgagcaaagtccgaaaccatagttgaattcatcaggctggaaacgcggcaatatgaagtcaatatggttaataacgccagctgttagtggtagagcggtaatgacataatctcgaaccttggcgttatttaaatcgtagctggtagcgttcacggtgtaaattcctgttgtgtcaaccaacacatcacattcaaccaaaacattgtgagtacggaagtcatcatttgtggtctcttcgttattgaacaggtattcgagacgagatgtaggctgtttagacgcggctggacacgaatattttatccagcgatggtttagcaacattactggagagtatgcaccgccatttgatgtacggaagtaggccgatccagtttttagcgttggatcgtcaactacgttcatagatagccggtcaggtttttcaaaagcgatcgggtagccgacaatttcggtgacgttgaagtcaaaagcggctgagtaatgatccttaaaagtgatgaggactgtcgaaagatcggggcgtccaattcgcggtatgaagaaattaacctttgttggaaccgccaagtcacgcgactttaccgtattgacgataacatcatcaagaacagccccattaacatcacggaaaatagcatgaatatcaatgacactcgcagcgttgaacttgatgatgagtgatccgcgaacacccgtattacggacaccgtttactagtttggtaccatccgcacctaaatagctcacgctttgtccagtgtgtcctccagtccacacgtgaagccattttttgtccgcgtagagctcattcctgaaatctacatccgtaccgcccttctgccaaggggttgtcccctcagtgaagaacgaatttctgaatacattgtcacggtttgcggcttcgatatatccggattctaggtccgaattgtttgaaacttcgtcctccttgacgagtgaataatcagttgctgaaaagctgactggctgtccgtctgtattccataccataatcaagaaattgtcctcctgccccgtcacgtcaatatgagcgctgtttctcacagccattattttttgtgcatgtgcattgaacgtcccgaagtcaaagctgggtagccagtcaccgtttgccttacgcggaatcagcgtgattttcagattttgatcaactgccgaaacaatgcgaacaccaagacggtagctaccggtgccaatgacgggttgcccgatgctattcagtctagggacgacaataccaaccccttgattgttgacggtgccggaaggtgattgaaccgttacccacgttgtgccctcacgatgacttactgaaagcaaaacgccggcaaccgaaggaacagcattattgatcagcccgttttgaaacttagcatttggtacgaggttattgcgggacagattgtcgaggtattggccaatctgatccattttagcggcatcgattgccggtatctggtaaactccgccatcctgccatgcaccgtttttgtagtaataccatcgttgggaatccaaaaccgcataaatactcttaccgccatctccattaggaaacgcctttttgaggtcatcaaaggttggatacgttcctcgaggtgtctcatttttcattttgctgaaccactcaacagcaagggcaagcgattcacgaacgtctaacccccactgtttgctacgtatccacgtggctaacgactcagaaatattatcgacaaagccgttgttgatgtcttccctaattgaattttcgtatggaatatgctctggatcacgatatggttcctgcttgtctaccattatttgctcccttctgccggtttggcagcatcttctaatttcttgacacgttcttctatggttgcaagggttgctccagtggaggtcgtttgtgccttttttaactggtcaacgtctttaccaattgcgccaatattttcagtaatcgaattgagtttatcgcttatatcggtcagcgaatttttgatgccattaatgtcggcatcactaaactctgtctgtattttgtcaacagtttgctgtgcttcttgagctgcttttaaagcatcctgagcattagtgttcactaattcgatacgggccgattggccgagaactgttttctggatctgaccatataagcgttgattattaagattttttgctacagtatcgactgcataatcaacgccagacttaaacttatcaccaataacgagctcagcgttttgaggttgaatcaagtcaagtgtttgtccaacgatccgcattgtttcgtctgtttgggttagcggattaattactcgattgaagttgtatactttgaagtcttctggagcacgcctaagtagggaaaggtctaatgctgtaacagaaaacttccgcgtaactgggcgctgtccacttatccatgaattaacagcttcttgaagttgctcaggtgtttttgcattatcaaagacttgtacgccttcaaggactccgtatttatttatcaaatcaggaatatccacatacagcgattttccagcgtctgttaaattaacccgaggctgaactgactcttcggaactcacgttatctttgacagctcctaaaggaacaactcgtgtaattatcccagtagggtcagtttcaaccttcattgctttcaaattgatgccaagacgaatgattgttttgccagtttcgccaagctgtgacttaacatctaaaaaacgtccattctgagcagaacgaacgcggatatcatatcctaatgtggtcactacaaaatcatgaagcgtatcatacaggtctttttctggagtcgtttctaaggtttgtgactgtgtagattctggcataatccccagctgcatttgtttaaatgggtcaactcgggaattgaacatatcaaccagctgcttgatgatcgtagcaggcgtcccggtaaacgtttggtatccgggtacaacatcgtggaagaatgcgagcgcaccctcacaagtataagaacgtgctagagcaccagtttcggccatttcattagtgggaaccaaaacgcgaccgtcgaaaaggacctcaccggtatctattcggacaacccgcactcttgtgaccatcggcattatctcgttatagccaggattgttaggcaacacactaaacgtaaatgacggaattgaattgatatccgttttaatttctgcggacgtcagcattgttctactgccgccaggacgcatgataacaatagacttgtcattattaataattgtgacctgatacaaattagatcacctccctgtgccatgcgaatgagatttttcccgatccagtaacggtaatcgtgtttgttcctacctctaagggaatatcttgtgatgtgccttgtggaagttgatactcgatttgtccaatgcgcacagtcaaagccgcatttgtggttatttgcggtgtcacgattgtcacgctgttattgataagttcaaaactccgactgccgtttatttcgaaatcaacgtcctgagcaacatcattattaaaatcaaacgtgtcccaatcgtcatcgccttcaaacttgttcgcaatcatgaatggatagcaagtgaatacgactgttagctctcctgatcgaacatcgtcttttaaatctgccgcctcttgcaactcggccaaaaaatgataatcaggcaacttgtcgtcataaagttccgcttttgaattacttgagtacagccaattggctatttccgtttttaattcgtgcattgaaacttgatcatatccatatttattgacaacgtttatgacataggtcactttgcgttcgttataaggctgaaccccaccaattgttgaaaagtcatagctttggttactgaatggcaccgacacaatcgttttaatctttgaaggaaagccaatgtcgtgggaaacaacatgaatgtacgcgccgaaatcgctcggccgttttcctaaatacgtgaagtcatgaaaaggcattagcttgtcacccctcttgtttgcaattgaattgccttgccgtttgcgttgtttaacattggcccaacgacttggccaagaaccttaccgtcaacaattaggtagatcggcctgtcattgtctggtttaacgtttgaagccagtgctttgccaaggcgttcaatcgtttggtcggataaagtcatattgttggtgatgccgctgacattcactgtacttggcgtccgtgctgcgaacgtttgcggattcaattggtttattctattagcagcgcctccgaagtctgtggtgccaccagcaaaacgtggaatcgagtagtttcttgcggactgcatggcagtttcaatttttgtatgtcgaggaagtggtaaggtaacatttcgcccatatgccacaaattttgctccatttggtagtgtgacgacctcttgataacgagtgccagatgcgtcgttaatagttgctaatccaccggtaaagttttgagtgcctcgtgcaaacttgccactgttcaaaagtcgttgtacagcgggatcaatatctgcactaatcctgaatgtttttgtgatggtagcattgccaccgaatgcagcaaccgcattaacaccaatttgtgacgctgatgaaacaccatctgcgttaccattgaaaaacatcataatcggtactttgctgttaaacgatgttatgctacttttacctgacttagatgctccatcaacgcttcccgaatttccttggaagaaacgcatgagaggatttgtagcgttgaagctgcctatttcttcctttcctttttccgcatgatttgtcacgctgcttgaatcgccgggaaacagttttaatcccggcaatacctcgttatacttagcaatactcgttccgcctgaagatgattcatgtttaaccttacttgcatcggcagggaacagttttaatcccggtagaacttcgttgtatttctgaatgctccctttggcttcttctgtttttccaagcacatcagtattatttgcttttagccctttttcgttggggttcttaaacaaattatattgatcaattgcaactccagctttttccaattttgtacgagcatcggaatcgttcatcaacagacttttggtagagtttggaaggctgttccaaagaccgtatttaacaaccatatcggctaagtcggatttgcctttggtctgcataatagcagttttttcttctattgataggccattccactctccggctttgatcatggcctggactaagcctgcagaagccttatctttaacgattgcttctagctggccaagagttaatcgattccagtcatttgctttatcaatagcagctatcaaagagctggtatcgccctttgctacagccttgatttcttttggtgtaagtgtattccacaaatttagctgatcaataatatcagcgatgtcttgcttgccaaaagaaactagggttgcatatttctgcgtatttggaagcttgttccaaactcccatgtcaaaaatgatgtcttcaagatctttcttgcctttagcattgacaatcgcttcttgaacttttaagtcgagcttctgccactcgccggtttgctgaagtgaagatactaatggcactgttgctttatccttaacaatggcttcttgctgtttcaaggtgagattgttccagtctccactcttgactaaagcatttactaaaggcgtgtaatcgcccttcacaattgcttgctgatccttaagcgacagactattccaggaaacaaacttatccataatatcagcaagttgctcgcgtccctgagtacggataattgcattcttttcgggaacgctcaatttctgccattgttcagatgatgccagcgcttcgacaatcatttgcttggcatttgatgtaatcttggcgtacttgaggtcaaagacaagttgcttccaaccttttttagtgctggccgtatctttcaacacttcaggaagatttgttttaacttttcctgttttggtgtcaaatacaagattgttccagtggtcacctgcctgttgcgcagctttgccaaatccttcagttgccgccgcaaagtcgcgattactcttgacgcctttcgccatagcattttcgtaactattcatcgcagactctgcttgcgatgctgtcagatgaaagtcagtttgcagttccgctagcatttcggagcgagacgttccctgtgctttcatggcttggatagcaccggcatagaggctcttcatcttattctggtgatcgcgttctaaaccttctaaagcaacgtgacgcatggtcgcatcattcttgaattcttcattaatttttgcttgttgcgacttgtatgcactgttttctttgttagcagcgttccacatatcttgatactgctctagggcagcactcttagacattcgtgttctctcaccaaggacagctttgagcacattattctgttgtgatccagaaatctgtagcgtcttgacagccagtgcggcatttttacgacggtagttatccaacagttgatactggtcagccgtcatctgtgctccgctcttgttaaacgatgcagtaatggcttgggcctttttgttgttgctttccatctctttgattcgcttagcgttagcggctttttccttagcggcctgcttttcaatgttgtctgcggcttcaccgccaaggcttttagccaatttctttgctgctgtctcagactgatcagcggcttcttttgcggccttcgttaaatcattgaaccctttagaaatcgtcttagcattctgggtgactgtgtggtttgtatcatcaaaagcaccagaaatttccccagaggcatctttcattttggaagcagatcggtcggcatcggcaccaatatcagtaccccatcgtgaagttctgtcagcagactcaagagcctttttgccccacaattcccaaatggctacaccggcaccgacgactgctgtcacgcctaaaacaactgggacgattggccccaatgccgctagcaaacctgttccgctcgctgcggctccgcccatggccgctcccattccagaagcaccatctgctaccgcagccgctgcaggtgcaaccttcagtgcttcaaaagctgtcttactaaacccagacttgagcacatccattgcagtcccgccaatttttgcggctgcggatgctctcccaatgactcccgcaattccagatattcctttgctcaaagcaacaaccggcttaagagctccaccgataagagaactcactggccctacaactgccgcaaacgctgcaaatttgataatggtttgttgcgtaccgctgtccatttttgaaaaggcattgacaacatcggttgctgttttgataagaggagtcagcgtcggtagaagtttttgacctacttcaattcctaaaacatgaatcgactcttgaaatctcttcaatttggcggcatccgtattgtttaactggttagcaattttggcagttgttccgctagcatgctcagcttcactggtatatttgcgtagctcaccgccacctgcactaatcaaggcattcatgccggcttgcgcttcagtgccaaaagccaacgctactgcagaagcacgttgctggtccgtccaccccttagtgttattcttgattttgtcaagaatctctggaagagttagcgttccttttttgaaatcagcaacagatatgcctaattcactaaagccttcaatgttttgcttagaaggcttcaacagtcttgttaaagcaccacgtaatgctgtgccagcaactgatccttcaatccctttgttgctcataataccaatagcagccgctgtttcttcgagtgaaataccagcagcatgagcagaagggccgacatatgtcattgcctcgcccatatcctggaatcctgctgcagtagcgttcgcaatataggtaagagcatctgtaacgcgagacgtgtttttaagcatgcccgttgttgattctgtctttagaccaaattgctccaaaacggatgtagaaacatgcataacatcgttgaagtcatcgccagacgcttttgccgcattgagaactgcaggcatagcgcctaaagtttgcgcagcggtatagccacgtttgatcatttctgacatgccgtcgttaatcgcagccgtggaaatgccatattcaaccgaccactttttagatgctgatgctagttgatcaagttgcgcacgatacttagcagtaatcgcacccccatttgttagcaaaggtcccattgcttgaatttggctgttgaaatcaatagcagatttagctgctgccacaaacccaatggcaattggagcagttaccgcccttgtcatcgttgatccgaaactggttagtttggagcttgtcttttcggtaacagatgcaaatttagaggcgccgtttgatactttagtccagccgtcactttgcagtgcaatctctttgcgtaaggccgccattcgattttcattttgagcagcagcggcagcagttcgattatactgtgatgcagcattagcttgcagttttgtcgcacgattaatttcttcctgcgatgcagtctcacttttattaagtctttcaaccgctttcgaattttcatcataccgttctcgctgtttctgaagctgagcttggtagttctttgactggcggctcaatgtgtcataggttgaacgcatgttgttgatagacttttcagagcccttaaacgcagcatcttgagcccgcaactcagcggcagttgctttaattgaagaattcaaaactcgctggcttacttgaaacggatcaatgttcaaactaacagtagccgcaatttgtccgagatttcctaacatgttttacctcccttcatagaattagaaaaggaacggaaaggccttgtcgatcgtggtctcccgttcctcgtaaatctggttaagcttttcaatatcgcggagcgtcatagcatcaacgtcagctaatcggtagccttcagagagccttgctttgtagaagtcgtcaaggttgctaatggcttctttgacgtccgcttcggtgatttttttgctgtgtccttcttatcctcttcaccatcgcttagagaatcgccaatggcatcattgattgaatccagcgatttcaaagaaatagacgagccatcaataacatcatcggtagtaaactggtttttccagaaatcaaccgcaaatttggctaagtttttctcgttctcatcgtaatcatcgtttgaagggccatctttacggtttagcatgcgcagctgttgttgctgcacttttaaggcgttcgtggtatcacgtaatgttggctctccatttcgtgtgaacacgcaagtttcgcctttgatatttagtttaatttgatatgccatgcttaatctccttaggtataagccgcccgctgttcgcgtattgtgcatttacaaggcgacaatgatagaaacggctccagctaatgtgtgatctgcgaattactaagccggtgtagcgggagtaatagtcgcgtcttcagcagtcttagggaatacatagctgtggaaggtatcaaaattgaatccatcgttgtcttcacgaccaatcaacacaacattgccagtatcttggtcaccacgaggaataaatgagccttcgatgctgtcagcacttggatctggtgtgccgtcaacagtcttggtatcaacgcccggaagtgagaacattcccttgagcataccaacccaaacgtatttaccatttgagagctttgtacggaacaaagttgcggcgtaattagggctaaggttctttggatatacttcaaccccattaacaacattaatgccaaataaatcagacttcatctgtgaatccacatcgtacatttcgattgtttcggttgcttctgtgataccaccagaaagaatcaagtacgggccatcatcagcggacagcgtcttttgctctgttttaatatccaatttcacactagataagccttgaatctttcgtgtgcttggtacaaagtcgtcatcaccgacaaccccgtattcaaaggccgaagccccaaattttgctaacttcttattagttgtaacagcagtatctgccatatttaaaatcctcctttaggaaaataaaaagggctagccaatcggcagtccttgaaactgaaagtatcctgttgtcatacggagggctggggtatcaccatcaacgtaggagttgcgataatacctttcccagccagccgcatgtagtgcttgatatatctgtgtttcaattttttcttgttgatcccagtccgttttgtccacccaaaaatctacttgtactttcggatactctaggattctagaatcgtcagcataatcagcagcatcaccgggcaaagaagtgattctcacccatggagctaaactttcaggagttacgctagtctggttattgaagcttggagtgcctatatacaccttgtcagcaatatccaaattggccgacaggatgtcataaacacgtttttcaggtgccattacatcccgccttccttcaagtggcttaggaaagcagcgataacaactggccgcatgacttcttgggtttcttcaatgaaatgttgcgggtcctgcattgaagtgcccgagtttggaaagtgagcacgccagccagtatttttaccatatccaacgtctacttctgttacaccactcgtttcacggacacttgaaagcttgatgtcatctctcagatgtccgctcatatccgtctcgccgtcccactcaggcgtattgctttttagcttgtcggcaaacttttgtgcgccatctcggacagccgctcgagcctcttttgcaactccaaattggagcttgttaagattagcaagcagttcagcatcccctgtgacttttacgcccatcagctcaccgcctttgccgtaatcgttgtcagatcgcgcctctcgtaatcaggatcaagccctgtgatttgatattcattaccacgccattgaattctccaagttggttggatttcctctgcggtcaaaaatcgcactaaaaaagtcgggctgtctttgcgagttcccaactttgtctgtggatcatttgcttctctgattggcaccttaggaacttccgcccaaaccgtcatatgcttaacaagcacaccatcaaccggaactccgttaaccttttttgactcatagctgacgaacgcaattctctcagtcattcgattagttcgcatcaggatcaccatcctcttccggcaattctgagcgaagctgattgatgatatttgtggttgatgtttgcaacggaaagcgcatgacttcagcacccatacctcggtagtcatagtcttccttcacttgcttcataagtgctgtgaaaaaacgatcccgagtttctggattgcttagaaattgttccggctttgatccaaaactaatagccgaactgatttcaccacaagcgtcatgcaccagttgcataatcattgggtcttcgattgtctgatcaactttcaagtacattttcagaacctgaaactgttcatcagtcagtgggcttttgtcaagcgtagtatctgccaagagtaatcacctacccggcgttaacagtaacagcaagcgttgagctgatgccattagtgctaaatgtgattgtcgctgtgcccgctgccagattggtaattgtgtaaataccatcggacttcttaacaaccgtagcgacgctttcatcgctcgacacagcttcgactgcttgaggagcgccatcaggagtgactgtcaccgtgatatcttttgtggcaccgacaccacccgtgaacgttttctggctcaaagtcactccgtcaggcgttacgcttttggggtatatgttaggaagtaccctgctttttcgtcagcaacagatacaccaaagcgcataccagcttgcaaatattgaccgtgaatctggtcatccgtccagcgaaccatgaagtctgcgcggttagcaaacagaatcgcccgcttgatgtcacccaaaaaggcgtgtgcttcgcctgctgcacccaaagtatcatcagatacaacaacaatcggcataccaagaacgctcttgccagacggggtcaagatactgtcttgcaacaagtaacggccattaccgtctttcaccgtatccaagaagttgtaaaagctctgggacgcgatgattgcacgagagtacgcagggtccaaatccacgttgttgatatgcttcaaatcatcaatgctagagatcgtcttggcagtgaagcctttcagcagagttgcaacggcactgttagtcgtgttgaccttaatttgttgtgcgttctgggcaatcaacccaaccaaatcaattgcggagtcgtcaatagattcctgtgaaaccggaagagcctgacgatacgtttcaacagaccagtcgatcgatttgaagtccggctttgccattgctgggttcttttccaactcggcaacagtagccatcttggttgtagcatttgcaactgttgggtaagtacccttttgtgtggaggcttggaatacgttcgtgaaaggtttcagatcaacaacagtctgcaattcacgctgtggtgtattgctaatagtttctggaatggtcacggccgcatccgctgccttaacacctgcatttacagcatcactggcatcggtaggatcggcacgaaaaattgcaaattcaccagcttctgtcttttcaaaattgacgccatcagtattacgaccacgagtatgcaaataagcattcagtgcatcgcgatagctatgctcttccggatgattgggcttcttcccactcggctgttcattgcctttcaacgcagcctcgtataagtcacgtttttcttcaagatctttgatctctttgccagctttatcatacttggcacgaacgccttctgccttcttcaggttttcctcggaatcttcaccttcaagtaaagaacgaagttctgtcttcatagctggcaacgctgaacgcttttcatcaagttgctttttaacagcagctaatttttcatctaaagtcatctagtgaccctccttattttttgtataaaaataggcaccgattattcgatgcccttgagcaattcctctttattcagttgataaagcatcttgcgccgcttaagttcccattctggcggctgatctagcgcttttatctgttccaacgatcgtgctccgacctttacctcagtgtctggataagcaggtgttgtcaccggcgaaacatcaaacagatgatcaatgttgttgattgtgcgctcgtatttaacccctcgttcgcttgacttttgccacttttgcgcgtctttgtctggcgcaatcgtaaatgcaaagcttgactgactgataatcccttgccggacgttttctagtaagtcacgaccgagttgtgtatctggtggcgtcagagtgtacttaagtccagtgtcgtcaatggtcagttccaaattaacgccagtgcggcctaacacttggttttgatcatggttaaatagcgccacgacattgctcatatcagcattgtcgagcgcatggcggtcaatgtgctcacgaaaactaaattcaccgccgcccatgatttcagatttccggtcaaatttaagcgcataaccttcgatgacagttggatgtttctcatccccatcacgaatttgcatgggtgtcgctgtcattcgcagctcctttgtcattagcatcacctcccttcaattgcgatgcgtgttcagcttgatatgcttccttttgatcaaggaacactgtgttaagtgtcgactgaatacgatccatgttcgggtcttttaacggtttctttccaagctccgcacgtccctcgtttccagtccacagtccgccattaactgctgtattgacgtcagcaatcggcaatccgtttactgattttgtgtcaaagccaatgcgatactgatggcgctggttgtcatcaagcaactttagttcaaactcgcttgtaatcggttcaaagtaaaatggaagatcattgcgaatatagtcatcagcaagctgcttaactgactgattgggactattttgggctaatcgatacgctggcacccgtaaagccttcgcaatctgcgctgttgaatagttattgctgttaatcagattaagaacgttggtatcaacttccaacggctgataatccatcgtcgcgtcaactataattggcgatccagcatcagcacctgcctgtgccctttcaaaatcttcacgaatcttctggcgtgcttcggcagataggcggctctcttttgctttgataattgagcctttcaatccgctcttgaagaacttttgaagcgtggaaacaccggattcttgaagtccaatctcatcacctaaggaaagtagcggcgagcggcccatgatggtgtcatatgaaaagaacttccaatgaataacatcctcaaaactgcaaactttttgaacacttgcgttgtatggtgtgaatcgatagacaagattctcgggatcgcttgtgtccacctgcgtctgtgatggggcatagaactcaaacatagctggttcgttggttatcggatcgcgcacaatccgcgaataagcattgccagtcaaaattgcattgaccatcatggaaaatttccactgatatgctgataaacgtttgttaacctttgtgttcatcagataatcaatgtcagacaagtctatcacttcatcggttgagctgtcagtaatcactaacgggaaccggctgacgtcaccagcgacaattgatactgctgttagcacatcagagttgcgtaacgctgaaatcccaagataagccccacgaaatgacggaatcacccctgaatcaagcaaattatcagcccaatggggatctgcttctgttgcaagtcctcgaaatagcttcattcaatcacctcccttcgttatcaggaagcaacagaataaaggcgagaacaaacaacaatccgccgcaaaccatgaatccagtaggcctattgatcaaaaaagccccatatccagctaaaatgaagcctaaaacagtggcaattccagccatatttgcgccaagaattctaaaaaagttagctagttttccattcacgttctcacctcctagaagccaaaatcatcgctgaagacacgctcatcgtccaagtagttgtccaagtcttccttgaacgcgatggcataagcatcaagcgtggcatcaatcatgtctattttgttagcatacttattcttattaatacggacgccgttgttgtcagacattagaaccgcgttcattgcggcggcctgcataatgcgattatctgaatgctttatgcgaccgcctataacatcatcgcggaactgcttagttggcattgacagtgtcagcgttccttgtcgtacctgtaccatcggccactcaggatgattcttctcaattgccgttagcattggtccaaattgataagggtcgtacatgataccttgaacatctaagtcattacgttcaatgaagtcttcgagccattcatatacccgatcgttgtcgatgatacctgactctaagctgctgatctctccttcgctgtgttgttcagcagccaagtagtcaatccgatccgtcttgattttgttatcaattccgcctttagaagcgacaaatgcataaccatcgagccaccaccagccttcttgcgggattaaccaagtaatggcaaaaaggtcgcttgtacgaccaacatcaataccaatccaagctcttttgccgcgaatatcaggcttttcactcaattcagcatccttccaagcatcgaagtctaaataactatcttcagtcgcttgccgccaaatgttgaaattcttgaccagttttgcatttaaactgccatcagcacgtgcttgagatagctttgtggtcaaatagtcggtgatctgatcatgcacaatatcaacgtcaagtagcggattcgatttaatccaagaattggggtcatcaacctcttgtacgttgtcttgttcagcaatgaatgcaaaatagcgttctgccgtttcttcaccggacaacaccttttttgcatatggataattttgttgaaacatcggcacgttcatgtcgaatccagccgttgaaatgatgaacgtcagataactaggcagtaacacctgacctgaggcaagggtttcaatcatatctgttgttttagcgttggcatattcgtcaaccaccgcaacatggggttcatagccatcgacaagtcctgtatcacgagagaacgaacgaattgttgatccgtcgtctaaattgacaagttcatctcgcgtaatcttaaccattcgtttgatgcctgggtctttccgcatgagcgcacgtaatcggtcttttaccattccgaatacaatgccggcctgcttgcgatcattagcagcggtatataattgccgtttgttggctggattctttccgaacagaaactcatacagaatgacgccagaaatcaaaagcgacttaccgttttttcgtgccatcgaaatgaacacatcggtaaatcgccttatatttggatcatctttgtcaacccagccatatatactgccaataatgaatttttgaaacggtgctaatggttgtggtttcccactttttggttctggcagaatctccataaatttaacagcttttcccgctagatttggatcatatcgccatcgccaatctgttcgtttcaagtcttcttgatgccgtttcaccgcgagattaactgccttagaagtaataagacgaccgtctagcacacgttttatgaaattaggcattggatctttaaattttgacaaccagcatcacctccatcgcgtctagccaaaagtatcaatgattgaatcgttcttctgtgcttcggtcttaggcatgctcatctgcatccggctgttgacattaaggccaagatcactggctagacttttaatatttgctgtggctttattcaaggtgctaatgtacgcataatattcatcttgatctccattctttaaagccaatttcatgttgaccgatgtgtttttgtaaaccgaataccatgtacaatagttttccaactcggcgcgatcgagatttctaagtggtaaggtccccaaagattcgatgattcgcttgtattcttgttttgcgactgggtcaagatgattaggcggtgttacctgaagttttggaatgccatctttggccattaattccgcatgtagcttggcttcttgccgttctttggtcaaatcacccttagacatttgcaacactttgtattttccagccatttcccacttcacctcctaatatctatataaaatgggctgagtttacccctgccgccttaaaaatcgttacaatttggggtgcaaaaaagaggtcgatcgttcttctgttccaagaaatgtaacccccgataaaaatggaaggggggtctagccgtttccagcccgtgtagtcgcccgataaattgtcgaaaatttgttttttaattttttattttcttgaattttgcaaatttgttttctgatttcatttcgtcaagtttgttcatcgctttgatgagttgactcacatctcgaccttgcttggatagtctctgcatgcatgtgtctcggtcagtgtcaatgagtatgtgttcgacatctcgactagcaagcaacgtgtctaacttatcatctggatatgtcatgactaaccatacatggtcgaatgtctgctctgctttaagcttccgcagtatcagctcatagattagctgcacataatcattggcgtctatattgccctgatgtaatggcagccctgttaacgccgtcatgagatggtagtaatcatagacgaggtcatgctgtccttgatgccgcttgacgtacgttgacttgccacttgctggatagccaacgattactgtaatcttcatggctcgatgttgtcccttcttacgcttggttgtctcacgtctcgtcttccagtagtggcagtccctgcataaagcctgcaggttatccgcattcgtgcggtcttcccagtcatcttcgcttggaacaatatgatcaactaatgaggcttgcaggccacagcgttggcataaactgttgtctctaatcaatatctgctcacgcagctgcttccattcattactgtgatagaacctaaggtagtccgactgctgctcattccgcacacggttgtactgcctatccgcctccgatctaacacgagcattggcatcaaccaattgtggtcttccatttataaaggcgagcttcttacttggcatagatatctcccgtatacgatgtgttagtcatgaccatcactcctcgtgtaatctaatgatgatcccaaataagataaacaacgccagtaaagcaatcatcactattagtggcgcgaatactagcagccaaatccatgcgatcaagccgaatagcttggccagcacgaatattagtgtgagcagtaataggaaattgcacatgctaaatcatttccgtgtattgtttgatcttgtcaacccgcaagtcgcaccattcatcatgtgtgccgtctgccttgtagattgttacgactggcattgatcggtatcccagcttgcggaaccgctcgtagtcgtccgcgtctgctgtgatggtttgcactggcatgacttgtgacagcttgaatactgttcgccggcacttttgacagcgcggctttgtgtaaatgattgcgttcatgtgtttctcttctctcgataatttctcaattattgcttgctctgtgtggctaacgtacccgtagctgactcttttcatacctgacatgacctacaccgccaactcgaatgtatagccgtggtgatgtttttgcctgccacaaaggcaagcatgtactccagtgtccttcagtccgagaagtctcgaggctttcttaatactgtcgaagtagtaccggtgtcctgagctagtgattacataaaccggacttccgttcgcctttgccatgcgttcaactaaagtaccatatgtcatattgtaaagtcttgtgcaccattccagattagatacattgttgtttgtcttgtcttcgtctttgtggttgacttcgggcaagttgtcggggttcggcagaaatgcttcactcacaagacggtgaacgagtttttgctcaacttttccatctcgatgcaggccaacctgaagatacccagcacctgctaaattgtaagcgagcactttcccttttaagtggtttcctcgcatgtctacacggtcaagactccttactcggccaagattgctaacctgatatagtcctttgtaatcttcaatatctttccaaacttcagttgagttcataagtgcaccgtagcctttcatcgtcataaacgaacgcatacagcagatgtttgcccgtggtgaagccattcttaatctcatagggatcatttggctttgctgttccaagctggcgccacataatgccacgatcatctttaaaccgctcgctatgatagtggcctgagtgaagttcgtatgtttttgccatattgaatatctttttgtactcaaatgggaaaagccctgtcagcttgtccttggctacatctccgtgggcgagcataatgccaacatgccctagcaagtatgcacagcgccagtcggttgccggattactgtcattgagatcaacgtgtacttgcggatagcgatctattagcgcataaagaaaagcgtattcgagatcacctgaatggttaccgaacacgctctttattgagacgcgattgctatattcaattgccagcggaataatctgatcaaacaacttcacagcatcatggaatgcctgacgcatgtttgcgtgatctaattgtgttcctctaaccgtttgtgttgcatgaatctgatcactatggaacagatctcccaattgctcgatcacaatctcgttgtagccgtccatgattatctctctaagttgactcaccatgtcttttagatcggcgaatgttgtccagccaaaatgcaggtcaggcaatgggatgactaagttgcgatcgcccgatttcttcatgccgtaattgaccggaatgattttgtcgttgaacgcttcagccatttcatttatcgataagccttgtttcggctttacgcgaatatgaatgctatactgcggaactgtgccgtcttcggtactatgctgctcataaactttgtagtcgcctaagaccatctcgaacttatcaggatcgtatccacacaactccatcaaagttcgtgggtctttatttggctcatgcttgagtctcattaaggccgtgactgtttgactaccatcagcattaagagcgacttttctatcaacgggtttgctgtttctatctgttttcgctgaatcgtattcattcttggctggtttttggaactcgatgccaagccgtcttgctttaccttgaagcgcatcatagctaattccgagtttgtcggctgtctcgcgtctggtaaagccttcagaggcgagcttcctaatgtcaccgatctgttcatctgtccattgcatctactcgcctcctgaaatataatgaccgtgagcagtttgatgacgctgctcacattctcatgaagaacttcccgagttcttaagccctcggattcggacccgaaagcttttttgttgcttaaaaaatttcgatgagttagaattaaattgttcccaacagatactcattttcactcctctgtaataccctatctttaggctctcggcccccaaccgagggctattttagtatcttctataaggaatgtgctaatatatatgcgtgagtagtgtcttttctcctccaagtcaaccgctgctgctcacacaagtatttcgttttttcattcttttggctcttggactggtctctgagggcttttttaatccgatttattgctacatgtgttatactcttttttggtaccgttgtttcacctcagtaaacaccggtagctaggccctcagttaatcgctcagagggcctttttgttgcacaaaaatagcacctcaccgttcggcggagtgcttgggtaaataaaaagacgccgtggcgtcttgatatctcaccgatttgtctttcgtttgatgtcgcttgatccgagattacaaacagaaaagcacaaactaaatattcctagaaaaagactaaaaagaatcattttatttccctccatatacgttcaaatcgccactgactctttcattcaaatccttaccgttcttttcttggaatttttgattgaactttaagtattttgtggctagatcattcctcttctgcaaagcatttctgtcgtcaagaagaacccgtctaactacagccaatgaattcatgaagtcttcccggtctcctgcagttagatagaaagactgcttgtactttttattttcaaacagctcagttactttggcatttaatcgataaatgacatcagctaagtccttgcgatagacttggtaattcattgaattgcgttgaggcaaacgagttatttgaatatcttcaattactttcaaattttgtttcaagctatatatttgatagtcaatttgattttttgtaacggctatgtgatctgactctgcaacttttccagtcaaaatatcaatgtcagtttcggctagtttagaagagtttaccaacgcttgatttgacctttgcatgtattcttcatttgctgtcctataactattccacgtattcaaactgatcgcaaccgaaactattgatattattattggaataatcttgtcccactttgttttcattacgtggaatattcctaagacaaaatcaccaattcgctcatacagtggcagcttcactttcaatcacctcaaaagaatagtaccccagcatgaactggaatactacattgaggtggtgaaggcacgagagttggattcgaaccaacggttaatgacgtagttaaatgcggccgcattcctccataatcgtcattcagggcaggtgctgtgttttagaccactcagccatctcgtgcaatgcaaccggcgggatttgaacccgcgacaccgacgcacgcgcgaactttagtcggtgagcctatctcaatcggttgctgctcgctctcccagtgtcagatggggtcgtcgcaagctttgtccggtcgctaaactggacaatgtggcatacgggaatcgaacccgcctgactatctcagccagtcctcattgccacgccttgccacagctttatcatcactgaggctcggaggaaaaatgcggtgtctcaggtttctcacctttggcacaatacaatcataagggattccgtttttagttcgccactcatttatcaatcaattagtcctcaaatagtcctcattcatcgatcatttattgctcactactttttctgggtgtgacgccaaagtaccaggccgctgctaacaacgcatttttctttctgcgtgtgtaggttgctgcagatatatcgagaatattcattgcatcaccgtctggcgtatctgtttctggcccatcgcaatagcgcacccttaataaacgctgatgtgattgtttcggcattgatgcaatacaactgtcgcaccattcacagaacttacgtgccgattcttgtctttccaaacgctgctgtgcatacagcggacgctgaacagtgctggcagaagttccgtctccccatgcactagtgatctttggattgactggcgcctttatgaatccacgctctgctcggtatttatttaggatattttcgactgcttcccgatccttttcatcgctaattgataaaagctccatcacaagcgccaccccttatggtataattaaatttgtaaaagttttggggataagcgtgccttcgtggtgcgcttttttgatgccttaaacgtgcgttcaacatgtgcgtttgctatactgtcattggaggccaactcctaatctttgatttcattcactctcaatcgtacgtttggcctccggcgcgtccctcattaggcgcgctttttgtttacaatcatttgatcctttcccagttagcccacatccacattgcagcgcctgagattagcagcattacggcaatcattgctttccctccaatagctgtttgtcttcaaagatgttgccaatgtgacgtactcctaatcaaatttgattgctgtcatgttcaggtgctcaatcaagccaaggcgttccaaccgctcatagttgagacgctcgcagtataaatctgcttcgtactgagacctgaattccttgattttggtttcgccattgcgacccacaatcttgaatttcatttttttatcggtcctatccagttggctcatttcttcataatgtttactcatttttcttcctccaatttcacaatttcgccggtttcctcaacgcgccatacacctagcacccatgcaagggcgaaggtgtcctcatgttcaaacgtcatccatggagataaagaaactactgcggcgtagctcatcgttccggatagagagaattttttgtgtttgagttttacaatcacatcgcctaccgctttcggaataaccggcagattatctggaaacgcggcgtcatatctggcacgccattgttctgaaccgtgtgacatgtcagccattaatgcgttgaacacgtcttgcttcgtctcattgctcatcgtcagtcacctccaactgttccttgttgtaatcgatgatgcgttgatagccatcatgtgcttgccacgcgcaatcatacaggccacacagatcaagtttgttgatcgcattgttcgcggcatcgatggccttttgcgcagcgtctatgtcggctttattcgtcatcgtcagtcacctcttctttttcgcagtattgcaagccgtagtgctcgatctctgcttcggtgaacttgccacgaagttctttatccgctgggcaaatcgttaacaaatctgtatcgccggacttgtaataccaaacctctttggtatgtggcaccttgacgttatacttcttctcctttgccacggtgtagccgttgacgtaagcattcatcagcggctcttcgtcatcatcgccatagaaagcaatgctggctgctgggaacttgccgctatgtgcacgttcaacgatttcggcttgctccttggttaggactacctttttaggctcctcaacgaacgtgacaacgtgaccgccatacttttccgcccatgcaagcgcaacatcaatatttcttacagcggttcctaccggactgttccaccaaggtgccgtacgctcaacggtcaagtattccccatgatcgttcttaataaggtatattttctcttcgctcatttttcgtcctcctctttcttgataatcagtggttccggaatatcgactttaatgtcatcgccacgggtgttgtgcgattccgtgtgcttggccatgttctcgtttatccagcggatacactgagattgatactttgctcggtaatactcggttcttgtgtttaagcctgctactacgtacatttgtgtgcctctcatttcgcgttgactgacttcacagcctgatcggaatagtccttgatgctctgtgcgtctttgatggcttgtgataagtcattgtttgcctgtttggcggcttctaactgagatgtaagatcattgatggtctgctgtttagcatcgacctcagcctgtttctgggcaactgctcgctgtccttcaatgatcttttgctgaatctcggcatctttgcttgccatgtcgttgtcgtattgctgttttagggacgcatactgtgcctgcgcgtcagacaactgatgctgcaaatcggacaagctagattttgaagcgtgaatcttagccgtcagcttgtcgatattgtttttggtctccacgatgttctggtgaccttgccaaacattgtcggcaatggtggttgcaccggccccaaacataagtcctgctaaaacagttactgtaaatgtcaattttttattcatgattttttctccttaatcgatctcttcgacttcaactctcggattagctttgtcaataaagaaccgatctcgcagttctacaatgtgatcccagttgtcgttttctaaaaattcagccttttgcatgccgtcgaagataaacttgtgctgaaacgcgatgttgtccgggtctgttcgcttgtcataccagtaccagtcgaaacttagaggttttccccattgaaatttcacgccctgattcatcgcttttctaacagccaacattaccgtttccgttgcttgtttcttgacttttgctccgccgaacatattgcctcgttcaaccttgatgtactgattaagagtcatgaggggcaatggaataatgatcctgttcacgctggtttcacgtccttcagataatattgacgttgcttgccgtcaaccatctcaaccgttgcgattaactctttaggcgcattgttgtcaaaagcaactggcttgttaatatcttgtcttgctcctctggcgttgtatcgttcaatcctgatgattcgtgccacaccgccaagatcacgcacgcccatgaatactcgatcaggaaccataaccagatcaccgaccatcatttttgttttaattgcttgcatttgaagattcctccagtagttccttgtattcttcctcgctaattggctgttttagcttttctagcgatattcccatggctttagctatctttgtaagtgtgatcatcattacctctctgccactaagaaaactagaaatagtgatgcgactcacgccagcaatcaaagcaaaacggtatattggcaagctgggatgatcatcaagaaagttgcgaagtcgttcacgtgcccaatattggcctgcattgttagtttcgttctcatgctcaatcatgcttttgcctcctcaaaatttttgttctggtaaactcacgtttagcttctgcaagtatcctcgccaaatatcgtatgtgttttggcagtatactcgcgttactggatcagtttctttcgtgggaagataagcactagtttctccgaaatattctgactcagccgtctctaaggcatcgaccaaggtaacgtacgcccactggttccaaaacttcttcataccagcatcggcttgttttgcctttttaaaatactccacggcttcatcaagttgcagaataacgaacagtgagtattgataatgtccctcctgcatgtactcattgaactctttaagtgtcatagttggataagacatttcaatacgccaccttaaactgcaactttggcgcgaaaaaacgaaaatcaatgctaccaagtgctccttcacgatttttggcaattgttaaagtcacagtacggatatctgatttttcatcctgccggtcactgttccaaaggaatccaatggcattgctatcttgttcaattgatcccgactctcgtaaatctgatagtaccggttgcttgtcctgacgattctcaacgcctcgtgataattgactaagcaaaacaattggaatattaagctcgttggtcagcactttaaactgccgcgtgatctcttctatttgcaggcggcgatcaggctgtccacgaacaccgatcaatccaaggtaatccacgatggcaagatagcctttttccgcttctgcggctcgctgacgcattgttttgacgatctgtggtaattccacctgcttgtcgtaaagctgcaagcgatagtctttaagaacgtttcccgccttttcaacctcaaccttctcagcatcgcttagacttttctgcgggttgatgaatttgccagcactgatgccagtcttgcaggccaacaagcggttgtagttttctgcatttgacatttcaagcgaaaacatatcaattgtcaattccggttgctgttttaaagcctcaatgatgagattaaccgcaaatgctgatttaccgacaccagggcgcgcaccaatcgtcaacaaacgtcccggcatcaagccaccacccagaatattgttaagagtgaagtacgttttaatcccattgtcagcggcaccgtgtatcattttgtcttccatgtctgctgccaaatcagcaatggtactttcagttaccgtctgactggcagcagtagcattctgtgaggcaaccatcatcgcggtaagattgtcctcgcttggttcttccgagtacgcttgtgctgctttaatgagctgactacggaaataatcccgtttaagcttgcctacccaccagtcaaaacgtgaggtgccaaaatcactggtcataatgtattgccaatctgctgctgacatcacgccgggatgagctgtatcgaaaccatcctgcaattccagcgtatcgacgtcacctggcaacttgttcatgtaggcaactactgcagcgtattgctggctgttaaaccatttaggatcaatccattcagacttgatgagttccggcttcgtatatagtccatacatgacatgtggttcaggattgctagggtcataaagcttttttgtcaagcttgttgcctccgttcatcgtattcagcaatgtaacgtttagcatcttctggcttgatcggaataccttgcgctttgatttcttcaagcactcggtcaaggctgttgtagtcgatatacattgcaatagcagttttcttgggatcgaacttaggctttcgagcttcctgctcctctcgttcttcctttacgacctcgaggtaatcgttccatgcctcttgattgaagaaagtactaccgtctttgacaaaccgcttctctgtgcctttgctcttgattagctgtcgataagccacaatgccatcctgaatttgtctgttggtagcagggttcttctttctactcattgctcgtttgtaagcagctaatgctggcttcttgccaatcttctttggatacagtttccagagcttttcaaagtcactctctaacgtgctatttgcacgtgtatttatattattaatacttgtattattctcttgctcatttttgagtatagggtactcgcatttttgagtataggtattctcatttttgagtatagggtaagcattaattcggatataccttttttcgatttctttactgccatctttgtatttaacggttcgatcaatatatccatttttttcaagtgaagttagccacctctgaatcgtagcttggctaactttataaagccccataaaatactgatcgccagcccaacagcaaccggttttattactcaaagccgtgatttctccatatagaagctttgctccttgttgaatgctgttgttataccgtacatttgcaggtataattgcatagtaattaggggtttcattcatgatcgtcaccaccttcatggaagcattgatcggcaatattttggcgaacatccattaagtctgcttcgaatttgatcatatcgagtgatgtttgacccaagatatccatgtattttttaaagttatctttcaggaacaagcggttttgaatcttctcaccatcggtcatgtgaggatcatcatccctgaatagatcgcacttggtttctgcccattctctcaaataatccaagaggtactgattagttcttactttgtatgcaagtgattcaagacggtcaagttgcttgccaatttctctggtcattgttttacctcatttccttctgtgatataatgaggtcactcaacgcgaaacctcatttttggccgttaagtgttctagcgcttagcggtttttgttttgccaattatttcgttgattaagctgatggcggtttgcaagccgtcttctcgtcccatggcataagctcgcgtctgatccgttccttgacggtaattatggccaaccagacgtgcgttctcagcctgggtatacaagtaggagataagtggaactagcttggctatagcttcttcattcaatccactgcctccaatttccgctgtggcctaagcagtgaccaatgatcacgccgaaggcaccaccaattagtaaatattcaatcattatttgcccttctctctaagcgaacttgaaatctctgggaaccatttgtcgatgaatgttctccacgggccggcgtgaaacatatatcccttttgaccaggtggtgggtaatggacgatcctgtcctctaacacttttcgaaagcgaggtacatcgagaatattgttaacgacccatgtgttgttatgtcctttgattagactagcggccgttgttaggtcccaatattccattccttcaagctgacgttttagttcttggttctccttgatcagctttgcttgctcttctgcatcaactgccaaatattttttgcttgaaatctgcttattttcgacaatttgtaacagttccatggcatttcctcctttctttcgacctccccttggcagataatcaggttatctagtgatggaaggaggtgattgatatgaaaaacgcaactttgctttttgctgatggctcccgccttgaacttcatgaaggtgaaaaacttagcggtgtttcgttttctgaaaatgcaactcatccacggaacaaagatcaagagtatgaaaaactgatttaccctgaacttgctttagagggcgttgttctgaagctctggtctcatccagaagtcggactagctgaatctgtttttgaagttcttcacaactatgagtggtttaggccatatcacgaaagtggtcattactatcattcaagcgccgttatatctgctaccttcagttagctatgcgttggcttaacgcaactttgatgattcgatcaatcgcttgttggaaaacttgatcatcatctgaaaatccatttaggtatctatggtctctacgttgcttttctagatcagaaattgcgtcgtcataggtaccttttttgtgttgctcgattaacttttcacagtaagatgccaacttttctgcctttaaaatctttaagttcaggcacacttgagataagctttgcttttcttgttcagctttcatttagacagcctccttttgtagaaacttgttgataaaatactgctggccttttccggttaccttggtagtcttggtgatccgcacgctgccgtctgggttctggaatgtacgttccttgatgtcgaacagttccaagtccatcgcgcgttgcgttggcatgtttcgccggtcacccttactaatcagatagccgtgatctcgcagccaagcgaacagcctattctggccaatatccacaccgttctggcggatgagtttggctaagtcaccgatgagaatgctcgtatggctggtggctaccgcgtctgcaaacaacgctttaggcgcttgaatcgcgatggtttgcttctgttgctcaatcttttcagcttgattagctgccagcttcaacgcttcggcatagcttcccgggattgcataacccgttctgatctgcgtttccatactgttaaaggcttggatgtactgaatcttgaactgaagcgcacgcttcccagtgaatccaacagccagcaatgtgaatccgtcacgattcatgtagtacattggattcgttttcccattagaagcggtgtaactaccatcaataaagtacttttttagtacagcgtaattttccgcgctactcatcaaatcacgaattgctgctagtacatctctgtggttctttccaaatgattcagcgaccttaagactggtggtgactgcctgacggtcgtgcataattattaattcattcaatgtgttcccttctttcttttggcctcattcattaacgatggccatttcacgtgcttgacctgaggtaccgatttggtacttcagctggtcttcttcttcaactatgagacggtaacaaagtcttgcttgccaccgggggtcatcaatttggtgactcctttttcagttgcgagattggtctcgcctgataagccccctaagttaaacttagtcacctcatcgccgtctaatgatttcaacgctaccgttgtgtttgttagtttcagcgcattcgtaatatccggtgctgaaaaccagataatgccgtttgagctgacagtccgaatttggttatcctcgaactgaaatagttgtagttcgttcataccgtctccccctttgtaagcaaatattttttgccaactacaaatgtttcgtagtctttgggcaaaaaaataatcgaatcaaatggtagtttaactagctttgcaaactcaaaagctttatctgttcgcaaaacttttcgatatttctcatagtcagcataggttttggtgctcattcccagcgcttccgctacttctttctgtgaaaaatgcaagttgtttcgtgctccttcaagcgtaaaagctggttcaattcctgtcattttcgttcctcctttcaacaaaactaaatatactacgaatggttagtagttgcaatagctttttgcaaataaattgtatttaggtatgtacttttctacgcaacaggtgtacattatagccagcataaataggaaatgaggaaacgaaatgaatactggagacaccataaaaaagctaagaaaaacccgcgggatgacgcaatctgatttggctaacagattgggagttgctccgaccactgtgtcttcttgggaacgtggagctgcttatccattaatgactactgctaaatccatagcagatatcttcggtgttcctgtttctgtgattgctggagaaaaagagatctcaaatattgctccatctatgcctgtacactcctacaaatacttagatgcaggggtttcatgtggtgcccctgaattagttgaagcttatacgaaagacaacttggaagaaatccaattatcagatgccataatgggacgctacgctggtgatgatgacattcttatcatacatgccaacggcgaatcaatgaacagagttttccctgatggtgcgcttctcgcagtaaagcggacagatgatctaagcaatggagacattgtcgtcttctcaattgacaatgaagatttttcttgcaaacgttactataaaaacgatgaagctaaagtagtctcttttcagcctgacagtgatgatcctcgttttgaaccatacgtttatcgttatgaagatgcagacaatgtcgctatatttggtaaggttgtcgtatacacagtcgttttataaaaaataatcttacgtccaaaccctgatcgacgttaaaagctgatggaaattgggggaaaatcgacataggaatgtttgataatgcttcaaagaaagccacccagtatcttaacaagcaaggacttggcgatctcggcgttggccgtgtggccgacgagggcgtcacattcaagcagctgtcccgcgattatcaacaaaagaaaattgttctacactcactgaatgacaagtatcccgacagatgcctcgatcccgaagatatcagcatcataggcgttgtcatcaactaacccgcaacagtatcaggacgcggcgtcggcctacttacgcgatacaatctagtcaacaacaaataaacggcttagaggtgacaatcaaccgtgactacaaataaacaaatggtaccggagcttcgcttcaaggggttcactgacgcttgggaacagcgtaaggtttcggaactagcagaccgctatgataatcttcgagttccaattacagcatccgaacgtgtagctggggaaacaccttattacggtgcaaatggtattcaggactatgttgaaggttttactcataatggtgaatttgttttggtcgcagaagacggtgcgaatgatttacaaaactaccctgttcaatatgttgatggtaaggtttgggtcaacaatcatgcccacgttcttcaagctaaagaagaaagagtggacaacaaatttttgacgaacgcattgaaacataccaacatagaaccatatttagtcggcggtggacgtgctaaattaaacgccgatgtcatgatgaagattaattttaaagttccaacattacctgaacaagttcaaattggtaagtttttcgataatcttgaccacctcatcactcttcatcagcgtaagcttgaaaaactccaagaacttaaaaaaggctacttgcagaaattgttccccaaaaatggaagcaagttcccacaattaagatttgctggatttactgacgcttgggaaaagcgtcctatcaagaaaatcgctaccgtgaacggtggcaaggactacaagcaccttaacaagggtgacattccagtctatggaactggcggatacatgctaagtgtcgaccaggctttatctgaggaaaacggcattggcattgggcgaaaaggtacaattaactccccctacattctaagagctccatactggaccgtagatacgttgttctatgtgatacctaaggggacacaagatctaaattttctgtatgcgatttttcaacgagttaactggaagaaatacgacgagtctaccggtgtaccatcattgtcgaaacaaacaatcaatgccgtggaagttacaactcctactcaagctgagcaagaattgattggaacaatgtttaagcaacttgataatctcatcgcagtcaaccagcgtaaggttgaactgttaaaaaaattgaagcaagcctatctccagaaaatgttcgtgtagtacttaactgtggtacaactgtcatcaacaacccacgcaagcggcgtccccgtgcaagccggagagtggggcttgtaccacataccaagtaaaggatgtgagtcatcatgctaaaaaagatagttgccatcttacttattgttttgttggctggcgcaacaaccgcttgcgatgatgacaccggtcatgatgaaaacgttgaaatatttaactgagtgcgaactggatacaaaaaagccccggccgctgtggtcgaggaacagttgtttctgtcaaacgtaactactgtcgcaatctggctgttttgatagcatctggtgttagctgaatccagtgaatatattcaccatctgaaagatcaacaagggccttaccagacaaaagtgcagcaacctcgtttggcccaatattgggcttacttgaaaacatgccatacatgcccgatgcttcgtcgatatcccatacttcgtctttttcgtcaacgatatatatgccattttccatttggagaacctcctttatcatgattacggttcacctaatttcttttttcatgaatttcattcacttaattatatcacgaaaagcgcctacttcttcaaaacattaaagaagccacacagattgtaggaggtaaaacctatgaagccagttacagtaagctcttataagtttggcgaaaaaacctggaaaaattttgaaggagaaccgatcaaaaaatatgagcactcagttctcctagacatttcaaacaccgaagtcttcagtgataaagaaaaaacagaactaaaccacaagatcgttgtccccttttctagaattagagagaaacgattcatcaaagatattccactcagtaacgtaaacgaggcgcttaacaagaaaaaagcaagtaggagaaagtaacgacaaaaagcgcctacccaagcgaatgggtagacgcctaacagaacgtgactgcatggttaggtgcaatagcacccgtctgtattgtagcacaaggaggtgtaaatgtggccagtattagtaaacgtggcaaaaaatggcaatatcgtgtctcttacaaggataatgatggaacacgcaagtatgtcaacaaaggcggcttcccctcaaaaaaagctgctgatatagcggcaaccgaagtcgaacgtcagcataatcgcggtgcaaatttggatcttaacaagataacgttaatcgactactgggacaaatggattgagctgtacaaatctggtaagcattctcgtatcaccgaagcccggtataaaacaattcgtaaacagttattagcctactggggcgaaagccgtgaactaaaatcaatttcaaaatcagactggcagggatttatcaatgagtttggcaaaaaaagggctaaagatacagtcagcaaattgaatggctatgttcgctcaatggctgattctgccgtcgatgaccaaataatatatactaacttcactcataacgttgtcctcactggtaatgaaggccaagcaggaatcatcaaatatttgcaagtaaaggatttgcgcaagctcgtcaattactgcctagaatttgcagactacgagcatattgcttactacatcatcgcaaccggggcactgaccggagctaggtattctgaagttcttgggctcacgtgggatcatgttgatcttaaaaaacacgttgtgcacattactagaacgtgggatcacagatatggcagcggctttgcggctactaagaacaaatcaagtgtacgtgacatcgacatcacgagagaacttgcagacttgcttttacgtctcaagaaggaacagcaagaggtatacgttgctcagggatatcgtgatagcaaacaactattatttcgcagcatacggcataacatgctatcgagcacggcaattaataaggatctaaggacgatcgagaaggctctagacatttcccccgcgattactttccacgggcttagacacactcacgtttcctatttgattgccaatcacgttgacattaactatatttcaaaaagacttgggcatgccaatacaatgatcactcaaaaagtctacgctcatcttcttgaagatcaaagaaaagagcaggtatcccagacgctacaagcactttctagactttagcttgtgcacattttgtgcaccggaggaaaaaaacaaccgaaaataaaaggaaacaaaaatcccgaaatgcctttataccagcattccgggaagctatagaaagcatctagaagcataaaaacggagagtaagggattcgaacccttgatacaggcaaaacccgtatacatggtttccaaccatgctccttcagcctctcggacaactctccataaaaaactccggttgtcaggctcgaactgacgacaacctgattaacagtcaggtgctctaccaactgagctaaaccggaataataccgatgcatggcgtaacagcctagaccactatcaagaattcgttatcatcgttgcacttgacttgaaaattgaggcatttttataactttttaaccaaaaccaaacacggattccaggcatcccacaactgcgggaagacctctaagcgctcaaaccccatcgcttcataaaaacgaatcgttcgatcatattccggataatgaccttcatcaactgtcttaacctgcagataatgtgcatgttgccgcgcaaagaccgctaacgcctgaaataattgccggccaactcccttgtggtggtaagctttcttgacgcccatacagttaatctcacctgttgcttgagttgttttatcaaaatcaatgaacccaatgacttgattatcctgtttagcgacccacagtggtaaagttgccgccgcatcaatatattcctgtgttgatgcgggtagcccaaaccattcaggcaagtctgctaaaacttcgcgcacaatggcctgcttttttgctggcgctttttcacgtgtgacgatgatactgttgctgctgaccatgctgcatctcttttcaatcttggattaacttgacgaaaaacaattcactcacgccattgtcaggataatcaacggttccaaattgttgaaatcctagcgcaggataaaactgcgggccttggaatgacaacgtatctaaatggacgatcgggcaattaatttccttgaacgcggccaatagttggttcaccagccgcgtgccaagtcctttacgccgatacgccggtgcgatccacaaggcttcaatgtagccgattcgatacatagcgctatagccaaagataccgccaacacactggccatcttcttcggccaaaaaagtgaacgtgattcccggttttgcctgcaaaagcggcttcttcgccaaattctctgcttcaaactgatcttcaacccaagtcatcgctgcatcatcccctgaggctaacgtatagatcgctggcaagactggtgatacttgcaactgcaatggtttgacaaaaaagtattcggtcaatgctgcatgggtataatgcaacttgccgaacgcttgatattgattggcgcgataaaaagacggcgcctgataatcgaaagtttctaacctgactttgcgacatcccgccttgaaaagttcctgctcgactgccactagcaaagcctggccaattccctgccgacgaaacattggatcaacccatagcatctctaaataaccgatcccgtaatcatccgaactcgccgccacgccgccaataacttgagtgccttgtttaacaacgagattaatggtcaagtcagcccccttcccggaaaaagggtgcgactttacattatcgtgatctaatcggtctaccagttcccacccttgatccaaggtgcctgatttgattttcatttcatcctccagtcattataaataaagtaataaagactcaaaagtaattgctttgttcaaagacttttgatcatagcatttgtaaagtggtacgcttacttggctttgattatactgaatattcaactaaaataaaatgaaaatcaaagaggtcatgaaaagctatcgtggtatttcaccgcatattgagtgtcccttccggaaaaggactcgcaaattataatttatatcgtgcgatttcctcacgatatcggctcaataactgatgtgtacaacgcttgggagtcattgatcttttgacgtttttccagagaattgctgcaacttttaatcgagaactaaagacaacagtagcatgatcagcaaagaagtcgcgtacaaatcgattccactcgtaagtctgttcctcgacattatgggcaagaaactgtttgcgcgccgatggtgtttgcgtcgcttgataaaccgcaactagatcggccaccgtcaatcctaactcaggccgcgactcggcttgccgtttgacaactgccattggcttggtgaacgcaaacttagatgtcttaaaatacgccgcaaaaaagcgacgtgcggccgcgttaaacgcgaaacccgatccggcaagtggcgtcgtgagcgtgatcgcaccaagattaaccttggctgtcggcccgctcgttcgcgttggggtttcaggaggctcacctaacattaccgcccttagccgctaattcaattccgctttggtaccggaagcagtcaaatgatactcacggcaaagtgcagccaactcggtcttgtagtgataatgatcaaaaaaatccgcttttaacaccatgccacctgtccctttgttgacttaccatcttgtgtcagttacttcttaagtatacattagtctaaattaattctcatgccggtttttcaccgaggacggcaagttgcttatcgtgggcgtaaccgtacaacggtgattgatacttttcagagttgactcggtcatcatctaaaaacgcatattcggttaaaataaaaagcccgtggttagatcatcaacttactttgacaatccccacaggcgctcaatattaatctttcatatgttcagttaattctactttagcagcgttataacccttgataaaatcggcaacctcttgcatccgatgaccagtgaccacattgccaaacggtgcgatttgcccttcacacacaacacttcctaaatactcaaatggtgccgcatccgctcatttgccgtacacttctttagccaaacccattgccgaccacgccttgggccaccctgcataaaatgccaaatgcgtgatggttgcaacgacttcctcttttgtcaagccatgatccttacccattttcaggtgtgcttttaactgggggaaatcgccgctcgtcataagacaggcaatggtgatcaaactgcgatcacgcgccgacaactcgttttctttggcccagacttcgccgaacaagacatcatcatttagtgcggcgaattgcggggcaaaatcgcctaactgttttcttcctgctgtttgtttcttcattaattactcaacctccgttaatgctgcatatgcttcatcactgacaggttcaagccattcgctagttccctttgtaattgcaatatggctcatccaatgatcttttgtggccccgtgccaatgtttgataccttcgtgaatcgtgacaacatcgcctggacgtaacttttgcgccggcttgcctgcttcttggtaccagccttcaccacttgttaccaacaagatttgaaatccgtgatgatgaatgtgccagttattgcggcacccaggttcaaacgtcacattggcgacatggacatcaatttcattttccgcgcctacaagtgaatgcaaatagctctggcctttaaaatattgttgataagcggtgttagcttggcctagtccgaaaagacccgcatgatcattctctttggtcacaagatctaccttctttcgtcattgagttcattatgcgtcagcgatcgaaaaatgtataatacttatatagcatatatcattatgcatttttatcatgattaggagccttgaccttggaattacgcacgttacgttatctggtagcaattgccgacgcaggcacgatcacggctgctgccaataagattcacatttcccaacctgccttgtcgcgccaaatgcaggaactagagcgtgaacttggcaccaaactttttaatcggaaaaatcgggcgatcagcttaactgctaatggcacttatctcgtcaaccgggcacgccaaatccttaacctgacagacgctgctatcaccgatatgaccgatgaccaagccattaacggcagcttagccattggtttgggtgaatccaggcttaatcgcagtgttctgcacgcggccaagaccttggtgaccacatttcctgatgttaaattaaaaatctacagtggtaatgcggccgagatcaccgaacaacttgaccatggcttactcgactttggcgttgtgatcgatccggccgatacttataaatatgcctataccccgattaccggtgaaaacatctggggattggtggttcctaaaaccgatccgttggctaaattcgcggctgtcacgccaaaaatgatccgccatcaaccactcatcatttcagaacgacaaccagttgtcaccttgtttgaaaaatgggccggtccgaattttgatcccgcgcaaatcgttgcccgcttcaatttagcctacaatgccggaatactgacaaaccttggcttaggttacactgtgggccttgatcatttactcgataaccgggaaatggccttatcatttatcccattttcgcctaagctcacgacccgtatgacgttgatctggacccgccatgcacccatgtcgcgaaccgcgcaaaagtttctgacaatctttcagcaacaaaacccgtcacccgccacttgaagattaacgcaaacaaccagcagatgcgccgactgaggagacgttatctgctggttgtttattcaagctatgattgaaagtgactcaggttataactcttttttctgcaaaagccatgctgacgatccgatcatcacaatcaaaaatccgaggctaactgcaatatacggcggcaactcgctcatttccatgctaccaacgcccaagttctgggaaactgccaagaaatcaatatacttcaaccaagaccactctccaattagatggatcacccctacgagaatcgggaaaataaccacgacaatcgtggcaattgtcatcgagccagtcgcgattaataaaaagacacccagactaaagatgacactcaggaaaaaggtggctgctacaatacttaagctcatggtattcaaaacacttggccagctggcacctaatgcgcggcccttcgctaaaccgccaagcagcgcaatgccaaagttaacggtaaataagataagtaagtcgagcaacatcactaagtatttcgccagaacaaattggaggcgtgaaatccctgaaatcagcgtgttcttgtaaaccttttggctaaactcatagccaaaaacaatcacaaagaccccgataaagaaataaagtaagagcgtgtccgtcatattggcggcctgcacgccaaactgaaccgtccacgtttttgcagcaatttgagcaataagattgtcatccccatgtactgtcacaccgccgacattcttgcttgtaacagaccaaacagcataggcgatggtgataagaacgatgacatacatgcctagtgtacggcgttggcgatagaaatcggcgcgaatttgattcatcatgcctgtccctcctgtttttcagtctgccctagcaagcgcatgtaaaattgctccagtgaaccggcttggtggctgacgtcttgaacactcaccccactggtcaccagtaattgattgaccgcggccgcatcgacatctttttggcgtaataacagatgctggtcgtcaagtacatcaaacggctgataaccgtgctgatccaatacctgtgcggccaccgtcgcccggtcaacggtaatggccagtcctgattgattagcctgatccaattccgccttgcttaattgcttgatcatttgaccatggtgaatgatgccaaatcgagtggatacttgataaagttcactcaaaatatggctcgaaatcaaaatcgtcgtcttacgttcttcatttaataacttaagtaatcgtcgaaattccataatcccggccggatccaaaccgttgatcggctcatctaaaatcaaaaaatccggccgtggcaaaatcgctaatgctaaccccaaacgttgtcgctgcccaagtgaaaggtgcttaactctagtggttcgcttttcccgaagccccacaaaatcaattgtctctgcaatgacctgttgatcattgatgccatgctgaatggcgcaaagtcgcaagttctgagtgaccgttaatttttcaaacgctgccgggctttcaataatcgcccctactcgactcaaagcgcgctggtaatgtccggcccgctcgcccagcagtgtaatcgtgcctgcctgcattggggataagccggtaatcagccgcatcaaggtcgtttttcctgccccgttttcgccaattaagccataaatatcaccacgttcaaccgtaaaactcacttgatccagtgcctgaaaatgaccgaattgtttactgacctgatcaatcgttaaaaccggttcatccatcgtccttacctccattattttgctttacaaaaccagcatagcgatcattccttaattaccagcataatcaatccttaattaaacctaaattgtgaaaaggtgcattaatagcttacactatcattggaggaaaggagtgacgctgatggcgaagatattaattgttgaagatcatcaggatatccaggccttattaaaagatgtgctaaccccgacttatacggtcatccaggcttatgacggcattcaggctttaacggcctttcatcgagaacaaccggacttgatcattctcgatttaatgctgcccaacgtgaccggtgaaagtgttttaacaaccattcgtaaaacatcccaagttcccgtgctggtgttaacggcgattcaggaaaaagccaaaaccgttgccctgttgcagcaaggcgcaaacgattatttgaccaaaccgttcgacattgacgaattactagcacgcattcaagtccaactgcgccaagtcagcggccaaccgttaatgacgaacgatcaactaaaagtcggcgaaattcaattagaccctaagcgtcatgtggtgaccgttaatcagcaaaccctaacgctgcctaaaaaagaatatgacatgttggcgttaatgatgcgtgatccccatcaagtctttgataaaagccaactttatgaacatgtatggggtgagccgtttttaaatgccgacaataccctaaacgttcacatcagcaacttacggacaaaaatcaatgaacttgcccatgatcccaaatacatcatttcaatctggggcatcggtgtacgtttgatttagcaaggagaaatcattatgcttggcttccttattttacttatcgtgatctgtctagtactctttgccttgctattactggtgataaccgatgttcatcgcatcagccgtgatcttgattatattaatcaccataacaccaatgcagggatcacaagtaacacgaacctacctttgattcgcaaacttagcgcgggcatcaatcaaaatctcaatacgatgcatcaacttcaaatcgaacaagttgaacaggaaaaaaagattcaccaaatgctcatggatctgacgcacgatatcaagaccccgctcacagtggcaaccggttatgttcaactacttgaccgtcagcctgaagccgatcccaagccttccctcgcccggattgccaacaacctgcgttcagtcaactactacctgcattatctgatggacttcaacctgattcaggaaaagacccgcagtttgaaccatcaatctgttaacgtttcggaattacttaaaaacgaactctttgattactatgaccaactcaccgccagcggattaaaagtgacacctgccatcaccgatcaattaatgctcgaaaccgatgaaaccctcatgcgccggatcattcagaatttaattggcaattggcttaaatacgccaaaagtcaggccaagctttcttttgcccgccaagataaccatcacttggtcatgaccttctcaaatgacacggcacaaccggtttcgcacgtcgatcaattagtcgatcgcttctacaccaccgatgcggcgcgcaccacgcaaagtgtcggcttgggtttaagcatcgtccaatcgctgacgaccacacttggcggaaaaatgaagcttgaggcccatgacgactcattcaccgttaaattgacatttcggactgataagctgccagcacactaaatcccgcgatactccttatccgagacccacttcagaatagctgaatacgaggttttttcgagctaaaacgcttgctttttgtaaggagattgttattctattaacagtctattaactggaggggcaagacttgaaaacacaacataaatggctcgttatgctcacggtaacactcacaattgttctagctgcatgcggtcagcaaggcaaacaatcgagtcccaattcgagcaaacaacaggtctggcaccgcatggaatcagatgtgttgcaaacgcttgatccaagtaaggcatcggaaggcgtttccggtcaggcgattattgataccatgaatggcctgtacaagtattacggtcataaactacagccggcaatggcaaccaagattgtgaagccaactaacaatgggcttacttatacttttacgttacgcgatgctaagtggagtgacggcaccccggtcacggcacaggatttcgttttcgcctggcagcggacggtcaacccggccactaagtcatcccaggccaatatgtattccgggatcaagaatgctgacgacatccgcgctggtaaaaaaccggccgcgacccttggcgtcaaagcaatcaacagcaagacgctggaagtcacgttggaacatccgattccctatttcaacagcctgctaaacaatgtcgcattcttcccgcaacccgctaaaaaagtgcaggaatggggcaacaaatatggcaccaagtccgaatacaccctttcaaacggtgcctttaaatccaaaggttggaccggtaccggcgacaagtggaccgaggttaaaaacaaccgctattggaatcaaaagaatgttcacctgactcaaatcgatgttcaagtggtcaaagacaccaatacggcactcgacctttaccacactggcaaactggatgatgccacgttaaccggccaacttgccgcacaacaaaaaggtaaaaccggttatgtcgccaccaaacgcgcccgcacgtatttcctggaactaaacgaaaacaaagtgcccgcgtttaagaacacgaagatccgacaggcaatttcaatggccattaatcgcgattcttttgttaaaaacgttcttgctgacggctcaatcgttgcacgcggcatcaccccggccgacttgagtcaattgcctgacagctcaaccgattttgccactgcggttggtaagggcacaaaaacaatcaccacatataacaagaaaaaggcccaaacgctctggaatcaagggcttaaggaactcggcattaagaatgttaatgttgagcttctcggtgatgacgttgatgcagtcaaggcgacccaggagtatcttcaaggaacacttcaggaaaatctgcctggcttgaagatcagtattgccagcgtgccggccaagaatcgccaacagcgggcatcgacgcgtgattttgacatggtgttaagtacttggggcgcagattaccctgatccgaatacgtatctggatctgttcaccagcaccagtgagtacaaccacggtcaatggcaaaatagcgattacgaccagctcatggccaaggccaatggtgctgatgccaacaatccaacggcgcggtttaaagacatgacgcaagccgaacaactacttgtcaatcaagccggtgcgattccgctttatcaactcgttgccgcgcggatggttaatccaaaaatgcacgatctaaaaaccagcccgggtaacagtttcaactttgtctatgcttatttgaagtaaacaaaagccgtttccgctcatcatctgcggaaacggctttttagtgcgttaaccttcaataaacattatctgcatcaaccacaggcggctcaattggcaccattgtccgatgatggcggcgataagttgcaatttctttgacgccgtgccgctttaacatggccagtgcctggttaaagttggcttcataatgcggaccttcatgcgcatcactgccaatcgtgaacaaatggccacctgcctgctgataccatgagatggcttggtcatacaaaggcgcattctgccagcgatacatcgacttggtgtttaactccaatgcaagatcatgcgcgactgcaatggcaaagatctgatccagcagtggctttccccatgcttccaactgctccggtgtgatatcaaagagccgcaagccataatcaaaatgagcgagaacatccgcatcgtgaaactgtttgagtccagccagcatccgcgtaaagtaatcttccaattgctgttttgccggtaatccagccagctgcgcatctaggtaatcatgctgcccgtcatgatgaaaactcaacagcgtcaaatcaaagtcgtgattggccagataatcgcgtaatcgttcctctgccggcgcaaagtagcctgcctctatcccaagtaacatttcgttttgatagtgactagcaagagcggcttgtgttcgtttcatcccggcataatccggcagatcatcacgcccgccatcatcaggattatcaaattcaagatgctcagtggtgacaacaggcgcctgagtctgcgctaaataatcccgcaactgggcttcagaatcaaatgaatacagtgtatgcatatgctgatcataaatcgtcacgaatggtttcctccttcaatagttcaccacatctaagccaaaacgccatggatgacgcctactcctatttttatttaatcatagcatagacacgcggtaatgattgccaaaccttaaaacgtacctctgtagctttccccgtgcaatttcagtaccctgtttttgaattctggtgatgagcgccaaacaaaaaggttctaagttaacgatcctgccaatcaggatagctacttggaacctttttggtggcaaccatcaaaattatgcaaacttcgaaattggaccggctgcatgtttggcttgtaacgcctcaaaagtctggggtgatagcttgcctagatcaactagcttagactcgatctgatcaagcactgtcgcccgatccgctgcggaatgcatgaaatcataccgatcacggtcaatggtaatcatggatgagcgcgtgtaaccttttgcccaatcttgataggcagcattgacgcgctgataatatgcgaccaattccggcttttggcgaatgtcttccatatcccgaccgcgactttgaatttcatcgagttcatgatccggatcgattttgagataaacggctaaatccggcaacccgttccatggactgccattgacgttactttgcatttcctgagacaacgtgacatagacgttgtaatcaatgtcatcgatttcgccatgtttatgcagttgtgacgccatcacaaagtccgattccagtgatgagtccataatcgcattttcctgcgtcacggcttttttcaattgctgataacggaaggtcaaaaatgcaatctgcaacatggccccagttcgtttacgactgtcagcgccggcaccatagaacttctgcagcatattggcaatcatcccgttaccttcaacatcttcataatacgcaggtgcttccatatccgctgacaaaacttttgtcaaagacgtttttcctgcaccaatactgcccagaatgtagatcacaaatctcgctccttaattagcttaattaggttataacaaattaaaacattaccacatcaatagcaaaagtgctatttaaagtgtctttaaaccaagttgcttacgcccacgattgaaccaaggactcacagtgaacgcaaggatatcattgatgacataaatgctggagttgatcgccattgccaagctcgcatcgccttgcgcaaaggtgactgcccataaaataagttgtgcaatcccgctgaacaaccaccagaaatattgattgttgtaccgcaagaagcaaacaatgccacctgttaacgaaattgcaaatgccataccatcataaactgggcgaggatcatttgtgaattgaccgattaagtacgcactgactgcccaaaccaccaaggtgaagccaatagacaacacccatttctgcaagttgaaagtcttcagatggttcttggtatcatcattccaagtccgcacactaattaacaccggcagatccaaggtaaccacgtaagcaatctgttcgaacatggaaaggtaattacgagcggtataaccaacaaaaataaagcaggccgcactcagcaacccaagccagccattgacagccttggtcgcgttaattgccagcacacaaagtacccctaaggttgtgccaataaaggtaataacggtaacagcagtaatttttgcatccaccaacgtcatcagctgacacccaaaggcaaaccaaaataaataataattctgttgcggccatccttttaactgatgcagcaaccaactaaaataattcccagacgtttgcacaaaacaagactcccttaagtttcagttttcgttgtacgacaacaaccgtttttattatgccgcaagaaaatctgaaatgtaagtcttgaatatacaatatatcggtggtaataggagcgatcaccacaacatgtgctaatattaagaaacccttttcatagcggtcaaatcagaattgttgaaaaaaacccagccccaacatctgcgtgaacatttcgagtacaggctaaatacctgtcacctggcgtgaagcacgataaagacggtccaacaaagcttgatcatgaagttccggtcgctgattccatgccgataagccgggatacccgcgcagaccgtgccataatgccggagcataaataaccccgccttctgctcgaggtgcggttgcggcatagagtgcgggtaaggctgcttgctgcggggattggcgcatccaaggcagcacccgaaaactcactgctgccagtcgcatgggccaggccgttgctttcgattgaatcaccttaagactggttgccgccagtcccgggctggacgcattcaccatgaccgagtgtccagctgcttgaaaaagctggttgagtttgaccgccatcatggcttgagccaacttggacgtgatataaaaatgccatggtcgatagttgtggccatcaaactggttaaacgtcagctgcgggttgcccattgcaattgacgcaacattgaccacccgagctgccggtgctttctctagtaatcccgccagccgcagcgtgagcataaatccggaaaaatagttcaccgcccaagtcaattcaacgccgtcagccgtcgcgattcgcttagccggcatcataaccccggcattattgatcaaaatatctaaatgcggcagcacctgcaaaaggcgatctgccagccggttaaccgcttgttgctcactaagatccgcggccatgaaggtaatggcttgccgcttcgtctgttgctttaacttcacaaccgccagctcgcctttggatttatttttacctacaatcgtcaccgccgcgccatgtcgcaataacgctgcgctcatggctaggccaaccccgcttgttccgccggtcaccacggcaaccttacccgcaagattaggcatatcacgctcgctccaatgacgtttaggtttttgcatgtcatcatcccctcggccaagctacttagctttacggcgtttcagcaacacccgcaaatcaccttgcgcatgctgaaacttaagaaattgctggcgggttttttcaaccaactggtaacgttgcggattctttttgtaaaagtcctgatgataattttctgcaggccagaaagtggcagcaggttcaatggccgtcacaatcggccgcacataacgcccggaagccgccaccttagctttagcagcttcagcaatttgacgttggctcggtccggcaacgaaaatgacagggcgataatgaccaccgcgatcttgaaattgccccaatgcatcggttggatccgttaattgaaaatacaagtcaaccaattcctgatagcgaatccgccgcgtatcgaaaataatctccactgcttcgacatggccagtctggtcactgatgacttgctcatatgtcggattgggtacgtccccacctgtgtaaccagaaatgactgattgaataccgggctgatcaacaaatggctcaaccatgcaccagaaacagccaccagcaaaaatggcccgctcctgataagccagatcatgctgaaaatgtgcactaatatccgttgtttgcgcaccttcagaatcacctgtctgcgcccgataaaaatcggctacatccggcgtcaggttatcgcgaatcgccaagggtcgcaagcttgcttttagttgatcccagctcgccccgacagaagcgccgccttccacctgctgtttggcccgcactaactgttggcgctcaaacgcacgcgtgcctggcgctaatagtaaattggtcaacttggcaagataagcttcgactgtcagcttcatcatccaccgcctccacttcaaaattcaccttaagtatacgcgcgcacggccgatttagatagtgcacaatcttttcgaaaataacagggtatccgcaaaaaatgacttgattttccgttcaccagcactcacaggcgcaaaaaaaacgcctacttgatgatgtgactaagcagacgtttcttttcaagcatcgtgggtccaggcttccttcaaaccctgatcgcgaaaactcgtattatccaaccaggcgactttaaaccggccatcttggtaggtcaccttgctaacactggcattggttagttcagtacgattgggcaaaacgcctccatgtgcacgtaaccataacaagctagccgtgccgtgactcacgacgagtacattggactggccggctgtttccgccgctgcaacaatccgacgcaaggcaaaatcatagcgggcaataacttgttgactgtcttccgcctgattcgtggtatcggcggcatgaaacccgtccgcaatcgcttcaatcggcactttgccactggtgaccagctgatgataatctggaacctgaaaaacttcctgggaaacatcttccagttcacggccttcaaaaatgccatcattttgttcacgtagaccgctgtcagtttcaactggcaactttttttgcatccctaataagatctgctgggcggtttcctgcgcgcgaatgagatcacttgccactatacgctctaccttcaaaccactcgtgcgcaaaccaacacctaaagcaaatgcctgtttacgcccgcgcgcattcaagtgtgaattcgtcacgccttgaattaagcggcgcacattgcctgctgtttcaccatgtcgaataatatataaattaatcacgattgaccctttccaaatgccttgttgccagtaacgccgtttaaataaaactcatgccgggtaaaaatctgtcgtgccgtcattgaatcacaattactttttgccgaagatttgttctttcagccgtaagccagttggtgtcgttgctaggccgccctcaccggtttcccgcaatgttgctggcaactgcatgccgacgcgattaaccgcttcaatcacctcatcggccggaatcacactgatgcaaccggccaatgccatgtcagcggaaatcatggcttgacttgctcccaatgcatttcgcttcacacacggaacctccaccaagccggcaactgggtcacaaaccaaccccagcatgttttgcaacgtaatcgcaacggcggtggctgcctgttcggcactgccgccattagcacaaaccaacgccgccgcagccatcgcactggccgagccaacttcttcctggcacccgccttctgctccggcaatcccggcattatttgcaatgaccaagccaaacgccccagcggtaaaaagaaaatcaagctgctgatcatgcgtcaggtgcaggcgatcacgcatcgccaacaaaacaccggccagaactcctgccgatcccgcagtcggcgtcgcacaaatcagccccattttagcgttcacttcattaactgccactgcattgcgaacagcctccatgatcggtttaccgctcatgaaccggtcatcagcaatataatggttcagctttttggcctcgccgccggttaacccggtgacacttttgaccccggcaatgccttccttaaccgagcgttccatcacttccagattacggctcattaaatgacggatctgtgcttcagtccgcgttgagttttcgacttccgtatgcaccatgagttcggcaaccgaggagaaggcatgactttgttctacaagttctttaacggtataaaacatgataagctcctttattagccagttcgtaaccagttgttagcgcgtcatcactcaaagtaagtgacattgcgcatatgcggtaataatttcaatttggccaaaatatcatcatgataatcatccgtttcaatgatcataattgcctgttcccctttagcggtgcgggtcaccgtcattgtcccgatattaatgccggcatcggagaaaatcttggtgacctgtgcaatcatccccggtacatcgtcatgaatggtgatataagtcggctgacccatgctcaacgatatcttaaacccattgatttccgtgatctgaatattcccgccaccaatggaaaccccggtgaccgctaaccggtgatcaccggcttgcaagacaatatgtgccgtgttaggatgatcaaccttatcgcttttcggcacaaaactcactttaatcccttggtcataggccagcttcagcgattccggcaaccgcggatcatcgggtgccatccccaacagccctgctactagcgccacatcggtaccatgaccgcgataggttttggcaaatgattcgtaaaggtaaatcgtaatcgtctccggggtttcgccaaaaatatcgcgcacgactttaccgatccgcgctgccccggctgtatgtgagctactaggccccaccataaccggtccaataatatcaaagacgctgtgaaaacgtacatctggcatagttttctcctttatgatgaccgaagtcgaagttttcagtcgttcaagccgacaacccgtttcttaatcagtgtgattttaccaccctgatgttttcactgctaagtttttatcagctttttttgaaatcacatcaagaatcgaaatcatgacaagtagttatgcttaccggacagcggcagtattttgaactaaccgcgcaaataccggcgctaaggttcgcacccgctgttgtatgtctaaccatagcttatcaggtatttgccaaagcgggtcgcttgccagataaacccagccaaccagaaattccgcactttttacggtctcaaatcgttcaatcgtctgtgccaatgacgcagcggttaacggcacggttgccttagatgtatgctcactagccagtaaccaactgtcaggtaatgtcgaaataacatcagtgatacctgaaaaatcattcggtacaggtttactttcgcgcaaacaggacagccacaaaaacaggcgatcatcccaaaaacctaacgccagatgcggcaacattttatagccgcggcgactcgtggaaaaggctacccaggtgtttggcggcgggttcttatgccgacgccgatgttgggcaatatgggcaaaaattggttggttcggcgtctgcaacaatggcacaatgctctgcgcggcttgcgtaaacttcggatccaactgttgccgaatcaaggccatccgcgcacttagcgttggcgcagcaaaaactgcaaagtcgtcacttgtaaacaccctttcgtcattcctttctttacgctagaacatgttacaatgaggtcatattgtaacgcgttgtcaggtttcaactttacgactcgcgttcacacaacaagacggttcaccagggatcgttatatctttaattgatcaaaccaatcataaggaggcttttcatcatggcagaagacaatatgcaggaacatctcaacagtgcattatacggcccaccgcaaaccaaacccgacgaacgccgcaagtacatgggctcgttacgtgaacgggtcgctttatgtatcagcaatcaggaactggctgatcccaaacgacagcatcaggttgccccatttttaaaagatttccatgaccgcaactataaagccctactcaacggcaaacttgataatgccattaccggtccttacatgaagctcctcaccgatgccaatgtgccatttacattggttgctaacgaaacggcccaaactgccgataccgcgcctgggctgcttattgtggcagccactgccatcaatcaggctaacatcacattgccgccacttgatgacacgcaagaaaagcctaagaaaaagtggttttgacttatttaagcaaccgctaaagacatttggcgcaacttaacaaatataatggaatgtgaccgcacctaaatgtcagcatcgtgcccgtaacgcgcagaagcatgatcatgaacggtgtaacccaaccgaccttagagcaaatttaccacgctgaggtcggttttaatatgacctcgtttacttatctcacagcaaacagccagtttagcaatgccggggcaagtgcgcgtgattcgcccatgtccaggtgcaaaggcgcagcgagatccggtaccggattgacactaattacgttcgcctgcccatctgcctccggatcatatggtgcatacagattatcaatcacaatgtcgacagctgctaccggcaaatcaagtgtggcggcagcttttagcgccagttgcttgtaactgtcatcaatctcgtccgtcacgtcatacaaatcgccaccggtttgcggatgcgcggcagtggttaagaaaacctgctgcccgcgttgaagcacagtctcaggtgtcaacgcttgtgcctttaactgacggcgcgcgctagcatcaagctgcaattgccgggaagtcgcgcggtgaccatttttcaaggcgatcaattccttaatggctttgcgcccatcgcctacaacattagctgctgctgtttccaaaacgctgagcacttgttgcccgatgatggtaaaatggtaggtcgtgccgcgtgccatcatttcaatgagcaccccatgatggcgattggcttcatgaaaggctcggtcaaactgcttttcagtcggtggtatcgaaaactgctcaaccgcttcgccttggctgcgtgcctcgggtttcaccacaatacttttatgcgcaaagctgtgctcaaaagctgctttggcatccggccatttagtaaacttagccccacgtgcaactggtattcctgctgcggccagcaactgtttggctgtgtgccgatgggtggcaacgatcatggcattggctggcgtatagttggtaacaacgccgtctgcaatgacttgtgtctgggtatccgtggcaatttgcaccagattctgttgacgatccagtatcgtgaactgataccccccatccatagcagcttgtaacaatgtctgggtgttttccgataaatctgtcatccccggcaactcattggtactggttaagtccgcctgtgcttgccgactcaatgactcatccgcagctgtttggtcatgaaacgttgcaagaacttgactggcaaggctcgtttccggcttcactaatcgcgtctgcatcaattcaaaagcttgtttttgttgcgcatcaatgccaacatgatttaaccatgtcgccatcgcatccagcattgccggcagctcggcgactttggcatcaggtgccatctgggcaattgtccgcgcctgcatgacagcatgccggcgtacttcacttgccgcggcaaccggaatggccggttgacttagcgcaaaccagcagctatcacgcaagaatgtcagcatttgggtcgtgatcccgctagcagcgtacggatcaagctccaccacaacgtccagcgcaagaattcgatccaagtggtctggatccgtcactttttgaaccagttgccgttcctgatccggtgacggccaaaatgcgcggtgaccgtcagctggagaagcagaaaacaagtaagtcaacaatggcaactgccgcgttaacccgtctgctaccaactgataaacttcattacgataggcaacatattccggaccatggccctgaaaattctctgctgtgtacaaccgttcaaatagtgtttccggtaaaactatccggaccgtttgctggttcactttttccgcggtaaaagccgataagtgccctgcttccggtaatgccgtccaaattcgacttagcccagcccgtaactggtcaataacggcaggaaaatcgtctagtaatggggttacgatttgcaacactgaagcagaaagtggctgaaccaaagcatggcggctacgttgcggccactgcggtaagttggtttctgccggcagaatgggtttgacagttcgaatcacacccattcgcgtctgagcggccaagccaaacaaatgttcttttcgaatcagttgccaataatgattcacaatgtgtcattcctttaattgatgatttaaaattagattaacacgcagccggcgggtttaacagcatgcttgtaagggtgcagcattttttgactgttagaactgcaagcagccgaattttaaaatatgattttttaatgtatcaggtgaccgcatgaggtgctcgtcgacgtagactcggctcacgctcactttctataacgcgttcgcagtcgcagcaatctacgtgtaaggacctcaagcctaaatggccaaagcccggccatttaggcttgaggccgcttacactccgattgctaagcgctcctgctcacgctcactttctttaggagggatctttttgcagcaaccgcttgcttttcgcatgcgtcctcaaaatctagacgaagttgtcggtcaacaagagcttgttggtcccggacgaattattcgccgcatggttagtgcgcatcgtttgagttctatgattctttatggtccgcccggtactggtaagacgagtattgccagtgccattgccggcagcacaaaatatgcgtttcgaatcttaaatgccgctaccgataccaaaaaagatctgcaaattgttgccgaagaagccaagatgagcggaaccgtgattctgttgctcgatgaaattcatcgattggacaaaaccaagcaggattttctattaccactattagaaagtgggcgcatcgttctcattggggccacgaccgaaaatccgtatatgaacatccaaccggccattcgcagcagaactcagatttttcaagtcaagccactaaccccaaccgatatttcaaccgccattgaccgcgcccttgcagataacaaacgcggactaggtaagtatcaagttgatttaacgccagaagcacgcgattacctgacccacaccactaatggtgatttacgggcggcgctcaatggtcttgagctcgcggtactctctacgcctgctaaaagtgacggaacgatcacaattgatttaacaaccattcagcaaagccttcaaaaaccagccatttccggtgatacaaatggtgacgctcattatgacatcatctcggcttttcaaaaatccatccgcggttctgatgtcaatgccgcgttgcattatctggcacgtttaattgcgatcggtgatttaaatagcattacgcgtcgactattagtcattgcgtatgaagacatcggtttagccaacccaaccacggccagtcgaacactaaccgcgattcaaagtgcggaacgcttgggtctaccagaaggacggattccactcgccgatgccgtcattgatctttgtctggcaccaaaaagcaactctggcatcaaagcaatcgatgcggcactagctgacgtcgaaagtggacaagctggtcagattcctgatgacttacgcgatgcacattatcgcggggccaaacaattgggccacgggcaaggatacaaactaccccacaactatcccaacggctgggtggcacaacaatacctgccggataacctcaaaaataaacaatactatcagcccaagacaacgggtcgctatgaagctgcacttgcccaacgtcaacaacaacttaaaagctggcaacacgaagcccaaaaggtgaagaaaaagtaacgaaagcggtttcgcttgcacgaatggtcgttctcgtgctactataacggtgaaagttctaaggtgttcgcgcttccttaactatcagttgaccgaacagtatcgagaccttgggaccggaagagtcatggacggtgctgctatttcacttagcggctaatgtccttggcgtctgggcccacatagctagcagcgggtttcaacgatccgggaagaaaacggcaccagttagtctttcataaaaaccaatcatgtttttggccggccaagcgccggctttttttgtggtgagcgcgagccggcgcggttagaaaccggagtgtaagtggcctcagacgtgatggccgggctttggccattgcgtctgaggtccttacacgcaggtttctgcgccggggagcgcgttatgggcgtaaaccagagctcaagcggcttcagacgtaatgaccgggttttggtcattgcgtccaaggtccttatgtgcaggtttctgggctggcgaacgcgttatgggcgtaaaccagagctcaagtggcctcagacgtgatgaccgcactttgaccattgcgcctcaggtccttacacgcagactcctgcgccggcgaacgcgttatgggcgtaaacaggtgctcatgtatcaaaacttaaccacccacacccaaacacttcaccacaaaaatctccaccagcactcccactcactgtggcataatagaaccaaacagctaggagggattttacccgtgacactcattttaatgagcatctatgcgcttttcgtatttgccttagccgcctatacatggcgtcaccgcaaccaaaactttttaatgatcaaaaaaccagccccagcccttacccgttttttgaagatctttacggttctttttacggtggtcggtgtctttgccattattggaggattagccttcccaacttgggcaaatctggtgattctggtcagtggggcttttctggccaccattttcatttttatcagtcttacccagatcaagttgtgaaacgcttttcatttaatttcatgatggaatcaagtacaatgaaggtagaggtgatgaggaatgttacaacaatatcaacatattttggttgcgatcgatggctcatatgaagccgagctagcgttcaaaaaagcagttgccgttgcaaaacgaaatcaagcagaactaattctcattcatattgttgatacccgagcgtttcaaaatgtttcgagttttgattccgcaatggttgaacaagttacggaaaatgccaagaccaccatggaaggttacgtcgatcaggccaaaaaagcgggactagaaaaggtcagtttcagtattgagtacggcgcgccaaaaacaatcatcgcccgcgacatccccaaagctaagaatattgatctcattatgattggggctacagggttaaatgccgttgaacgtctgcttattggttcggtaaccgaatatgtcacccgaaacgccttatgcgacgtcctggtggttcggaccgatttatcaaacaagccggctctagcaagtacaaaaaagcctaccccacacgaaccaaatgattagttaaatcaacgacttcatcatataaatgttttaatcaagaacgaactacttttgtaagttaatcatgtcatcttgcgcctcggcaaagatgccggaccgcaccaaaaaatacctgagaatgtcgtcagctgcagcaacgatgctgcaagacgactatctcaggtatttttaaacatcaccgcataaccggattatgcagtttcaatattgggcttctgcgctgccatctctgcacttaacccagcagctaatgttgttgaaccgctgacttcagcaaaggcaatcgcgatttggtaaatcttatctgcctgtggatcgcccagtagtttcatggcacgagcttttagggtaaacagttcgtcaagcaaaaacagtttatcgtgcttaactgcttcgcgaatcccatgatcggcatacttcaaaacggccttgaagtcacttaactcatagtaaacgcgggcaatatgccaataaatcgtcaactcaatatcgagatatttgctgtcggacaatggtacatgcttcaacattcgtagcgcttgatcaatatagacccgcgaacgatcaaaggtatgcttgtccgcatatgctaagcctaagccaagcgtggctagaataccgtataaatcccgttccgaattaacaagcgggcttaagacccgaccaaaaaagtagatggattcatcaggggcattgttcttgaataactcaacaataccttggtagtagtaataccgtttctgatcgtcttcattcttaatcttttcgaaccgaattttgctcagattgtctgcagcgattgcatattggtgatggtgaatctgataatcaatcgcattaagcatttgttgagcccgatcatgatgctcaacgacaatatcatcgagttgaatacccagtcgactaataagccgcatcagaatattcatgcttggtactttgttccgcttctcaatgaggctaatggtagcttgcgtacagatatttgctgccagttccgcctgagataggcctttcaacttacgatagtagcggactttatcccccaaaatccgtagcgtttgctgctcctttcgcacacttatcactccccagtgttccttcttacatatcaacatagaaatcggcgggatctcccccttaacctagtgtcaattatacggataactggttttaaaagctaataataacaaccgatatttattctatttttgtaaaaaaattttttaaattttgagctttgataatgaaaaggctcacaacgttaaaactaatatactataatatctactcacttataatcatttataactatttttattggtcagccatctttaaattgttaaaagttagctaatacgttcatcagctcggttttaatctcatttaggccttaacccatagtactcaagtatcagttgaatgatcgcatgcttttaaccatttgcctttcgaaagcatcttcacctgggcaacgactacgtataccttgatctgccttttttaacgtggtaaataattttctgatctgcatttagtgcaggatggttcacctgtgcttcgtcaagtatcacgtcaacctaattatgccgttgcaacacacgccattctaataaaaaaccgattcaaaaccgcgttatcacagttttaatcattcggaaccagcttatatcagcgaacgtcagctgcaacgccgattaatatcaaaaataaatatcttaatgatctggcgcttcgaacgctcaaaaaagatcaacaatctgttgaatataatccgcaatcggctgtggtaaatcagcgcgcaacgttaatgcctgcaacaagcgattgcgattataccattgtacccaaaaacggtatgattcctgtggccgcacattgaccagcgtgtgttgccaatttttcagacacatcaaaaaggtctcactataaaactgattgacgttggttaagctactgaaataaagcgccagccgatgatcttccccaaaaatcaacggggtttcgacccgtcgccacgcctcaacaacggcagccatcaaaaagaccttttctgaacgcggaagaaccggcacttggctcaattcctcaagcatattcccgatatgggtaaaagcatgcgcccagcctttattcggaacataaccgcgaccatctttctccagcaaaatataagtaccgatattttgcacggtgctcaaataatcatttttgctaagaatatggtaacgattctgatccgcgtagatcatcccactgagaatcataacggcaaaactccgcagaaaaatcgcgtcattttccggttcaaagatgtggctgaacaaaatatcgggtgcctgcaagcgcttaaaaagtgccttaacttgttcattcgtgaacgcctcagcctgaaacaaatcgttaaacaggaaaaacacgcctttatcgcgaacagccggattggtactggctaagtgtgcgaccaaaaaagcaatttcatcatcggtcacacttggatcgctggtttgtttaacccgcttttgaatggcccgaattctggcgacagccgttttatcatcccagggaattttcagactcgtttttggctcagtcgcgatgctagtgatgactttgcccagcatgtccggtaaagtcgcgaagatcttgccttgattcaacgaaatccgcaactgttgcacggtggtttgaatggtatcaagttgcgtcaaaatgatcctcctctaaaaaatccttagctgtttaagcagtaatcatgattaggatgttacttataacaaaatcggccgacttattttctgggtcggatgcgccaatacccatccaaagtctgtcggcaatacccgtttggtcacgcgcataccgggctgattcatgatcgtaaacggatactgatgtgccagcgcctgcatcatatactgattcaccaaactctcacccatccgaccgtttaaaaatattcggtaaccggggtaacgcttcaagactgaatcaagcattgcggtgatctgggcatcgcgcagttgtcgaatcgtcactgccatcgccacccgttcgcgaaaattccccaaaaatgctcgcttctcatccggtttaatggttggaatccccagcgccatcgccttgatgaaatgctccaagtcctcagccatcatccgcctcctattaatccagctacattgctacccgaccccagccgcattctttagcttaaggtgagtattcatacattcattcattgtagcacccccacataacgtgagccagcctgctaaatcgcatcagtatccaaccatggtcatcattaaacctgcaaaaacgtcgacaaggctcaatgacccactttgctgagtcattgagccttatcgacgttgtcaacctatcaagactgatcagtcaccacactcaaagtgccggacttttcaatcagtccaaccgatcttacgaaagtctcccctttcgtatccggaccagcgtatgccccaactagacccgtttttttcgatacaagcttgcgattcgctcaacatatgccggtggcgccttttgaatgccctcatagcgatcccggtaatgccagatctgaccgatactgatgcctgtttcctgcgcaattttggacaacgccattgattgcaagacctttcttgccttgtcgtagttatccatctgcagccccctcaatagaatcatttttggtgccgcatctatcatagcccaaaaaattaggcttgcctaatattttatgcaaaaaaaagccaaacatcactgtagctccatccgcaaatgaggctacattgatatttgactgataaatacatcttaaaaacttgcacttagctgtttttgccagatacctgaaagacctggaaggtgacctgaaagtctgagaaaccgcgccaccaaagcatcacccgacagacccatccatctccatgccgatcaagcgattaagttcaaccgcgtattccattggcaattctttggtaaaaggttcaacaaagcccataataatcatttcggttgctttggcttcagaaatgccgcggctcattaaataatacagctgttcttcggaaacctttgaaaccttagcttcatgttccattgaaacggttgaattgtgaatctcattgtatgggatcgtatcgctggagctcttttcgtccattaaaatggtgtcgcattcaacgtggcaaaaggcgttgtcggctttcttggtgaaacgcacggtgccgcgataatccaccgcgccgccatctttggcaatcgacttggacacaatcgaactactggtattaggggcattgtgaatcatgcgcgcgccattatcctgatcgactccttcaccggcgaccgcaatgctcaacatggtgccgtgcgcgcctttaccatccaagtaaacgctgggatacttcatggttgtcttactgccgagattaccatcaacccattccatcgtggcattatccaatgcttgcgcccgcttcgtttcaagcgagaaaacattcttgctccagttttgaatcgtggtatagcgacagtaagcatcgtttttaacaaagacttcaaccaccgcggcatggagactgtcgcttgaatagttcggcgccgtgcagccttcgacatagttcacatgtgcgccgggttcaacaatgatcaacgtgcgttcaaattggccggtgttctcggcattaatccgaaaatagctttgaatcggaacatcggtttgcacgcccttaggcacatagataaaactaccgccggaccacactgccccgttgagcgccgcaaacttgttgtcgctaggtttaaccaattttccgaagtattcgtgaaccaattccggatattccttcaaggctgaatccatatccatgaaaataatgccaagcttttcaaattcatcccgcatattatggtaaaccacttcggattcatattgcgcactcgccccagctagatattttcgctcggcttgtggcaccccgagacggtcgaaagttttcttgatggtatcaggaacgtcttcccagtcacgataggtgcgatcagtagccttttggaaatacagcatattgtctaaatccaagtcggataaatccggtccaaagttaggcatggccagtttgcggtaagtggcataagcctttaaccgatatgccaacatccaatcaggctcatgcttttcagcggaaatagcccgaaccgtgtcttcggtcaaaccgcgcccggtcgagtaaaccggcttgatatcatctttgaaatcagctggattctcatccggtaaaaagtcgatatccgcggcaacgacttcattatttttagtgtttttggtttcagtcatcggtttcacctctctgcgtcaaaacttgcgcggctgctttccaagctaaagtggcacatttgatgcgcgccggaaactgatggacaccctttaaaacagcagcatcccccagaatctccgcatcaggcaccgaaccattgataatcaagtcagaaaaagtctcgaccatctgctcaatttctgcaggcgttttccctaaaatctgctccgtcatcaaactggcacttgcttgcgagatcgtacagccgctaccggaaaaagcaacatcatccacccgaccggcctgttcgcgaatctgcaaatgcaaaacatcgccacagctagggttacggaccgttatttcatgatcgaaatcggttaacgtaccatgatgccgcgggtgttgggcctcatcaagaatgaccgcacgatacatttgatccagtttagtcaacgccatggaaatacctccttgccgcccgaaccgcttcgactaacttagcaacatcatcagcattgttgtaaacgccaaagcttgcgcgaacggttgccggaacccctaatcgtgccatcaacggttgagcgcaatgatgaccggcacgaacggcaatctgctgctcatctaaaaaggtggccagatcatggggatgaatgcccgccaagttaaatgacaccgttgccagactcgcttgattgccataaaccgtgacatccggtatcgctgccaactcagaacgcagctgatcagacaggtcgtgttcggtttttaatactgccgcatcaacattttgcttaaaccagtgcagcgctgttcctaatccgatcacaccggcaatattgggggttccggcctcatatttaatcggcccctctgcccaagtgctgacatcatcgcgaacttctgaaatcatttcgccgccaaactgaatcggcggcattttggctagaagatcagcgcgaccataaagaaccccgataccggtcggcccataaattttatgcccggaaaaagcgtaaaaatccgcgcctaacgtctgcacgtcaacgggcaaatgtgccacggcctgcgcaccgtcaaccaccaccaccgcaccaactgcatgcgcctttttggcaatggccgcaaccggtagcgtatcaccggcaacatttgtcacttgggcgatggcaaccaaattggtctcaggcgtaatcgctgcaagcaaggcaggcacatcgaccaccccatcaggatacacgggggtcacttcaaacttggcatgttgacgcttggctaattgctgccacggaataaagttactgtgatgttctgcaccgctaaccacaatccgtccgccttcaggaactgcatgtggtccgaatgcactcgctaccagattcaggctatcagtcgtgccacgcgtaaagatgatttcatcggcactttgagctcccagaaaatccgcaacttcctgccgcactccttcataggcctcggtcgtatcataagccagtttataaaggccgcgatgtacattggcattttcattaatatagtagttttgcaggctatccaacaaggcttgcggtttttgtgaggtcgccgcagtatctaaataaaccaattctggatgagccttaaaaaaaggaaattgttcacgcatcttcagccaccaacgttcgatcaatcgttgcaaacagttctttcttcagccgctgatcatcaatctcagccaaaccgccttccaaaaagccgcgaatcacgagacgtttggctaacgttgctgaaagaccgcgactcattaaatagtagagttgatcagcattgacgcgcgtcaccgaagcagcatgccccgcggtgacgtcattttcatcaatgagcaaaatcggattggcatcaccttccgcacgcggcgacagcatcagtacccgattttcctgctgggcatcgcttccccgggcacctttgacaatatggccaatcccattgaataacaaatgggcactcccggtaatgacaccgcgctggttaatatggccaactgtgtgctgcccttcgttggtcacagaagttgtgtagctgacatgctgactccctgaagccaagacaccgacattaaccgttgcttcagcattttgacctaataagcggacgtcaacccgattcaggccggagttatgcgaaaaaccggctaatgtccagttaagtttagcattgtcagccaaagtggcggtgcgattaaccaaaacggtatccgcagagaaactatcatagcttaaccaattgacctgggcatcagcttcaatcactagcattaaccaaatacccagcacatgaccgccactagcccacttttcctggacggtgacgttagcccctttgccaacatgaacatacaacaagccaccagcgttcttgggaccagtcaagacaatcggatcgtccccactaacaaaatgggcaggaatatcgatagtcgttgcgccttgaggtgattgcaacagccaagcatcaaggctcgttttgggattaaatcgctgcgcttcactggagccggcagcataggcaatgtcttgaggtgcatgtaaaatcacacgatcctcaacggcatcaggttgattttttaaataacgtgctagtgggaatttcggcagattaggtgctggtaaggtggtggtctcaaccattctgatcacctactttaagatgttcatacccggtcttttccagttctttagcgagctccgggccgccgctttcgatgatccggccacctttcatcacgtgcaccacatccggaataatataatcgagcaagcgttgatagtgggtaatgatcatgctgccaaactcaggaccacgcatcaagttgacgccttttgcgacaatccgcagcgcatcaatatctaacccggaatcgatctcgtccagcaggccaaaatgcgggtgaatcatcatcagctgcagaatttcgttacgcttcttctcaccgccggaaaagccttgattcaggtaccgatccgccattgactccggcatttccagcgttgccatggttttatccaactggttcaaaaagtcagtaatgcgaatctggtcatcttctgggcgccgcgcattgattgccgcccgaatgaattcagcatttgtaacgcccgctatttcttggggatactgcatgccaagaaacaatccggctcgcgcacgctcatccacggcaagatcgagaatcgattggccgtcaatcaaaatgtcgccttgcgttacctcataagcaggattgcccataatcgtttcggctagcgttgacttgcccgtaccattaggccccatgatcgcatgaatctcgccggttgctaattttaagttaacgccggtcagaatctccggatgctctggttcagctttaattttgacatgtaaatctttaatctcaagtgtatgcacaacgttacccccgaatggatttgacttttagttatagggtcattttacgtcagaaacagtataccggcaaacacggcaactttttttgctttctataaagttaatcgttcatggttgtttggacgcgtgtaaaggaaaaggcagcactcaaacgagagtgctgccaaatcagcttaaattctaatgatgactcttgcgggcaaagaagtcgccgatgaattgaaccaggaagaccaatgccaagatgaagatcaaagatacaatgatcacatcatattgataacgttggtaacccacggcgatagcaaggttcccgaggccgccgccaccgaccgcgcctgccattgcagttaagccgatcacggaaataatggtcaagaccgaaacccgaatcaattcggaaagtccttcacgcagataaacccgccagacaattcctaatggcgagacacccatcgcctctgccgcttcaatcacacctggatcaaccgttaacaacgcgttttgtacctgccgcgcgtaaaacggggtcgtgccggcgattaaaggtaccaatgccgcagtcggcccaatccccgtaccaacaattgctcgggtcacgggcgtcataatcgccagcaaaatgatgaaagggaccgctcggaaaatattaaccaatttatccaaaataaagtaaaacggatgattggcaagcaacccaccttcatcagtcaaaactagcaagatgccgatgataattcccaagataccagccacgattgcggttaaagcagtcatatacagcgtttcgttaatggcttgagttacgccgccatcaccggaccagatgggaacaacgttaggaaaatattttgtaaaaaattgtgccatctacttaggcctccttcttaagaatgtcttcaatcttgacatcctgttgttccagataatgaatcccggcgtcaacatccgtctgagcacctgataacaccacaatcagattaccaaaaggcgtgtcctgcaggatttgaatatcaccaaacaaaatattggcggtcacatgatagctttcaaacaacttggcaaccagcggcttatctgcagaatctcctacgtacgttaagcgcaatagccggtcgttagcacccagattcttgactgccggctgctgcataacggcctcaattgcctgatccagttgcaaagttgtatcaatgaaatctttagtcaactgttgcttaggatcagaaaagacttgcaataagtcaccacgctcaatgatcgcgccggcatccatcacggcgacccgattacaaatctgcttcaccgcttccatctggtgggtaatgagaacaatggtcagtcccagccgtttgttcagcgactgcagtaattccagaatcgaactggtcgttttaggatccaacgcactcgtcgcttcatctgaaatcaaaatctcaggatcagaggcaagcgcccgcgcaataccgacgcgctgcttttgaccaccggataattgggccggataagcattggcgcgatctgtcaacccaacgaggtctaacagctcagcaaccttcttttgaatctcctgcttggacttgataccttttagcggaaacgcaacattatcggcaatggtgcggctattcatcaaattaaaatgctggaaaatcatcccaatccgtttacgttccttacgtaattctgccggtgctaaagcaagcatatcctgtcctaatacatgaatgctgccgccagttggccgttgcagtaaattgattgtccgaacaagtgtggacttaccggcgcctgaatagccgacaatgccataaatgtcgccgcggttgacggttaagcttacatggtcaacggcatggactgaacggtttttaccgtggaattcgacgtccacatcttttaaagtcacaactgcttgatctgacataattgtccccgtttctaattaaaacttatagttccaagccggtaatgtagaacctttataaactttcttcaacaattcagctgtccgcttcgtctgataggccttaacgatcttcttataggttgcattgttcttatccttagaagacttagcagcgataaagttcacccacggcttggattggctcgtaatcttttcaaccgcaatcgcgttggccggtttcagattagctgctgcggcaatatcattgttgacaaccgcaacggccacatcgttcaatgagcgtgctgtttgggcggcatccagttccgtgaatttcaagttaagcttgtttgaagtaatatcgcggatcgttggtgaagcaacgcctttcttcaaagtgattaacttattttgtgccaaaagttgtaatgcgcggccttcgttggatggatcgtttggcaaggaaatctgatcgccttgcttaacctctttaagtgacttgatcttattggaatacgcacgcattgggccgatataagtatcgccaatatcggcaatcttggtattgtgcttcttattccagttattcaggaaattatgatgctgaaaagcgttcagttgaatatcgccatcttcaagtgcttggttcggctggttataatcagtaaactgcaccaacttgatggtgacgccttgcttcttcaagcgggactgaatatcggtccagatttctttgtcagtactcataataccgactttaaccgtctcattcttactggaactcgatgacgacttaccgcacgccgccaagacgaagacaggtaaaaccaatgcaagggttataatggctcttttccaaaacttcataaactttttcctcctcgttcgggtcacaaacaatatgtgtcagcaatttgccgaaaattaaaaaaacccgcttccaaaacaatgttttagaagcgagttaactcgcggtaccattctaattcgacgccaaagcgccctcagtaacaggcaataacctgtgtgcggaataatgaccgccagccatcatcgcttaaccaatgctcagcgatgccgatcaatgagccatcttcaattcaatcaactaccctgctctcagccaaccaggttttctgtacagtctcatcaaatctactcactcatatcattcgtttccctaaatgaattaaatcgattctagacgataaaagtagtcattgtcaagtaaaaagtaaagtaagcgcgagccggcgcggttagggaccggagtgtaaggtggccttggtcgtgatggccgggctttggccattgcgaccaaggtccttacatgcaggtccctgcgccggggagcgcgttatgggcgtaagctagaatgtcagggcttacacttattatacacttaactattgtcaaagcctatcatgaaagtacttttatagtttttcaccatccactaattagcattgcaagtcaatatggcaaaataaaatttatatccgactttacctagcataaatcgttagtatgccggtttgataaacatagcaaggagtcttaatatgacaaaacgggcagtggttttttgtgtaaaagggttgcacattatgcttgtagcaacggctataacgtctttagttaaaaaataccattctgatcgggaaatgaaaatcctggttataatagaaggcggaaatcaagacgatattaactttattcgaagtatcccgagtttgtatggaaaacaacagatctcggttgatttttgggcgcctccatatcctctgctagataaagtttccgatcagtttgagacgggtacaagtttgcctaaattggttctttggagattgttcttgccatactattttcctgattatgatcagattgcttatatggacaatgatattttaataacaaccgacattaacgatttgtttgatcagatgctacctgaagatgttattggtggtgtgttagactacgaagacgttacgcatcctgatcacgatcgttcaaaagagttctacctccctagtaccgatcaatatattaatgcaggggtatttgtcgccaattcaaatgcatatcggtcagttgttccgttcgagaaaatgatagagatcattaatcggcataactatccatatggcgatcaaaatattttgaatattgcgttttacaatcatatttatttgttgccatggcggttcaacttacaatacgataaccggctccttgataaatatgaaagtcttgcaccgcaacgtattaaaggaattcgtgaacaactaaatgagcctggtattattcactttgcagcaaacgggtttgttctcccgccttggtatgtcttcacgcctactacaagatgggagaaaatgtggtgggaaacctttgttgatatgcaaaaaaagcacctggatttcatagctaggactaccgaggatacagttcatgaaccttaatgggacatatgtagtgggttgctgatgattatcttcggacactggtttgtccttgaatctgaaaaaagaagcacaggcttaaagactgtgaccattattgaatgaggcgggccgatttccttgagattaggaaattggcccgcctcttagcttcaagcgtaatcaatctcattgcgcttcagcgttcttcattttcaaaagatcttcaatatatgcaagataagatgcgcactatcctctaaatttaatggcgtaagataccccagctcttacctagttatactagaatttaacgcgtaatcgactttaccaagctaaacacacgccagaaattttgttcgaattcatcccgtgaatacccatgttcccatggaagtgaacggatttcactaacgaagtgacggataactactttttttcgtgctgcttgcattttttttgcttgttttagattgtagtgaagtgcgtaaccgtttaaccattcatcatctttttggtaattatattgtaaaggaaggtggattgattggctttcaaacaggttatttaaaatggtttggtcaatgaacgaataatcagaagtgtttatagtattaaccaattgatcctgagtatacgcttgaatgtacttgtgggtatttataagtagcacgccagaattaaagtaactgtcaaaatgtttgatttctggccaaatggaaccctctttagtatcagcatatagaagggtctgaaaatcattgactgcaccgatggctttatcatccggtaacatgtcaaacataggtgatatgtcgtcacagataaggacgtcgttatctaaatagagcaaacggtctgtgtcactaaatatgtacggcgcaaacaaccgccacaagacaacggaaggatatctggtatttgtgttggccgtgtgaacctgatccatgatcgatggcttttgccagacgtcaactgtaatattggggcgcagaagttgtttgggaatgctctttaaccaaaaaatatcctgattaagataatcatcagccattaccagaattctaagaggaatattgactggccagtgtagtacaagggaagcaatggcagtccccgtaagttggatgtgactgccggtaacagtaaaaagtacggcgttttcgctcatttaatataacctcctaaagatgtttcggtaagggtgacacgagctggcatcacgaatcacaatatagacacagcaataggccagccgttgtttaactgttcaagatgttctgtagatactcaacactttaatcaaagagggctttaggaacttagatttattgctagatagcaaaagtagccacatatgctccagtgcaaaagtatctattaatacaatggtctgtggtggtgagggttgggcaccaactggcaaattttgtaaattggtttgctatgctataataacattatttatgaaattaggatgctgctaaacagtatggaggatttgaattaatggaatatgtaatttcaccattgcaacctgatactgatcaagcgaccgttaaagcaaaaatggatacggcctacttttttggaaaagttgggtttcgtgaattgtttttatcgcgttatgtattttggaatgatgagcactggcgatctgagattttagggataattgcgacagttggaaagggagatgttgtcatttatcagattcccacttatgctgaaccctccgtagagaaggccgttgttgagctggtgcataagcagggcgcacttattatcgcatttgtccatgatgtcgaatatttacggtttccggactcttatgacaaaggacaggtgcttagtttcttcaaatcatttgatgcattgattgttggtacgcagcttgtaaaagaaaaattggccgcagatggcgtcaatattccaatgattccgagtggcccgtgggggtatcgccaaccgattgcttatcgtcggcctagcttttcaaagacgcttcactatgcaggcaatctagttgatcgcaaggccggatttttgcaaaactttccagaaaacttacatattaaggtatatggttcagctgatggtaaaactgacctgcctttttcgctagcggattctgtagaatatttagggagctatcgtcaagaagagttggctttagctttaaatgatggttacggcttaatttgggatgaagataaggaacatcattttgacccatatgccaggattaatatgacccacaaatttagtttgtatctatctcttggtttgccggttattgcatgtaaccaaactgctattggccggtacgttagcgaaaacggattaggaatcgccattgactcccttgataatctaggcaacattatcgaaggtgtcacagaagatgactttaatcgcattgtcgataaggtagccaacatcagcgatctaatccgcagcggaaggcacaatcagatggctgccttacaagctgttttggcagtaaagggtacattaccgttctgatgactagaagatctgaaagagagagtacacaataccaaataaaaccattattgctaacagaacagataccgttacttgaacgactgtactgatctttaaatggtctttggatggtttcgtgatttcttcgttttctttatggacgcgctgggcaatgtctttgtcgattaggttctttcttttttgtttcataatactttgagtataaagagacaaaaaaacaaaagcaactctagatgaaattaaatatgaaggagattcatgaatgaatttctggggttctagctaccgatatcataaaaaagcaaaaaaaataattaagttgcaagagacgtatcgtgcaatgggcgatgaggaacttcgacagcaaactgaattatttcgccaacgacttgcaaaaggcgaatctttgcgatcgttactcgttgaagcgtatgctgttgtgtgtgaagcagactttagagttctccatatgcgaccatttcctgttcaagttttgggcgccgttgcaatggaatacaataacatcgttgaaatgaagaccggtgaaggaaagactttgacggcgaccatgccgatgtatcttcacggattgacaggtgctgggaatttcttaattacagcaaatgggtatttagctaatcgtgatgcggaacagatgggtcaggtctaccgttggcttggcctaacagttgcttccggtgttgcgcagcccgggcatgaaagcgaaaaacgcgatcggcagagaatctatcaagcagatattgtttacacgacaaattcggcgctcggatttgactatttgtttgacaaccttgcggccaatccagaagaacagtatatcaatcatttgaattatgcgttgcttgatgaagccgatgcaattctactcgacagtgcgcaaacaccattgattatcgctggtattcctagagtccagtcaaattattatcagtcggcagatcgcatgattaacatgctcaaggaaaaggtcgactataagcgtagtgatgatcgtaagtctgtttggtttacgcctgatggcattaaacgtatgcagcatttctttggtgttgatgatcttctaggcgatgaatggcatgagctatatcgtcatttagttttggctttaaaagcacacttcatttacaaacgggatcgtgattatgttgtggatgatgacatggtcgttttagttgatcgcgataatggtcgtgaattgatcggtatgaagatgcaaagtgggcaacatcaagcaattgaagctaaggaacacgttaagttgactgatgaaatgcgtacgatggcttccgtaacctatcagaatctatttcgaatgttcggccagcttgcagggatgacaggaacagctgccactgatgccgcggagtttatggaggtttatcgcttggcagtataccgtgtgccgaccaatgaaccgatgattcgcaaggatttacctgatcagctatacatcagtcaaacagccaaattattggcatctttgaagactgttcataaagcatacgatgagaaacgtcctattttgattgaaaccggttcactctcgctttcgaatctctattcacgtttattattaagagaaaaaattccacatagtttactgaatgcgcgcagtgccgcaaaagaagcaaaaatcgtggctgaagctggtcaactaggggctgtaactgttgcaacctcaatggcaggtcgtggcacggatattaagcttggaaagggagttaaagaaaaaggggggctgcttgttttaggaacagagcgaatggccaatcggcgagttgataatcaactacgcggacgggcgggcagacaaggagagcctggaagcagtattttttatacatctcttgaagatcggatcgtcattcagaatgcgccgaaacgggttcaaaaatatgcttacaagcattcacatgacaagcatcaacagctcagtcgtcatggtcggtttcatagggtgattgacgaagctcaaaatcgcgtcagcaatgcaggtcggagtgcacgattttcaaccttgcaatacggtgaggttttccgtgcccaacgtgattgtgtttatgcaacgcgagacaaagtgatggttgcttcttcccttgaacgagttataaaaggagtttttaaacgagttgcagaagattttgtgaaggatcatgtgaaggatcataggaacggggatatttccgacttcctagactttgtatataccaacattgatcgcgattatctcccccaaatgctagaggaccatccaaatcagtggcaagatccgacaacagtcctatgggggcaatcaattggcttgaatgctcatttgacgcctacaaacagtactgcttcagttgcttggggcacgaatgcggctagcggcgttggtgcctttaccaacgttaacggccggatcaccagctttaaaacggaggcacccagcggcaataccaacgcggctttacaaaccaataacggcactccggttacattcacggcgacagcgactaacgatgataagaccacagtttccggcaaggtccaggcaacgattggtggacttaatccgttgacagtgcagcggggcacaagttttagcgttaagcctgcagcattagatggcgtgacttatccttctaagcccacttttaaatggcatctgtataaggatcaaaaaggcagtcaggactattcgccggtggctggtgaacaaatcacgaataataccgacactttaaactggcaaaatatccaggcggcggcagggacattgtattatcagttagaagttgaatttgatagcggccaaaagtcttattggtacagtaacatcgccccactaaccatcaccgcctccgctccgcagctgcacgcggttcctaatctgcagtttgcgcttagttcgggcgctaacccaagcattgccgatttttatgccgcacagggtgtgaccatggtgtatcagccgagcacaatcgctaaccagacaaactgggatggtaacaatcatggtgcgttggcgattgctggcggcggtagtacctggagtttgaatgttcagttttcaccgtttaaaaatcagacaacgcagcactatttatcaacggagactggtggcagtgcggctgtgaccttgcattttgctgatgggaccgcggttcaggccaaagataaccgccagccggtgacggtttacagcaaagtgaccaaggacgttaccacgacaaccgctaccacgacttcgctgcaggtgccgcaaacgtcaacgattcagccgggaacgtatcagtctaccgctacttggacgctggtcaaggcgccttagtcgtgtgaaaccaaaaaaaccccgcatcttcgcaatcattgcgagaatgtggggttatttttgcgcatcggcaggcttatgcgtcagattctgataagccgttttgccggatgacttgttgataccaataaaatgatcgtttccgataacgcttcaaagtaccgctgccgtcatcgtgtttgtcgacgtagatgtagccgtagcgtttggccatttcaccggtgctggcggagatgaggtcaatcggtgcccatgaggtgtagccgatcagatccacgccgtcttgaatagcatcatacatggcggcaacatgggcacgaagatagctgatgcgtgccgtgtcattaacggttttttggccatcttgttcaatcaattcgtcgcgcgcaccgaagccgttttcgacgaccattaccggcacttggtagcgatcgtaaatttgattaagcgccgtgcgtaacccgcggggatcgatttcccagccccaggcactgcgctggaggtaggggttcttgacgccagcaaagaagttaccgccgctggtttcgccgctttcagtggtcgccatggtgctggactggtaataagacagagcaaagaagtccacggtgcctcttttaaggagctcttcttcccacggctccatatccatgatgatattgtgatcgcgccaataacgtttggcaaaatagggatagcgacctttcacttggacatcgccgcaataaaaattattaagttcggtggcagtttggacaagggcaatatcttctgggtggcttgtcagcggatagagcatgcgataagccagcatacaaccaattttcaggttgggatcgaacccatgggcaaagctgcagactctggcactggccacaaattgatgatgcagtgcttggaggcgcatttgggtggaatcgatatcagggctgatgaaccggttggtgtcgtccacatacatgccgccagctaagtaggctcccatcggtcgggttagcatattgatttcattaaaggtcagccagtagtggacatcattgtgaaagttggcaatgacagtttgcgcaaatgtaacatattcttcgatcatgtctcgtgacgcccagccgttgaacgccttcgtcagtgcaattggcgattcaaaatgcgagatcgtgacaagtggctcaatgttgtagcgcttgagttcagcaatcaacgccgcgtaaaaggcaagcccttctttgcttgggccgtcgcttgcagaaccggttgggtaaatccgcgtccaagcgatggagaagcggtagactttaaagcccatttccgcaaacagcgcaatgtcttcttgataacgatgaaaatgatcaatggcttcatgactggggtaaaacgcgtctggacgtacctcgcgggtgagttgacgggggacattgtgagtgccgcccagtaacaagtcgctggttgctaaccctttgccgtccacgttataggcgccttcgagctgattggcagcagttgcgccaccccagagaaaattttcgggaaattgacaaatggacataacgacctccttcattaggtttcggggatgaaactgaatagcttatcgcctggccggacagatgctttttcatgcacttcaatccgttcgggaggcgtattcggtagtaaaacaatcaccgtgggatcaaaaccagacttttcaatgagcggcaaatcgatcttaatgagcggttggccgactttgacggactcaccttgagagacaagtggtttgaaaaagcgtccatccagtcgcacggtgtcaatgccgatgtggatcagcacctcttgtcccgaggccgtggttaagccgatcgcgtggttcgttggatataacatggagacagtggcatcggccggcgcgacaatggtgccgctctcaggaataatagcgactccgtgtcccagcgtgccagctgcaaaaacctcatcctggacgcgagcaagcgggatcatctcacccgcgaccacactctgaaaaggttgcgggtgcgttttagcgctggtgcttgcattggtcgcgacggtggcaaagaagtaggtggaaagaaaagtcgcgccaaatgcgatggccacagtcagtaaggcgttgcggaaattagtaggattagcgccgatgaagacggggagggtgaagatccccggtgaaccgaatgaatagcggaccagcccagtgagcccggcaaaaagaccggccagtcccccggaaaccacgacgcaggttaacgcgtgtttatacttgagcgtgacgccgtacagtgccggttccgtgatgccggacaacgcggtgacgctggcagagagcgcgatttggcgtccgcgggtttgcttttcacgcacggcaatggcggcagcggctccagcttgggcaatattgctggctaacattccgggacccataatcgtttcactaccaaacttggtcatggacaaggtcgctaatggcaaaagtgaaacatgcatgccaaccatgaccagcagtggggtgaaggcgccgaccagggttggaacgagccatggtgtatgttgattaatgaaggtgaccgcggtataaaggccatcgcctaaaagactgccgatgggaccgatgacaattaaggcaatcggagcggtaatgagtgcgactaacagcggtttgagcatggttttgatcatgttgggtgcgactttttccgcgaatcgttcgacatagctcataaaccagacgattaaaatgatgggaatgacgcttccaccataggatgctaggcgaatgggcgcaccgaataacgcaatgggcttgcctgctgcgaccagcgctgtgaagttagggtgaagtagcacaccggccatcatcattgccagataggtattggtgttgaacttcttggcggcgctgacggcgagcatgaatggtagaaaataaaacgcggcatcagccatgaaactcaaggtgagataggcggtgctttttggattgaggcccactaaggctaagatggcgatgacgactttgaacatcccgccggcaatgagaacggtgatgatcggggccatgatgctgacgatggcgttaagaatgcgtttaattaaatttttctcttgggttggtgtcggttgattcggttcgcctgcttcatgaagctgatattgttgctggatagcggcatagtatttggtcacgttagcaccgatgacgacttgagattcatcgccggccaccacggtactaagaacttccggcattttttcgagttgtgcctgattgaattgctgcttatcgcgtaaagtgaagcggaggcgagtggcgcagtgggtgaggcttttgacattttggatcccacctacagcagccatgatttgggtggcgattttggctggatcagacacggtcaagacacccccttaacgccacggtcattttgccgcgttgatgcccgaatcctttattcaactggttgctcgtgcgacagtcatgcttttgtacttgcaatatgaataacccccttcataaacaaaccctgttattggcagtaaaaaaacagacatagccaagaagatcgtttgaacgataaaacgatgatcaaagttctgtctgtttacccggtaacagtagatgtgatatcagctgttaagcgtatgataacggataccaaaataaaaagcaacctaattagattgctttctgcattgtttgtatccaactatttattatttatctaaaaataaacgataaatagcaagctgaattaaattgtacataaaattaaaatgaataccaacatgttcatgcctaataatctcagcggcgaatgtttaatcaaactgttacggctaacgacttttaggctggctgccagtcatcatacgcttgcgaaaacgcgggtgatattcatagagaatgagggctgcgaggccgatcagccccatgatggtgaccagccaaccaagcggtatccccggggtgtggtaagtgagggtaaaggtagtggcttttttagggactttaatcccaatgaagccgcgataattttgaattttcacggactgggtatctgcttgccagcctttttcgtaagggatagtgagcatgatgtagccactgttgtttttttgcgtggttaacgatagacggccgttttggatgatttgcttaggtgcgttggttttggcggttttaaccgtttgcttgaaggcttggcggttaagggtatacagcgcaaagtgatcgaggtcgatttggctgaaaccgcgattgaaggtcaaggtgacggtggtcggtttcgtggcattaagtggcaatgatacggtcttggagccgttgtcgggatcatttttaagggggatgttgttaatgctgatggtcatatccttgcgcatgccttcacccatcacgagatattgctgctcgctgctagggttgacacttaaggtaatgctggccccaagctttttgtttaccttggttgccacggcattggtgagggtggtcagcggtttgacgttatcgacactgatcccggagaaatcagaagtggtgaagatcggggccgtttgctggttcgtcaaagtggcaaaataagcattttgttgcaagaccggatttgcctgcacttgggttggaattttgctgaaaatctgagtggccacgggtaaggcatccggattttcataaatattaaagagctggttgtgaccgactaatttgtaggctggcaaatcatagcgggcattgaaaatattgcgcgaggaagcttgttgatactcggaagtgccgacttttttactcgtcgtgttgaggagcaataactgtttgacgccgagtaagctttctagcggccaggtgaggtcattgtttttgacccgcccggctgaaccgattgccccgacattggtgagggtattgatggtgctggtgtttaaaaccgaagaaaaagtgctgatcccgttgaagttatattggtagggatcgtccatggagcgttgggtgtcggcattaatgcgatagaacccggatggcccgatttttttagcatcgttgtaagcggcactaagcactttgctggtgacggtgaaatcggctttggagatgaaactgatggcgccgaggctggcataggcattggcgcctaagtcgatgacaagcaaggtcaaaagtgcgccaaccgtccattttaccgggaataggcgggtggcataactgtagagcagcacggcggcggttaggagcaggataccggcgaggatcagatgcggtaaggtgacatatttgtgtgttcccatgcgcaaggcggcggggatgatgagcagcccgccgatgactagactggtgaggagtaaacgtaaccgagacacggctcgcagctgcatgagtccacggagactgagtagtaagaaccaaaaaatgacaatgaatgagtggcggtataaataccacaccggcgcgcggaacccttgccagataatggcgagaggattgagccagatggataatatcaagagtaacgtcatgccggccgaaatcaagcgttcgcgaaccggaatcgtgcgggcaaggaaataaaaactggcacctaataggccgatcatgcccatatacaggttaggcaggccattagagagctgatcaaaattgaaactacccggaagtaactttgatggcaagtcaatcagcgaatacaaggctttgaaactgaaatcagcacctgcactggaaaggcgggaagcactcagcgcgtaataggtcggaatgagcacgaccgccgcgatcataccgctgagtagcgagccaataacaaataggctgatttttcgcagtaattgcggttgatgttgaatcgcccagtgccagccaaagtaaagcgccgcaaaaatggcgaccatgaagccaatgtaataattggtgatgaatgccagactcagcgggatgacgtatggtagcagccgttgctcatcaaataatcgttcaatgcccaagaccacaagtggtaacaggattaccccgtccatccacatgatattcaaaaagttggcaaccagaaatccggatagaccatagctaatactgaagacaaagctataccagcggccgcctgtcagataattcgccaaggcttgtgctgccatggccgcggtgctgtatttaagcgcggtcacgaataaaaccgccactggtaatgcggagcggggaaccagaacaaatacgagattaaatggacttaacaaatagtaagtccagttggcatacatgccgccgccaagactattggaaaaagaataagctttaccggcagtacccagcagtgcgtgttttaggtaagtaaagaagtcgacatattgaacggccgagtcattagcaagaatggatgatgagccaaacggagccatttttaaagccgcaaaaacgatgaggctgatgacaaaagtaacaccgaaactaatgaagagtagtggccaggttgattgtttgtttgaacgcgacatatcagacgaggactcctttttgaaaaccttgaaaatcaaatattgtcattaattatgatagcaagcgaaataacaggttaaaaaatcaggtaaccttaactattaattaaatcataacgcagaatggctcggcacgcgatcgtcaggaactgagcgcgagccggcgcgcttagaagtcggagtgtaagtggcctcaggcgtgatgaccgtactttggtcattgcgcctgaggtccttacacgcagacttctgcgccggggagcgcgttatggcgatcgcaccgtcccgttcctcggcacacatgacaacttacgatttgaaagttacaatattgggaaagcactagcgggaggattttcatgcgcgcggataccgaagattcaggtttagtttcacagcttaaggccaatgcaatctggctattgccacttttagcgattattttggtgttgcttgtccagtggccgcagttacatttgacctacattttccatcaggatgatacgatgccgcagttacgccgaatggagagttatgtgaccagcgtccggcatggtagctactttccaaaagtctttcccgaagaagtacgcaatttcggctatgcttttgatgccttttacccgtcattgttgttattgccatatgtctggttgcgactggcagggatggggattgtcagtgcttattacggctatcagacgctgattctagtggcaactgtggtcacggcttacgttagttttttgcggattcgccggcagccactggcaggattcgtctttagtctggtttacacgacagcggtttatcgggccttggatgcctttgtacgcggggctttgggcgagaatttggcgtttattttcttgccggtgattgctgcaggtatgtatgaaatttatgccaagcagtcgcgtaactggttcttgctggcatttggcgtgactgggttgatgtatgcgcatatgttgtcactcgtgatggtgctggtatttcttgtcggcgggttcctggttttggtggcgttgcagcgggtaacgtggcgcatggtcagatatacggccatggcggcagtgagtgcgttgttgatgggcttgggcagttatttgccaatggtcgaactttcccggcacctgtcacttaaactcgcggattcggcaacgatttggcccaattatcttcaattcaatttaggtgatttagtcacgaactcattgagcatgtatgcctcaaccagcagcatgcaaaatgtcagtcaggcttttcggccggggattggcgtcttgatgcttgtgacggccattgcactcgccattttttgggtaaagttgtcgcgggcagtcaaagttgcggctggtttgggctttatcggtatttttctaagcactgatttatttccgtgggcattatttagcaaaaccgtgttaggcacgattcaatttccttggcgatatttggagttagtgaccttattcttcagtctggcgcttggtcttttggttgcagatcggtcgcaaccgcaaccattagctttggggttggtgctggcgacttgcatcgtcggctttagctatgccgttaatatcaacacgaccatgatcaatgccaacacttaccgcattacagataaaaatgcggtttcatactatcaggattctaccggtggcggaagtgaatatgcgccgcgagaattcgacatgaccacattctttaagaaaaatcatcagacggttttggcgtcacataaccttgagcatgttaccaccccgacccaaaactacaatgacatgcaattttcgtacacgagtcggcgtgccgtgacgctaagattgcctaagtttgcttatgttggttatacggtgacggttgatggccgcccaactgcctatcacccaagcggcaaacttgaccgtatcacgcttcatgcacccgcgggtacgcatcatgttcgggtggtttacaccggaaccgtcttgcaacatgtgaccgggtggatctcgcttgtcgctgcgtttgtctttttcgcttggtggatcgttgtccatgctcggaggcaacgggatgtggatgatgcgctggtttagtaagtttgcgaaaagcgttgaatgtgcggataacaagcattttaaaacacaatctcatggcagtttttgaacagcggcaatttctgaacttcctaaaattagatatattcggcgttcttggactgtgagaccccatatgctatgctttctgaagggatagatagggtaaattatgttcagcgaagagatcagaggtgatgttgaagtgtttgaagataagtataagatgtccgatgcggaagaaaagttgctgtttgagaagaatctgccttccatgatttatcttgctggaaagtacgaaaacttaagcaccacattgctcgatactaaagcaattatcaataatctgaccattagcggggttaaacctgatgatgttgaagttgtccttaacttaaaagcagcttacaaatatatcgtcggattaccgcagacgattcagtttgggattgaacaaatacagaaaatcaatcttatcattcaaggtgcaggaacgcctgacgcaggtaaattcaggactaagacggtattagtcggtttaaccaacgaagattatgtccctgccattccaaatgaagccaatgtcaccaaaaatctggaagcgctgttaacctctcaaaagagtgctactgaaaaagcgatactactgatgcttacattgtcacggcaacaaattttcacaaacgggaataagcgaacggcgatagtagcggctaatgcattgatgtatcaagctaaagtcggtttattagcagtgccagagaaaaagatgcattggtacctgtctcaattagccaagtactacaaaacagggagagctgatcaacttaagcggtggctgtatgaacatgcggtttttggcattgaataagtgatgtttcgattgaaaatggtagttgttttgagccattctgttggcatcgcgatataaccagaaaaataaggcaagctgaccttgattttgcaaagtcggcttgccttattcacttaatctcgcgagcaatgaagatggggcgccttttggtttccaaatagatgcgaccgatataacgtcctacgatgccaagtgcaaagagctgcaggccgccgatcatcagaaagatcgagaccatagaaggccagccggatgtcggatcgccgaacaaagcggcacggacaacgatgaagatgagagcgatgaacgcaccgatgaagctggtgatgccgacaatggaaacaaacgttagcggggcatcggagaagtcgatgatgccatcagtagcataacggagcaaattggggaacgaccaactcgtttgaccgtgttggcgttcaatattgcgataaggtagatacttggttttgaacccaacccagctgaaaagtcccttggaaaaccgattacgctcggtcatttggacaatggcttcaaccacttgccgcgtcattaagcgaaaatcacgcgcgccgggaacgatttgcgtttgcgacactttattgatgaatttgtagaacatatccgaaaagaaagaacgcagatgagcctcgccagaccgatccacgcgctgagctccagccatgtcgtagccttcttgtaaaattgcgtacatatccggcagcattgatggcggatcctgtaagtcggcgtccataacggcatagtagtcggctttagcagttgaaaggccggcatacatcgctgcttctttaccgaatgagcgggaaagatcgatataatgaacctgatcgtctttagcttgcaactgcttgatttgatcgagggtatcgtcagtagaaccatcgttgacataccagatttgcggttgcaattgcggcaagctttcacgaaaagtcttgatcaatgcttgataaatcagtggaacattttcggtttcattatgacaaggaataataattgccacgctttgcggcatgaaacggcctcctcgatttcaagttaattttcttaataaattgatgattcctagcaaaatcaatactcaatcatcatgcatcgttttaacggccttggccaagctgtcggcctgacttgatacggttgtcaggttcgcagtcatgacatcgatttgctgattgagtgagctgtaatattggtttagttgggagatttgcgtttctaggtcggcttgagacgtctcttcactgtcagcagtgttatcaaaaaaggcatcttctgctgtctgcatttcgcggtagtagctaaccagcgttttgtgatccaatttggcgagcttcagacttgttagcactttgttgacttgagtttggggggtatcatcggtcggctggttatttaacttggtgagcgtgttattggcgtttactaaagcagtattggctgcctcaagctgtttgaacgcagctgcacgtttggcgagcagctttttaacggggccgtcatcatttctgaaatctgtatcaggatgatcttgatacgctttttcaaacgttgatggaaacgcgccgacgctatcaccaataatttttagtgcagcttgttctttttgcacttgtgtttgaacggtagcggttgtggtttttaattgttgtttagggtttaaagtggccgaacatccggcaatcagaagtgccagacccgcgagccatatgagtatttttttcatcagcaactcctctaaatatatggtagcgtaaagccggctgaaatactagcagcagggggattgcaaatgaatttcacccctgaatcctgtttcttcaggatacgagaaaaatgaagcggcaacaagttcttttcaaggatcatgataaggtggtcggtcagtggaaagtttacgtgacgacagccgcggctaacggtaaaataacagatatctgagcgcacatagctgacgggcgggctaaaaaatttgtggtgtaactggtttgatgcgttcctatgctaaactgacaggtggagggtgatgacgatgcacattgggatgcgcacaatcaaaacagcggtagggacagcagcagcgatgttgatcgcttattcgttgcacttggaatattgggccgctgccggtattattaccattttgtcagtgcaaaacacaacgaaggcgtcgtttcggttagtcgcctaccgcttattagccacgctgctaggattcgtgattgcgatcggggcgttcttgattttaggctacaatgcgtttgcttttggcgttttcttggtgatttttattccgattaccaatgtgttcgcggtccaaagcgggattgtgatgactgccgttttggtaacgcattttatgatggcgcgcagttgcagttggttttggattaaaaacgaacttttgctgctggcgatcggggccggggtggcgctcattgccaatctgtttatgccaagtcttgaagctaagatcatgggctttcaaaaacaagtcgaagccgagatgcgtgaaattattgatcatatgagtcagcagttagggacagatcagcttaaaagtgcggacaattgggccaatttatctgatttgaagatgacgctggacgcagcagttgcgtgggccaatcgacatagcgataatcagttgttgtctgaaaatgactactatcaggcctattttgaaatgcgcgcgaatcaatatgaactgctgcggcagatgcaagatagtttggatcgtattgaaacgccggtgatgcaggcggcggtgatcagtgatgccttggcaatgacagccagtgttttgaatgaagacaatccggcagcgcaattggtgacaatggtgaagaaaattcagcgtgattttgctgcctcacctctgccaacggatcgtgcttcttttgaaagtcgcgcccggttgttctattttctggaggatttttcccggctgttgcagttgaagcggaattttaatcatattatttcttcgcagaattgaatcagacgagcaattgcctagctgagcgaatggcgtaaagtttcagtgggtgttaagcaaggctgcatcagtttagacgattttagaagcagtgcgatgggtcaccttgttcgattattaggatagaaagcaagagctggcggagcggtggcgggctcagtggtgaaattggtcttaagcggagtgggcttctccgctttagaccaaggccgagcttcgaaaccgcggtctttgcgggttcgaagtcgtgcccaccactctagctgcgcggtcgccagccccagccaccgcggagccagctcggagtatcggaaatcacttaattagagtagaaccgagaaaaacctgacacttacttgaaagcgttcctacttgcttggtttttaccgtgatgttagactaaacatgtactttttgaatggtcgtggttgcatggtttcaggactttcttccacttgtaccaaacagaaatacacgatattatcatgcgtcaataggcgcaaggaggaatgttctcatggaacacggcacagttaaatggttcaatgctgaaaagggttacggttttatcacacgtgaagatggcagcgatgttttcgttcacttctccgcaatccaaggcgaaggttacaagactcttgaagaaggccaagcggtaacgtttgaagttgaagacagcgatcgcggcccacaagcggttaacgttaacaaagactaatttaaaagtttcaaaacaaaagtgtactattttgaattttatttcaaaatggtacactttttcttttgattaggtgattagcgtttagcgcttcaaggctcagaagtcccgtctggcaaactcgggatcagataacacgcttaagttcaatcaccgtaaagcacaagtattgccgtggtttgtaatgacacatatcattacaggcgaaagggtgacaagcatgactgttaaaacttatcggctaggaaactcaattgtggttaccgttccagcgttattcaatattggcgaaaacgttgaatatcaaccgattattgacgaaaatggcgtcatcagcctgctacctgttaagcatcatatcttcaggggtaatgctggctacgatttacgtcaggcaatgctggaagaaaatattggtgacaatgatattccaattggacgtgaggacgcctggcatgaatagtgataatcagatcccatatcagtaggcaggttgggtatttgaatacattaaaagatcaatcatttatgtctgtctatcaaacattcaaaaaggggtctacactttttggcgttggtgatatatcaacactaaagatgtaggccttttttggcgatggagagcttcataagcagctgttcatggtaaactgatagttagcagttataagcttaggattgggctatggaaggcggggggcacatgttaagatttgaagaggtagcacctgatgcaagactccaatatctggatctcttgttggtgggcgatgaggatccggctatgcttcagcgctatttaggtgcagggacactttttgcggccattgatcagcaggtgccggttggcgttgccatggtggtggcggtcaatgcgaccacggtagagttgaagaatcttgcggtcacgcctgcccgccgccgtcaagggattgcatcaggattattgcggcatgtcagtttggtgtacgccgagaaatatcaggatatgctggtgggtaccggagatgttgattttgataatcttcggttttatatgcgccgcgggtttcgatttgattcgattcgcaagcatttttttgatgaatatagtcagccggtttatgctgatggcttgcgattacaggacatgatcgtgttacgccgcaaattgttgttgacgcgtgaggataagacaaaggagtaaggctattggcgaaaaagcgccgacgttttaccttaaagaaggttccattggcggcttggctggtcatcgctttttttgcggttggttcaatgttggttgtcagctcgtattggtcgcaacggcaagccgaagtttcacagcgccaagcaattgtcgataagaaggcggctgaaaaagcgaagaaagaggcttttatcaagcgattggtgccgacagcccaggccatgcagaaacagtatggtgtcttaacgagcattacgctgtcccaagcgattcttgagtctgattggggaacgagcacgttagccaaggattaccataacttatttggcattaaagggacggatcctgccaccacgaaagtattacggacgaaggaatatgttaacgataaatggattaccgttaatggtcggtttcgggtttatagcgatgatgctgcttcgattcgtgatcatgccttgttattcgttaacggtaccgactggaatccgcaacagtatgcaacggtaagagccgcaaaagattataagactgctgcctcggctttgcagacggacggctatgccactgatccggattatccccagaagctgattcatttgatcgaagcatggaatctgacccagtatgacaattgaatgttcgtattttgttgattattgaatcctcgttatttggttatggtagcgccaaattgcggggatttcgttcttttatcgctgtgaaagcggctacttagtttgttcgggaattagtgagcttgtattgttccacggcgttttttatggtaagctgattgaaaatttacaaataaaaggagtgcttgtggtgaaattactggaagaccggattaaaaaagatggccaggttattggaacagacgtattgaaggtggacaactttttgaatcatcaagttgatcctgatttaatggctgatcttggtaaggaagtctaccggcgtttcagcaatgagccgattacaaagattttgacagttgaaagttctgggattgccccggcgattgccaccgcgatgtcgttccacaagccgctggtgtttgcccgcaagcataagagtctgacgttgaaagatcacctgtacacagcaacggtttactcgtttaccaaaaagacttccaatgagattgccatttcgcggaagtttttgtcggctgatgacaatgtgttgattattgacgactttttggctaacggacaagcagttgaaggattaatggatattattgatcaggctggggcaactttaagcggcgttggtattgtcattgaaaagactttccaaaaaggccgtaaattgttggatgataagcacattcgcgtggaatcgttggcgcggattcgtgcatttgaagacggtcaggttgtttttgaaccggaggactaggctcgaagatgaagaataaaacaatttccaatccaaaagcagcggcattggggctgcaacatttattagcgatgtattcgggttcagtgttggtgccgattttgattggggcatcgttgcactttacctctgagcaaatgacgtatcttgtctcgattgatatcttcatgtgcgggattgcgacggctttgcaggtgtttggtaacaaatatttcggcattaaattaccggttgtgttggggtgtgcagttcaggcagtggcgccgctcattatgattggccagaagtttaacttccaaaccatgtatggcgccatcattgttgctgggctgtttgtttttctcattggcggtgcgttttctaaactgcgctttttgtttccgccactggtgaccggttccttgattaccgtgatcggtctgtcgctgattccggttgctttccagaatctaggcgggggttcgacgacagccaaagacttcggcaatatgacgaacctgtttgtcggcgcatttacggtattattgattttggctattaatgtctggggacgcggcttcttgcattcaatcgcgattctggtcggcttgattgcgggcacggtcttaggcgggttcctcggcttagtcagttttcagccggtcattgaggcaagttggttccacgtcccgacgccattttactttggggttccacagtttgaatggagctcaattgtgaccatgattctgatttcaatgacgtctatggttgaaagtaccggtgttttctttgcactaggggatattgtcgggcgtaaaattgaagcagatgacctgaaacgcgggtatcgcgcagaaggcctagccgtggtactcggcggtttgttcaacaccttcccgtacacaactttttcgcaaaatgtcgggttggtgcagctttccggaatcaaaacccgcaagccggtaatttattcggcagtcttcttggttatccttgggttgctgccgaaaatcggcgccttggcaacgatcattccggcaccggttcttggtggtgctatgctggtgatgttcgggatggttgcggtgcaaggtatccggatgctgcaacaggttgattttgaaaatgataagaatttactggttgccgcgatttcaatcggtttaggcttaggggtaacggtacagccgcatattgttcagttcttgccaaaaaccattcaactgttgtttggatcagggattttgatgacaagtctgagtgcggtgttgttgaactggttgtttaattcaccaagtcgtcatcctgaaatgccggttgatcgcgggttaaacgaacaggattcagacaaataaagtcaaagcgaggaacaattgtgacgcaatttattagtccaggcgctaccatcggcattattggcggtggcgtatcagcttttcgcatggctgatactgcaagcttaatgggcatgcggactgtggttttagcaccgacccaaacggatattgcactggaaaaagccgatattccgttggtcgggcaagcggatgatcgggaagcattaaaagagttgacgcaactgagtacggtcatgacctttaccgatgaaaacgttgacggcgctgtattggctgaattagcaaccagcagccaattgccgtcaggaaccgatattttgaccgtgacccaggatcggtacttggaaaaggtctttcttgacgatctcaacatgaatattctgccatatacccaagtcatcacgcctagcgatattaatgaagcaattgacaccattggctatccggccttattgaagccaattcaaaaggggatgggcgtggatcagcagttgttgctggcaaccccggcggatgtcgatcgcgccaaacaattactgcagcagcgtccgtacattttggaagcctatttgcaaaatattaaagaagttgccgtcatggtcgccaaggctgataaagaaatccgaattgggccggtgattcagaattattttgaacatcatcaactcaaagcatcttcggttcgggctgacgttgatccggcggtgattgttgagattcgccgcattgcagaaaaaattgccaagaagcttgattataatggcattttcagtcttgaatttttcttggcggctaacgggaccctgtacgtcaaacgggttttcccggggccaaaattgtatggtcacctcatgcaatgtaccagcgatatttcggaatatgaactacatctgcgcgcgattctcggctggccgctgccagaactggaattggccgaagatggcgttgcgattccgttacggcaaaaagacatggatgcggttttgacgcagattcaaatcaagccggattggcggtttgctttctatccgactggcaatgagttagtcggcgagattgaaatcgttggtgatttgaaagcaataaaagacagcatcaatgccacgggacattttgtgattcagtaaagattctcgagcgtgccggctgcatggaaaagtcggcatgctcaccggtgatacgatgatgagtatagaacatggcgcttacaatagaggaggaaactacctgtgattccgcgttatagtcgtcctgaaatggcggcaatttggtcagaaaaaaatcgttatgctgcatggctggaagttgaaattttagcggctgaagcctggtcgaaactaggcgaaattccggaagccgatgttaaagctttacgggccaacgccaagtttgatgtcgatcgaatccacgaaatcgaagcggtcacgcaccatgacgtggtcgcatttacgcgggatgtttccgaaagccttggcgaagagaagaagtgggtgcactttggcttaaccagtaccgatgtggtcgatacggctcaaggttacttacttaaacaggctaaccagattctacgtgcggatttagccgtattaaaagcaagtttggcgaaactggcaaaagcccataaagatacggttatgatgggccggacgcacggggttcacgctgagccaacaacattcggtctggttgttgccacttggtattcggaactcaatcgcgatattcggcgatttgaagatgcggcaagtgatgttgaagcaggaaagatcagcggggcggtcggaacttttgccaacacgccgccagctgtggaagcttatgtgaccaagcagctaggcattcgcgcacaggagatttcaacccaggtattgccgcgtgatctgcatgcccattacattcaaacgctgggcctgattgccacctcagttgaacggtttgccttgcagattcggcatatgcagcgaaccgaagtgcatgaagtcgaagaacattttaacaaggggcaaaaaggttccagtgcgatgccgcataagcgtaacccaatcggctcggaaaatgtctccggattggcgcgggtgattcgcgggtacgaaacgccggcactagaagatgtcctactatggcatgaacgggatatctcccattccagtgccgaacgtatcatgctaccggatgcaaccggcttgctagattacatcctgcatcgtttcacgagtattttggatcatctggatgttttcccggaacggatgaaggccaatatgaacctcacacacggcttgatttatagccagcgagtgatgttaaaactcatcgaaagtggtttgagtcgggaacaagcctatgacctagttcagcctaagaccgcgattgcatgggacgagcaccgcgacttccggccgctgttagaagccgatccggaaatcatgggccggttaagcgaggctgacttagatgatgcgtttgattatcactatcatctcaagcatgttgatgaaatcttcaagcgcgttggactggcttagtttcacaagtttgctcagaatatgataacgaaaattgacgctagaatttttctagggtcaatttttgtgtttaaattttaaatttgaacgacagtcgttatccggtacgctagcgccaactttttcaaaatcggtgccggtgacaataatcgcaaaaaaagaccttgcaatgtaacttcgcaaggtcatttggtaacggcatgtagtgataagacaggtggttgttgccaagcattttgaggattggcactgagcagcgattgatcggttgtcaggaccaataagcagctttcggtttgttgcaaagcatggttggcttcggttaagaactcgcgggtaacttgcggatcaaaaatctcggcatgaccgcttaatagtaaatatcgttttttacccatcaaaccacgataaaattgcaaatagatccgttgcaacgtgtttaaagtggccgcgggttgatcgagaaccggagaagtattggcaagccattccggcaaaaagtccgtatgcttggtgtgcccattgatgcaaaggttattccgaacactgagataatccaagataccagtgtcgcgactactgatgaaagcaagttgcttgatgaggccaccattaataaaatccttgatatattggtcgcgtaatgcggtcagtgcttcctcatccgggacgtataaatattgaatcgttttaggcgcgaaaagctttgcaagtctttcacgatagatatcaagctgctttgaccgaaataacatagctgtctcctaacgcggcatgacaagccgtttgcgaataatcgaaagcggggttaccaagcctagattggtgacgaaaatcacgccaaggccgtttctcaatgttgtcaagaagccggccggttgggtgaggtcgtccgttttaccgccgtaatagaataaggtttcacgcgtaaagccagttaggtgacgggcaaagagttgctgaaaggcgtgattcatgtcaattccacgatagccttcctgtaaaagatgaccaaaagcagaacgattcgcattggtcagaaactgaatcagctgatcattaaataaaataatcagaaaaacactaatgataaagctgattaagaaactgaaaaatgctcctcaattttcaagtcaagtgcaacgatgataacgaattcttgatagtggtctaggctgttacgccatgcatcggtgaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactaatgtaagattgtatctccgaaggtatattgcttaagcgtcttaaaattcgtcattcatttcccctcaacattttttcggtaacaattaaacgcggatccgttggcgtcttgatggcagttaccgtaactccttgattaataagactgtacaatgcctcgcgttccctgtcattcagtgcaattccgggaagtattgtcctccgatcgtctcgttttgacacatttcctaaattgatggtatggatcttcaatcctctatcaaatagtcgtttcagtacaagtgggctcttgactaatacaaaaactcgttgaccagcatacctatttgctgaaagattattaaaggctttttcctctgtgataattgacgtattcacactcgctggggccaccattctcagcaactctttttgagcattatcgtttgcaacttcgtcatcaatgaccatgattcgggtagccgctagtcgatttgtccaaagtccggctacttgtccatgaatcaagcgatcgtcaactcgaatatcaacaacatcattcaatatttgcgaacctcctttttctacgaccgacctataagaatcctattgccgataatgcaatcgacaaaacaagcacaacaagaataatacgtactggcgtcatacgcttcttaccaagtaaccaataaaccagtaacaccaatagaactggaatcatgcccggcaaaatcgaatcaagcacatgctgtccattcactactaatttcccagcaacatacttagctttgactgttgcattgatcaccgttggaatcaatgcaccaactaccatcaacccaaccacagaaattgcatcagtgattgaagttaactcgtctcgcagtgtcgtgacaagtttagcgcccgaattatatcccatcttatacaacgggataaccaagcacttgattgcaaccataacaaccagccaaagaataaccccaactggatttcctttaacagccatggaagccgcgatgccaccaaaaatagctcctggagtcgaaagtaatagcgtatcccctattcccgcgagcggccccattaaactggttttgatccctgttactgtcggaagtgaattaacgccttggctttcttcaattgcaagatcggctccaattacaaaaggtgccataatcccatttgtattgaagaatgccaactgtgtctgcaaagccttctgcaacccatctggattttgacgatacagaaacttcattgccggaagtacggagtagcaatatgccagtgccatcattttttcatagtttaatgaccccgttgcaccaccaaaaacaaagcgagtcagcactcgacgtttaatgttactaggcaacttttcaacctgtctcatttctgcatttgttaaattctgcttttgatcactcatcaccactaatctcctctccgttgccacctttaattgaagccgttggtgcttttgtattgtgtgtggtcactcgatgctttgatttatagtacacaaatgccgctgcaacgccgaacaaacctacacctaggacagacacctttatatatgccactagtaagaacccaataagcaaagctggccactgtttttttactggcatcgtccgtaacaagatacctagcccgactgctggcaataagccacccgcaacttgaagtcctgaaagcaaccactgtggaacatattgaaacgcagtaacaacaagccctctaccaaaaataactgtcaagagaatagggatccctgtttcacacatcgtcaagataatagcaatccattgccaaattcctatcatcttataattacgatttcccaccgctttttctgcttgatgttggaaataaacattaaccatttttagcaaaacatctagttgaaccatcacaattgctactgggatgccgattgtaaccccgacttttccaccgatgcccgttgcaattgcaagatatgttccaacaattgccgcagctggataatcaggaacggaagcgcctccaaaactgctgactcccagtgtcatcaattgtaatgttccgccaacatacagtccggtcgtcacatccccacataaaagtccggttatgacaccgcaaagtaatgcttgccaaagtccaattgcgctaacccagcgttcgtaattcataaagaagccaaatataataactaagattgactgaatgattgttacatgcatgacaacttctccccctattcgtcgtccggcctggtatcttgaatcagcgcaccagtcgagacttcttgtactcccggattgtcaagaacttgctgaaccacgaagctcaattcattctggtgatttaacaacgccgttaaagcatccacaaaacttatattgacaacaatcttcgcgttttttctgtctcgcaaaagtgtataaaaagttttgaaaggtgtgccttgaaacatatcagccattactaagacatccccagtcactgaagctatcaatgactctgctttggcattaaagtcataaatactgtcatcacccagacaaagcgtatgaacattatttaaatcctttgaaaaacatgccaatgtgtcatagattccttgagcgtatgatccatgactggttaaaataattgtgaccataatagccctcccttgtttttgaattcgctttcatagtaatcttcgatcagacctttgtcaataaatttatggaatttgttcgaataattgtgaacgaatcttggggtaggtttttctgcaccttctccaacattgaccaagtcctttttttccgttaatcttagggtgagaatttccctttcgatagaaatgagcgaataaataatgaacaactcaaaacgtatagcagatgatttgcgagcactcatcagcgaaggcggcttggtggatgatcagttaccgactgaaaatagcctgatggccaaatatcgagccagtcgttatgctgtgcgcaaagcaaccgaggaattacaaaagcaaggtatcatttataaagtccaaggcggcggtacttttgtaaataaagcgtacaaaaaaaagacactctcgcatgctgttggtttagtcacagctggtgatctcacagaaaacggtcttttaaatactataagcacagctttttttaaaaaaggctatactttgtttacggttgaaactcataactcaccacaatcggaatatgagtcgctacggtctttttacgatctaaatgcagatgctgtacttatcgaacccagtcaaagtgctgtaaacacacaaagcttaaaactattaggagaaatgcaagtgaataagattttcacattctttttattttcctcctatccttcagtatctgcccctttgttctctttgacggatgctgacagtgaagcggctgtcacaagtgaagttattcaaatgggccataaacgcttactaggaatctttcaggtagacgatatgcgtagtgttttaagaatgaatggttttatccgtgcataccagcaacatcctgaggttgctttaaattcttatatggaaacttaccaatcctcagagtcactacgagccgttattgaaagagtgcgtatgcattttattgatgtagataaagaactccgaccaactgccatcgttgtgcacgatgatcggatggcattacaagttatgtccatgttgcaacgcgcgggtattcgtgttcctgaagacgtttcgattgttggattcggagattcgattcaatccagcacagtaacaccaacgctcgcaactgtctcatttgacaaaccggcatttgtttctcatctcgtccagcagacccttcttgctatatcaggtgagaaaccagtttctaaacaatttcccgcatacttgataaagcgtaaaagtctgtccagatatccttatcgagttgactagcgctaattcaaaccaagtttaaggctttcgaatttgcccgtcactattagcacgttaatgatattacatgctttccccccttaactcagcatatgacactccttttaagagttctcgctaagcatatgaaggcgtaattataacgcttagtgttaacttttccgcccactgcaaaaaattcttttcaccacgactaggatcatgcgcattcacttgaaatagcctactcttacctcatgtaaaccaagaaaaaagccatgcattttttcacgcatggcttttttacagcttaatggtttgataaccgtattcagtacttacacagatcgcgtcatgccactagcaaaagcgctttggctcaagatcaactttcacttacaggactttcactcatcaaatgaacctcatgatcagcatgccgcagttcaggccagtactctcgattcgccacaatcaaatcatccagcacttcttttgccacttgagcactaggcaacgtcttcgatagcgtaagtgcctgccagagttcctgataatcatgatgaatccacccgtccactaccagcttctctaccatcgcctgattgaggatcatcccgcgctgaaacaatggaattttcccttgcgttaacggttcggcaccatcttttccgacgatacaaggcacttccaccatgatgtcgtcatcaatattggcgattgcgccattattttccacaatgagcaacatgcgttcatgtgtattaaaggcaattgcacaggcaagatccacgataaatgaggcgtgactgtcgattggaaacgcgccgacctcgctagtacccgcatcaatgatcttttgtgcggccgtgaaaacacgcttttctcgaccgtcctcaacctcattagcgcgcgtgtattcaggatccgaatgggcaacaacataatccgggtataaataatacttgaggtacgtatttggcagatagttaggatccaccgcaagcagatcctgagcttttttgtgggtcgcctgccaactcgcatccatgtgctgcgtgtccacttctacttgggtcagataaccgtgatgcgctacatagtctcgaatctgtggtaaatattcatggccgactttatccttgacactcgtccaccagccaaaatgattcatgccaaaatagcgcacctctaaatcttctggttgtaagccaacaatttgtgacatccgccgctgagttccaaccggcatatcgcaaatattcaaaattttggcatctggccgcagccggcgacacgcttcggccacaatcgatgctggattggaataatttagcatccaacaatccggtgaataccgttccataaagtcaatgagttcaatgatgtcgccgatactgcgcatcccataggcaattccacctgggccacaggtttcctgtccgacaacgtgatgcttcaatggaatcttttcatcctgttcccgcatcttgtagccaccagagcgaatgtgtgcaaaacagaagtcaacatcggtaaaggcggtttggggatcagtcgtccaagtaaactcgatattaggtgctttttcctttaattcaatggcaatcgccttggcaattatcgcttggcgggcttcatcaatgtcgtacagcttcaaagcccgtaacggaaaacgatccgcattttccagcagcatcatgacaatgcctgctgtataggtactgcctccgcctgcaatcacaattgaaaacttcttagtctgggtcatcataaacactcctattcaacttctgctgtgtcgaaacctaatgcggcatccaccgcggttcttactttagtgactgctaatccatagacaacatggacattgttgccttttttgatcaccccactggcgccggtaacattccttaatgtcgcttcatcaaccagatccggatcttttaaaaccgttcgcaagcgggtataacaattcgtcacactttcaaagttgtccgctccaccaagtgcttcaataatggtcgcgactggcacatcttgggcacctttgggaacttgtacaggtggcgtttgcttcttcgcctgataatcggctttactataaagtttggtttcttcggtatcttgctcacgcccaatggttttcaagttgaatcgtccaatcaaaaacctgaacgtaaagtaataaatgaagaaaaaggcaatcccgacgagtatatacatcggccagtgagtctttccgatacccagtggcaggttatacagcagaaaatcaaggaagccatttggtccaattgcccgaacgttaaggaggttcaagacgaccatgctcaaaccgctcagcccagcatgaacgacaaacagtaatggggcaatgaacatgaacgaaaactcgattggttcggtgacaccagctaagaaagaagtcacaacggcaggaattaggattgccttgactttattcttgttttccggtttcgccatttgatacatcgctaaacatgcgccgatcaaaccaaacattttcgaaataccacgtgcatcccagataaccgagcgtgatagtaggtgaataccaggatcggccatctccgcataataaatatttctggcaccttcaaaaatgtgaccaccgatttcttcaaccccaccaagcgaggtatagagaaatggcgtgtaaatgaggtggtgtaagccggtcggaatcagcaatcgttccagtgacccataaaggaataacccaaagttaccggtctgattaattacgtggcccaaaccggaaatacccatttggatgaatggccacacataggtcagtgcgactgccaataaaaccgtcaccggaatcagtacaataaagacaaaacgactgccaccataaatctgaaatgcactgtggaattcagtatcaacaaatttgttatggatataaccaaccgtaataccgagaataatgcccagaaaaacgcccatatccagaatctgaaccccaagcaccgctgcctggccggttccttgaagattctcagctttggaaagaattccccgcagctccataaacttattcatggcattgatgaaaactaagaaagtcagcaaagccgtgaatccggcctctgcttttttcttcttcgccaaaccaaccgctaaccccacacagaaaatcaccccaagattggtcagaattgacaccaatgaccccgacaaaatcaaaccaaagcccttggtcactggattattcataaatgggacaacttcaagcaatttttgattcgtaaagatattgccgatcgcgatcaaaatacccgcaatcggtagaattagcaccggcacaaacattgcctttgaaaatcgctgtaagccatccatgaccttttgcttcatcccttttcacctctccgataggtatatttagtaacctgatatcgttgttggtttaaacttaacaaagtattggttgtatgaaaaccctttcaaagtcattgggaacgcgttacgctcgcttggaacaggttccattcagctcacgaaagccagataaaaagccatacgttttttcgcgtacagctttctttacattttaaatgtctgataattccttaatattacttgtttgcaagcactacttccccaattcaatcacgccgtcatactccgcgcgcaacttcgcatcaagatgatgactcacttcaatcagcgtcgtatcgggatcatcaagaaatgctttggtaacggcttgggctgtttctggatcaagtgcagacgtcccttcatcgagtaaagcgattggttttggtgcataaaagaatcttgccaatgccagtcgctgcttttgtccacctgacaagttttcgccgttttctttgatcagctggtggggtgatttcacaaagtcaacttgtgctttcttcagtgctttttgtagccagttgtctgcatgttttttctttcgccaaagtgcagtattgttttcaactgagtcgttaaataagtatacgttttgatcaatgtactgaccgattcccgtcagctgtgctctggttagtgttcgaatgtcgtgatgatcaagataaacatggccgtgataatccgtaatttgcccattcaaaatcttgagcagggtacttttacccaccccgctgcggccaacaatggcgtatttgccgccgcggttaaatatcagattcaggtgatcaaaaatctttttgccgtcaatagcgtaactcagattcacaatttttagcgcgcgctgaaaagtcgggactgatattgactcgctggcagcttcattgttaaccgctctcgcagcaatcttgtcaaatagtggccgcgttgatttaatctgaacggcatcgttgcttaggctcgacattgagttgaacacgctggcagcaatattcccagttgaactaatagccccaagcggaatcgcacctaagatggccagtacactggtgaccacatccaccataacctgacaaaagatactcaaggcggcaattagatttgaaactcgggtattagtttgcgtgtaagcaactttagtatgaccatatttttgcgctgcgtttttcacaagccgacacaattgcctcagctgatttgcattggaaaatacgtcaaacccgttgagtacattggttagttgattcgaaaaggcagcgttaccatctgacaactgttttgtagcagtggtcatcgatttttctaaatacgaaggtccttttaacatcaagatgactagcacgaagatgacaggcaggaacagcaagtggtaggcggcaagtgccagggtcgcaaagaggacggtagccgcgctggaaatcaacgcaaagaactttttgatcgcgttcacctcgatgtttccggcatcattcacgtattctgaaagatattctcccgttgtctgccgatgatattgttcgtaggatttaccggcgattttccgcgaaatggtactgcgaaccgccaccaagatgcgctgggttagcttttcctgaaaaacagtctgaaagtagttgctgacaagaaacgtcatccagacaagcaagttaaccaccgaccattcaaccagtgccagcagattcttggaaaaaacggcatcggtggtaaatgttaatagcaccgacgtcccagtatatagcaaaacattaacgataatccagacaatattaagacatgtccgcccacgctgttgcattaagaagttcttcatagtctatctcccctatcaagcatcgttatcccgacaccaccacaactaggttttcttgatactgcttactttagtcgctaaactggggaggaatcatagtgtttcgaaaatgaaacagggagtaactaactatgaaaaactttggcgcaacttttagatatttacgtgaggcgcgcggtattagtctgagctcactggcagacgatgtcgtgtcaaaaggcatgatttcaaaatttgaaaacggcacctctgatttgtccacgacccgcttttttcatttactggatgccatctacgtcacgccttatgaatttatgatcgtgatgaatcacttcaagccacttcataccaatcgctttctgaaaaaagttaccgcgtgcgcattagctcaaaacgtgccggggctcaagcgtttggccaatgaacaatacgaacgctggcaacagtcgcaatcacttttcgatcaactcaattggatcatggccgcatgcatcctcgccgaaaccgcaaaacaacctttatccgctaaagtcgacctacacgtcctcactgattatctattcaagtgtgaagactggggtaactttgagttgatcttatacggcaacactatgacacagttgccaatcgacgccattgtcatcttttcccagacgctgttagaaaaatgctctctttacactgggttaatcacggtatacgaaacctgtatcaatgtcctgctcaacaccatcgccgtcttgatccgccacaatcgcatccagacggctttaaaaaccgttgcccttttagaacaaaaagacttaccggaatcgtttctcttggaaagaattcttttgaagtactacaaagggattctgctagaaaaaaccggcgaatcgaaaaagggacatgcgcttattcacgctgcactaagcgctttagatgcaggtgactgcgatacgttcatcagctcgctccgagaagcgttagccgatcttggggtgtatcatatttgaaactaaaaaggccgtacttttatacagccttcccgcgtcatgcatcacttttgtcaccgaacccgctaattcagtttctccacctcgccgatcaccagctcaaacaaggccagcatctgcgggtaaaacagcgatgcccgttgatttacctcatccagcgggaaatcatctgcgactttaagcgtccaatcagccattttagccaaagtgctgtctgcgttgcctgtgaaagcaacgacgggaaccggcagactgctgactaaagccgctttatcaatcacactctgcgtctcgccagattttgaaacaacgataaacaatcccaaatcctctaaataattctccaacaacgcagccgaatcccccggagttgaaaagaaacaccgcttacctagaatctgaaattttttaaacatatactgcccaattacgcctgaaaaaccagccgcatacaggtacaaatattgattttcaatcgccgcgatttgttgagccactgcgcgaatggtcgtcacatcattttggtcaagcaccgctgattgcaacggatcgtcagcagcctcaacggattgtgagccggcctcgccatggcgcaacatcgtcatcaacttatactgcatctctacgaaaccgcgataacccattttgtgtgctaaccgcatgacggtcgcggccgatgtgtaattcgctttcgccacgccgcgcacacccagatctaacacacggtcaatgttggctaccagatactgcaaaaccgtgaactcagtctccgtcaagctcttccccgcaaccagcttttctagtttcacaattgtcagcgatcctttcattgttcgtcatgctgatttgtcaaccaatcctgcacaaatgaaaatattcagtcggcatacgtcaatatcgtaacctgatcgccatgcgcaaccggccccgctttaatcgcatcgaacgctttcaccttctccatatttgtaaacacaaccaccacagccgggtcacgatttgaggctttaatcgcagcaatatcgacttgcgataaaacatcacccgcctgaacttcatcctctgccgcaatcttagtctcaaacggttccccgtccatctcaaccgtatccaatcccatgtggaccaacacttcaagtcctgctgcggatgtaattccaatggcatgtttcgtcgggaaaaccgagctgatgacgcctgaaattggcgcataaactagcccttcttcaggcgcaactgcatacccatcgcccatcatcttttccgaaaaacgccatctttgagcgcctccaacagcattagctcgcctgtcaccggtgcagtgaaaacgtcacgcttttcttttttgaacaacccgaacattaatcgccatccccttctgaatttgactgaaaccccgtaacttcacgggtgttattttttattgtacaggaaaagagaaagtcgtgtaaacggtttctttgcgaacgagaaatacaccaagcaaaaacattgcgatgactatctgcggcatgctaccattgtttcagtcaaaagattagcgatagtctttttgattgtctactatgtactatttccaaaagctccatgctcaaaagggagcatcggtggcgaccgatactccccctgacaagaccgttcaagacggttgacataagatttgcaatcaaaagaccgtcatcttctccaaaagattagcgacggtctttttgattgtctaggattgctacctccaatggcaccatgctataataaaacacgaaagggagcatcggtggctgccgatactcccctgacaagaccgttcaagacggttggcattaagttgactaatcaaaagaccgtcatcttctccaaaagattagcgacggtctttttgattgtcttgtattatcagcataatggtgatgatcagcgcaatcaacgataatacgaaatcaccgaagaccagcatcagcatcaacgcatcagcaacagacaactaggcacctccttccgtatagattttgatcatcgcgcataggcgaccacctcacaatacgttggatttgccaaccgtcattcactttcttgtcttgtttattatgccatacaaaacatgaaaacgcccgtaatctcaatgatttcaggcgttttttaatgcttggattgtatttcttgatgcgtcagtcagagagtctcacagtcagaagtaaacctctgtcactaatccgccgcaaccaactcactcgcatccaccagacgcttggtcatctcccacagcttggtcacgtcttccggtcgcgtcaagccagttgccttgtcaataatcgagctgtaaatatgcgggatgacctgtttaaccccggcatccaaggcaatttggagaatcgcttcgtaattatccaagtcgatgccgccagtaggttcgaggttaaagccttccgcggcacaggctttggccactgcgcggaattcagcttcgtgcttcaagccgcccatggggaagaacttgaagctggtgccgcccatgtcttgcaatagggcaatggcggtttcaaccggaacttctgcggccggtttttggctgcttttcggtccagtggcaagattaacgatgccgactttgccagttggtgagaccaagccattaatgacggtctcattttggcctaaaagtgcgcgactggtaccaacgccggtgaagacttgattaacgtgttggggctgcaagacttgcgaaacccgactcaccatggcgctttgattcgggtcgcctgcgcctaagccaaccgataacccattagcggtcacggcttgatattttttcatatcttcaatcgccgcttcatcggttgcgtagttcttggtcaaaacgccgactaccacatggccttccgcagcttcatagatgtctttggcattgtcgacggaaccagcgagcacatttagagcgacacgatttttataatagtttggggttaagttcatggaagacaacctttctatgcgagaatttctttgagacgattgacgatcaggtccatttccgcttgatcaacggcacgaatatcgaattcgatgatcccttcattggcccgatattcgcgcgtgtagatagccggatcccctgcttttagttcggccgtaacctgcttggcattcttgggactggaggcttctaccgtcaccgcggcccggaaaatcgggcggccggcgccatcttggacttccttcacgttcaggtgtggcacctcattcaaagcggccacgaatgggtgtagccgcttcttcatcgcgtcaccggattctggaccctgatccagatactggctaagcgcggtggtaaacccgagcagattttccttgccgattttcatggcgcggccaattccaagtccttgcagtttcgtccaaccgatatatggttccttgccgaaaatcaagccagatgccgggccttcaatcgccttggccccagaaaacagcaccacgtcaacgcccatttcgacatacttgtgcaaatcctcttccgccgcagcatcgagaatcaatggaagttcgtggcgatgagcaacctccaaggcttcctgaattgtcagcatgcttttttgcaccgcatgatgacttttcacatagaaaattgccgcagtgttggctgtaatcatcatctccacatgttccggcgtgcacatattggcatacccggcctcaaccacctggccgccgccgagttcaatcatgacttcttccggcgtgccgtaatcaacattctgtcccttaggcaaaatgatttcacgcttggtataccgcgaagaaaacggatgataaacatgatacttactaccttcaccaataatcccggcgacggcttcagcgatcccggctgacgctgagttcaccaccacagcgccttcagttcccagttttttggcaatgtacgcgccagttttatcaaccaaatccttcatttcaaaaaagtgggtatccccaaactgctgtgcctcaatcgcggcctccggaactttggaaacgcctagaatggtcattttgccgctagcgttgatcacgtgcttcaaatcgtaagtgctgtaataatctgtcatgcgtgttgttcctccaaatcgtaaaccgccccgccaacaactgtgtaaattggcgcgatgagttgctggccggtttttgtgttgccattagaatccgttaataccttatcaccttttgttaggttaaaaatggtcacgtccgcatcttttcctggtcgcaaccggcctttattcaaaagatggaaggtgtccgccggtgcaaaagtcaccatccgaataacttctggtaaggtatagccgagcagcaacatcttttccatcgtcgtcgccatgtcataaacaggaccattttcacgattgcggtggtaaatatccgtgctcaaggacttaggatcaaggccatgatcgcgggcaatctgcatggttttaaaattaaacgaatctgtcccgtggcctacatcgaaaacaaccccacggtcatatgcatcatagacgaattctttgatctcaccgttttcatcaatcatcccattcggcttgccattataagcatgcgtcaggacatctcctgcacccatcgcttgcaaaatatctttgagttcaggcggattggccccgacatgcaccataatcggcagatgtccgagcaaagccgcatatgatcttgccgccaatagtggcttgatgccattatcaatcaccaccgaatggctttcgcgggccttgatgccgacgataaaatcaggtaagtccgcaaccgcatcaaacaacgcctgcttattgactttatctaggtcacccagctcatcctgcgctaaaataccggtgcgaccgatattgatcagtgcgtaaacattggtctttttagcgcgcgtaatgtcgtaaaaactccgaatattgtccgcaccggttgatcccgcatcgatcacggttgttacgccagccttgtacccatcttcatcgggatcgtcatagtacagagatagcttttcatagcaatgcacatgatcgtcaatccacccagccgtgacgtaggattgctggtgtaagtcaatttcctgatgaccgcctgctccttccagctttggtgctaccgcagcgatccggccgccattaatgccgacctcgatcggctgttcacgttctgttttaccgttcttaattaagacatcaaacacaagtgattacctgcctttcgatttgattgtagccatttttggatgcaacgcttggagaaatctgaattgcgtcaacaagtggggaaagttgaccatgaacatggttactcctgtgtaccgggctctccaaaatcttgcactcccgccactctccgaaacgcgcaaactggcgcagaaacctgcacataaggaccttagaccgccaatgaccaaagaccagtcattggcggtctaaggccacttatgctccgatttctaagcgcgccagtttacgctcttaaagtttcaccgggaagaagaatcccataatcatcgcgccaataatcgcaccgcctgggattggttttttccaagcgtagaacaacgctgcgccgactgtgctgccaatgccaatcggaatgctggcagtcacggcactgaggataatcaacggcccaaggaagcggccagtttggttaccggcccccatcataacgtcggcaccaaatgtcgcattgctttggttaatcgtgaacttccgcaccaggaaaatgatcatcccgataattaagcccagaatcgccccagtcaacaacgccaaggcaaagtttgacaccagcgacttggcgccaaccgacagtaagatcgccggaatgccgatgccgacccctgtcaaaatcgaaccgccaagatccagaatgccgacaagtgacccttccagaatccgggcaaacaggaaactcgctccaaacgccgccgctgcgccatacgagccaccggtcataccagccttcagcattgccacaattgccacttcattgaaggccccaacgccatagttaaaatacatggatgttccggcaaaaacgcctgccgacatcattgcaacaatcgcgacaaagccccaatctgcatgccagaaatcgcgatccgcagcttctctcaattcttcttcaattggcgcttgatttgctgtagcttgtttatccgccatcagttaatccacctctactttccgcttaacgtgttatgaatattcgacaaccagtcaggtgcatttaagttaaaggacttcagcaagttgagatcgaatccgcggaagaaccctgataagacgaaaagcaaaatggccgcaaccaaaattgatttcgtaattcgagtccatcctagttcatcaacaccttttccgacaagaatgcctaaaacgacccctggtaccgcattacccataatcatcgccgataaaccgccaaacacggttccaaacaggcctgaccgtcgaccggcatcaattgccgccaaccagaataagattggcatcacgaggttaatcaactgattcgccgccggaacaagcactttaaccgccgtcacttgcagcgattcgggaatcgaactggacgtgacattcaagaaagcaacgaccacgatgccggcaatcgccccggcaatccccattttcttaggattatgcatggtttgttcaacgttacgatttttaaccagtaacccagcagccgcccagttcggaatgacacggtgcgtaatatcctgcgtaaaggcgccggccccaaccgttgacgcccaagcattaaagaagaaacccaacccgaaactaaaatgcgaagccggatcgccttctgccgcgttcatttcgcccagtgttcgaaacgcgcccaaagcttgtgtctttggcgcggtgaacatccgtgctgccccaacccctgccgcaaaaccaaccaatccgccaataatgatggactggaataaaattgtgagaattggcaattcatttcacacccttcaaaatattctttagattcggcaatgacatggcatccggcgatggtgccgcgacgtcttcaaaaaccaaagcgtcaaggtcaatcgccgtaactgcaaccgtcactgccagtgtcactgcataagtggtacgcgtgcgtttaaaaaagaaaaacagaaacttttccgtataactcgacttaaccagtttcagcggctcgactttttcgggaacgatccgcaaaatcgcagtttcggtatcaccaatcagctttttttggatattgctaaaagcggctgcaaaggcttgctgcttggtttcacctttgccagataccgtgacgacttgatgtttggtttcattgacgactgtcatttataaccgcactccttacgcttcgggatacttcttgttccacgcttcgaccagtgctttacccaacgcttcttgatccataaagccaaaaccgagaactttagtgccttcctcgatggcagtcacaccttcttgaatcgagcgcatgccatgacgttccggccatccatattgcgtatgcgcagtaatcgcccccgcaccgccggaaccacagaagctaatgcccatatcggctttttctttatccatcacctgacccaaacgcatatccgcccccataccaggcaccacaacggcagtaccaccagcggcttcaactcctttagcaacgttttgacctttacccatccgatctgcgataactactttaaccatgatatcttcctcctgagcgtgagctggcgcggttagaatcctcgccagttaacacgagataattgcaatcgtaaaatatctccacttcaaatcttgttctgcgccgcttcaaagtgaatcgataacacatacttctccgcatccgccaaatgaccgatgtgccgaaccacttgatcggctaaatccagcgactttttcgagacttccgcaaacatttggggatcgactgccggcaacttttcgcctgactttgagcggttgatcatttcaatcagatgattcgttaacacttgcaactgaaccgcggtaaaatgaatctccgcttgttcggctaactgaatcacgtcactgacaatcacttgaaccgcctgtggatcttggctttgggcaatcattttttgcacttcaacaggtagcttaatttcggcttccagtggtgacatcccccttctgagacacagcatgacctaaatttaaatattcaagaatcgcatggacttccgcgcgattgatggcaaggccatgatcggtaaaaattcgttccacggtgccagctaatttggcatcgtcatgattaggttttccttggtactgcttaccaaacatgatgcgctgggcagctaaaaagacgtgcatcatgaacgcatcggcataatacgggtcaatcttggttggcaactggcgcttgagttctgaataaagactgaacatggtcagaattgtttgttgtgtctgcttttccagatcaggcttaggcttaatcggaactaccggcggctctgctttgagttgttcaagtggcacctgcaaacgtttggccaccgcacgccggatagcggcaatatcagtcgcgtttggcaagggctggacttcaatgacttgcacatccagatgcttcagtgggaaaacgctaatcaccagctcaggatgctcgcgggcaatcagcgcccgcgcatcatcaatggaggcaaatccgaccaattcaatgttgggtatcgccgaagccacgcgctgttgaatcagattggtgatcccaataccggtggcacaaatataagcgacccgcaccgttttcagttggctgtcccgattgagcgataccatgaaatgcaaggcgataaaggccacaaaggcatcgttcaaaatcgggcgataggcggccagctccttatgcaccgtcttttcaatggctgcaaacaactgcggatattcgtgcttgatgtcctgcgtaaacggactgtattgaagcagttgattctccttgccaagcgactggctgaggtgcaggtagagattttcctgaagttgactgtcgtgactgaaatcgtgatcaaccagcgccccaactgccaagatgattcggtgcgtcatagccacaaagttgtcgttctgtgccaccgttaacttctgaccatccgctccaaggtaataagcaaaatcgtcggcccaaactggcaggttgtaaaacgccagtgctttgagaatcaactgaccggtaaacgtggtactgtcgccttgctccacaacccgatgataactattcaccggctgattaatcccttggcgcacaatgccgattgcgagccgaatcatggtcgtgatcaaagcgctgggatcaggcattttctgatcctgttttcccagttgaatcgccgctttcaggatcgtattaaacgcatgatcaaaggtcggctcactcgtcaaaacgagcgcccgtttcggttcaaccaaggcattgaggcaatccaccagctccgccatcaacgtcttacgattcaactgctgagcgataatgcgttccagcaaccggcgaatatccagctccgtccccgtgagtttgtagccataataattcttactcgtgagcttcacattcacctgatgcaaaaaggcagccagtttctttaaatcgttgttcacggtcgtttgactgacattcacccgcgcttgaagctgctgttgggtcgtatagtcacctgtttgcgccaaaatcagaatcatgcggataatccgttcattcggggccaaatagttatccgccaactgctcatcgattttctcgcgcaatgccatgcgatcttcaacgcttgcttcaatccagacgccttttcgtggggcgctttcgagtttggaatggtgcaatgcaagccattcacgaatatctgccaagtcatacttcacggtgcgaatactgaccgccacggcttctgccaactgcttagatgtcaccaccccttcagcattcagtaactgcaacacaatttgccgctgccgagtactcaattgcaacgtgttcaccccctcgtaaaaccacttgccacaacgatgccagacgcctgccagcacgccattcacaccgtccatttccaacctccaccgtcactttaaagcgctttctaaaaagaaacaatacgcaatcattgcacgattaatcgtgcaatcgcatgtgatcgggcaaacaatggcaaaatggtctgttccaattataacgaagactgtattcatgccgctaactttcacccttataaaaatgcttatgtatagggattaaaatgataagtaaacgctgactatgcctgtattgatatggaacaatcgcccagacaggttcagacacttttcacattattaagaacttaatcatgcaaaaatatgtttctcacaccctcaaatacaactgttatctgattttgaatttataaaccgcatcaagtttttgaatgcttcacataaaataataaatagttaggtggcatatccaagaaacgccataacccacctcatcgtcactaatcacagcggcttacgttcatcaaaaaaacctcctgctgctcaactttcggcaacaagaggcatctctattttgctagtgctttttcactcaaactcccgcagtcttatcaagctggcgtccttcttcattgaacacccgaatcgcatcgttagcagctgcgtttgtcatcagctgtttgaagatatcataactgatcgtcacatttgcggcgccggctttgatcgcggccatgacttgtgaggcgtttttgaaacttgcccccatgatcttaatatgcgtatcggtactttgataaaagctgtgggtctcggcgatcattttatatggatcaatgtcgagctgctccatgcgattcacgtatggcgcgatatagtcgcaatccacaacgcaagccatgaagccttggcgcgttgaatatacggccgttcccagcagacattcatcgggcttttcatccctaattgcagagattgcctgatagcccggttcaaacagcggcactttaaacgccattcgggtatcatccgtgtccggaaaacggcggcgcaattcatgataatcagccaacagttcgtccttggtatcacccaccagctgaacgaataaaacgccgggctttaaggcgcgaatcttagtcagctgttcaaaacgcggctggccttccttaagcaacaacttaggattagtcgtaacgccttcaaactggttaaactgcaacatttccttaatctggctgagattggcagtatcaatgaacatcgcttattcccccttcataaccttaatgacggtgccgacatccaaatccggatagggcttttgctccaagtacagtgatccggccagttccggtgtggtcgcaccgtcaaaaacaatcgcggtgtgacctaaattgcctaagttcgtattgacttcgttgcccaccgccgtaatggcataagtctgatcaccaaacatcatcacatcgccgggtttaatcggctcaagaatttgattcactttgataatgaagcaggatgaccgcaacgcgtcaggcgcctcatctccaaaaagaatcgccatgttaatatccttaaacccgcgcgcttcggaaccaacttcaagaatggtggtttcatatttcactgttgctgctactgacgacaccgcactcacctctctaaaaatcctgctttattttgcatacaaaccaaaacttgctaaccaagcgaccacgactcggggaaccccgtttaagaatcgcgaatacaacactgaaaccacaccgacttcaacggtttttgagtctgcttcttcaagccctaaaccaacaggaatgaagtcagccgcattttgcgtattaatggcaaacagtgccggtaatgcatattgcggctgaatgttgccgcggccgatttcaaccccgatcagcgtcccaatgacttgggcaataaccgctcccggtccgagaatcggggataagaatggcaaggaacagataaaaccaatcgcaatcaagccaaaaacattcccagccagtggcgtcatgagtttggcaaaccaactgcctaaacccgagccttgaatgatcccgattagcaacgcaacaaaggccataaacggaattacggtgttaagcatggtctggacagaatcttttgccgcttggttaaaagttgcaattaccttcccggcaccaattccgatccgggcaataaagttaggctttttcatttgggcagtgatcgttttgttcgtgtcaaacttggcttcgcgagcttcagcagcttgctcgtcggttgctgccgtttgcgcttctgtattcgttgttgccgctgcccctgcttctgccaaggcagcatgctgcttgccggcttcaccgcgctggtcaaatggaacgccatttaacgcctgatccggaacagcatcatccggcaatgcggtaatctgattcacatcaacattggaaacatacaatttaggcacaatatattttgccagcggtccggattttccggtgggcaacacattaatggttaagatgtttttcttcggataaatcccgcagcgcagcgttccgccacagtcaatgatcgccaatgccgtttcgtcttcgggaatggatgttttaaatccatcgacggcttccatcccggtcaattccgcaattttgtccacgatggctggccggttaccccctgtcacgtagataaacttatgcttctgttcggtcggtgtaattgtcaacggcccgccatagccgcctgatcctttaacgacttgaatgctatgccattttttctcagccatgatcctaatctcctcattttaaaatcgcgtcaacttcacgctatgaccgctgctaaacttcttgtccgttacgtgcagacagatcaacggttttgctcagagtaatgccagtttgcttggaaacataagcagttgtgaagtcggtaatccagccaccgataaagttcatgacaatcccgactaacatatagcgaatagccagatccatttgattcagtccgagtttttgcaccccttgcgcaatccccaaccagacaaacagttcacctggattgatatgcgggaagacgccattactcgtatgacaaaactgggcttgggcggcataataactaggcttgtagtattcaggcagaaagcgagccaacgtgaaacacattggattgcccagcatgaacgccgcaagaaaaggtaaaaccagataacgcattaacacattacgacttgctttttgggcaaaccgttcgatgcgttcttccccgataaaggcaataatcgtattcatcagtaccaacaacagcagcacaaccggcacaatgttggtcatccaactaataaacgtcttgccgccagtttgaaacagcttcataaagccagcggcaaagtcagaaatatattgcatgatggcatccccctagatcgtattttttctaaaaacatgcgccaatgcatcaggcaatgctttgatgcgctgaccgatctcattaaaaatcggcagtgcaaacatgctgacgcggctcgtatcaaaatcttcgaaactaagattattcgttttataattcacataattacggtaagcattcagaaaacactcacgctcggtccgactcagcttctgcagggccgtataatcagcgccgacttcagcgactaactcaccatcaaattgagcgacttcgcgaaaccggctaaaaacggtcaaccctttcatcacccgaatttcctgaatccgatcattgtgatccaacccaatcaacatcagactgccttgccgaaagcgccgtggattcttgccgattaagacgcggccttcctggcgaacagcatgataattgcgggcaaaattacgaatttgaaaataacccattaacgcctgcaataaaaaggcggcagctacgaaaatacctagtatcaaaatgttcattcataatccctccgttacaatggttaacggatcgcgactgtctgtaattttctgaagattagccatcgccgtttcattcaccgccagcaaaaacagcaaatcatacaacatggacaaatcttccaacgcctttttgcctaaggtccgcggaatcccgatgacaaaaatatagctaacggacttgccaccaatcgtgatggcatgtgtcaacacgctcagatgcagaaacaagcgattctgatcaatatcggcaattgcatgcggaatcgccgcgccattatcaagcacaaatttggtggtggcttcatgttgaatgagccgctcgataaagcctgtatcgaccaaccctgcctggcaatctgcctgaagcgtcgcgcgcaagacagcttcatacgactgccctggttgattgtcatagatttgcgcccgccagataatacggccagcatcaatttcatgttgcacagccgaggcgcgcaccttcgtctcaagcacccgatcccgaaaaatgtcgccaatcatgaccacgggaactttcaatctgaatgccaatggccggtctgtaaaaaccatgatgagttgatcctgatgggcaagaatatcggtctcatcctgaaaagtccgaatgctgacttgcgattcaaacatggtgttcaattgactttgcaaatattgcaacacgctttgccccatgcttgaaaagaatccaacttgcggctgatccagcggcgcccgatccgcatgttgcagcgccatttcaaagtaaacggtcaaataattaatctcgacatccgcaatgtgaatccctaaaatttcttctagcttatcaatcatcaccatcgccatatcggccgctaactgaaaccgctgaagcatcttatcggttaaataatccgatggcgaaatatgaaaaatgccgcgattgatcagaaaaatcaaatgatacttcgtcgtttgataaaactgatcatagtcaattttggcatcaaccaaggttcgaatgtcagctgcaattcggtcgaaaatgactttatttgcctgtacctttcgggctaacttttctgctgataataatttatttgcgtacaggttaaacggaaacgccaaaaagttatattcttcctgactaaacttgacccgacaccgatcctcaatgtccgcaatgatgttaatgaacaaaggtgaatcttccattaagttcgtgtaatacttgctgatgccgttaagttcatagtgatgacgcttcaggaaaaccacaatttgcatcaccttttggaagatctgggtggtactcgttttgatcttggccgcattgagtcggctaatcaccgccgcgactaaagtcttatcgtcaaaaagccttgcctgtacatagtcgaataagtggttataaatcagcatcgttaaatcgaccgttgagcctacctgcagcttaatgccgcgactcgttgcactttcaatgccaagatcgtaattttttaaccagtgccgacacgcgtctaaatcttttagaagtgtgccgcgactcacggtcagctggtcggcaatctcatccataggtacaaatttccgttctttgatcaaccgaaacagaatctccgcctgccgtttttgcttgtcgttattatcaatgttttgcttgaacacgcctgactgaatcagtgaaaattttcgataattcagaatatgcaggaagtacccgcttttgttaatgcgaatttcggctgcatcccccaacgactcgcctagttcatggatatatttttgcatcgtgcgtgtcgaaacattctcgctttcagccaattcgtctaggctggaggtaccatttgccaaaagataacgcaaaagccgataatccaaactattcaatcaggtgacctcctccaaattaccgattatccgcgcgacttgcctcctgccacatttgttgtaacgcctgtgatataacttgctcgattcgataagaagtagttcaccaaatccgctacttcactgagtttcccactgcgacccaatggcgtagtcgaagtcgaacgataaccggcgcgaatggcttcaacggtggtatcacgcgtgtacgccaaggcttcttcatagcttggtgttcgcaagccggttgcttccataattcccggggcaaccccgaccacgcgaatgttgtatttacccagctctttggcccatgaacgcgtaaacccgttaatcgcgcctttacttgccgaataaacactttgaccaacagagccttccaaaccggcttcagaagacatattgaccacgacaccgtggccttgcttcaccattcgccgcaccactgcctgagaaaccaagaacacgcttttgacattaacactgaaaatctgttcaaacgttggcacgttcagttcatacttgccatgtgggtctttggggtcaaccaaaatccgcggtttattgatacccgcattgttgacaacgccccagatttcaccgtttattttttcggctgtaacagctagattttcaaccgcttccggatccgtgacatcggtatgaacataagtcagcttcggatctttcaagtcgccttccttcagatcgccgttaactacattggcaccgttatgaataagttctttaacaatcgcggccccaattcctgatgaaccacctgttacaacaatcgtcttaccatctaagcctaaccaatctgacatatgctatcgctccttttcatctttcgtttttatggtagcgttttcttcgactaggcttaatccagtgattttccatcaaccctgaaaattcgtgaaccatgtcgtttagtttcaggattataaaaaagcagatggatctttcgtaacttacgaaagatccatctgccgttattttttggtgatagttatggtttaagcaatggagcaacttgaaaccaacaccagccgcgtcgttagtgtaaagtttctctcggagcatgtgggtgtcaaacacgagcacattagtttacacgattcccgtagcagtgcaaagcggcaccttgttcgaatatcaggatagaaagcaagagctggcggagcggtggcgggctcagtggtgaaattggtcttaagcggagtgggcttctccgctttagaccaaggccgagcttcgaaaccgcggtctttgcgggttcgaagtcgtgcccaccacgttccagcccagccaccgcggagccagctcggagcatcggaaatcacttaattagagtagaaccgagaaaaagtcctcaattttcaagtcaagtgcaacgatgataacgaattcttgatagtggtctaggctgttacgccatgcatcggtactaaatgaaatgctgaatgtcaatcaagaaaggaaatatatagaacctttattggtgtcaaagagacattcttccacattttatatagcaggttgtacatgaaaaagcgattgattgtcgttatcctgatgcttttggcactggtggcgacgggctgttcgagtcagtcgacagctaaacgggaattggtttcgggcgatccttattcggatactcagtttctgatggggacggttgttatgattaagatttatgacaaggggaagcagggagcactagatgctgcttttgcccgtgttcagcagttggccgatgaactgacggttaaccagaagggctccgaagtcgatgctgtcaataagaatgcgggggtgaaacccgtacatgtcactccgagtgtttatcgggtgattgaagctgccaagcattatagtgaaaattcgaacggttcgtttgacttggcaattgggccgattacgagtttgtggcatattggttttgccgatgcgcgcaaaccggcgcaaagtgaaattgatgccaagctgccattggttcactatcaagatgttgctctcaataagaaacaacagacggtatatcttaagaaaaagggcatggcaattgatctaggtggtattgctaaaggctttattaccgatgaagtcgtgaaaacgttgaagaaacagcatgtaacgactgctattattgacttaggcggcaatatttttgtcatgggcaaaagtcctaaaagcactaaaaaagactggagtgtcggtattcaggatcctaagaagcctcgtgggacggccatcgggaccttacctgccagcaataaaaccatcgtgacctcgggtatctatgaacgctatcttaaagttgatggtaaggtttatatgcacctgatgaatcccaaaaccggctatccatttgataatgaattaatgggtgtttcgattattaccaaaaagagtgtggatggggatgctttgtcaacagcgacttttgataaggggctatttgatgggatggcctatattgaaaagttgaattatgctgatgctatttttgttaccaaagataaaaaagtttacgtgagctcggggttgaaagataagtttaagttgttgaaggactcggggtatacgctggcgaagttaaagtaagttggttaagggttcacaataaaggcttgaccgacttttaaccgcgctggctcgcgctcacaataacgcgttcaccggcgcagaagtctgcgtgtaaggaccacgaacgcaatggccaagagcgggccatcacgttcgaggccacttacactccgacttctaagcgcgccggttcacgctcacgataacgcgctccccagcgcagggcttgcgtgtaaggaccttggtcgcaatgaccaagcgcgggtcatcacgcccaaggccacttacactccagcccctaaccgcgctggctcgcgctcactacaaaaggggagagtagatgtcgttaccgatatttttagaactggttgaaattcgcaccaaactggcaagtgttttgccatttgcgattggcactttgtttgcagtgacttattttcacgcctttgattggctcaatacgcttttattttttactgcaatgttgattttcgatatgatgacaactgcgcttaataatttgatggattatcaaaaagccaaagatgctcattatcagcaggaagtgaatgtcattggtcgggctcagcttgatccgggaatggttgccaagttgattctggtaatgcttgtggtcgcttcgttgctgggcgttgtgttggtcgtgcggacggattggctgttgctgttaatggggatggcttgttttgccattggtattttgtatacttgggggccattaccgctttctcgtttgccgcttggtgaaattttttccgggatcgtcatgggattaggcattccggttattgcaacctatgtcaatattgccccgggacgcttgcttgccttggattttgggtggccaacagttgttttacgtggtgactttatcgccatcgttgcattaggattagcctgcattaccccgatggcaaccattgccaatattatgctggctaataatatgtctgatattgaagaagatcagcgcaatcatcgccacacgttgccgatgtatctgggcaaatggtggtcgccacgggtatacgcgttgttagcttatgccggcttcttagcggtgatcttgggcgtcatttttggcgcgctaccgatatggacattggtggtggagttagcctggccgttggtgattcgcaatgtgcatcggttcattcgtgatcccagcaaacagcgaacgtttcataccgcggtgatcaacctggttttggaaaacggtttgctggttgtgggtttgggaatgggggtggtgctatgacccagtcttatcatcggctgacgtggccgctatttttagaatttattcggttaccggctaaggctgccagtatgttgccgctggtgttgggaatcagttacgctgcttgggcatttcatcagttttcttggatcaatagtctcatatacgctgcggctcaattggctattgccttatttgtgacaggattcaacaatgttcaggattattttaaggccaaagatcgcagttatcagcagtcgcaaaatattatcggccgcgagcatttgtcaccttggggcatgttggcacttaccatctttattttgctcatcagcgtggttttaggcattattcttgtcatgcgcaccaacctgagcttgttagtgattggcgcggtcggggtcggtgtggccattttatatacattcgggccggttcctctatcacgattgccgctgggagaggtgttggccgggtttgtggaaggttatgggactttcgtgatcgcggtgtttatcaatatgacactaccgggaccgcttgacttaacgcttgaccgccgcacgtttacatttgcacttaatctgggctggctgttacaactgttgatcgctgttttaccggtgatcattttgaatgctgctgtcatgtttgccgataacattgctgatatggcgcaggatatcaaaaatcagcgctttacattgccatattaccttggccgaacccgagctttacgttggtaccggttgatacccttctgtacctttgttgcgttactgctaggtgttttgacccgcagtttgccatggtggagtttactcgttatgttgacttggccggtggtgaagaaaaacacgcggcggtacactaaagcaccaagcaaagacaaaacttttatttttacgattcaatctttaatgatcgttggcggtgctttactgttgaccttgtggcttggtattttcttctgagggtgtgagttcaaaatatcagactcgatcatggtagttggtagcagtgcgatgggtccaccttgttagaatattaagatagaaagcaagagctggcggagcggtggcgggctcagtcgtgcccaccactctagctgcgcggtcgccagccctcgccaccgcggagccagctcggagtaacggaaatcacttaattagagtagaaccgagaaaaagttgacacttaccggcgcgaacctctgcttgctatctgtttgtaatcttggtaagatattggacgtgactggagggaacaagatgtcagtaaagaaagttgctttagcttgttcggtttgtgggcaacggaattattttgttcccgaaaacccaaaacgaacagaacggttaacgttaaaaaagttttgtaaacattgtggccgcgtgacggtccatcaagaaaccaagtaataatggaaggagcgcaatgatgaaatttatcaaaagtgttttcgcggaaatgaaagctgtcacttggccaactgcccagcagacgcggcgtgatacgtttaccgtcatcatgacttccattatttttgcgatctattttgcgggtgtggactgggttatcaatgcagtcttccaagccttcttatattaagacctgacaaactgctttatttttgctatactatgagcaacgcaaaaccgccttcgatgacggttttttattttgactcaaaacactaaaaggagaacattatggctgaaacagttacatcagcagagaaacgttggtatgtcttgcacacttattctggttacgaaaataaggtgaagacaaaccttgaacaacggaccagcagtatgaatatggatgattatattttccgggtagttgttccggaagaagaagaacacgagcaaaagaacggcaaagagaagatcgaaatgaagaagaccttcccgggttatgtgttagtcgaaatggtcatgacggatcaatcatggttcgtagtgcggaacacgcctggcgttaccggtttcgtgggttcccatggtgcaggttcaaagccggcgccattgttgcctgaagaagttgcaagtgtcttgcattcaatgggcatgagcacacggcatcaggatgttgagtttgatgtgggcgaacccgttacgattattgatggggcctttaccgggatgcatggtaaagtaaccgctgtcgataaagacaagatgaagctcaaagtcgtgaccgaaatgtttgaccgcgaagtcactgctgaactggattttgatcaagtcgacaaactgtaggcaaggctcatgagcagctggttttggctcgtgattgcagttggcactgttgtgattgcgggcggtttagcagactttatattactgggtcgtcccggatatgcgccggtgccattagtcatggatgcaacgccgactttgttcatccccggccatttaggtacgcggtattcattcggccatatgttgtggcgtatgcagcgtcgttatggcttgagtaaagatgttgtcgcgattgttgcccctgatggcagggtgcgtttgcgtggtcggttgaacttgaatcatcatgctgcggtgcaagtgctattcaccgataaaaccgtgcgcccagctgcgcaattacggggactaaatcacgtgattacggctttacaggcgcaacaagctttcagtcagcttaatctgattggacactcaatgggcggcgtgacggcagtgttgtatttattaagcaaaccagctgtgccagtcgccaacctagtcactattgctgcgcctatgaatgacttagaagttgctcagcgctcaccgattctaaactggtcgttgacgcgtcagggaccggaacacacagccccaatttatcagcaatttcagcgcaccattgacaatcttccttctgatttgcgatggctgaacattgccggagacttgatgcttggaggtcgccatgacggcgaggttgcgattaacagcagttttgcggtgcgttatctggtgaaggatcggatcaaggactatacggaggtcgtcattcgcggaccgcgggcagcccacagtttgctccatgagaatcgcctcgttgatcatgatattgttgaatatttatggcagcagcaacgcgatttttagctattgtcagaagatatcggttgcgcgataagcaacggcacattatttttggcattgcttaggaaccttgaccatgatggccaaggttccttatgttttacccgcaagttgctgtcaccggaaataaggcattggcgacaataaagttgccgcaatgcttgctaggaggaaaatatggcccaagtctatcttgccgctcctttttttgatcccgcgcagacaaagcggttgaatcaggtattagcggctttaaatgaaaatgagtccgttagcggtattttttcaccacgcgatgatactaacaaagcaggtttgacggaaaattcaccagcttggcagcgacaggtttttggtgaagatattcgcggcttgcaccaagcaacggtgatggtcgcgattttggattatattggcgaagaccctgatccgggaaccgcctttgagatcggctatgcgtatgcgcaccacatgccaattgtggcgctacaactgacggacatgaaaatgaacctgatgctcgccggctccattacctgttttgtaacagatattgccgagctgaaaacactggatttagatcatgtgctcgttcgtccttatgtgggaccggtgttttagtgagcgtgaacagggccgcttagaaaccggagtgtaagtggccttgtcgggctttgaccattgcgaccaagatccttacacgcaggtttctgcatcggagcgcgttatgatgataactgaaaacttgctagcgtgatgtaacgctggcttttttaatgtcatcctgaattttttaaaagcccgccattatctgtttgaccggtcatcgtcagcattaacgaattgttattgattaatctatatcttgatattgaattcgtttggctataccatatcttgtatacgggagggacggatatgcaagttatgatgaaaccgatcaccttggcgcctgaattcattgccgaggttaagaaagaaattaagccgcactggggggagcttggctgggtaacctacaagcggacctatgcgcggtggctgccgaatgaagagcgaaccgagaattgggatgaaaccgtcaagcgcgttgttgaaggcaatattaaccttgatccgcgtttacatactgcggatccggatcctaaagtagtaacggccttgcaaaaagaggcgcgcaatcttttcaaacttatttatgggttggcaggcacgccatctggccgtaacctttggatttccggaacggattatcaaaagcgtaatggcgatgcattgaataattgctggtttattgcgattcgtccccaaccatatggcgattcacatattgtgccaaccgatttttctgctgatcagcctgctgtttcgatgccatattctttcatgtttgatgaattgatgaaaggcggcggtgttggtttttccgtcaccaaagacaatatcgccaagttgccaccagtagccagtgcggttgatttgacgattgtcattgatcggcgcagcgccagttatgaagcttcacttaagatgggcgcggttgatcgacaagcatgggaacaagcccatgcaaccgaacgcaacgatcggtatgttttgccggatacgcgcgaaggctgggttttggccaatgccaaggtgattgatcaccattttgccgcaactaatcctagtggccaaacgaaattggtattagacattaccaatattcgaccaaaaggcgcgcgcattcatggttttggcggtacggcttcagggcccatgccgttagttgaaatgttgcaggatatcaataacgtgcttaatgcgcgagttggcaagcatttgacagcggttgatgcaaccgatattggcaatctgattggtaaaaccgttgtcgcaggtaatgttcgccgctctgccgaaatgtcgttaggatctgctgatgatgatgcgtttatcaccatgaagcaggatcaaaagcaactgtatcatcatcgttgggcatcgaataacagtgttgcgattgatacccagtttgaagcctacgcaccgattgcgacggcgattgccaaaaatggcgaaccaggtattgtcaatctcgacttgtcccggcactatggacgcattgtcgatggcgaaaatgccgccaatgatccggatgtcgaagggacaaatccttgcggcgaaatttctttggccaacggtgagccctgcaatttatttgaagtattcccggttgtggccgtgcagcaaggttggaagctaaaacaagccttcacgttggcggcgcgttatgctaaacgggtcacctttagcaactacgactggcaggtttcacgcgatattatcaagaagaaccggcgaatcggcatttcgatgtccggtattcaagactggttcctggatgatttcggtcatcgggttgtttccggatttgaaccggttgttgatccgcatacgggaaaaatggtcgagaaaccgatttacgatcctgagattaaacaagcggttgatggactttatcgtacggtggtcaacgcagataaagcttattctgaagccttgggatgcgaaccgtcgcgcaagcacacaaccgttaaaccatccggaactgtggctaaattggcgggtgtttccgaaggcatgcatttccattatgccggttatttgattcaacggattcggttccaggccaatgatccgctattgccggcactgaaggcatgtggctatcacattgaaccggatgtttacactaaaaatacgatggtcgttgaatttccgattcgtgcagcgcatgcggatgatccggcatttgcttcggcaggcacggtttcgattgccgaacaaattgccacccaagcgttcttgcaaacatactggtctgataatgcggtgagttgcaccgtgaccttccagcctgaagaagctgaccagattgctgacttattatcacaatatcggcatgtcatcaagtccacgtcaatgctgccatacgttggcgcaggctttaaacaagcaccaaaagaaccaattgacgtccagacttacaagcagaaatgccaacagattcacggttcggttgcagcggtttttgcggctcaaaatgccgatcatgatcaaaaagatctcggattagtggatcaaaccgattgtgctggcggtgcttgcccgattaaataaacgatatggaggatgtaggttcatgttaaagaaagttttacggtcactggttgtcttcttcactgcgatgttggttcttaccgggtgcagcagcagtgctagcagtacggccaaaagcagcagcaaacccaatcagattgtggtcacgtatcaactgaaggaaaacggtaaggcatttgcgaataagaaaatcacgcaacctaaaaaatctgttgttatgaccggtttgaagaagggctggaaagtcaaggcttccaagggcttcatcactgagatcgctggcaagaagcaaaatgttgccaagaaaacatactggctgtacaccatcaatggcaagatggctaaaaaaggtgcctcgcagcaaccggttaagaaccatgataaagttgtgtttgacttgagtgtgactaaatgaagctgccagtagcagccaaaaagccatcgcctgtccgggcggtggctttgcttggtttattaaccgccttgtgtacggttttgcgcattattaaagtaccgattcctaatgttcagcccgtcacggatattttgatggtgacaacgctgctactgggatttcggtggggcattgctttgaccatgagtaccttggtggtttcaaatctgattttaggatttggcttgtggacgttgccgcagattgttgcttatgcgatgtgcctagtcgtggttcaagttagcgtaacgttgataccgctgattcggctcacactttggattcagattgggatagccggtctgcttggctacttatacgggttcatcgttagtttaggaatggccgtcattggcagtttgaatggtcttggcttttgggcttattatttaagtggtttattgtttgatacttatcacgtcattggaaatctcgtgttttatccgattgtggtgctggttttgcaacagggattgaaacgcttttctcatcagggttgaagacaggaggcagtcatgaagctatacacaaaagtcggggatcacggtgcgaccaaacagattaacggtaagaaggtgccaaaatacgatccgcagattgtggcactaggcgatcttgatgaactcgattcgtggctcggctatgttgctgctcaagcgcaggcaacgccaggatttgcctggcttacagaagcgttgcaagcacggcagcgggaattatatgagctgctggcggatattgcggttccgcggcaccaaacgatcacagaagcacatgtgaaggcactagaagatgcgattgatcaaatgatggccgccgttccccatatcacagcgtttgttttgccaggcggacatccgctagcagccgcgttacaatacggcagagcagtggcccggcgcgcagaacggtcattggatcaattagctgctaaagatgacactttgagcgccgtcacattgcaatatagcaaccggctatctgactatctttttgcgttggcacgctacgtcaacttcaaagcaggcgttgctgaggtgaaaagtaagtaaacaaggttagtgtgatcgttagtttgaaagacccgcaagtaaaaagccttgatccgaaaaattggaccaaggctttttgcatactgtgatagtggaacgcatttttaactaaaagctattctgtcgcttacgaaggctggcttgcggctggcgatcttattccgctacaggcaacattttcaaaagatggtgttgttcaaaccaatagccgatccgtagaagttgatcttcacgacccttggcggcggtaaattggatccctagtggcaggccttcatctgaaatagcggtcggcaagctgatggctggggcgccggttaagttcgcttgttgcgtgaatggtgaataggtgagactgggttcgaataaatcccagatcagcgtttgttgttcgcttgggtcaagctcggctgcgtggtgcatttttttaatgatcgctggtgattgtaacgcggcatcaatgcgcggggcggttttggcggtggtcggggttaacagcaagtcgtaactttcgtgaaaccgactgtaagcttcagcggctcgatcccagatggctaacgaccggctgtaatcagcggcggtggtgtgcaaccctgcttgatagatggcccaagtgattaactcaatatcgttaggcgtaaccgtccgaccggtttgatcggtgtaggcttggaacatggcagccgtttcgccaccattcatcagataataagcctgcatgagtgccacaccgtccacatccggagcagcttcggtcacggtatgccctgcagcgcgcaacgcatcgacagctttttcgacggcagttatggcggtgctgctgaccggtgtgcccacgggagattgcgttgtgtaagcaattcttaacggtcgcgtgtcgttgacttgatcaagccgcagtggtggggcgataaacggtgcggctaattgagtagtggctaaaccgcgtaagagcgcttcggtatctgccattgtccgggtcaaggcaaaattaatggaggcaccttgccagccgcgccattcaccgggaccggtgggaacacgaccacgcgttggttttaacccgatcaatccagaaaatgaagcggggatgcggatagagccgccaccgtcagaaccggctgcgagcgggctaattcctgcggcaaccaacgctgcagcaccaccggaagagccacccggtgagtaggccagattccaaggattacgcgccggtccgtaaagtgcagcatcggtaatgtttttaaatccgaattccggcacattactttgaccgacaatgatgaaacccagtctttgcaaggcctgaacaaagttattcgtacgggttgccttggcatctttaaaaagacggctgccgcctgtttccggagcgccggcgaggctttgaccgagtcccttcaaaaacaaaggaaccccgaaaaaaggctgaccagtatccgtgagtgccgcggcttcatgctttgccgcatcaaacctcgtccacgttaccgcattcagttgcggattgcgcgtggttaatttttttgcagtcatgtcaatcaagtcaccactcgtcacggcacctgcacgaacagccgcggcttgagctaatgctgaagaaatcatgtttagcctccaaaaagatagtgagcgcgagccggcgcggttagaagtcggagtgtaagcggccttgggcgtgatggccgggctttggccattgcgaccaaggtccttacacgcagacttctgcgctggtgagcgcgttatagaaagtgagcgtgaaccagcccggttagaaaccggagtgtaagcggcctcgggcgtgatggccgggctttggccattgcgaccaaggtccttacacgcaggtttctgggctggtgagcgcgttatggtcgaagcgcgagccggcgcggttagacctcatgccaacaagcgccttttgtttccctgacagcagttatttttagttacctttgacaaccatcttaccgtcaagttaagctttgagtaaagttaattgttttagcccgttatattttttcggctaaggcatgaaaacgagggagtgatgaaacaatggcagtttatggataatagcgacgcggcacccacgcagacatgagtgcaatcattaagtggaaggtgctcatgtggtcaaaacaaactcaatggcgaaatgtattgatgagctgttaataagcaacataggctctgaaaccttgccaagtatgatgaaaccagtaagtgtctcgcggatgcttgctagagacgacatgcatacgtcaaatttatgaggaggaacgatataaagctttaattcgtgtcatagcggcatgcttccacagtttatataacaaataatgatgttcaataaaaccatatcgaggcgcgatgcttcgactcaggagaaaactgctgcactgacacggtacagccagcaagaaccacaagccatttttgcagctttgaagacgcaagaagcgggtttgtcttcacaagaggcagcagaacggcttgaacaggacggccccaacacggttgttacccaacatccgcgcccgtggtatttaattttattcgctgcattcaacgaaccctttgtctgggtattgctattgttgtgtgcagtctcaaccatgactgcggattatgacggcgccagaatgatgggcttgatgattatcttatcggtgtccattcatttttggcaggaatatcgttctcaaaaggaaagtcatgcattggcggccttgattgccaataccacggcgatcacgcgtgccggtgaaaccaaagagcaccccatggatgaagtggtgcctggtgacattgttcagctggcgaccggtgatatgatcccggctgatgcctatttagttgcgactcatgatttatttgtcaatcagtcgtcgtttactggtgaagcgatgccggtagagaagaaagcaggcgcggcgaatttaagcgataaacaaagcttgtttgatgctcctaatctcgtttttatgggaactgatgtaatttccggatcggggacggccgttattctaaaaacgggagacgcgacttattttggcgacatggcgagtcaaattagcgataagccggcgccgaccagttttgagcaagggatgcgcgccattagccgggttttaattagcatgatgttggtgctggtgccggtggtctttgtcattaacggtattaccaagcacgattggtcccaggcattcttttttgccatcgcggtggcggtcggactgacaccggaaatgctgccgatgattgtcaacagtaacctggcaaaaggggcgttggcgatgtcgaagcggaaagtcattgtgaaacgactgcacgccattcaaaatcttggcgcaattgatacgcttttcacggataaaaccgggaccatcactgaggaccgggtcgttgtgatgcgctatgttgatgctacgggcgaaaccgatccggcagtgttgcggatggcatatatgaatgctaattatcaaaccgggtggcacaacttgatggatactgcagtggtggattatgcccgtgagcatcagcatcttttaaccgatttaccaagcgggctgaccaaaattgatgagattccgtttgattttgaacgccgccgactgacggttgtcgttgctaacgacgcgcatcagtggatgatcacaaaaggcgccttcgaagaaatgctggcggtttgtgaccgagtgcaactcaatggtgatgtactgccgctgacacctgagcggatccgaaaacttgagcaaactaacgcggccatgagtggtcaaggtatgcgcatgattgtcgtggcatatcgtcaagacgtccatcaacaggaaatttatacgccagcggatgaacagcatatggttttggctggttttctgggtttccttgatccggccaaacccgatgcaaaagaagcaattgggttgttaggcgcgcatggtgtccgggttaaggttctgaccggcgataacgccattattacgcagcatgttgctgaggaagtaggaattgccaatcagcttgttgcaaccggcaatgacgttgatgccatggatgatagcgcgttgcgacaggcagttgagaccacggatttgtttgtgaaactaagtccgatgcaaaaagccagaatcattaaaaccatgcgtgcggccggtcacacagtcggatacatgggtgatggcatcaatgatactgctgcgttgcgtgaagcggatgtcagcatcagcgtggatacagctgccgatattaccaaagatgcaagcggcattattttgttggaaaaaagcttattggtgttggaagatgggattctagaaggtcgtcgcgtttatgccaacgctatgaaatacattaaaatgaccattgcatctaatttcggtaatgctttttcggtgttagtggcgagtatctttttacctttcctaccgatgctggccattcaattactggttcaaaatctgatttatgatacctcgcaaatgacgattccatgggacaatgtggatgaagcaaccttagcgcaaccgacaccgtggcgagccaagggattattgcgctacacattgacttttggaccgctaagttcgatttttgatatcacgactttcctatttttatggttcgggcttggcgttgggacgcatgctgccagtgtgccggctcagcacctatttcaggcggggtggtttgtggttggtctatttacccaatcactggtggttcatgtcttacgcacccgccaaacgccattttggcggtcaccagcctcagctattgtcatcttgtcaaccatgatggctttgttagttggccttttcataattctatcgccattccatcaggcatttgatttcggtattttaccagtcacttactggcctggagctgctgtcattattcttatctatttgatattggttgaaactgttaaaagaatttacctaaagcgcggacgaccgtggttatgaagttttttgggaacagataaaacgcagggatgtgccggttcttcttgccttttatcgtctaacatggtaatctattcgagtatgttttcagcatacgcgtgggaggccaaaaattctggccatcataaccacatcacggacttaaggaggtatgtctcgtggctaaaaaagtagcaaacattgtcaaactccaaattcctgctgggaaagcaaccccagctcctccggttggccctgcacttgggcaagccggtatcaacattatggggttcaccaaggatttcaatgcacggacagctgatcaggctggcatgattatccctgttgtcatcacggtttatgaagatcgttcgtttgatttcgtaaccaagaccccgccggctgctattctactgaagaaagctgctggtgttgaacatggttccggcgaaccgaacacgaagaaggttgctaaggtaaccaaagctcaggttaaggaaatcgccgaaacaaagatgcaagaccttaacgctgccgatgttgaagcggcaatgcgcatggttgaaggaacagctcgctccatgggcttcgaagtcgaagactaggccgcactgttcggattctcagtgaaaactgaggcaatcaggtggaagggagtaaaatgctcccagtgaccacatttgcaaggaggaaaacccagaatggctaaaaaaggtaaaaagtatttagaggctgctaaggccgttgatgcgaccaagcagtatacccctgaagaagcagttaatctgcttaagaaaatcgactttgcaaagttcgacgaaaccgttgaagttgcatatcgattgaatgttgatccaaagcaggctgaccagcagatccgtggcgctgttgtgctaccaaacggaactggtaaaacgtcgaaggttattgtttttgcccaaggcgatcaggctaaggctgctgaagatgcaggtgctgatattgttggcgccgaagatcttgtgcaaaagatccaggacggctggttggactttgatgttgccgttgcaacaccaccaatgatggcccaagttggacgtttaggccggattcttggaccgaaaggcttgatgccaaacccgaagaccggtaccgttacgatggacacggccaaggctgttaatgacatcaaggctggtcaagttgcttatcgtgttgacaaggctggtatcatccatgccccaatcggtaagaagagcttcgatgctgacaagctgcttgaaaacttcaaagcaatgaatgatattgtgctgaaggctcgtccagcaagcaccaaaggtatttacatcaagagtttgacgttgacctcaacgatggcacctggcatcaaggttaacccaacagacttctaaaacattcattgaatattttaagactcgctatgattagcgggtctttttcttttgcggtaaattaagtctgaaccgtcaagttacgaaaagaggtcttactatggaatcattcacgatccggtcgcttcaacccaatgatgaggatgcatttaatgagtttcggcgcgatgttttaaatttcgatcagcaaaatcctcacagtcaaaatattgttcgcgaattgacgcctgcaaccgactttacgacaaggttggcagtactaaccgccgatcagaatcccgaaaaacccgagttagtgccgcagtttgcttttttcatgtttaactcggaaaacgtcatcttggggcgggttcgctgccggactgaaatgacaccgatgctagccagaaccggcgggcacatcggctattatgtggctccgtctcagcgcggccacggttatgcgaaaaacttgctcaaatttgcgttaggttattatcagcaacgccaggaaccttatgtcattgtgacagcaaaagcggctaattgggcaagccgcaagacgattgaggccagtggcggcgttttacaggaaatcttgcccgaacaaaacactgaatcgcttgccatttaccatattcagttagctgctgcaacgggtatttgagcccgacgacttgttgatagcggattattcggtgcttgttgatacgataatttgccaggcaatctgtcgtcgagggttcatccgctgtcttggaatttatccggttggcatctaccctctgaataagctatgattaagtaaggacacgaagggagcgtttacaaaaatggcttatcaaaccgttgatccgaacacgaacacgttggagaaaacttatgcgaacacaacaccggcacaaattagtgagatgttgacggcggggcatgctttttacaagcagcagcgtaatcttgaccctgcaacgcgtagtgcaacattacatgcggttgctgcttatttccgcgacaatgccgatgaaatggcggcaattattaccaaagaaatgggcaagcggaccgaagaagcgttaggcgaagttgaactttgcgctgaaattgcggatatgtacgctgatcgggctccggcattgctgcagccgcaaccgcttaacagtactgcaggggctgcggtggtcaatcacgttgccagtggtattgtgtttggcgttgaaccgtggaacttcccttactaccagttaatgcgtgttttcgcaccaaactttatggtggggaatgcggtgatcattaaacctgccagcaatgttccggctagcggccttgaatttgaaaaagcagttctggctggcggcgctgacaaaggtgctttccaaatcgcacttatcgggcatgatgataccgagacctttattaaagatccgcgcgttgccggtgtctgcttgacgggttcagaaggtgcgggttcgcatgtggcggcgttggcaggtaagtatttgaagaagtcgctgatggaattaggcggtatggatgcttttctggtcttggacggggctgatcttgagcacgtgattccagaagccattaaaactcgcctcatgaattgcggacaggtttgcaccagctccaaacggtttattgtgttagataaatactacgatgactttgttgccggcttgaagaaaggttttgaaaacgtcaaaattggcgatccgagtgatccatcagtcaatgtgggtccattgaacagtcaaaaggcaaaagataagctgcaaggtcaggttgatactgccattgaacacggagccaaagttgtttacggcaatacaccggttgatttgcctggtgccttcttccggccgactattttaacggatattgacaaggacaatccggcgtatcggacagaattattcggcccggtcgcctgcgtttataaggtgcatagcgaagaagaagcgattgcgttggccaatgatgttccttatggccttggcggagcagtctttgccggtgataccaatcatgcggcagaagtcgctgcccagattgaaaccgggatggtcggtgccaatcagagtcaaagctacaatgctgagttgccatttggcggggtcaagaactccggctatggtcgtgaactgggagatttaggcctgtatacgtttgtcaatgagcaaacggtgacccgggcgctgcgtcagtgatctagcccacacgagtttcaagtgaaaaaccgcctttgtatcataacgaaactttgaaaagactttgttgcgcatttgccgtgataaagtcttttttaatggccagaagcatgagtcaataactggaatttggtgcgaaaaaatttgtagaccaaggaacagcttatggtggcatgcttttttggtgatgatctggtttttgaaaaataattttcgaaaaaaatttttaacctgtggatggctgatatggcgctgattataacgggggatggtgcaatatgctcgagaaaaattcaaaagtggaatcgatttcattgtatttatatattaacaaattttttaatgctagtattgtataagtagtcagaaattagtgtagggtatgagttaaattctagccagtgacggttctgagtggccgacgtgttagcgcctatattggatagataatgcttccgggagacaaggttaattaatagtcagagttcgtttcataactaacacaatttttctcgataagtttatttttgagtctaggagtgattgctagtgaactatttcatcaatttcggtatgcctgccagcaaatcgggtattgagcatgcgcagataaagcgcaagcgcctatttgataagcatggtgaaccttacgtatttcttctacgggattgggaacgggatctacatactaacactgccaatgcaggaattacggatgatcacctcgttaacatgtttgattactatcagcacgcctgccatgttgacgtggtccggttgttaccggagcaggtagatctgggacttaaagatcttcaatattccgatgattacgagcacaatcgtatgttggtttcacgagctgatgggcgattggctgcgcggatcaactatgttcgcggcactagacaggtggtttctgtcgaattgtttgacggagttgagaatctataccaagttgaattttatgatgttcgcggatttaaatcattggttcagtggtataccccagacaataaggttggcaacgaggaatggctaacggtggatggccgtccggtaatcagagcatttaacaagaaaaatgaagatggcaagcttaagcagactgggtggattctgacagatcgcaaaggtaaaatttttcagtttgacacgattgatgcgttttttgaacattttattaatgacatgaatgaaactggccagaatgtctttatccttgatcggtctttattggcggatgaagcgcttattcatctagagaaacccgcttacacgattatgcacctacataattcacatgctggcgatgcgcaacggccaatggattcgattatgaataacaattatgaatttgcattagttaatggtgcgaagtattcagcatttgtttctgcaactaaaaagcaggcagccgatgttcaaagacgcttcccttacatcaaaaagtccttccatgttcctgttggcgtggtatcggatgacgtgcttcaccgccagcgaattctgtcggaaaatcgaatattcggcaaagtcatcgcggttgctaggattgcaccggaaaaaaatctgaatgatctggttcgagccattgccatcgtccacaaacaaataccgcaagtgacgctggatttgtatggttacccggatgcaacgaatcattatgctgaaaaacgaaaaatcgaaaaaacaatccaagaactttcattggaaggggttgtggcttttaaaggctacacggaaaatctggaaagtgcgtatgatactgcccagatttttggcttaacttctatcatggaaggttttgatctctcattactggaggcgatttcgcatggtgttgtcggcgtgacctatgacgttaactacggtccaaacgaaatcgtgcaagacggcatcaatgggtatgtcactccgtatggcgatattcatgccttagcggagaagattcagttattgctatccgatcgtgacaagatgcagcagatgagtacgaatgcatacgaatctgctaacagatattctgaagaaaatgtttggaagaaatggcacaacgttttaatggatgcacaaaagagtgaggggaaggtgacgaaatgatttacatggttggtgaaaatgtttttacatttaattccggcactgagttctcgcagctgcaacgcctgaaagccttcaatcaaaatggcattgaatctaaactgctactccggaactataatcgcttcttgtatcgggatgacgagcgtgcaggagttaacaaagatgcatatatcaacatgtacgattactttcagggtgttgtcggggttgagcgtaaagaacaaaagttacgcttactggaatcgattcccctgacgaaatatcatgtcgttgggattgacaataatacgacaactatcgatctgttaggtcgaacgcttgcaaagattactgtcatgccagagacggtcggattagttggaagtattgattattatgatcgctttgatcacaaagagttaaccgaattctgggattggcgcgggtttaagtctatggaacaaaattataatcccgatggaaccgtggctgcacagaagtttttggatcagaaaggccatgtggttttggagattatccacatgaataaaaatggtcagcttgcaccgacaatgtggaagttggttcattatcaaggacatgattatgtatttgattccgaagatgaccttttccgttttttcctgaatgaaattagtaaaggcaatccggggatcatgatttcagatcgcagaacgctcgatgctgccgtcaagcaagttaatcatgcaactgctaagctcgcttttattcatgaaggtgacctgttcttgaaaggagaagggaagaagcgcgtacctaatgtcatttataacgaggtactaagcgagcagcatccgtttagtaccgttatttttcctacgcatgatcaagttaaagcgattgagactcaatatccgtacttaaccattgaggctgccccggatacttatgcacagacgccgaaagctaagaaaatacaacccgatcatccacgattggcgtatatcgggcgtctttttccagataaacagattacggatttggttgatgcgtttgaacgtgtacaccgagaacgcccggatgctgaactgttcctcaaaggttatttttcagacgaggcctatcgccgggagatccgcgatagaatccacaagaaaaaacttgatgatgcgattcatctggttgcctatagcaatgacaatcaggatattttgaacaagacgacgctgtttgtttctgcggcgaagtcagaagctttcggtatgaatagtcttgaggcaatgtcgtatggcataccagtgattgcatacggatgtcacttcttgaagcataacctgttagtgaacagacaaaacggggtggcggttgctaatatgacgcctagcgagttaggcaaggcgattttggtcgtgttacaagataatcggctttatcacaaattacaagctggtgctttaaatactgcaaaacaacattcagaagctgatttcatcggtgcatggaagtcagtattatcagcgttcttttgagatgactcccggttcgcttttgcttgcaagtactcaggaaaggggatgatcgcaccacgagaaactatttaaacagttctaagccggatttttaaatacaagtaaaaaatcaagtgggttgctcattatttattgagaggatcttgggtatgaaaaagataaatagagcaaatgttttggtggagaaaaagcgtttcaagatgtttaaggcaaagaagaaatggttaattgctccattattcttcatcggcatcggtttgggaaccgcctatcagacgaatttggttaaagctgatgctcaagcgcccaacagttcagagtttatcgaagcgccttcatcgggagccagtagtggtcaaaatggaacaaatagcctaaaatcagcaagtgcaagtgtagctacagccagcagcagtgcgagcgatggtcaagccaaagcgagcacggcaaatgtggcaacgaccactaatagtaaaattggcggcagtcaaagtagtgccaacgcggccagtgcgtctcaaagtagtgctagcgttgaaagtagtggccagatcaaaagcactagttcagccagtgctggcagtaacggcgaaaaagcgaccagcgctctaagcagtagtgcagttaatgccagcgatggtcgtgcgagtcagggtgttggcggcacgtcaagtggtagttcagatactacgagtcaggcaaatgaaggcaacagcgccgccagtgtaacaagtgcaagcgccaatagtgcctctgcaacaaatacatctgaaggtcaaactccagttaatgaagcggtatcaaacgatgcttctagcgccgatgtcagcaccgcgtcagagtttgatgcagccatggccgattcaacggtaagtgtcatcaacgtacagtccgactttgttatggatgttagtggtgatcgccaatcgtatgcttatcggccaaacttagttattaatggcaataaccacacaattgattttcaaaagaagtatttcgaagctgatcctacaagtagtcagaatgaatcgtttaccatcaacgatttaaatatgtacggttacagttggtggggcccggttactatcaagggtagtaagccgaaagacggcatcgatcattcggtagtgttcaataatgtcacatacacaggtgcacaactgatgtatggcatttatacaaaagcctttattaaggggaatacaaagattcagtcagtgggcagttatgtttccccgctggacggatcaacccagacaacccaaggcttaggcaaccagcaaaactttcaaattagttatttagaggttttgcctggcgctacttacacggggacaactactggtgggactaacgttgaagtatatgatggcggttcatttattgttgacaagggagcaaccgttaacttacaacgcacggatgcaagcaaatcgaatgaacgtggtacgaatgcattgattgatacacagggaggtaatgttgagtttaaggatggatcaaccgttatccttaataaaaatgcacttgtgaaagatggctttgcaccaatctatattgaagacggtggtaatctaaccgttgataagaatgcaacggtatccattaccggtgcaactggaaacattccggtaagaattgacggtaccggaactgtcaacctcaacgaaggatcgcacatgacgatcactcaaaatggtgcgcctaaacttggctatggctttatcaatattaaaggtaccggaggcttcttcgttgcaagtggcagcactttggatcttaatgtaacgggtacagggacaaagagtgtcaatgcaattaatgtagcaaatgacggtcaactgagttttgcacaggatgctacggccaacttaaccattgacggtggcacgggcgaagcgcatttgttgaaagtcggtgacgatgccaacattaacatctatatgccgaaatccgttctttttaagattaccgataacgatgacgcagacagcagtttatttaaagtcagtggtaccggtacgctaacaggtcaatatgtgaaaatcattccggatgacgggaatgcctatggtccatataagtccgctatctatacactaaaagggaatggctcttcttcagataccgctacggttgaaggtgagacagcagaagatgaacaatccgggaaagcacttgccgacacgtttgcgactgataaaagcctggagttcgtcagtgccagtgataattttattaaggtaaatccagttactgatgaaaccacaacgcttacaggtaaaaccactgccggagcctatgtaacgatttcaggtttaaaggggattccagaaggcagcttaactgcgaattcctatgatagtacaaaatatttggtacaggcggacaagggcggtaattggagttacgaactgccgactggggtttcgttacctgccaatgcttcatttgaagttatttcgagtgctggattcattgtgaaaacagcgacggtagtgatcaacgatgccgaaacgccaaagcaggcatccagtgcagctggcagcttaatcaacgccaatagtgctgctgatgtcacagcttcacaggcaaaggctacaagtgctgctgctagtgatgcggcgagttatgcaagtgaagcgcaatcgattgctggcagtcatgctgataatatggaagtcaagtctcttgccagtgatgctgagaagcaatcgcaaattgctttggcagctagcaagtctgctgcggctagttccagtgcggcagcgtccgcagcaatcgtggcaagtagcgcggctagtgaagcgtcatctgcagctgctgccgtaagtaacgctgatgcatcagcaaactctgcagccgctgcttatgattcctacgcttctgaggccagtgccgcttctgctgctaatgatagttcgggatatgccactgcatcatctgcagcaagttccgctgcggctgccatgagcgcagcgttatcgacagcgcaagttgctgccaaggttgcagtgagtgatgcagcagcagcgggtagtgcagctgctgttgctagtgcagctcaaagcgactccaagaataaccaagcgactgcagctacagcaagaagtcaagcacttgatgatttgaataagatcaagtctctaactgattacgcaagtggcgcaagttccagtgccagcgaagcgggtcaagcatcaaccgcaacatctgcgtatgctagtgctgcaagttcgcattgagccgttagctcagttggtagagcaactgacttttaatcagtgggtcgacagttcgagcctgtcacggctcagagaattattggttttaattgacggctcaagtcgatatttttgccgacttagctcagttggtagagcatctgtcttgtaaacagggggtcgaaggttcgaatcctttagtcggcatggcaccaataatttgataagcattttgtttcatgcggaagtagttcagtggtagaacatcaccttgccatggtgggggtcgcgggttcgaatcccgtcttccgctttccaagcacagtgccgagggtgtgcttggtcgaaaagttcctcggcattatcatgatttgcacccatagcgcaactggatagagtgtctgactacgaatcagaaggttgtaggttcgactcctactgggtgcatttaacgggaaatagctcagcttggtagagcacctggtttgggaccagggggtcgcaggttcgaatcctgttttcccgattggacgcttagtccatatgtttttctcgcggtgtagctcagctggctagagcgtccggttcatacccgggaggtcgagggttcgatcccccccgccgcgattgagcttggacctttagctcagttggttagagcaggcggctcataaccgcccggtcgtaggttcgagccctacaaggtccatctttacaggcgggccactgttcggtataatcagtttgttactgttatcgcgggatggagcagttcggtagctcgtcgggctcataacccgaaggtcgcaggttcaaatcctgctcccgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccatattcataatcatccttatgcgggtgtagtttagtggtaaaaccacagccttccaagctgttgtcgcgagttcgattctcgtcacccgctgcggttatgatattgggcctatagctcagttggttagagcgcacgcttgataagcgtgaggtcggtggttcaagtccacctaggcccattgcaccacttaattttatatacacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatggttaaatggagaattacccaagtctggctgaagggaacggtcttgaaaaccgtcaggtggatgtcaatccacgcgagggttcgaatccctcattctcctttataattatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtccctctcgatttgagaggaacaaattctataaaaagattcaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccattcatagggatatagtttaatggtagaactacggtctccaaaaccgtcagtgtgggttcaactcctactatccctgctttataatggcggtattggtgaagcggttaacacaccggtttgtggcaccggcatacgtgggttcgatccccacataccgcccttttattggggtatagccaagcggtaaggcaacggactttgactccgtcatgcgctggttcgaatccagctaccccaatttctccaactgccataggagaaatgcactcaacttgatgaatatggcggtgtagccaagcggtaaggcatgggtctgcaaaaccttgatcgtcggttcgattccgatcaccgccttatcttgcggctaaaccccagcaagacagagtgttagctatcattattatgccggtgtggcggaattggcagacgcgcgggattcaaaatcccgttccagcgatggagtatcggttcgaccccgatcaccggtagcacggccccctagaggggcttttttagtgctcagaaatggctttaaattgggattcttgttttttctgggcgcttaaaaatccctgaaaaaagatgcttttaccgaccacttttgctttttgggggtattttgctaaaagtggtcggttagctcgtaattccaaatgacgctactcctcgtgtgtcaaggtattgagagccttttgttggtcggcaaagtggtcgctggctatcacaaaactttaacggttttcgccgcttgtcttggagccaacttgtctatcagaggtttgtggatttttaaagtgatttcgatgttctcatgtctcgagcgccgaaacatgaattaaatagccatacccttaacaggcaaatactactgcgagtgtggcgaagggtatggaacttaggccaagcatgtctaaacgcatacttgcacgacggatttcgcagttacggcatcaccgttaactgcttcctcgtataaacaactggcgagtggcccaagaaagatagatgggagtcgctttcgcttaatttgtcagacgagatagattgggagcctttgtatcaaggacgaatcttccttaattgtatgcggtgataccaacagatggcgttgagagagaactaaatctggcttgcgtttccttagcactcaagtacaacagatcgattgcaatgcttacagcgaaaattcaagcaaaaaaattgtcccatgattgccgtgtccaaggcaatcatgggacaatcttgaactggcctaagaagctcacagcttgggattaatcttcccgtgtaaacttaataatctttgctcgtgagcgttctaaagcacgacggaaacgattgcttgtgggcgtatcaaacggatgcaagactgccgtctcaaacgcctaatattccaggggtgacaggttttctagaagctgaaaaaattcaacacgcatgagcaatccgtcttcgactgaacgtattgctagccgttcctgcaaagattcgagcgcactcgctttgaatggaatagcggtagcatcaatccgacgcttatgggcaaagtgtctgcgcaagattgaacgtaagtgggactgtaacaccattcgataatacggcccaaattgcgagccactgctgccgtcataacgcgcaacagcttttatcatggcaattctggcctcttgcaaccaatcctcataggaaaattctctgaggttgtagggttttaaaacctttaaaaccagagggcggtattgttcgaatagtttacggaaagcttctgaatcgttcacagcttctcttatcaagctcagttcttcttttttcatatatcctcctcccctgatctactagcaagatcattctacaataaaacgtttacaattgaatagggaacaattgttcaggtataactttttataccagggcatgtataagaaatcgcaaagaatcagcttttctggggcacaaaattattaacattattttcttattttttcaattagaatcaaagaatgcgtcctgatcaagttgaatgactgattagcgcgtggacatcgtgatccggtttaattggcacgtttggctaaaattggtatggtaaatagcctttatatgatgcgactgtctgtactttaatattgggctgaatggtacctgtggaaataaagtttaaaaagctgcccgatgcgtaaggaagagcttttgcgcttgatttaacgaggtgagttattttacatactccgtaatctgcggtaacctaattaggtcattttataaggaggtttccaactatttcttcaaaaacaaaagacaacaaaattggtctatttcagctagtcatgttggcacttggttcgttaattggatcgggctggttgtttggatcgtgggaagcggcagaagtcgccggaccagcggcaattttttcttgggtcattggcggcgtcattatcggtgtcattgcctataattacgtggagttaggtacgatgtttccggaatcaggcggaatgagtaaatttgcgcagtattcgcatggctcattggttggctttatagcatcatgggctaactggatttctttggtgacattattgccaattgaagcagttgccgcagttcagtatatggcatcgtggccatggaagtgggctggttttacccacggctttttacatgcagggaggattaccccacaaggactgttagtggtctttgcgtttatcatcatttttacgttgcttaattactggtcagtgacgttgctgacgcgctttaccagttttatttccatttttaaaattggggtaccgttgttgacgatcgttttgctggccttgtcgagttttcaccccgaaaattatgggcattcgttggcaaccttgatgccttatggtagtgcaccgatttttgcggcgacttcggtttcagggattatcttttcttttaacgctttccagactgttattaacatgggaagcgatgtgaaacgcccgcaaaagaatattggtcgcggcatcgggatttctttgcttattagcggaattatttatattctgttgcaaagtgtctttatcacgaccatttctcctgatatgcttgctgcccatggatggaaaggcctgaacctcaactcgccgtttgcggatttggcaattttgcttggtattcactggctgtcggttttgctgtatatggatgcgtttgtttcgccatttgggactggcgtttcgtttgtcgcttcgtccggtcgtgcgcttcaggcgatggtgggcaacaatcacattcctaagtttatcggtaaaattgacgaaaagtacggaactccgcgtgtcgcgatggtggtcaatgctgtcttaagtatgattatggtctctatttttccatcgtgggggacgcttgccagtgttatttcaacggctacgttaattgcttatctgacaggaccggtcacggtgatctctttgcgtgaaatggcgcctaatttcaagcgtccggtcaaatcagcgatgttgcgagtaatggcaccgttggcatttgtgttgacatcattagcggcttactgggcaaaatggccaaccaccgttgaagtcattggggttatctttttagggattccgttgtatctgttttatgaatggcgatcaggttggcgcagtacgtggcagcagttaaaagcctcggcgtggatgcttggttacctggtctttctctcggtaatttcgctgattggcagtgctgagtttaatgggttgaactggatccattatccaatggactttgtcgtcattatacttggcgcggtggtcttctatttttgggggatcaacagtcatatcatatcgaagtacttccgtaaggccgcgcgtgttaacgataaagttaaaatgcctgcagcggaagacatcgagcgtgacaagtaaccccaaaagtgaagatgttaatatgtattcataaatgaattaatagatatttcttcaaaaaagataggttgtaaatgactgattgtcgggatgtttcgcaagcggctgcttaaaaatttacgacttttgccggatgatgttcatctgatggcaaggtaagatatttttaaaggtttgtgagaaaattgcatttagtcatgcctatctttatacttatactaaacaaatgacgtctggaggggatcaggtgaatatcgggatttttacagacagctattttccgcaagtcagtggtgtcgcgacgtccatcaagaccttgaaggacgatctagaacgtaagggtcatcaggtttatattttcacgacaaccgacccacatgtgccagatgatgcggtcgaaccgaacttgttccgatttacaagtgtgccgtttgtttcttttactgatcggcgcattgcggttcgggggctgtttcacgcttatgcagtggctaaggaattaaatctggatattgtgcatacacaaactgagttctcaatgggttacattggtaagtttgtggccaaacaactgaaaattccaacgatccatacttatcacactatgtatgaggattatctgcattatgtcttaaacggtcatctgctaaagccgtaccatgtcaagcaatttacccgcgcttttctgtatcacgtaagcggtgtgattgcgccgtctgagcgggtgtatgatacgttgcggcgttatggcgttaagaccgacattaagattattccaaccggagtcgatttaacgcaattcgcagagcaaaaggacccgcacttacgggaaaagctgggactggcagatgtgccggtattggtttcgcttagtcgcgttgcttatgaaaagcgaattgataaattaatcagcgccatgcccgcaattttggcgcaaattcctaaagcagttctcctaattgtcggtgatggccctgcacgtgaagatctagaggcacaggctgctgaattagggattgccgatcatgtccggtttaccggtgaaattgaccatgatgatgtaggcgactattatcgtgtcggcgatgtttttgtgtcggctagtgattcagagtcacagggactgacttatattgaggcaatggccgctgatcggaaagttgttgcccttgctggtgattatactgatcaactgttggatgatccggcgttgggaacaacttttacgactgaagcagaaatggttcatcaagttgtgaattatctgaagcatcctaatgcctatgatgatcccaaaccgcgaactgaaaagctggtggcaatttctgctgatcggtttggcgatcgggtacttgatttctatcgcgatgttatcagtcactattccccgaatgaagctgatgaaactgtgccatggaccgatgaaagtagtagcaaacggaccatgaaaggttaactatgatcgttattaacatgttttcttcagccaataaggttgctgggcaaggcgtgggtgcagtttacacagaactgatgggactgttgaaacacgattttgccaatgaatttcaaattaatgtcaatcgttatacgcgcagtgatattagtcattatcatacaatcgatcctaagttttatttatcgacgttctccaaaaaaagaggccgcaaaatcggcttcgttcattttgtgcctagtactttagatgcgagtttaaagttgccgcgagtggcgcggtggacactagaccgctatacgttagctttttacaaacgtatggatgaacttgttgtcgtgaatccaaacttcattcctaagcttgaggcctatgggattaatccggacaaggtaacgtacattccaaatttcgtttctcaacgtacgtttcatccggtttcccgggaaaaaaggcaggcgttacgacatgcgaatggttttaagccggatgattttgtcgtttttggcgccgggcaagtgcaagatcgcaaaggcgtcggtgatttcatcaaactcgcgcaacaaaaccctgactaccgctttgtctgggcgggcggcttttcttttggccgcattacagaaggttatgagcggctcaaaaaggcagttgcaaatgcgcctgccaacctgaactttaccggtattatgccgcgagaaacgatgatcgactactataacatggcagacttgttccttctgccatcttttgaagagttgtttccaatgtcggttttagaagcatttgcaacggatacgccggtaatggtgcgtgatcttgaattgtatcagcaaatcatcacgccttatgcaattacggcggcggatgtggcagacatgcaggcacgaattcgagcattagccgatgatcgcgagcttttggcaacatatgcggccaagagccgtgaagcggcgcaggtgtacgatgaagctcggcttgaaaaagtctggcatgatttttacgtgcaacaagcagcgttgggtaaacactagccgaggagttatatgacacggaagaacaaactggccgtcttcatcatggttctgattggcgccggcatttttatttatgaagcacgtgatcttaatggcgcaaaactgatccatgaacttttatcgcttgatcttaagtggctgttagtggcttttttactgatgtttggttcatggatcgttgaaaccttcgttgtgcagatttttattaaaaacggatcggacgaattagactttaagacagcgttgcgggttccgcttgtcgagcaactattcaacgcaattacgcccatggcatctggcggtcaaccggctcagctgtttgcgctcatgcaaagtggggtggaggctggtcgcgcgagttcggtactgttgatgaagtttgttgtgtatcagtttatggtgctgattaactttgtactcactttacttatcggctttgatcaagtgtctcggcattttggggcccttgtgattttcatcatctttggctttgttatccacgtgattgtgattgtcggcttgctcatggtgatgtactactacaaattcaccaagaagctcgtcagaatcatcatgataccagtcggctggttcgtgaagccggaaaagaagatggcgatgcagcttgatctggatcacaaaatcgatactttttacgccgaaagcctgcacttgaagcgcgaaaaagttcgtgtgattaaggcgtgctttttgacgttaattcagttgctgctttactatgcggttccgtattttgtgctattggcactgggtgtgaatcacgttagcattgttgaagtgattgtgttacacgtgatgattgtgatgattgtcagtctgtttccaattccgggtggagctggcggtgcagagtatagttttaaaaccctgtttgcgacgtatgtggcctcaccatctaagttagtgcttggcatgttgttatggcgctttttaacttattatctaggaatgatctgcggcattgttgcaatggcattacctccaaaaaaagacgcgtaaacgcccttcagccagtcagcttggttcaaggttttctggcggatggatggcaagctgaaattaaattaaatgggattccggagacagttacttatgtcttcaggatcccatttttaattgatgatgattcaaaacgcgtgcggattctttccgtttacgcttgattagccgatgtggctggccatgaacgcgcgcaatcgcttaacggcttcttgaagatcggtcattgatgccgcgtaactgattcggatataaccttcgccgccggggccaaaagcggtacctgaaatcagagctaacttctgttcatgtgccaaggcgtgcgtaaattcgcgtgagcttagatgcagttgggtcggaatttttgcaaaaagataaaaggcaccatcaggacgagccacgctaaagcccatgtcgatgagggcggcataaacaaaatcacggcgtttaacgtaagctgctttcatcacctgagcatcgtctgcaccgttcgtcagagcttcaataccagcgcgctgggcaatggtcgttgcggcagtcacaagatattggtgcacctttttggcttgcgcgattaactgctggggacccatcaaaaagccaattcgccagccggtcattgcatgtgatttagacagaccgttgacaataaatgtacgatcgtaggcaaattgtcccatggatacatgcggctcaccataagtcagttcagaataaatttcgtcacagataatgtagaggttatgtttagcggcgatgtccgcaatggcctttacttctgccgcccgatacgtgacaccggtgggattgcttggatagttaaggataatgcctttgattttagcatcaggatttgcagtgatggtggcctcaatgagttctggggtcaaaacaaagtcggttttactcgtatccatataaagcggcgtaacgtgattcagcgtcagaagcggaatgtagcccggataaattggtgacggaaccagcatagcatcacccggatcactgatcgtcgtaatagcggttgccagtgcttcagtggccccgactgtcaccagaatttcatctgtagcctgatagtcagtgccatatttcgttttaaaaaaatgttgtgcggcttcgcgtaactccggatcaccaaccatcccggtataatgcgagtaattttcctgaatggctttgatcccggcttgcttaacatgttccggggtgttgaaatcaggttcgcctagcgtcagtttcaaaataccgggaatatcactgacactttcgtcaaattgtcgaatctcactaacctcgatggcaggtagttgttcgtttaaaggttgcaatgtcatacaaatctccttaataaagtaagcgcgagccaacccgatttctgggcaggagagcgcattatgatgtaaacgcgaaccgatgcggttagaagtcggagttagacggctaccactaaaagattgcctaactgacttttacgccggcaaacgcgttataatagcatgcaaatagcatagtccatttgcctatcgacacgcaacgtcataaaagtagaattcaaagtgatatttctcccacagaggcgacggtttatgctaagctatttcttgaaataggaaaaattaggaggccattttatgaaacaatcacagctcgtggccatcatcaaacgccttgaagccatgcaggcaggcgatggcgaggcacagtcacgccgcttcgaaaaaaatggtgatgaaaagggcctcgtgacgtacgatcccaagaccgaaacttacgaacttgaagaattaggcactcaccagacgttccagtttgataatatcgatcttgcggccatggaaatctatgatctaatggattttgatgaagacgagggcactaacggtactgatagtagcgatcaggctcaagcttgagttctgagtaaagcggacttgcgaaggttcgctttttctgtgtgaatcttttctgatttgatggatcagtagtatgaaatttgactgatgttgagttaaatggcggttgacgcgcaccgccttgctcaaacgcattcaaatgtaggctattgataggctgttgagtagatacctgtatcagtttcaacaagctcgagagaaagactgccacattgcgaatggccgatttgaactgaaaagcgttaggccgtgtttgtcactaaaatgacatcgcggctttttagtaagcgcgagccggcgcggttagagaccgaagtgtaagcggcctcgcgcgtgatggccggtctttggccattgcgcgcgaggtccttacatgcaggtctctgcgccggggagcgcgttaggagataggcggtttacaaaggatcaattttaaaccgttgaaaagatttaaacacttggcaacgagccactaacttgaatgacgtggttttaaggcttctttaagattgcggttgattcgactgtaatcggcattgaaagtttgtcttttaaggaatgagcggttatcctagcgaatgtgctatacttttgacattaaacaatgacttggaggctccacatgaaccagatcggcgctaaaattcgaggatttttcaataccagactcggttttctggtacttgccattgtcttattctgggcaaaaacttattgggcatatcaagctaaattcaacttaggggtcactggtagctttcagcatttaattctggcagttaatccgattccgacaacgctttttctttttgggattgctttatatatgtcgggacgtaaatcgtatgtcacgatgctgattatcgatgccctgacgtcggtttggctttttgctaatgtactttattatcgggaattttccgactttctgacttttgctttaatcaaaggatcaggtgcggtttccaataacttgaacaagggaattatggggatcgttcagccgacagactttcttgtgtttgtcgatgttctatttttgattttactgttagctttcaaggttattcggatggatatccgcccgatcaaaaagcggtttgcactgggagtttcgctgctggcagtgttaatgtttggggcgaatctggctatggcttatagcgatcgttccggactgttgacgcgcacgtttgacaataactacattgtgaaatatctgggtctcaatgcctatactgttgttgacggggtcaaaactgccagcaatagtgcaacgaaggcaaacgctgattcgagtgatgtcaaatccgtactgaattatctcaataagaatcgtgttaccccgaacgcagaatataccggtgtggcaaaaggtaagaatgtttttgtcatccacttggaaagcctgcagcaatttatgattgacttcaaatgggatggacaggaagtcactccgaatctcaataagctctatcatgaatcagacacactatcttttgacaacttctttaaccaagttggtcaagggaaaacggctgatgcggaaatgatgatggaaaattcattgtttgggttgcctgaaggggcggccatggtaactgacgggacgacgaacactttccaggcggcaccagcaatcttagatcagcagggttacacaaccgcttcgttccatggggatgtaccaagtttctggaaccgtgataacacctataagtcttggggatacgactatttcttttctaagagttacttctcaagtgggaaaaattatgatgtcggctatgggttgaaggacaagattttcctgaaagattcagcgcagtacatcgaacaactgccgcagccattttatgccaaaatgattacggtcacgaatcactatccttacacactggacaaggaaaatcagaccatcagtaagaccgacactggcgatgataccgttgatggttatgtccagacagcccgttatctcgatgaagcaattggtgaattctttgactggctgaaggaaaccggactgtacgataagtcaatgattgttctctacggtgatcattatgggatttcaaacaaccataaaaaagccatggccaagttaaccaacattaccggttttaatgactatgacaatgccatgtatcaacgcgtaccatttatgattcacatgccaggactaaaaggcggcattaatcacacatatggcggtgaaattgatgccttgccgacaatattgaacctgttaggcgttaaggacaatgatacggttcagtttggttcagatttgctctccgctaatcatccgcaaacagttgcgttcagaaatggtgatttcgtcacacctgatttcactaaggtaggcagtcaatactttaataccagcacagggaagaaaatcaccaagctatccccaagccaaaagaaaacggttgacgctgccactaaccgtgtgacaacggaactgtccttatctgatcgcgtcatcaatggtgatctgctgagattctacacgccgagcggatttaagaaggtcgatcgtagcgatttttcgtataagctgaccgatacgaaaaagaagctcaaagccgcccagaagaaaggtacaagcttgaaagcagaaaataagggtaaatcggtggcaaatgaatataagaccgatgcgccagagcttaaaagcgatgatgacgaaagtagtagcgaatccaaataagcgactaaaccttttcgacagtgtctttttaggcactgtttttttggactgatatgaagctaaatttaagcgataattggtaacacatgcatttagtgtacttttgaattttgaaattttctaaacatttgtaagtgaaaaggttatgctaaattagaaaaaagcgtacaattttactagatgataatagttacaaattaggaggctgacgatgaatcaggcagtttataacaaaacaattaacttgctcaaagcaaagcagattcgggtcaccccgcagcgcgaggcgatcatttcctatatgatcgacagtacggcacacccgacagctgaaatgatttatgcaaaactatcgccacagtttccacatatgagtgtcgcaaccgtatacaacaatttacgtctactggtggatcttaatttagttgaggaaatgtcgtctaatgatgcggcgactcattttgatttcccgattgagccacactaccatgcgatttgtaccaactgcggtaagatttttgacttcacttacccaggggtcacggatgtggaggcagtggcagctaaaaaaaccggtttcaaagtcagtggacatcatctcgaggtttacggtatttgtcccgagtgtcagattaaactgggtatgaaataagcctacgttactgttcggatggccacgctttaaaatgagattttatttagacacagctatcaagcataagtgatggctgtttttatttggcgatagacgctgcaaaggataagtcaccgtaatatctaacgtgcaatgatcctgtgctttgagcaacgtcaatcaagcaagacttttttgaaaaaatgcttgcgcctcaaccggcttgctggtattatattattgctgtcaaaaagcagatccctttttggggtaaagataaaaatagtcatgaataaaacatatgaagcgtttttaacaaaaaatgttgacatgatatgctgatcatgataatctatcaaagttgtcttttgacaaagtagtcctttgaaaactgaacaaagtttcgtttaaatgtgcagggtccttgatacttcggtatcgaggcaaaaagtagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactagatagcgtttatatttaattattaagtcacggaggcagctatgagttacgcaaaaaagatgctggatgcacttgaggcgggacaaatggaaacagcgcgccaactgtttacgcaggttctggcgcatgacgatgacgaaacccaatacaatctggccgaagaactttacgcactgggattcaacggtcaggctaagcgtttgtaccaaggcttgctgggtcgttatccggagcaaggggatttagcgaccgccttggctgatatcgcggtttctgacggtgatgccgatgcggctttaaattatctcagtcggattcagccggatgatcctgcctacgttcaaagcctcatcagtgcggctgatgtttatcagtcgttgggattgtatgaggttagtgagcaaaaactactgaaagcgaaacaattagccccaaaagagccagttgtgacgtttgcacttggcgaattttattttgactgggggcactttggtcaggcaattgcggcatataatgagctgcttgctgctggcacgacggaactggccggtgtgaatattgaagctcggctcgccgctagcttggctcaaaccgggcaatatgaagatgcggttgctgcgtatgaagacgttggcgttgacgcattggatctgaatggccggtttgaactaggtggtttgtacctgcagctgcacgatccggctaaggctattgcgaatttgcaggcagtgattgataccgatccgagttttgccaacgcctatttacccttagcaactgcctatgaggcacagaaccagcctgagaaggccctggatacggttcaagccggggttatggttgatgatacgaatccggatttgtacgcgttaggcggcaaactagcgcttagtgaggacaatcctgatttagcggaaacatatttacaaaaagctttgaagatcgatcctgaagatcaaggcaatatgttggcatggagtaattttctggtgcaagaagaacgtgatcaggagaacattgattttcttagtcgcattgatcaatccggtgatgttgatccgcaaatctactggaatatggccaaaagctacgatcggcttgataatgtacaaaaagcccgggaaaattacctgttagcgtttaaccgtttccaggattcgccggactttctacatgatttaattgatttcttccagtcaaccggtgctcgcaccgagctaaaggcagcgctggttcgttatcttaaactggtaccgactgatgatgagatgcaaatgcggttggacgatcttaatgatgagacgtgatccggtctcggtcttaggctaatggccgaataaaaggcgtcggcgcttcttttgataagtgaacccttcacccagtgcttcatggacatccagaatgctaataaaagcacgcggatcaatggcttcaatcagccgttttgtgtgggcaatttcgctggaagccaccacggcgtaaacgacttgcttgcggtcatgggcaaagccgccttctgcatgcaaaaaggttgttccgcgttcaagctcgtccataatcgccgtggcaattgcctggctgtggtccgatacgactaagacacccttggcagcataggcaccatcaagcgtaaagttgacgatgcgcgagaaaacgtaggcgccaagcagcgtgtacatcatgagctcaatgtttaagtatgtcagggaaacggtcaagacaatggcatcgaatatgagcagcgttcgccccattggcacgccggtttgctgctcaaggatgcgggcaacgacatcggtacctccagtggttccgccatgtcgataaataatcccactaccaaagccgccaaaaagcccggctaaaacgccggatataaacaagtcatggtgaatatcaatgcttaagggcacccgttgccaaatccacaaccaagcagataacatcaaagttccatagatggtataggctaaagcacgcttgcccaaaaatttgtagcccacaatcagcaaaggaatattcaacaaaaccgtgctataagccggatccagaccccaccagtaacgaatcagcagagtgatcccggtgacgccaccttctgctaggtgattggcaatattgatatacacgagtccaaagccgtaaagcgcacagcccaaagtgatcactaaaagatccagtccgattcgcgtgttacgtgacatgagatgcctccctgaaaagattttaagctcattttaacagagattttatttttcggtatgattaaggggaggtgccggacgaaagtaagaggagaatttgatgcaattagatttaaaccagccagattttaaagcagcgatcccgatcttgaaaaaaatcgaagcagccggatataaagcctattttgtgggtggcagtgtccgcgatgccttactgggactgcccattcatgatgtcgatattgccagttccgcatatcctgaagaaatcaagcggatttttaagcgtaccgtggatactggcattgaacatggcacggtgatggttctggatcatggcactggctacgaggtgacaacgtttcgaaccgaatcggcttaccaagattttcgccggccggatcatgtgacatttgtacgctcgttagctgaggatttgaagcgccgcgactttaccattaatgccttagcagtgcgccatgatgggacgattattgacttatttgacgggttaacggatttaaaaaatcgccaattgcgcgctgttggcgacccgcatgaacggtttcatgaggatgccttgcgaatgatgcgtgccgtccggtttgaaagtcaactcgggtttcatattgaagcgacgactaaagccgcgattgccgctaatgcaccattattgaagcatatttcagtcgaacggattgctgcagaattcaaccggcttttggttggcattgaccggcgtgccgggatgcaagactttcttgatacgcacctgtttgcctatgcacccaagctagcgcctcatcaagcagcattgcagcaatttagtgaattgccaaatcaagcgttcacaagtattgccagtggctggacggcgttgatcttcatgcttaaagtcgcgccggaatcgtttttgcctgcgtggaagcaatccaatgacttgatgggtttagttgaccaagccgtgaccttgttgcggaaaatgccgacaccgactgcttgggatctctacagcgccggatcagcagctgtggccgtggtcagtgaagtcgccgcattgatggatcaccagtttgtcccggcatcgctgacgactgcttacgaagcgttgccgatccattccaaaaaaaccttagcactgactgggcgtgatttaattcaagctggcgtgcgcccggggccggcgatgggcaagattttgcatcaaattgagtaccgcgtggttgatggcagcttgccgaatgattcaaaaaagttgttagctgcagctattgaaatgtctcgagaaccgtcgtaagtgtgttatgataggcatgtaagcacattcaacaacatcatgaggggcggaacagattagctgtgatgcgcgcgaaagtatccggttaattgttgctctgacttgatggcgaagggggatttccaatggcagaacatgtttttgaacagttagtttttcattttcgtaatggtgacgaatggacggtgcaacatgatgaattggcagatgtctggatcagtcgggtgacgaccagttacggccggattcacggtggccagattcaagaaattcatccatgcaagagctttaaggtcgagatcttgcctgaagccgaccacgttaagtccagtgatattaacaccggctcactggaaatggggatgtttgggcgcgcaacaaagtatcaggacattgaaaagatggatctggtttttgatgatcagaccaaaaagcaggttcagatttattttccgttcaagcaaaaagatccaagcgggctcgataatgaatatcaaacgagcaagcttgccaaaaatggccacctttacattgtgattgatgctcagcataccgtggatgatgaatatccgcgaatttaaagcggcctgctaaactttaattatttcatcaatatcaggggcgtctgattccagtacgagcggttgaccgcttacgactgatcacgcgccccttttcttgtgccttgcttcttgctaagatggacaacgacaggaaatgagggacgacatgcagacgctaacagcacagggcctgagcaaggcttatggtgataagcaattattcaatcaaatcgactttttgattaacgaaggcgagcgaatcggtttgattggggtgaatggtaccgggaaaacgacgctcatccggtctttagccgggatggaatcggttgatgccgggacgattaagaccccaaagcagtatcgcatcagctatctcgcacagataccggagcttgatcccgacttaccgattatggatgcaatctatcatggtgattcaccggtttttcaagcaattcgccaatatgaacgcgctttggcagcctatacaaaggatccgttaaatcaggcaaaaaccgatgcctataccaaagccgatgctaaaatgacgcaagaggatgcgtggtcggcggaaaccgatattaaaacgatcctcacgcaattgcacatcggcgacttaacggcacgggtcggcagtttatctggcggccaacaaaagcgggtcggtcttgcccaggtattaatcgagtcgccagatttgttattgttagacgagcccacgaaccaccttgattttgactctattgcctggctggaaaattatttgagtcattaccgcggcgccttggtcgttgtgactcacgaccgttattttctggatcgtgtaaccaatcgtattttcgaattagaccgcggtcggcttttccagtatcaaggcaattaccaagcgtatgtcgccaaaaaagcagaacaactggaagccgaaaagtcggctgggcataagcaggcacaactttatcgccaggaactggcatggatgcatgctggtgcccaggcacgatcaacgaaacaacaggcccgtattaatcggttcaaggcgctacaaaaagcaaaagacgaagcaccggcacctgaccagcagctggatccgattcaaatcgcaagtaccagactaggcaagaaggttattgaaatacatgatgccagcttgcgatttgatcagcaggtcatcttaaatcattttgattggctggtgcagccgaatacccgcatcggcattaccggtcaaaatggtgctggtaagtcaaccttgctcaatattattgcaggtaaacaagcgcttgatagcggcaccattgaattgggggagacagttcggttaggttactatacgcagcttaatacgaatctggatccaaaaaagcggatcatcacctacttgcaagaagtaggcgaagaagtcgtgcaggcagatgggcagcgcgtttcggtgactcagatgctggagcaatttctatttccacgcagtatgcacggcactttgattggccgcttatcaggaggcgaaaaacggcgcctatatttactacaggtattgatgcgccaacccaacgtgttactgttggatgagccgaccaacgacttggacatcgccaccttgaccgttttggaagattatcttgatcattttcccggcaccgtgatcaccgtgtcacacgatcgttactttcttgataaagttgcggatcagctgcttatttttgatggtaatggccgaattgaacgcgccgtgggtgaattttccgattatctggcaaaacaaaaaccgcagtccgctgcatcaaaaacaaactcagccgcggccaagccaaaagcaccggcaaaaaaagcggcgccaaaacagaagtcaaagctgacatatgctgagcagatagagtatgataagctccaacaagaacttgatgaattagacgagcagttggccaaggttaaagcagaaatggcgcaggtcaatggtgaggattacgtgaagctgggcgatctgcaggcacagcttgatgcgatcaataaggatattgaccagaagttcgatcgattcgccgagttggatcaatatgtgtcgagtagtgaacggtaaaggagcagagcagacaatgttagaacagccatatcttgatcttgcaaaaaaagttctggatgaaggccatttcaagcctgatcggacccatacaggaacttacagtattttcggccaccaaatgcgtttcgaccttagcaagggctttccattactgacgaccaaaaaagtaccattcggccttattaagagtgagttgttgtggtttttacacggtgataccaacattcggttcttactccaacacaggaatcacatttgggatgagtgggcgtttgaaaaatgggtgaagagtgatgaatatcacggcccggacatgactgattttgggcatcgcagccaaaaggatccggaattcgcggcagtttatcatgaagaaatggctaaattcgatgaccgggtgcttcatgatgatgcttttgcagccaaatatggtgatcttggcttggtttatggatcccaatggcgggcctggcatacgagcaagggtgacacgatcgaccagttgggggacgttattgagcaaatcaaaacgcatccctattcacgacggctcatcgtgtcggcgtggaatccggaagatgtcccgacaatggcgctaccgccttgtcacacgctctatcagttttatgtcaatgatggcaagctgtctttgcagttgtaccaacgttcggctgacatttttcttggcgtcccgtttaatatcgcgtcctatgcgttgttaacgcatctggtcgcgcatgaatgtggccttgaagttggcgaattcattcatacattcggcgatgcgcatctttacgtcaatcatcttgaccaaattaaagagcagctcagtcgcacgccgcggccggcaccgactttacagttgaatccggataaacatgatattttcgactttgacatgaaggatattaagttgcttaattacgatccttatccggccattaaggcaccggttgccgtttaatcgctagaagacggcaagtcataacaagtgtctgattgctttgtcaggtttaccaatgacacaaaaggcgccattttgttcggctttggattgcatactcaaaggaggggtctcgaatgaccgcatttttatgggcacaggatcgcgatggcttaattggcaaagatggtcatttgccatggcatttaccggatgatttacattatttccgggcgcagacagttggtaagatcatggtcgttggtcggcgcacctatgaaagttttcctaaacgtcctttacctgagcgaaccaatgttgttttgacccatcaggaagactatcaagcgcaaggtgccgtggtcgtgcatgatgttgcggcggtttttgcttatgctaagcagcatcccgatcaggaactggtcattgctggcggtgcacagatctttacggcgtttaaagatgatgtcgatacgttactggtaacacgtttggctggcagttttgaaggcgatacgaaaatgattccattaaactgggatgattttaccaaagtctccagccgcaccgttgaagataccaatccggcgctgacgcacacttatgaggtttggcaaaagaaggcttaagcagaagccgatgaccggaattggtggttgccagctggtgcgggtgtgagtttagacgcatatttgcgtgcatttaaaaaatcgtctctcgtacagaagaggcgattttttgtcgtttattttaatcaattattttacagatagaaataaatagataagtacatgcacaggctgccgagaatcacaaagaggtgccagataacgtggatgtaggggatgcctttttgcagataaagcatcgccccgcctgtataagccacaccaccggcgactagcaaccaaaaaccgactgggcccaaatgatgccacaatggaaccatgccgactaagcaaagccagccgaggacaacgtagatcatcgtttccagatgcttgaagcgattcagaaagaaaagtttgtaggcaatgccgccgagacacaatgcccagatggcgattagcagaccaatgccaagtttcccgccaatagcgaccaaacaatatggcaggtaagaaccggcaatcagaatgaagacacctgaatgatcaagtacctgcaaaacatggcgcgccttgctaaaataaaaaccatgaaaagcagtcgaggcggtgtaaagcaacatgagcgaaacgccaaaaccgagaagactgaaaagttcaacttgactgccgctattgacgcctttaatgcctaacgcaatggtgccggttacggctaagccaagtgcaaacgcatgggtgatggcgctaaacatttcattgttaaattcataatgacttgattttgacacgcgcattgtttacctcctgatgaacatttgtaatgggtggggaagatggcaggcttgcaaccacagcatggcttaaatcaggaactcgatcgtttggctgctacctgtttattaaaagtttagcatgttacgttttacaatacaactaaatctagttatgacaactaggtgatgtgtactgacattgtttaagtagtttgctataataatcacgatagacgaacctaacagaaagcgtggctcagacatggcaaatatcaagatcgtcacggattcttccgttcagctgactccagaagaaatcagccaacacaatattacggttgttccgttgaccattatgattgacaatacggtttatattgatggtgaaaccattacgcgggaagactttatggacgagatggcagcagcgcaaaatctgccgaagacctcgcaaccggcgatcggtacgtttaccgatgtttttgataaactaacggcagacggcagccaagtattgtccattcacatgacagaaaccatcagtggcacggtaaattcggcgcgacaggcggctcagctggcaaaaggcgatgtgaccgtcattgattcgcaatttaccgatcgctcaatggcatttcaggtgttggcagccgcagaaatagccgaggcaggtaaagacatgccaacgattcttgataagctcaagcaaattcgtgaccatactatcttagtgttgggcgtgactaacttagataatttagtcaaaggcggccggctcagtcgcgtttctggcttaatttcgtcattcttgaatattaaagttgttttgcaaatggaacatggcgaactgaaggccttgcgtaaaggacgcggcatgaagacgattaataatttcgtgaccgaaactatcagcaaaatggccaagctgaccgatattcaaagtattggcgtatcaacggcaggtgctaaagaaatcggtgaagatatcgggcggcgcttagcagaagtcttgcccaacgtcccgattctggttcgcccaaccgatccggtcatcgcaacacataccggacccggtgcctttgccatcacttattacactgattaattttaaaataaatttaaccggccggcgtcagcgtcggctttttttaatgacaatggtatttgggtgacgattgcctgaagtcatgcctcaccgatgagtcgggaaccggtgatagggttgcgattgttcgctcgaaaaatacagctgctgaacctgatgcgagtaccggagaaagactaaagcagcaacctttgtttattcacgagacctcaagtaaaataatatattataacttgttattcatgtatttatgggaggcaacatgcgtacattaaaaaatttctttatttcctgcggtgtcttgctgctcgcttgtctgctcgcgtttggtggatggcaattattcggaccggtcagttcaccaagtgaagtgaaagtcgttgccaacacccccaaacatttgcagttgacggcactcggcgattcattgacttatggcgttggagatgcgactaataatggtggttttgtcggactgactaaaggtgagctggaggcaaccgggcaatatcaagtcaccacgaagaactatggcgtcagtggcaataccagtgggcagattctcactcgcgtcaataagcagcctaaaatccgggcagacttaaaacgggccaatattattacggtgacagccgggggcaatgatttaatgcacgtcttgcaaaagcattttttgacgttgtcggaaaagcaggtgacggctggtagtgttgcatttcaaaaacggctggcaacattactgacaacgattcgcaaagaaaatccaactgcacccatttatgtttttggcatctataacccattttatgtttatttcccgaagatgacggcgatgacgaatagtgtgaaggcctggaaccaagcaacgcaaaagaccttgcagcaatttgatcgcacgtattatgtggatatcgacagtgtgttatctaatggcgaaacagcagcaaataaggcttccgctaaagaagcgcttaaagaagcgacttccggtgatggcaatccgctgattttttcacaggatcattttcaccctaataatgccggttatgggcagatgacaaaacagctcatgaagcaaatgaaagcaaccaagaaagcgtgggagtaagaagatgcaggcaaagaaacgatcgcttcaaagaaatgcggctaaacaaaaggcggtgagaaccggaattaattggtggaaatggttattccttattttggtcgggctattgcttggaaccgggatctggtttacgaagaccgcactgatgccagtcaagatcaactcggctccccaaacggccatgacatccaacgacccggtatttaccgtcaaagtcaccaaaaatagcgccaatcgaattatggcgcattatctgaaatcatatctgaaggacagcaagatcaaatatgccgtcactttgggaaccaatgaagcagcgttaagcggatcgttcaaatttctagggaatgccgttaagttccagttaacatttgatccgcttgtgttgaaaaatggtgacgttttgcttaaagccaagaatctgaatatcggcgcattgccagtaccaatcagttttgtcatgagctatattggcaacagttataaaattccaaagtgggtcagtctagatagtaaggctggtacggttgtgctaaaattgagccaatttaaactccaaaatggcatgacccttaaggcaaacaagttggatctgaccaatgatgatcttgaatttgcggtttacttgcctgatgaagagtgaccattagaaagaagttgaaacaacaatgaaaaaagaaacggctatttttgcaggcggctgcttttggtgcatggttgagcctttcgaggagcaacccgggattttgaatgtggtttccggttataccggtggccatgttgccaatcctacctatgaacaggtttcttcgcataccacgggtcacacggaagccgtggaaatcacgtttgatgcggatgtgattgattatccgtcacttttgaatatttactggcaacaaaccgatccaaccgatgcaatggggcaatttcaggatcgcggcgataactatcgaccggttattttcgtcaaggatgaggcacaacgacaggctgctgaagcttcaaaagcggcgttggaagctagtggtcggttttctgatccgattgtgactaaaatcgagtcagcgaagccattttatcctgccgaaccggagcaccagcaattttatgccaagaatccgcggcgttatgcaatggagcatgcgcagcggcaggcgtttatcgacaaaaactggaaggactaatcatgcatcggactttttacgagtatcttatgacgctgcgtaaccccaatgaccacagcgaggtagcggaatttgccaaaaatgctttcctggatcaaagctttccgaaacatgaaaaagattatcatcggttaagtgattatttagaactcaacggtaattatttaccgacgatggccatttttgacgaaacgtaccgtgattacgaagccagtgaaagcacaggaggcgattcatatcaataaacacaaggtgccattgtgggcggtcattgttttattcctagttgcgcttggtggcggtgcggcaggtggttatgccctgtcatatcagcaagcacaacagtctgtccttaaaaccggagttcccaaagccttagcaccggtgatttcggcttatgaaacggttacgaataattattataaacaggtcagcacaaccaaactgactgatggcgcgatcaagggcatgttaagttcccttgatgacccatattcggtttatttgcaaaacaatgacaaaaccaatttagacgacaccatttctgcttcatttggcgggattggtgcaaccattcagcaggatcacaacaacctttctattgccagcattctaccgggaacaccggcgaaaaaagcaggtatgaaggtcggcgatgtgctgcttaaagtgaatggtaaggatgtgtctaaagagactgttacccaagcagttgccaaaatccgtggcaaaatcggcaccacagtagcagtgaccgttaaacgcggcagcaagcaggccaccttctccatgaaacggaaaaagattaccgttgacacggtgactgggaaacttgcgcctgcgaataaacaggttggggtcattacgatttcgaccttcagcgaaccgactgttaagcaattcaaagcgactgttaagaaattacgcaaagaaggcgctaaatcctttatcctggacttacggcaaaatccgggtgggatgatgacggctgctttgtcaatcagctcgatgttctccaaaaacggtcagaccgtcatgcagattgaagatcgcaatggtgcaaaggaagtctataaagcaggcaaaaagcttgatggcggcttcaaagtgactgaaaaaaccgcggtgcttattgatggtaattccgcctctgccagtgaaatcaccgcagcagcattgcaccagaacagtcaaattccgctagttggcgaaaagagttttggtaaaggaaccgttcaaaatgtcggcgagatgagcagcaacaaagaactcaagctgaccgttgccaaatggttaacgccagatggcacctggatcaaccacaaaggcctaacgcctgatgtgaaagttgcttaccccgcagcagccaaaataacgttaatcaatgcaacccaactcaaacccggtgacaagggcagtgatgtgaaatcgctgcaacagatgctaaaagccttaaagatcggctcagctacggtcaacggtcaatacgatgatgcgacccaggccgctgttaaatccttccaggaggccaacaagctggacgcaagcggtactgccgatcaggacaccttagccgcactggcacaaaagctcagtgatcagttaacgaaggatgatccgatggtagcggctgctatcaaggaagttacgaaatagctcgtttgaatcaatatcaatgcgcgcgcatgcctttgagggtgtgggcgcgttttttaatctgagattttggacttgttaaggagcaaccccgtacttatccctgaaaatttattgacatcataaattatagaaactatgattaaagcacttaatgaaaccgctaacattgcttgaatcgacttttaatcggtgcggtaggaaaagtatttaggtgttactggttaatagattttaaatagaaaagcaggattaaatatgcaaactttagattttaaggaaatgattactgagctacaatccaaaataccattgtataggctgatgttgttgaatgcccccacaggtattggaaagagttattccgtgatccaagcattatgccaatacgcggtagaacaagaaaactttagggccttttttgtaaccgatcagaaaaagaatctgaaattacaggactttgaagctgcttggaatcaagtcgcggatgaacataaaggaacattcagtgaacgcattggggttgtgcgttctttggaagatacggtagaacgcttgattcacgactgggatcacaaaaagattcctggaatgtatcgagagacgcctatatttaaaaagaatattgaaaaactaagaaagacctttcagtgttataagatgcttcagaacgatgctattgactcaaagacatcttggaatttattgaataatgctgagtaccaggttcgttgtgcagttatagcggttttgggagaaaaatcccatgccaatataaaaccaatattagatacaaaatcggacaacttacagattaaacttaatccgactcagaaaaatacaattcgagattatgtcctgaagcaagcaaaagcagattctgaatggctaaataacacatttcccacaattgacttagataaaagaaaaataatcattttaacaacatcaaagttcataaaaggttatacgcccttctttgaaaaaagttcgaaatcttttcagttctcaccaattctatcaaattctttggttgttcttgacgagtttgatagcacaaagaagcagattttagataattcaattgaggacgcattaaaagttcaagttgatttattgccattgtttgatgctctatatgaaggccttagtaaaattacctcaattttcaagtcaagtgcaacgatgataacgaattcttgatagtggtctaggctgttacgccatgcatcggtagcgtatgctagtgctgcaagttcgagtgccagtgaagccggttcatatgctcatcaggcaggctccagcgccagtgaagcgactggccatgcaagtagtgctacaagtcaagcaagtgccgcatccagtgctgcgtccaggtacccaagtgatagtggggtccagtcagatgtaagtattgcgtccagtgcagcaagtactgcatccagtgccgctagtgccgcacaaagtgaggcttcgacggcatcgtcggctgcaagtcatgctagtgaacaagcaagtattgcttccagtgaggatgttgtatcaagcagtgctgcgagtgtcgcgtccagcgcggccagtgccgcatccagtgctgcaaaggctggtaacagtagtgctgcgggtatatactctcatgcagcaagtgcagctgcaagcagtgctaagagcgctgaaagccaagcaagcagtgccgccagtgctgctgcttctgatgattcggtagcttctagcgctgccagtgccgctttgtctgacgatgctaaggcaagtagcgccgccgatgtagcatccagcgcgacaactgctgccattagttccgccacatccttggctgatcagagtgccgcagggtcaaccgctggctcccatattttgccaagtactggtggagagacgacaggtagtatgccatcgggtcagacgccaacgcagacgaagccaacacaaacgaagccaacacaaacgaagccaacacaaacgaagccaacacaagccggtcaaacaatccagataggttcattaccgcaaacggatcatgcagggaggcatatgctaccgcagaccggtgatgatgctgaaagcggtacttctgttttgggtttgctgattgttagtctgatgggattgtttggtctttcgggaaccagacatcagaaggaaaataagccatcaaagtaatattggatcactaatgtcgcccatacactggtgataaaccaaaatctgatggaaatagctagtggtgtaagagatgattattctcttgcaccacttttttgttaagcacgtttttttatggattctgtgtgacaaatgtttgaaattgatgtggttaaattggttttgcgggtaatctagccactctaaaaaaaatccatgaccacaaaataaaggcgtactatttttagtacgcctttatttatgattattataatctgtctctaaataactatcctgatgactaagtgaaaaaccatcttagtatactctaccgttttcctataaagaaattgagctttcaaggacagctactgtttcgctgttgaagtttcaatggtgtcagctaacttaacgcccatagtttctttaccaaggaaaataatcgcaataatggcaatgaggatagacgccgtgaagattccgaaaatacccgtgacggaccagttagcgcctagcaggtgaccgactaataacggaccgacaatgccaccgattcggccgatacctgcagccatgccagagccgctgctacgaacaatggttgggtattgttctggcgaataggcatacaacgcgccccacgcaccgaggttaaagaaggaaagtagcatgccggcagtcaaaagcatcggtaagctggctgccatgccaaagcctagcgcgctaccagcagtgccgagaagaaaaaggcttaaaacagtttttcgaccccatttttcgatcaaccaggcagccacaaagtaacccggtaactgtgcaagggtcatgattaacacataaccgaagctattgatgaggctgaaccctttgagcaccatcacacttggcaaccacaggaacatgccataataagaaaagactaccatgaaccagacaatccataacatgagtgttgaacgaacatatggtggccgccagagggttgtcagggttttgattaaccccggccgcgccacttttttgaacgcgcgcgattcatggatgccttcacggaagtaaaatgcgtacaacccggctaatccagtggcaaaaatggcgactcgccagccccagattggcatgacaaagtatgaaatgatcgctgccagtagccaccccgcagcccagaaactttcaagcaagacgacgctgcgcccgcgcttttcaaccgggacgctttcggaaaccaacgtcgaagcaacaggtagttcaccgccaagaccagcgccaataataaaccttagtacaagaaaaataccataacccgtggcaaaagcagatatgccactgccaatcgaaaagactaataatgtaaggatgagaatggctttacgcccgaagcgatctgccatcataccaaacaagatggcgccaactgccattccgattgaactaacacttccgatccaacccatttcaaccgtactcaactgccattctttatgtaaagcggcaatcacaaaactcagcatgccgacatccatagcatcaaacagccaggcaatgccgattccgataattaaccgcgtatggctaggtgctttctttgacatcgttatcccccttgagaaatccaacattaattaggtgtcttgacaccccaaaacatgttacttatttcaccaaaaaaaggcgggtctgtcaatgaaaattttcatagtaagcacgtctgaggtaaagaagggatcgtggcgttaacaaaaagtagcgagtgaaaagccaaataattttcaaagcttggaggattcaaggaaaaagcaatcgtgaggcgaagaaagcctaatgcccaaatactgccgacaataccttgagggatgtacatgatcacggcaaaaatcaatccgctgaccaggatttttccggatccgatccgatcgcccaactgccccaagcgtggtgcagccatcagatttgaaatacctggtaatgcggcaataataccagcgacaactgtgatcggcccgacgttatgcattaattccttgacataaagactgatgattgggtaaatagacatgtttccgagctgaatgatggcagttgaaatcaacaacaccatgatggccttgggattgccgacttgagtgagcaatccgggacgcttttgcttgttcagcaagcgcggatcaggcgtatagtgttcatgcaccatggttaagctgagcacaaagacaatcatgagtaaggctccggtaataatgaaagtcagccgaattgaaaatgtctgggccaaaaacccgcctagaatcggtccgatcagattaccggaaacatagccggttgtcagaattccaatggcagttccgctttttgctttcggcgtttcggtggcaatcaaagcgctggcattaggaatgtaaccagctgctaatccctgtaaaaagcgtaatgcaatgagcgcataaacattatgcacaaacccgcacgcaccaataatgatggccatgccgaaactggagcgcagcagcatcagtttacggccgcgacgatccgccagtcggccccaaagtggactgacaatcgcaactaccataaaggtgaccccaaacgtaataccggagtagatactgagttggcctttggtaaaatcgccgagctggtcgacatagagtgagataaacggcgaaacctcactaaaacccatgccggcgatgaaggtgccaagccacaagacagctaaattttgctgccatggctcgagacttttaagtttacttggcaagatcgccaacttcctttcaaaaaattagttacctaactaatataacgcaatctgtgggtgcttacaattcaacgtgtcagtttacgattgttgaagtctcggcattcgcacaaaatatatttttgcagaaacactttgacatcaacctccgaccatggtattctactcgttgtgattagtcactctgcctaagactcagggggcgcaagccttaatcatcctgccgaggtggtatcggaaacagtagatacctctatgtcttggtagacatggagtttttttattgctaaaaacttcaaccaaactaatggaggtgaaaaacatgagtgaacaagctatcgcaaaaaaagctgaactcgttaagacgatttctgaacaattcaagaatgctaccagtgctgtcgttgtcgactatctgggcttaacagttgagcaagtaaccgcattacgtaaggaactgcgcgaggctggtgtcaagatggaagtcttgaagaacacctacctgcgtcgggccgctgatgccaacggttacgaagcattggatgatgttttcaagggccctacagccgttgccttctccaatgacgatcctgttgcccctgcccgtatcatggccaagtacgctgaccaatttgatgcattgaagatcaagggtggcatcatcgaaaacaaggttgcttcattggacaccattatggaaatgtccaagatgccagatcgcgaaggtctgctgtcgcaacttgcttctgtcttgcaggcacctgtccgcgactttgcattggttgtcaaggcaattgcagaatccaaagacgaagaacctgctgcataattttacgttacaaactatttaaaaaacggaggaaacaaacatggctttagatgtagatggcatcattgcacaacttaaagatgcttccattttggaactaaacgacttagttaagtcgatcgaagatgaattcggtgttaaagcagctgctcctgttgctgccggtgctgctgctggtggcgatgctgctgctaccaaggattcctatgacgttgaattgaccgaagctggccaagaaaaggttaaggttatcaaggcagttcgtgaaatcactggccaaggtctgaaggatgctaagggtctcgttgatgccgctcctaaggttatcaaggaaggcttgtccgaagacgacgctaacaagatcaaggaacagcttgaagaagtcggcgcaaccgtaaccctcaaataatctagtttcattttcaaacaaaagcacctcgcttaatcgtggtaataccgcaaaaggcgaggtgcttttttgtataaattttaaaagactgccgaagataacaactcaagctcacgatgccgtcattgatttaaataacaacatcaatgacaaagttgttattaaataggaagaaattcatggcatgtgagcaaactaaggactaattggctgcgacgctttgtttatagctgtcaagcgcatccgctagatctttatctttgatggtgacgtgttgatctttcagtacctgactaatgacacgttgcatcacacttgaattacgcgaccattttgaatagacactagcagttaaggctttcttactgtctgaaaatgtccctttagccgggtgcttgatcattttaatgacctcatacccatttgtgactttaaccggtgattgtgtatactcgccatttttaagcttgtacgcggcgtctttaaaggtcgaatcaagacttttactgttcgattcaaagcttactttgccacctttatccttggttgaggtatcgattgaataagtttttgccaacgtcgtgaagtctttgccagctgctaaatcactgatgacttgtttagctgtactttcatcgctagttagaatatgctgaacggtcactttgggttggtaggttttccaagcggctttaagttgactgttggtgactttctttaacttttttagtgccacttcgcttaagaggttggttcgaatgctttggcgaaaactgctcttactaaagccgttttgactcaaaaaagaagtgaagttttcaccatattcatttttatagctgttataagtattgtccactgatttggcgctgacggattttccatacgctttgttgagtgcgcgatagataagcaggttagcgagaacggttttggtggtcggggattgtttgagctctttataaaaactggcttgtgtgacctgaccaccggagtatgtagcgaccgttgtactatcggcttgtttggattggcagccgcttaatagcatgattgaagatgccatcattgcggctaagaatggaacgcgcagttttttcttcatgaaatcaatctcctttaacagattgcggaatagatcgtggctacattctaacgttggatattaaaaaactcaacatattcctcataatcacataatttaaacatttttccgccttagcatacctgaattgcccagtatcacagtcatgagagcttttttacaaataagaaaattaataaaagattaaaaattatgttgaaactcctgagtgtctgtatataatcttaactatatcaagccaaggtttgaatagttttgaaattactgggaatcggagggtataggatgcaaacaaaaaggaaagggctatcaattctcttagccagcacagttgcattaggagcactttctgttttgccaattggtgaagttcaagctaaagcggcaatctcgcagcaaactaaaggaacaaatttagcggaagccaagactgcctcagctggacgaactgccaaagacacgaccagtgcggtgaccaatcaagccattgcgacccaattagccgcaaaaggcattgattacaacaagttaaataaagttcagcaacaggatacttatgtcgatgttattgtgcagatgagcgcggcaccggcttccgaaaatggcacgctcaaacccgattactccagtactgccgaaattcagcaggcaacaaatcaggtcatcgcggctcaagccagtgttaaatcagccgttgaacaagtgacgcatcagacagctggagaaagctatggttacgttgttaatggctttacaaccaaagtcaaagtcgctgatattccgcggttgaaacaaatccccggcgttaaaaccgttactttagccaaggtttattacccaaccgatgctaaggccaattcaatggcaaatgtgcaggcggtttggtctaattacaagtataaaggggaaggcacggttgtctcggtcattgatactgggattgaccccaaccataaggacatgcggcttagtgatactaaaaaggccaaattgacccgaacagatgttgaaaaattcaccagtactgctaaacacgggcgttatttcacggctaaggttccgtatggctttaattacgcagataacaatgacacgattaccgacgacacggttgatgaacagcatgggatgcatgtttccgggatcatcggggctaacggtacaggtgatgatccaaccaagtcagttgtcggtgtagcgccagaatcacaattattagcgatgaaggtgtttaccaattcagatacatcggcgacgactggttcgtcaacgcttgtttctgcgattgaagattcggccaaactgggcgcggatgttttgaatatgtcccttgggtctgtttccggcaatcaaacactggaagatcctgaaattgcagccgttcaaaacgccaatgaatccgggaccgcagcggttatttcagcaggaaattcgggtacatccgggtcaggtacagaaggggtcaacaaagattattatggcctgcaggataatgagacggttggcacaccggggacatcacgcggggcaacgactgtcgcatcggccgaaaatacagatgtcatcaaccaagccgttacgattactgacggcagcgggttaaaactcgggcctgaaaccgtacagctttcaagcaatgactttgttgacagttttgatcagaagaaattctacgttgtcaaagacgcaagcggtaagttaagtacaggtgatgctggcgactatacggcggatgccaaagggaaaattgcaattgtcaaacgtggcagtctgactttcactgacaagcagaaatatgccgaggccgctggtgcagcaggcttaatcattgttaataatgatggcacatccacacctttgacttcgatttctctaacggctacttttcctacttttggtctttccaatacgactggccaaaaactggttgactgggtaactgcgcatccaaatgacagtctgggcgtaaaaattgccttggcgttgttgccaaatcaaaattataaagcagatcggatgtcaagtttcacttcatatggccctgtatctgatctttcctttaagcctgatattacagcgccgggtggtaatatttggtcaacgcaaaacaacaatggttatacgaatatgtcggggacctcaatggcatctccatttatcgccggctcccaggcacttctaaaacaagcgctaaataataaagacaatgagttctatgccgactataagcaacttaaaggcacagcattaaccgatttcctcaaaacagttgaaatgaatactgcaaaaccgattaatgatattaactataataatgtcatcgtctctccacgccgacagggagcagggttggtggatgtcaaagccgcgattgatgctttggagaagaatccatcaacggttgtttcggaaaacggctatcctgctgttgaattgaaagatttcacgagcactaccaaaacgtttaagttgacgtttaccaaccgcaccaagcatcagctgacgtatcaaatgactagcaatgaagacaccaatgcggtttatacttcggctaccgatccgaattcaggcgttctctatgacaagaaaattactgatgcggcagtcaagccggataccgatattgtggtaccggctggaaaatccgtgaaggtaccgttcacgctttcactgcctaagacttttgatcagcaacagtttgttgaaggattcttgaacttcaagggaaatgatggctcgaatctcaacttgccatatatgggcttctttggtgattggaatgacgggaagatcgtggatagcctgaatggcgtgacttacgatccaactggtggcaattatgggactgttccggtgctcaccaataagaaaaccggcagtcagtattacggtggcttagtcacggatgcaagtggcaagcaaacggttgatgataaagcagtggccttttcgagcgataagaacgcgctttataatgacatcagcatgcaatactacctgttacgcaatattagcgatgtgcaagtcgatgtgctggataatcacggtaacaaagtaacaacgctcagcagtacgactaaccagactaagacttattatgattcaactggtcgcaactatacttactatcgcgcaccggcttgggatggtacgtattatgatcaacgagatggcaatatcaaaacagccgctgatggcaactacacgtaccgtatttcgggtgttcctgaaggcggcgacaagcggcagacatacgatgtagcattcacgctggactctaaggcgccaacggttcgtcatgtcgctttaacgtctagacaggaaaaaggcaaaaccacttactatctcaccgctgaagcaaaagacgatcgaagcggtttggatgccactaagagtgcaaaaacatcggttaatcaagtcaccaatcttgatggcacctttacgacgacagggacaactgctgatggctacacaaaactcgaaacgccactgacggataagcaggcacaagccttgggtcaaggcgataataatgttgaactttatttgaccgataacgcctcaaacgccacggatcaatcagcttccgcacaaaagcccggatcaactgcttatgatctgattattaatggtggtggtttaccagataaaatcacgagtcaaacggctaactatcaagcagggaagcaaggtggcacttacacctttaccgggacgtatccggctgctgtttatggtacctataccgatgcgcaaggaaagcagcatgatttgacgaccacttatgacgctgatgccaatagtttcaaagccactatggcacttgacgccagcgactatgcgacgaaggttgatctttatactgaccaagcacatacccagttagttaaacattttgatacgaatgtccggttggcggcacctacttttagtgacttgcgggttaatgataatcaagatcaaacgtccgaaagtaccgttaaagtaaccggaacagctagtgccgacactgagaaggtaacggttactaacggtggcacgacaacaccggttactttggatgccaaacatcactttagtggcgatgtacccgttaactatggggataataccattacggtgacggcagaagatgaagatggcaataccgttaccaagcagcagaaggtaaactcaacttatgatgccgatgtcctaaaaaatgcggtgaccttcgaccaaggcgtcactttcggggcaaatcaactgaaagttaaagatgctaagtactatgaccctaagaccgggattgcaacgattaccggtaaagtcaagcatccgacgacgactttgcaagtagatggtaaacaagtaccgattaatgatgatctaacctttagttttaagttgaatctggggacagccggtcagaaaccgtttggcgttgtaattggtgataccacgcaagataaaacggttcaagacagcttgacctttattttagatgctattgccccgacactgtcactcgatagctcgacggacaaacctgtctatacgaatgatccgaatttccgtatcaccggaacagcgacagataacgttaattatttggaactggcaattaacggtagtcaggttgccagtcaatatgaggacattaacttaaacagcgggcagccgggtcatatggcaattgatcagacggtgaaactattagagggcaagaatgtcttaaccgttgcggcaacagatagcggcagtaacgtcacaactaaaaagattacggtttattatgagcctaagaagacactcgcagcgccaacaattacgccaaatacgactgatccagctaaagaagtgacgttgacagccaaggcagcagcaggtgagaccgttcaatacagtactgatggcggcaagacttaccaagatttaccgacaacgggactgagtgtatcggcaaacgcggactttaaatttaaggctgttgatctatacggtaatgaatcgccggcagtagattacgcggttaagaatattaagacggatgatccggcgcagttacaaaaggccacaacaacgctgcaggatttgcttactcaagcaaaggcaaaagcagcgagcgctcagtatactgacgccacaactgatgctctgaataccgctatcggatcggcgcagactgctttagctaaagctgatgccacaattgaaacactcacaacggcaacaacgcagctgaccaccgcagtgaatcagttggttgataagctgccagcagaccaacaagctgcactactaaacaagatacaatctgccaaagaggcgtttggaactgatttaggtggccaaaccgatccaagcaccggtaaaacgctaaatgccgaactggacgctgtcgctgcgcaaacgacagcaggaactagtaccgccgatcaaattgaaaccaacttcaataaggtattagatgctgcattgaatcaattggcaaaaacaattaaagcggcaacgcctgtcaaagttggtaatgccaaagataccactaccggtaaaacctggtacggtgatgttgatgctgtcattgctgcaggtacagcagctaaagcggatactgaaaagattgcacaattgcaaggtttgtttggtttgaagactaaaattgccgcagcggttgaggcagctgccaagacaccacagcaacctggaggcggatccggaagtggttctgacactggcaaagggtctggcaccggaagcggctctgaagcaggtaaaggttccggcaccggaagtggttccgaagcaggtaaagggtctggcagcggaagtggctctgaagcaggtaaaggttccggcaccggaagcggttctgaagcaggtaaaggttccggcactggaagtggttccgaagcaggtaaaggatctgacaccggaagcggttcagatgccggtaaaggctctggcactgacaagggaaatcaaccaaaagacacaccatcaaccaatcctaagggcggcgacgacaagaaacagacgcaagaaacgccggcacaaccaacagggaccgaaaacgccaatagtaatggtgcaaacagtcaagcgtccactaaagatacgctgccaagtacaaatgaatcgccacggcccgcacttgctttcttaggagctttagtcatgggtgggctaggtcttcttggcatcaagcgtaaacgcaagcaaagctaatcactatctttaaaacgattcgttacaagtatcgactaccggtcaagcgttgtaacgctcggttatgaatctatggtttaaaaaatccgacatacagatatggtgtgtaaacgccatgctgaatgccggtttttattttggttaaattttggttaaaatagacaaaaatcaatcacgaagaattaaatcggactgaattacggtctgagcaacttctgcacgcaaggccagttttaaagctgcggcaccaatggcggttacatgatgatcaatcgtgctcatgtttagtagccgactggaaagttgattttcctgacccattaatggcggaatagggagatgctgatcaacaaaatattgccgcaatcctgccgtaatatcgtcaccattacccaaaataaaatcaggctgtttcgccgcaagcatctttccagcgcgataaccatcttgaaaagtacgcatttgataaaccaccaaagattgctcgggacggtgaccaaaaacatcgacataactattaatcgtgagtttgcttgtggcactttgcgcataaggtcgactgagcaagagaccgattctagtgtggccttgccgcttcatccagttaaatgcagcttgataagcgggagtgcgatcagcgtaagcagcggcaagtttaacctggcccggatcttcgcaaacaacaatcggaccatatctttggtaactggcaatagtgcttaaaccaagtccgtgggatgtgaagatcagtccatcataggcttgtctgcgcaatgcttccagataagtgcgctcaagttcctgatcgtaacgcgagggtaaaataacggcgtggtagttgccgatcatagcggcgtttaagattcccgttaccaattgttcaaaatagggatgatcggtatgaggtaaaatgacaccgattgtccgggtcttaccggcgcttagattctgggccatcgtgctcggcacataatcaagctgtttcataacagtcagaattctagcgcgggcagcagccgaaacataacgatggccattaatcacgcgcgagaccgttgcggttgagtaaccagataggcgtgcaatgtcgtgaatattcgccatgaaagcacctccacacacagtataccagtcgattcacccagtcgaaaaagccgatatggcatgcagcgcgtttaacgtgcacgcatatcggcttggatacgcgactgcgggctttaagcaatagcagcagttgccatttgagttacagcctctaaatcttgatgatcgcggctgtttgttgcaatcgcatcaagccaatcatggatggtttgatcatcagttgagactggcactagcagcacgactgcaccgctaatttgctgtccagccgcccacggtaattgggagccaaagtcgaatccgatcaccattggcgcggatagcttgctaacgtgcccgtaagtcaaaacaatccgatcactgagcaattgtgtctcctctgcggcgcttgctaacagtgaactgagaacttcttgataatcaaagtcatagtcagtggtcagctttaacgcaatcgccttcaaagccccaatttgtgtagggtgataaacgggaagttcagagtaaaaatgtgtttgcattaacatgaaaatgacctgctatataaaacgtggaagaatgtctctttgacaccaataaaggttctatatatttcctttcttgattgacattcagcatttcatttagttcaccaccaaaaatcaaggcgccagactgatcaaagagaaaaaatcctgatttagtgatgtaaaaatccaactccggctgacgactggaaacgccggccatttcggtagacagaagccgttcgccgttataatcaatatcggcagtcgcctcacgtctatatttggaactatgcgtgatcttgccatggaacttggcaaggacattttcgccagcatcataagggataatggcttcgctacgaatgccggcagtgacagcttgtttcaaaatcgcctctggtaccgcattagctaaatcagctgataatgcctgtgccgggatcgtgttaataacaggttcgccaataaacttagcaacgaacagattgttaggctgatcgtagagggtctgtggcgaactaaactgctgaatggacccgtttgcaagcaccataatgttgtcggaaatatgcagggcttcgtcttgatcatgggtgacgaaaatggtggtgacgccggtttcacgttgaatccggcgaatttcttcacgcatctcgattcgtaaccgcgcgtcaaggttggatagtggttcgtcaagcagcaaaagacttggcgatttggctaacgcgcgcgcaatggcgactcgctgctgttgaccaccggataaagctcccggttttttgtcaagctggtcttcaacgtgcaccaatttggcaaggtctttagctttggcgtggcgctcggcttttccgactttagccatcttcagtggaaaggcaatattgtccaagaccgacaagtgcggatacagactgtagttctgaaataccatgccgactttacgggctaaggcatcttttttagtgacatccgtatcaccaaagaaaatttgcccggcagttggcgccaacagtcccgaaatcaaattcagtgtcgtggtcttaccgccgccggaaggacccagcagggaaaccagcgtgccatcgggaatggtaaaattcagatccttcagggtatctttcttgccatcgtaggacatcgtgacgtccttgaaagtaactttcaacccagtacgctccttcgaatagttttctgctcctcacctccgttcgtcggtcccacgcaagcatgccggtggggtcgcgccaaaaagaaaatttggaacaagatattgtggtgccgccacttcactaaagcatatctagggggcggggcgacaacacaactcttcacatattttaacccaatttcactcaaaattggactcattcgcttaaaaacatttgattgttacacaacaagtgataagacgcgaacgttcggcttctttgctataataaattcatgaaaaaggagcgatttttgtgatcatacgtccaagtaaaccagcggatgctgctcaggtggccccgctgattgatattgtctttactgaaatggaaataccgcagttaatgcgggttccaaaaccaaccttatatgcagttttgcaacaagcatttctgctgcccacttatcgttacggttatccacaaattctggtagccgatcaggatgggcatattgaaggtattgcagtgggttatctacacgaacaagaagcgcatattgatgatgctttacgtcccttgttgccaaaactggggctaaccccgcagtcatctttgtttacggataccgaaacttatccaggcgaatggtatcttgacaccttagccgtggcggccactgcgcaaggacatggcattggaaccaagttattacaagcggtcgatccggttgcccgcgcccgcaaagccgatgtagtcagtttgaacgtggacaagcagaatccgcgggctaagaagttatatgaacgcaatggctttgtcaaaaatggcgagctgatgattggcagccatcgctacgatcatatgattcggccagttggtgattaagtgaaaagtcggcacttacagctggtagtggaaccaaacaaaacggcactcgcgatgggaaatcttttgcgagtgccgttttgtttttcttaccatacttaaggtatcgtccattttttgtatcaatacagcagctaaagcctcagtcggggaagtccagaccatattcataacgtttcaacggatcagccaccccaacatggcggaagcggtcgaggatagccgccaacaaaatggcagcaggaatgtcccgattgctgggaatcgtaagcttaacaattgccggagcgacttcttcggcactaaaaatggttttgacgccatggaagacctgataatgattgttgagcaagttacccatggcgacccagttaagtttggagataaaaatgaattggtgccagacgccaaacatttttttgacactggcaacattacgatcggcaatatataggtcatagcgagggaaaacgctgactgttttttgacgaatcgaaccgagcggattgccgcttagtgtgttcaaatcaaatccgccattgataataccgtggcgggccgtcaaaatatacgccggtttgccattgtcggtttttaccacgctcagactgccggtacttaacgcattcatatcaagatataacgccatttgcagacctcccaggaaaggtcacatgctgtgtttaaccgcaaagattagaaatgggcatttgatgcttctgccttgttaacgcgaatagccttgcgaattgcggcggcaacgccattttcgctgttggttttggtggtatcccatgccaaggcagtgatttcaggaatcgcatttcccatcgcaacgccatacttggccattttaatcatgctagcatcgttgagattatcgccaatcgtcatgacttcatccatcgtgatgccccgttgcttggcataagcttcaacggcataacccttttgtgctttaatattgttaacttcaatgttgttggccgagcttgaggtgacactgagtttgccggtggcttcaaaagtctttgcgggtgcttttaaaatatcatgccgttcaccggtaaacgcgatgaacttcataatttggatggttggatcgtccaataattcttggtagttatcaacgtaattgatattcatcagttcaagccgagcagccgccagtgccaccgcaagtttgtaagttgtatcaggattcagatcaacgagcaaatcggcaacattttgaatccgctcgacgcgactatctgagaagacgcctttgttggtgacaacttcaaagtaaatgttgtctttttgcagcgttttgacaatgtaatcgtttagatcatcagcaattggaattgtgaccacgagcttgccagcctcgtcaaaaaccattgcgccatttaacgtgatgaaggcgggttttaagttctgagctgccaataagggttttgcctcagtcacgccgcgtccggttgcaaccatgaattcgataccagcggcttgcgcttcacggatggcctgggcgttttcgtctgagacttccattttgtcattcaaaagggtgccatccatgtccgatgcaataagtttaatcatatttacagttccctccggtttgtcatggtgccgttacgattttaattttagcatgaaaaacgcttgtccggtagcaaacgtgctgggattcttgtacactatttgcggaggtgcagcttttgaaaacattaatccataatgattggcagacggttctggaaccgatttttgaaagttccgaatatgcacggctgcatggctttttaaaagaagagtatgccactaaaacgatctatcccgagatgcatcatatcttccaggccttcgaatggaccccgtttcatgatgttaaagtggtgatcttaggccaggatccttaccacaatccgcatcaggcagtgggggctagttttgcggttgcgcctggcgttgccttgccaccatcactgcagaatatttataaagaattgcaaagcgacttagggtatccacccgtgcatcacggctatcttaaagcgtgggcgaatcaaggcgttttattgctcaatgcggtcctgaccgtgcaggctggacacgcgtattcgcatcagaatcacggctgggaagcattaaccgatgccgcgattgccgctttgtcagcgcgcggtggcgtcgtgttcattttatggggcaatgcggccaagaaaaaagccgccttgattgacacttctaaaaatgccatcattgcgtccgcacatccaagtcctttgtcagcatcacgtggtttttttggtagtcgaccgttttcacgcacgaatgaggcattagagaaaatgggagagacgccgattaattggcagctgccagagacggttacgacagaaaattaaaatgatagcaacagccgtttaagcggtgcaaaccagtgatccccatttgtctcagcggggacagtggggtgttgaggaacgagcagccgatttttccttctgacttctgctggtcataacccaataaaaacggtatgatgatacagaataaagcgcttttatggagggataaagtttggacctatttgaaagcttaaaagataaaattaacggtaaacatttgcggattgtatttccggaaggcgaggatccgcgggttttaggcgctgcagttcggcttgcagctgatggcctggttcaggcaattgtcttaggtaacccggataagattcaaagcctggccgccgaaaaaagctgggatctgagtaaattaaccgttcgcgatcctgaacatgacgagctccatgaccaaatggtgacggcgtttgtcgagcggcgtaaaggtaaggcgacccaagaacaagccgaaaagattgttcagaatgccaattattttgggaccatgctcgtttacatgaagaaagctgacgggatggtctccggtgcggtccattcaacggctgacacggtgcgcccggcgttacagatcattaaaacgcggcctggggttcatttagtgagtggtgctttcatcatgcaacgcggtcgggatgaacgatacttatttgccgataacgcgattaacatcgatccggatgctgaccaattggctgagattgcggttgaatcggctaaaacggccgcattatttgatatcgaaccaccccgcgtggctttgttatcattctcaaccaaaggcagtgccaagggaccgcaagtggataaagtggttgaagccaccaaaaaggcgcatgaattggcaccggatttggctttggatggcgaattacagtttgatgctgcctttgttccaaccgttgccaagcaaaaggctcctgattccaaggtagccggggaagctaacgtctttattttcccagaactgcaatcaggtaacattggctacaaaattgcccagcgattcggcggctttgaagcgattgggccaattcttcagggactgaatcaaccggtttccgacttaagccgtggtgcaaatgaagaagacgtctataagttggccattatcacggcggcccagaccttgctatgacaagcttaaagaaagatttcaccagtgaagctgcactgcaggcctttgctgcttcactgggaccgcagttgcaagcaggcgatgtgttactgctagacggggatcttggcgctggcaagactagttttaccaaaggcttggctaaggggctgggcattacggattatgtcaaaagcccaaccttcacaattattcgtgaatatcgccatggccgcctgccgctttatcatatggatctttatcgtttggaagatggtggcgccgaggatttagggttggaagaatatttcgaaggtgacggggtttcggttgtcgagtggcctgactttctggggcttagtgaaccggaaaccgacctgctgattcattttcaaaaggatgataattcggataccacacgtcacttagaactggttccccgtggtccgcgttatgaggcgttacttcaaagcctcagctaatgtgttaatgatggtttgctagagaacattcggaaaaacaggatcgagcatgatcgcaagtcgaaaaagcgatgcccggtgctgtttttttttttgaatcagccgagtaattgtctagctgaacgcttatattttgataactaaagtttgcatgctaaactaatagcaatgtgagctgttgaacgaataggaaagtaggtgcaaaatgttagaagtcaaggatctggtcaagactttcggtaccatgaccgccgttgatcatgtgagcttcacggtaaaacccggtgagatcatgggattaatcgggcaaaatggcgcgggtaaaaccacgacttttcgaatgattctgaatttcttgacgcctgatgccggtaccatcagctggaacgggcaaccattgacggccaaagattacgacatcattggctatttgccggaagaacgcgggttatatcctaaaatgcgggtgcaggatcaaattgtttattttgcccggttgcggggtatgaaaacagctgaaatcaaagcgaggattccggaatggctggaacggtttcaggttaaaggtagggctacggataagatcaaggatttaagcaaaggcaatcagcaaaaagttcaagtgatcgcgacaatgatacatatgccaaagctggtcattcttgacgaaccgttttccggactcgacccggttaatgccagtttgttaatggccggcatcgagatgcttaaagacaacggcgcagcgattatttattccagtcatgatatggctaatgttgaggctatttcggatcatttggtgatgttgaaacaaggtcgcatggtcttaaatggtgctgtaaatgccattcgggaaagctttggccgaaccaaactgtttattgaatctggcttgtcggaagcagaattgcaagcatttgacggggtaacacatcttcgccgacacggacaggagtttgagttaacactggctgatccagcagtgggtcgacaaatatttacccaagctgtggcgaatggctacataccggaatttcgccaacaaccgcctacgcttgatgaaattttccgcctgaaagtaggtgagtcgaatgcataagttctgggtggttatgagtcaggtttacaaaaagaatgtcaaaagtggttcgtggattttcctagtgttgtcgccattgctttttctggcaattggggtcggcatcgcgttttatgtagccaaaacacaagctcctgcccaagtggccgttgtcagtgacgttagcgccgtgggtcaggcattaagcaaacaaagtaccgatgacttaaagtttaaggtttattcgtcagataaaaaagccaatgctgctttaaatgatgagaagattgacggtgttttaacggtgaaggctgctgaccatttccgttcccattatgtagcgcgcgataacgggcaaacggttgacacgtcgacccttgtcaccgcactgagcggccttaagctcagcagtaccgctgccagtatgcacttgacgcctgcccaagttaccgccttaacgcagccgcctgtggttacctcaaaaacagtcgcgattgaagatggcaagcaagtacccaaatcagactccacgcaactcatgaaccatggtgttgccgtcgtgtccatggtgctgattctgatggtgacgatggtttacggctcaattctcgcgcaggaaatcgcgacggaaaaaggctcacggattatggagattcttctatcatccgtcagtgccacgactcagttcttcggtaagctggccgggatcttcgccttgttattgacacagctggcaatttatcttgttgccggattgattggttggcaatttcttaaaaaccaaagcatggtcgcaggggtcttgaaacagtttgatttctcgattctattttccgggactaccggtatgatcgcgattttctttgttattggaacactaacattttcggtgttagctgctttgacaggttcgctagtttccaatcaggagcaggtgcaacaagctgctatgccgattagcatgttggggttggttggctacttcattaccattgccgcgcagtcaggtgattcaatgcttgctcaaatagccagttatgtgccgtttttaaatgtcttcgtgatgccgacgcaaatgtcactgggacgagcaagtatgggcgaggcgtggatcagtattgcaattagcatcgccttcttggccctgtttacaatgttcacggtcaaagtctatcgcaataatgtgttggtttactcaggctccggcttatggcagtcaatgaagacatcctttagcatctggaagtcagagcggcatgtcgtgaaaaaataagctgaaaaagaaattgtgaacgcctgactgaacgggtaaataaaaatggctggcaaagatgcattttaacatttgacgatcagcgtgctgtttacaatttgaaaataaaaacgagtgcaatttttcgtgttaagctgcagcgaaaattgcactcgttttttagttttatacgctaatttgttaagcttcagcctgctttagctaacttcatcatggctttagtctgcgcttcgccaaaatgttcattttcggcaatgaggattcttgcacacgcataactgtccgctaaggcgttgtgatggtgctcaagcggaatcttgagtgcagcactgactgtatccaaacgatgattcggtaactttggtaaaaactgccgtgatgttttaaccgtatcaatgacctgatagcgtggcgcggcaatgccatagcgatcaagtgtcaagcgcaatacggaaacgtcaaacggtgcgttgtgggcggtgacaatccgaccaggcgtataaaacatttgaatatgcggccaaacccgatcaaaagtcggctggtcttgaaccatatcaggtgtaatcccgtgaatccgaatgttttgcgggtcaaattgcatctgcgggttgatcagtgtgtaaaaactgtcaacaactcgattttgttgcacgacgactaaggcaagcgagcaagccgaagcccgtttgcgatttgccgtttcaaaatccatcgcaataaaatccatgtcatcttctcctaaactaaatcctgagtcaccaattcgacaggacagtgatcgctgcccataatttgcgttaaaatcttagcatcctgaatgtaaggttgaaaggctgagctggcgacaaaataatcaatccgccagccggcattgttagctcgcgcgtggaagcgataactccaccaggaatatgtgaccgtatccgggtaaaaatggcggaacgtatcaatgaagccactattgagctgtttggtaaaatcagcccgctcttcatcggtaaagccggcgttgtggtgattggttttgtcatttttcaggtcgatgggttcatgggcaacgtttaaatcaccacagtaaacgagtggtttctttgctgccagttcattcgtgtacgcgagaaaatcccgatcccactgttggcgatagtcgagtcgtttgagctcgccaccggaattaggcgtatagaccgtcattaaataaaacttgggatattcaagcgtaatgatccgcccttcggtatcatgttcagggatgcccatgccatacgtgacattcagcggcttgtgcttagtaaaaatggcggttcccgaataacctttacgttcggcataattaaaatattgatagtagccgggcaaatcgagttctacctgaccagcctgcatcttcgtttcctgaagacaaaaccaatctgcatccaattcgttaaaaatcgtcataaagtctttttttaaaaccgctcgtaagccgtttacattccatgaaatcattttcaacatgcttcactcctatcgctgctatgcgccttcattttactagactttacgggtgaatgcgactggcgttcttgttagtgtaaaacttctctcagtgcatgtggaggggcaaacacgagcacatcagtttagaagattctcgtagcagtgcgaaggggcaccttgttcgaatatcaggatagaaagcaagagctggcggagcggtggcgggctcagtgatgaaattggtctaaagcggagtgggcttctccgctttagaccaaggccgagctttgaaaccgcggtttttgcgggttcgaagtcgtgcccaccactctagctgcgcggtcgccagcctccaccaccgcggagccagctcggagtaacggaaatcacttaattagagtagaaccgagaaaaagttgacacttactgctttttgcgctctgtgttcatgcgcccgaatttctgctaaaatagtaagtagtctttttgaaaggacctgatgttgtggtagacgcaccacggatacttgaaggtatcaccatgttgcatgatgagccgttgagtcattatacctttacaaaaaccggtgggccggctgatttgcttgcgtttcctaaagacgtggctgaagttcaggctttggttgaaatggctcgggagcgggatatgccgttaacggtcatcggcaacgccagcaatttaattgtgcgtgatggcggcattcgggggttagtcttgattttaacggcgatgaaaaaaatcaccgtgaatggtaacgatgtaacggctcaggcgggggcccggctgattgacacaaccgaagccgcttaccgggccggattaaccggacttgagtttgcggccgggattcccggcagtgtcggtggcgcgttattcatgaacgcgggcgcttataacggtgaagtctgcagtgtgatcagtcaggctcacgttttgacgcgcgcaggggaactcaaaacttacaatcatcgtgaattaaactttcgctatcggcatagtgtggttcaagataccggtgacattgtcttgagtgtcaccttttccatgaagtttggcgataagcctactattcgggccaagatggatgaactcaatgcaagacgggcagctaaacagccactggagtatccatcatgtggctcggtgtttaaacgtcccccggatcattttgttggtccgatgattcaaaaagccggtttgcaagggcatatcattggcggtgcgcaggtatcgaaaaaacatgccgggtttatcattaatttaggcaatgcaacggcaaccgattatcttgatatgatccaccttattcaaaaaacggttaaagccaagtttgacgttgacctagagcctgaagttcggatcattggcgaaccgttacactaagcaatatcttaaaatctatttgaaaggggctacacaatgcatttagtcgaagccgtcttattcttgatggcattggtcatcatctcaaacgtgctcagtcattacattgtggctgtcccggtttctttgattcaagtcgcgctgggactaggcgcggctttattttttcatttaacgatcaatttagcgactgattggtttatgttgcttttcattgccccgctgctgttttacgatggtcggcattttccgcggcgagaactatgggagttgcgtggtccgattatggggaacgccatttttctggtgtttgcaacgatgctggtcggaggttacttaattcatttcctgattccgccattaccactaccagcgagttttgcgttggcagccatccttagccccaccgatccgattgcggttcagagtttggctaagcgtgtgcatttgccaagcggggttttgcacttggtgagtggcgaaagtttgatcaacgatgccagtggcttgattgggtttaagtatggcatcgcggccaccatgaccggagcatttgcactaggccatgctgttcgggactttttctacgtggcgttagtaggggcgttagctggcttggtgctaatcggcttgattaatttgagtcgcaactggcttttgcaacaagggctcaatgatgtcattttgcatacgattttgcaggtgttgacaccgtttttcatttatttgattgtggatgaatttatgcatgcttctggcgtcattgctgtcgtagtagccggtttactgagcaatacgcagcataatcggtatgttgccgcgttgccggagttgcggattgtttctgaacggacgtgggatttaattgtttataccctgaatgggattatttttcttatcttagggattgagcttcctgttgccatgcgggacacgatagccgatcatgaagtcaacacatggcaagctcttgaatttgttgtgattgtttatctcggcattttggttttgcggacgttatggatttatggctacatgtggcttacggttcgttcaaaaggcaatcctccttcttggcgggcggcgttgttaagcggtatttcgggtgtccgcggtgccattacgctagtcggtgtgtttgctgttcccgcagcattggcaaatggccagccgttccccgagcgcagcctgatgctgtttattgctgccggcgttgtcgtcttgagcttaatcgtggcgattgtggccttgccgctggtgacgcgctcagtcgcaccgctgcaaacccgtggctccacgattgccgcagatggtagcagcgatgtcgccgaggatgatgaaaatagtcacgatgttcgcattatctctcagcgtcaagcccagctgtttgtctatcaaatggcagttcgtcgcgttgaatccgagcggcgggagtcaaatcaaaaagcggcacttgatctgatcgccgaatatcaaaatctgattcgaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactactctactgttgaatcctataagggtatctgcacacgaagatgccgacataccccaggtaacagaaaaagaatatttaaacaatataaatggtgtgaagcagattgactctgatcagtacttggaattagtcaatagtggggatgcttcttctgattttgtcgtttattttggttttaaggagtgcccatactgtcgagcagtttctcgtacgctgaagcagtttataagtgaggctaagcacccaatatactatatgaatatggacgagagtttcacggagacgacagctgatgactataaacaaattctggaatcactcagtccgtttaagtttcatggaacaccaactttcgcttatttccataataacaagatacgtaatatgttagttggatatccaattacacttcagcaattcacgcaaacagaagtaagcgttctgaataagcaacaataattatgctgggtggtatgaaaggctcactggaaatatagattttgacattgacttttgttttcttgattatttaggttctcagttggtctcaagatctgtgctaaggttattgcttaattctttagaaccgtttcaaaactacgtgggttgcatcagcatgtaaattagtatggtcaatcatgcgactgaattgatctaacgtataagcgggcatcgtaatccctccaaaaattgaattcgcttacatccagcatagcactttttgcgtaatgtatagcagacagtgaaaaatagcacgatgagatttgagggggagagttatcatgttaaacaatgtgagtttaaccggccgtctgacgaaggaaccagaagtgtttaaaactgctgctgatttggaactagtacgctttacgttagcggtggatcgggtttttaaaagtaaaaccggacaacgggaaaccgattttattgagtgcgtgatctttggcaaacgcgcactgacatttgccagctcgacaacaaaaggctcgttgatcgggattgccggccgaatcagcaataatcatttcgagaataaacaaggcgaacagcagtggcggacttcggtagtcgtcgataattttgcctggctggagtcgcgtgccatgaccgagagtcggcgtagtggttccatgcaagcgaccggaactgacggtatgccaccgggggcaccagctgaaccggcagaaattgctacggatgatttaccgttttagcagtagtaatccccggagatttatgctacaattttaattcgtgagtatccggctatttttgtagccttattactccttgctccggcaaacgatcggggcctaaagtccacaaggaggtgaatcgtcatggctgaaaccaaatatgaagtcacttacatcattcgtccggatctggatgaagctgcaaagaccgaattggttgaacgttttgacaatattttgaaggaaaatggtgccagcatcattgattccaaggattggcaaaagcgtaagctcgcatatgagatcaacaagtacaacgaaggtctctatcatatcgtgaacttgtctgcagaagatgacaaagcgatcaatgaatttgatcgtcttgccaagatcaacaatgatattctgcgtcacatgatcgtgaagcgggaagactaattgtaactttttgaaaggggcgctacggcatgcttaacagtgttgcattgacaggtcgtttaaccagagatgttgacttgcgctatacgcaaagtgggacagctgtcggttcattcactttggccgttgatcgccagttccgcagtgcaaacggcgaacgagaaaccgacttcatcaattgtgtgatctggcgtaagtcagcggagaatttcgctaactttaccaagaagggatcattggttggtgttgaaggtcacattcaaacacgtacttacgataatgcgcaaggacagaaagtttatgtgaccgaagttgtcgttgaaaactttgcgttactggaatcacgggcaaccacccaacagcggccatctgaacctgctaatccagcaggtcagggaaatcagaactatggcgggggacagcagtttggtaacaaccagccgcaaaatccgcctagctttggctctcaaggcgccccaagtaatgcaccatcatcgaatccgggacaaagcccggcagcaggtcagaaccaaggtaacaatggtaatgctgctaatcctgatccatttgccaataacggcaaaccgatcgacatttccgatgatgatctgccattctaacgtgtgacttttggtcatactatctagggtaagggatgcatgttaacccctttactcgcttggaatctttgatagagaaggaggaattctcatggcacaacaacgccgtggtggccgtcgtcgtcgtaaagtcgacttcatcgccgcaaaccacatcgaatacatcgattataaagacacgaatttgttggatcggttcatctcagaacgaggcaagattttgccacgtcgggtaaccggcaccagcgctaagaaccaacgtaagctgacgatcgcaatcaagcgagcgcggattatgggtcttctgccatttgtttcagaagactaatcaagtatttaaaaaggatgttcccgctaaaaagcaggagcatcctttttttggtgagcgcgagccggcgcgggtagggatcggagtgtaagcggccttgagcgtgatggccgggctttggccattgcgctcaaggtccttacacgcagatccctgcgccggggagcgcgttatgggcgtaaatcagaacataggtggccttgagcgtgatggccggggtttttgaccattgcgcccaaggtccttacacgcagatccctgcgctggcgaacgcgttatggaaaaatttaaattattttaactgggctaacattgcctgattgaattccggcaagtcatccggtgtccggctggtgaccaaattgtggtccacaacaaccggttcatttttgacaatcgcacctgcgtagtacaagtctggacggaccgtggtgtaggctgtcatcgtccgccccttggttaaaccagtctgaatgaagaattgtgggccgtggcagatggcgaaaaccggtttgtcatctaacaggaatgctttgacaaagttaacgaaccggtcgtcggcacggagctcatctggtgagaacccgcctggtagcagcaaaccatcaaagtcttcaggtttaacatcggtaatcgttgtgtcaatggttgccgttgcaccatgcttaccggtaatttgtttgcctgcttgtgtttcaatcaaggtcacatcatgcccctgatctttcaaagccttaactggtgaagtcagttctgcatcttcaaagttatcggtaacgagtacagcaatttttgccatcgaaatagctcctttcaagatatattactaatttagtttaacggattgaaggaattcatgcaaaatatagaaatattaatgaacatcgaacgtctggcagaacgagatgcttgttatagcgaacatgcgttattttggaaagacgttaagaacaaacgatagctaatatatcagtattcggtagcgcttcaattgaatataaaatcacaagcttatcgttatataaaaatttgatttggttctacaatgacggtgatcaggaggacaaaatgccatgatattaggattttgattatcagaggtgatcaaaatggggctcacattagcgacggttccactagcagttacgaatttatcgcggatgcagtttgcggtgaccgccatcacgcattttctgtttgtcacaacgactgtcggcatgttgctgacaaccatgatttttgaatttttatatgcttatggccgtggggatacggaaaaattcggtcggttgacgctgttctttagccgaatcttcttctttagtttcggtactggcgttgtgaccgggttgattatggaatttcagtttgggatgaattggtcggcattcacacggttgatgggcgatgtcgctggggtaccgttggcgattgaaagtatgatttcgttcttcatcgaatcaaccatcattggcttatggcggtttacttggggtaaattgccaaagcgcgcccatgcttggttaggggttggcatgttaggggcatcgctgttttcagtggtttggattattgcaattaatgccttcatgcagaatccctatggctttcacttggaaaatggccgcgcgcggttgaatagtttgattacgttgctacagaatccgcagtaccagccggaatttttgcatgttttatttgccattctgatcaccggcggctttgtcacagcaggcgtttctgcttggcagattctgcataaacgggatacagcggcgtttaaaattgccgtgcagatcgggttgctcatcgcgttgccagctgcctttttacaaccggctcaaggcgatgatcaaggagccgccacggcagcgctgcaacccatgaagtttacggcgattgaagggcgctacaacacggaaggcagcgccacaaccggagcgccatgggcaatggcagctttgatcaatgaaaaggatcggacggttaaggcagtttctattccgaatttaggcacttattttgggaagaatacttttaccggagctatgcctgggatgaacgtggttgctaagatgtaccacgcgaagttcgataagacagttgctaaatcctacgacgggcagatgaattattatccgccagttaccttgctgttttggacgatgcatctcatggtttatgcgggctatttcttcacgatgtttgctctttttgccacggttatgttgcatcggcgcaagtctagcattgaagctcaccctaagacgttgcgtgctttggggtggacattatggcttccgtacctgacgtttacttctggctggattgtggctgaagttggccgttatccgttcgtggtttatggtttgttgacgcaatacgatgcggtttcaccaagtctcacggttactgaagcggcaacgagtctagccatgtttttcgttgcggatgtgttcctggttagcaccatgatttatatttcgcatcgtacggtaacgcgcggactgccggagattgacggtaattatctggaagaacaccaaattccggatccatttgccaaggaggcgttcagtcatgcctagtctttcgaatttacaagtcatttttcttgggattattgccactgagctgatgttgttctttgtacttgatggcgctgacttcggggccggaatggcgaccttctttgtgggcgatgatttagcaaagcgtcaacaaatcatgaaggtaaccggtccggtctggggtggtaacgaaacttgggcagtcactgcctttgccgtgatgtttgcggcgtatccgggctggtattcggcattaacatccggctattacccgctcatcttcctcatgttgttctttttaatctttcgtggggtggcgtttgattatcgcaatcaatggcacagtcgccactacaatcagttttgggactgggcactgtttgttggcagtttgatgccgccgtttttactcgggatcgtgtttagctcgacagtcagcggcgtaccgattcgtaatggcttcgtctatgccgggatgggcgatattctgaccccgttcagcctattgggcggtattttagccgtcttgttaagcttgaatgtcggtttgacccgcgtgattaaaaaagtcaaaaaagacgttgcggttcagttgacggtggccttgaaacgcacgacctgggcactttatctggcggttggtgggtttgtggtcttgttgccatttaacacccgttttttcaccaatcggccggttatcgtctcactcctgttgctattactagttgcgtttcttggtgttgaaacctgggccatcttccgccagcgacaacggcttgcgttttggttaagcgttggaacgatggccagctttatttacacgattttccttggtgtctttccaaccttaatcgttggccgcacaccggggacttcggtaacagccttaagcgccaccagcggcccggtttcgttgctgtggacggcatggttattcggtttcaccatcatcttaatggtcggactacaagcgacggcctatcatttgatcaacaaatattatcatgaaccggcatcgccaatggtttaagcgagataataccgcgttcacggcaaggaggcgcgagggatgaagaaaatttggatcaacgtattttggggtctgttggtggtcagtttttggctgtatcaagtcttctggccgttattctggaacccgattagtaagttttatggcatggtcgttttatacagcatcgcagttgttgcattaggattggcgattcgcgcaacgctgaaaggctatggacgacaaaaagtttgaatgagaatattatcgacgtcagcaaaaaaggtcgctaactaaatagcggcctttttgatagcgtcacacagcgatatgttagccgagttgatagtccttaacctgacgatgcaagtctttaaattgctggcggtaatgccaagcgacaataaggataagcgaggtgaacagcagcaatgtaatattgcttcgctcaatgccgaatgtgccaccggttagccactgagtagaggtggttggtactgacctgaagaaaaggtttgtttcagaaaagcctaataccgatgtgccaaagaggatgcctgcagagatgtgccaagttgcatgaatagcactgcaaagccaaacctttccggaaaggagcgggatttcagacatcaaaatactaaacaggaaaagattcaaatcggcgtgccaatcaggttcaaagtttacggaatcaaataagacaacaaaagaacctttatcctttacggaacgaattgataaaggttcttctttcaagaaagatgaaagggtgtagtaccttggaaaatttgatgaggatttcccattatttgtactcgtttaccccttgtagcaacttgctcagggaaatagttcgtcccgtacaataaatctaccccattctgcttgtttttggtgaaagtttatttaaacgtcgcgaattcggcgataatcgttaaaatttcgcccggaatgacgtttaatggccgtttcacgacgtttatctgttagctattgacaaaagctgataaccattcgtatcatttggcaagcgtatttgatgccaagcgtgggcgctgatagatgcttgcagttgttgcggtgaaacatctgccggtaccctccaaatacgaaccaagcccatcaaccgattggaatattgacgtccgctagatagccgaatccatacatgataactacctggaagcagagcagaacaagcgcggaaagtaccagactgagacgttgccaaacatgagtggttgggaaaagctgtcgaatgaggatcaatattatgacgtcattcttgttccgaagagtacaaatataattattataataattttggatatttttcagaaaatattcatttgtgacagaggttgaatgtgtataagaagattcggcaattgtaataggatgtcagttgcaatgatagctcttgtttgctatcaattgccaatgtaaaaaaacagcgataatccctgtaacgacaaggatagaaaaatcttcagaggccttgtcttgatattaattctttttttaactattttgaatggtagatttatttaatgactgaatagttttttgaaattaatgaaatagacaaaggagcgctaatttgtgaaacatcaagaaagttcccttatcagaagaagcttttatatgctcgtattatatttgttgagtccatcgcccctactttttttgctgatcatgccttacacaaataatgtagtatcatcgctttcgctggcatttgcgtgtgttacgtcgagtgtcgtagtaatatatatggcctataaattatttcataaatacaccaatcaaaaaattattcagcgtgttaaactgagagatattttttacgtgattggtggctatctgaccattttaattagcaatgaaatcctgtcaaccttgaattatacgatttatcagcgtgtacaaacgtcaaataatcaggtcattgaatcatctctgttaagtcacaaccaacttatggttattcttcttgctattaacgtgattgtattgggaccaatcacggaagaattggttttccgaggaatcttaatgcatttattctttaagcaaaatcagttattttttaaagtgctattgagtgctctcatatttgcttctgcacatggtggagatacgatttttggattcttgatatatgttgttaatggagcagtgtttgcagttgtctacttaaaaactgggaaaatacaagacacgatcgcccttcattttgttaataatattgttgcggtatcgactatattatttctgtaattggtaactggctatttttaaatatggggttaggatggtcgcttaagtcaatacataccaatatctgcaaagcgattcatatgtctcgaaatcttaaaattttagactttgaaagatcgctgagattcatatctttcatggcgtaaaggtcaagtgagtgaaattcgagtaaaaaaagaacaaattcattcgtgccagaataccaattgcaagacaagcacgacagcagtaagaggcattcgtccttattgtcactcctagtacgaccaattatcctagtaagaattgtcaataccagacttcttactggatcgataaattctttgaaaagcgagatggcctacatacacgtaaataagggactgaacacagagcagtaagaaagtgtttattgaaacgctgtgctggttgattaattgctttgagagatcgatcccaagggtaatcggcaacattcttccagaaatctgaacaaactcaggtaattgcgttaatgggaaaattgaacctgttaaaaataataggagatacgaaataaccgactgaaaagaggcggtttttgtatacttcagtgttaaagcggcgagcagtaaggagaagccaaaaattccaatgcaagtaatgaaaaagatcggtagtagtccgatgtgaaatcctatgttcaagtgaaatatcaaggcaataaatgcaagaacgatgaaaactttaatgaaattaatgatgatccaaacagttgtttttacagtgagaactaattcgagtccggctggtcttagcaagagctggtctaatgtgcccatttgttttctaaagaaatactttcagaggcttcaccgataatcgaactaattagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttcttacttggttaagtcctcgaccgattagtactggtccgctccatgcatcgctgcacttccacttccagcctatctacctgatcatctttcaggggtcttacttccatataggaatgggaaatctcatctcgaggggggcttcacacttagatgctttcagcgtttatcccttccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttctacctttacactctgcgaatgatttccaaccattctgagggaacctttgggcgcctccgttacattttaggaggcgaccgccccagtcaaactgcctacctgacactgtctcccgccacgatcagtggcgcgggttagagtgttcatacagctagggtagtatcccaccaatgcctccatcgaaactagcgttccgatctctacggctcctacctatcctgtacaagcggtaccaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactttaatttcgctccccatcacagcttgtccttaaggcggcaagcatttcactcgctaccggacttactgcttggacgcacttttccagccgtgcgctttccttagcctcctgcgtccctccatcgcttaaacaaaataaactagtgcaggaatctcaacctgcttgtcatcgactacgccttgcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcaccctgacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgacgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctacctactgaagcgccctgttcagactcgctttcgctccggctccgacttttcatcttaacctcgcaggcaaacgtaactcgccggttcattctacaaaaggcacgccattacccgttaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagagtccgccgtttcgtttacagggctttcaccttctatggcgcagctttccagctgacttcgactacgtcgaactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccaacaagctatgtattcacttgcaggcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttacgtcagcggttatgcgatgcgaatttctattattagaaactcatacaaatacgctgtgttctcggcaatttaaaacatttacaacaatgatatccagttttcaaagaacaaagaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggtaatcccctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcacttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcattgccttggtgagccgttacctcaccaactagctaatacgccgcgggtccatccaaaagcgatagcttacgccatctttcagccaagaaccatgcggttcttggatttatgcggtattagcatctgtttccaaatgttatcccccacttaagggcaggttacccacgtgttactcacccgtccgccactcgttcaaaattaaatcaagatgcaagcacctttcaataatcagaactcgttcgacttgcatgtattaggcacgccgccagcgttcatcctgagccaggatcaaactctcatataaatatgagctgttcgaatagctcgatttgttgttctagcgaattgacttcgcaaatgttactttttgcctcgataccgaagtatcaaggaccctgcacatttaaacgaaactttgttcagttttcaaaggactacaccgatgcatggcgtaacagcctagaccactatcaagaattcgttatcatcgttgcacttgacttgaaaattgagggactaaatgtttcatcaacatcgcaaagaaaccggaaaggtgcagccagcccatgatattggcaacaccatattttgaacccaagctgaccataaatccggaatagttggctttatattcaacctgttccttattttccaacttggcttcaatgttcgtcaacgcggtgtgggcagttgcctcagcgccttgaacgatttgcggctggcccttgccggtgccgtcttgatcaactaacgatacatcgccgacaacatagatgcttggatcgtcttgcgattccatgttgtttttgactaagattcggccggcacgtccttgtttcaagccgaaatctttcgcttggtcagttgctttaaccccggccgtccagactaaggtacatgttgggaacgtggagccgtcttttagatcaacgtgatctgcgtgaacgccgacaacgccggtattcttcatgaccttgatgccgcgtttttccatgtaacgttcggctttgttcgcgtctgaacgatctagcatattcatgatcgttggcgccatttccatcaagctaaattgaatttcgttcggatctagcttgtactgtttggctaaggtatcgcgccagtcacgtaattcaccaatcgtttcggtaccagtgaagccagaaccgacaatgacgatagacaaaagggctttgcgtttagccggatcgtgctcttcggaaccgcgccgaacaacgtcttcaatgtggcgctttagccgaatcgcgtcttcccacttacccaaggtgaaaccgtgttcggcaacgccaggcgtcccaaagtcgttcggttgtgatccaattcccaagatcacataatcataagggaagcgtccgttttcagtgacaacttccttcttgtcgcggtcaatcccagtcacattatcggtgaccagcttgacattcttacgtcgattgaacaaccgctgtaaatcgtattggattgcgtcttctgggacacgatccgcggcgatttcgtgcagttcggtgacataagtgaagtacgagtggcgatcgatcagcgtgatcgtcacgtctttgttacgtttgtagtgcttggccaggtgctttgtcgcatagaccccggcaaaccccgcgccaaccacgacgatattggttttcgccatgcataacactccttaccatttgctttacccatactcttacaaagtatgtatctaagccattatagcctttaaaattacgtaatgtctaacgttcgcgctctctttttctaaagccgtacatttttgtgtaaaatgacacaaaaatacgcttcgtaaaggacgattaaaaaatgagaaagcgcttataatacccgtgtttggttgatttttttgatttgactagctaaactaaatatgtgattgaaaacacaatatcgcagttatgaactgcaaaaggggtaaatgtcatgaagttaagtaaagttgtgacggggacagccgttgttgcactgtccactttggttttaagtgcatgcagcagtagttcaagcagcaaaaattcatccagcagcaaggcttccagcagtaaagtggtcaagaagtcatcaacccaaaagcaggttgcaggtggcccgttgaaggatggtacttacaagctgaatgaaaccggctatgaccatggctataaggttgaaatggcgatgacggtcaaagacgggaagattacttctactaagtatgattacgttgataagaatggcaaatccaagaccaaagacgccagctatgaaaaggccatgaaggctaaggtcaaggttggaccaaaggaatacattcctgaattaaacaagtcctttaagaagaatggaaccaatgtcggcgctatcgatgttatttccggtgcgaccgattccagtatgacctttaagaattacgcccaacaattagttcaggcggctcaggctggggacaccaagccaattgaagtcaataacactggcaagatgaaagatggtacttacacgcttgaagaaaagaactacttcaacggctatcgggtaaccttctccatcacggttaaagacggtaagattaccgaaagcaactacgacaacgtcaataaagacggtaagtccaagactcaggatacgaaatacgaagctaacatgaagaaagtgaacaaggttggcccgaaggaatacatcccagaactgaacaagtcactggttgctaagcagtcaccagccaaggttgatgtggtttccggtgcaacccacagttccgataccttcatcttgtatgctgatcagttagttaacgctgctcaaaatggtaataccaacaagatcgaagtcgacaatattgtttacaagtaatggcgtgatcttgaaaagaagttaatgtgcgttattagcgcgggttaactaagcaagaacttgtttggaataatttttctgagcgagttcttttcttatgctcataatgcccggtataatggtgctgtaaccgttttagtcagtaaacgatgtggcacttggctagtgtgtcggcttgctttcggttcaagatgctcaccggtgcataaagcgttcgccagcgcagagatctgcgtgtaagggccttggacgcaatggccaaagcccggccatcacgtccaaggccacttacactccgatctctaagcgcgctggctcacgctcagctcactataacgcgctccccggcgcagaaacctgcacataaggaccttggacgcaatgaccaaagcccggtcatcacgtccaaggccacttatgctccggtttctaagcgcgccggctcgcgctcacactttttggaggtgattaacagcagacaaatatatgtaacaatgtagcgtaacatggtatgttatgagcacgataattaagtggaagatgctcatatgctcagaccaaacgaaatggctaaatgtctcggtgcaactgcaacagtgggataagtctggaaagctcaaagctcgcagaacaccacctaattgatgttattataccgagcatcaatacttggcttatatcggtcatgctgatgaattaaagaaacatcgacgagttgcgtgcgttttggctatgattggtttgagcgccaaaccccaaagattcaaccacacagcttgtggggttgaatcatcctggtctatcacctcagggagagctaactgaagacttaattagtatgattcacgtattttcgcgtcggttatccggcttacgtcaatacaaggaaagcttgaagacgatccatttttgaagtaagtcctttagttaacttgaagggaggtgaacacttttgattaaaacgcataagatcaaactttatcccaatgcaacgatgcgtaaagaattagaaaaattgtttgattatcgccgtttcgtttggaaccaagggctggaaatctggaatgacatgtatgacgcctctttagtcatgatggataagtcgatacggcctaatgagcgaaaagttcgtgatgaactggttgcgaacaaagcagattggcagtttgaacgatcggcgcgcgttttacagcttgccgtgaatgatttaagtaaggcgtgggcaaactatttgaatcctaaaatgcccaaccatgacaagcctaagtggaagtcgaaaaagcgctcacgtaaaacttttagaacggatcgtgcccagatagttaatggcaagctccgtttggatcaccatccttttagccgcatgcggccagtcagcaaaagcagcaaccaaccggcgaacgctcaacgttgcagtcagcacggaagccagttcacttgatccggctcatgcggttgatgcaaccagcggcgggatccttcagcagatcatgacgccgctttatgatcacgatcaatccggcaaaatcattccggcaatggccacaaaggttgttaagccaaccaacaatggcaagacctacacgctgacgttacggcgcgatgtcaaatggagcgatgggacgcctgtgaccgccaaggattttgtctactcactcaaacgcattgttgatcccaagactaaaaccgaattcgcgtatcaatacgatgcgatcgcgaattatcaggatattgtcgctggaaaaaagtcgccggatactttgggcgtttccgcacctagtaagtacgtactcaagattcagttgagccagccaacgccttatttttccagtcagatgaccggttattatccaaccaatgaagctgccgttaagcgttacggcaagaagtttggcacggctgccgacaaaattgtgaccaatggcgcttataaaattaagcattttaatacgaccagtgacagctgggattatgtcaaagacccgaacttctatgcggctaagtcggtgaaaatcaatcatgtacacgtcaatgttttgaaagattccagtaccgttgataatcttttcgctacaggcaagctggatgatgcaccgttatcaggcaacttgatccaaaaagaagcggacaatccggcattgagcaaaacgccggctgcgaatatgaattacctgcagctcaacaccaagaatccgcaactgaacaacgtcaacttacggcgtgccatttccgccgccttggatcgccaagctctcaccagcaaagttttgcaagatggttcgcaaccggctaaggcatttgcctctaaaggattggcaaccaatccgacgacaggtaaagatttcaccagcgatgccaaaacaccgttaacctattcaccgacgaaggcaaaggcctatctcaaagcagctttgaaggagcttcataccgacagcatcagctttacgattctcacttccgatgttggtaccgataaacaagtgggcgaatatttacaaagtcagctcaccaaagtcctgccgcaacttaaagttaccgtgaatagcttaccgaaaatgacgcggattcagcgatcattgaatggcaaattcgatgctgtcttgatgagctggaattcaacgattcaagacccctcagattatctaaacaccgccactgctgataatatttcaaacttttcgaaatttagcgatcacgagtatacagctttaatgaataaagtgaatgataccaacggccaaagcgcaaccgcacgctatcaacaagaacttgctgccaatgcccgggtaattgacgtggccggttacattcctgtttatcaaagtgccaacagccgcctgattaacacgaaagttggcggcttgcattacagcatgttgcaaccggctgaatatcgctatgcatacttcaaataaattaaccagaaagcaggtgtcacgatgacgcttcccatgcaagactttttaacgcaatatcttcgactgcagtccgtttcactggcggctgaaaatcagattcccgaaaccgcagcctttttaaagcaacaatttactgacctaggtgccaccaccagccgaattctacggacggatggtgccaatccggcagtgtatgcagtgtttcccggccaaacagcggaggccccgatattactcttctataatcactacgatgtccagccggccgagccgctgcagctttggaaaagtgacccgtttgaattgaaaataaccgctactcatctctatgcacgcggcatcaatgatgataaaggtgaattagcagcgcgactggcagcgattgcccggttgcaagcacaaggcgggttgccatgtacgattaagtttctggttgaaggcggagaagagcaaggcagtccccatcttgatgacctgctgactcagtatgccgatctgcttgcttctgatttttgcttgtgggaatcaggtggacgaaatgagcaaggtaaatttcaaatctctttgggcgtcaaaggcggtgttgcttttcagatgagtgtcaagaccgctgatttcgatcttcattccagtttcggcgcggtgacagagaatccggcatggcggctagttcaggcactggcaaccttgaaaaatgctcaggatgagatcaccattccgcattttcttgatgcgatcaaacctttaacggcgacccaaaagcaactcattaaccaagctgactttgattatgcagcctttgccaagaattatgggatcacccgtccggctacggtggcagacgatcagatcaaagaagctctgtataatcgccctagcttgaccattaacggactttcaagcggttatgaaggcccaggcattggcaaaacgattctaccgcatacagctttggccaagattgatctgcggctggttccggaccagacgccagctgagacggtgcgactggtcaaagccgcactcatagcaggcggttacccggatattgaggtctcggactttctcggcgaaccgccatttcgcaccgatcctgacgacccacgcgtgcaaacagcgctagcattggcgcgtgacacttatggagatgatgatgtccaagttgagttaaactcccctggcagcgggccaatgaagtatttttatgatgtcaatcatgcgccgattatttcctgtggcatcggtaatgctaactcgaccgcgcatggcccaaacgaaaatgttgccattgcggattacttaggatttatcgattatctaacgcaactggtgaccgaactagcagcttagtgacgttctgcatgctgtccgtcataggtcatagcagaaatggcagacaagtgatccaaccctgtgatcaggataacgaaaaaagccgggtatcggcgcggtgacaatttggtcgcgctggtacccggctttttgattttgatacgattttatggcaattggcctgaggagctagccgaactggcggctgagttgcttggcacgctttgactttgttcagattcactattagaagctgatgaagatgtcgattcctgactgctggtggatgctgacggtgtgctacttgtgcttgtctgcgatgcggaacttgattcgcctgatgttgatgattcagatgaactggcttcactcgttgtctgatcatcagttgctgcttgctgggcggtggaatcccgccgtaactcgagaaaaaccacgtggctcccccgtcatcgcaagatgaagccctttcccgctacagcgcctcaggagaagtcccacgttaggaattggaggtcgaaagggcacttggcacccttgatgcgacccacaaagttccccgacatcccggtctccctcaagaggaaccccgaggttttccggcaccccctcctctgagccctttctcccctcctgatctggacaggagggtcgactcccctgctttgtctggaaggggttcccgaccttccggtcgcacctcaggatgaggccggtctcacgaagacattccagacgtggcctcgtgggtggttccacattccgtaggaccccgatttcccggtcccctcttgataagaacccgatgcccggacacctctccgaactccagcctgtgaatgcagtcaacacgaaggggcagtttttccgtgcatcgttcggaaaaaaccccaggttccaaatacagctcgacaagcggcctctctccccggggacacctcgagaggcaagcggagttccatgcctcaacccaagacgaggcctgactctcctgtccccagtctgcagggaccctgcgatcggagtctgaaatcagaggtaccctgcggttcctgcctcaactggagatgaggccctcttccaatgcaccaagcccagtggagtcccgagaggcccctcccacctccagtttccctggcttctcagagccaccatgagaagccccctgaggtcacctgcacaagtcgagggaacccagggtttcctgcctcaacccgggaaagacctcgagagaccttcttcaacacgtctcgaggccagattcccctaccatggctcgggagcaatgacgcgctccccctcgccactcgcatggagacccgacttccctggcgccccacgagaggctcactgacctcgccgtcgtacctcgtgagaaaccgcacactggggccgccgctcgagaacagccccgagattcccccgtcatcgggagatgagggccttcgtctcctgcatggcctagagaccaatctcgcgacctctctccaaacgcctcaggaggcttgactcccttgagtccacccagtgagctccaagagatacccgtcgcgactcgagagcagagcggggttctttgcttccactcgagatgaatgcctgtctccccgggtgcgtctggaatgcaaccccgagatccctgtcgcccctggagaggaacattggcttctggacacaagcctagatgaggtctattggccctgcagtcactcgagagcaatccccagctttccttcgcaactcgaatggaagattggacttgcctgggccaacacaagaggcagcctgaattccccgtcgtaactcgagaatcccgccgtaactcgagaaaaaccacgtggctcccccgtcatcgcaagatgaagccctttcccgctacagcgccaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccgcgacggttttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcctgaagctgtttgcggcgttccttgttttgacgccgcggtttcctcgaaaaagcggtccacttaccttttgcttcacgtctgtacgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgtgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaactggatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgatagttgcgttgctttttgacgataaaccatgatcaattcctccgataggtcagcgataagtgcaagggtaaatcccaaagcataggcatttcgggcaaataaggcttacacttattatacacttaactattgtcaaagcctatcatgaaagtacttttatagtttttcaccatccactatttttttttcaagcagaagacggcatacgagatgcgcgagagtgactggagttcagacgtgtgctcttccgatctcaaactaaaatcttacttttattttcttttgccctctctgtcgctctgccttaactacgtatttctcgccgagaaaaacttcaatttaagctattctccaaaaatcttagcgtatatttttttcttttttttttccaaagtgacaggtgccccgggtaacccagttcctcacttttttttactgcggaagcggaagcggaaaatacggaagcggaaaatacggaagcggaaaatacggaagcggaaaatacggaaacgcgcgggaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataatggtaactattctatgttttcttactcctatgtctattcatctttcatctgactacctaatactatgcaaaaatgtaaaattatcacacaaaacataaacaatcaaaatcagccatttccgcaccttttcctctgtccactttcaaccgtccctccaaatgtaaaatggcctatcggaatacattttctacatcctaactactataaaacaacctttagacttacgtttgctactctcatggtctcaatactgccgccgaaattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctctcatatcctattgctattagatgaaatataataaaaattgtcctccacccataacacctctcactcccacctactgaacatgtctggaccctgccctcatatcacctgcgtttccgttaaactatcggttcaccaccaaaaatcaaggcgccagactgatcaaagagaaaaaatcctgatttagtgatgtaaaaatccaactccggcaaaataaaacctccacattgcccccaaaaaaacacttctgtccttgctgcaattttccatccataaacaccggctttggccatttaggcttgaggtccttacacgcagattgctgcgactgcgagcgcgttatagaaagcagaataaaaccaccgaattgcccaaaaaagaatacttctgtccctgctgcaatgtttcatccataagaaacaccaaaaagaaaagcctcccgacaccatcgtcaggaagcctttcttttttaccacaaactcacaccttaccgcttaaacaattcatacaacgcatccggcgtcttcgcatcctgaaacgccttcacaaaatcctcatgcgtcagtaacttcgccgtactcgacagatatttcaagtgactgccactatcatgttccggaatcaggaacgaaatcaccgcattaaccggcttcccatcaaatgttttccattcgactggctgagccaaatgcaacacgagcatcgctgaacgtttaatcgttgcgtcttgtgcgtgcgggatggcgatgcctttttccatccccgttgagccttctttttcacgcgccacatacttgttgaacacggcatcggcatcagttgccaagtcgttttttactgccatattagccaaataatgcagcacatcatcccgcgttttggcaggaacattgacttcaatgtattctttgttcaaaatctcgctagggtcaaaagtttgctgggattgatccgcatctggagccggttgattgcgagctgatgaaacggccacgtgcgcaaccggtacgtcatctgctgccccttccgttgccaacgcagcttcaaccacgccgcttttgacgccgcgctttttggcagagtggccggcaatcatggccaaaagcacacctgatgctgctgcaccgactaaaatccaggcaacccatagaaccggcttattcaccagtggcaaaacaatgaatccaccatgaggcgccggaacctgaatccgggacatatacgttaaaacggcagcaatcgcggagccaaccatgaacgccggaatattcattaacggatttttc
